United States Patent 10,597,667 (STRESS TOLERANCE IN PLANTS) - sequence listing, part 4

SEQ ID NO: 9413 - DNA, 1028 bp, Triticum aestivum
  misc_feature (794)..(794): n is a, c, g, or t
  misc_feature (815)..(815): n is a, c, g, or t
  misc_feature (871)..(871): n is a, c, g, or t
  Predicted polypeptide sequence is orthologous to G470
ggatccggcgacccacgcgtccgcagaaggcagtgatttcaagctctttgggtttaaagttgatcctgccagtgctggttttaaccatttgaactccccaatggctggaacgcatgagcctgtgctacaaactcaaccatctgtatcattagatcatttgcaaactgattgttctcctgaggtgtccttaagcattgctgggacgactgagaatgagaaaaacatgcagcaatgtccgcagagttcaaaagacgtccaaagcaagtcccatggtgcttccacaaggagttgcacaaaggttcataagcaaggtgttgcacttggtagatcagtggatctctcaaagttcgttgactatgatgaactcacagctgagctagacaagatgtttgaatttgatggtgaactgttgtcctcaaacaaaaattggcagatcgtttatactgacaacgagggtgacatgatgctcgtgggagacgatccatgggaggagttctgcagcatagtgcgcaagatatgcatttacaccaaggaggaggtccagaagatgaactcgaaaccatctggcccaaaaaaggaggaaggttcagtggatggtgacggcgcaaccgagaaggcccatcttcccgcatcaagcgatttaaattctagccaactaggttgtgtcaaggccgactgaggcgaggtatcgcggggggctaggtcccagcaaagaagtaacaacccctgaaagtatggtctatcgctattgctattgttgatcaccaccaactcccccactccccttctgatgncacaaccctttggctgtactngtagtactagtaggaaatgtagagactttggtgcgcaatcgcgcttgtcggctggnttgttcttcggcagagagagagatccagggccaggctgtccctttgcttggatgctcatggttgatccgatccatccctgatgtaaatattatgtatgtagggtgcgttagtatgtaatctggctgtattaccatccatgaaccacaattgttttta

SEQ ID NO: 9414 - DNA, 1409 bp, Triticum aestivum
  Predicted polypeptide sequence is orthologous to G483
gcacgagccgaggccagcgctgccggcgccgcagcagcgggcggtggacgggttctggagggagcggcaggaggagatggaggcgacggcggacttcaacgaccgcatactgcccatggcccgcctcaagaggctcatccgcgccgaggaggacggcatgatgatcgccgccgacacgccggcgtacctggccaagctctgcgagctcttcgtgcaggagctcgccgtgcgcgcctgggcgtgcgcccaatcccaccaccgccgcatcatactggaatcggacatcgccgaggccatcgccttcacccagtcgtacgacttcctcgccaccgtgctcctcgagcaccaacgggaggcgcggctggccggccgtgctgctatcccgacaacggttccggtgacggcggcgagggcaaggctcatcaccaggaagcgccacatgccggacccgaatcctccacggccggtgcatggggtgcggagaattcgtcctcgtgcgcttcctatcccgccgccgtcggactttcgctacgtgccggttccatttccgttcacctcggcgccgataggagccgcagcgatggcggaggggctgatgattctcccacccatcaaccacgcgactaccgagcgcgtgttcttcctggacaggaacagcggcactgacttcgcaggtgaaaactctgctgctgaaactatagcatctccgcctcctccggcagggcctgcaggagcagtggcgctgcccactgtccatcctgctgcttactacttgtgcgcttacccggtgaccaacgacgttgaggcctttgccgttggcaacactgatcctgatgtcatcccaccggagattgtagtgggagacgtcgccatcccaccggagattatagagggaaacgtcgccgatggcaacggcgacggcggacagcagcagcagcagagcgaaaaccttggtggtaatggtgagagtgtggtggtgtcgcaaagcaatggtgtgcaggaagatggtgcagatgggatgtttctgaaggagatcctcatggatgaagacctgatgtttcccgacgctgagctttttccgttggtgggcgctgcacctggtccagaggatttcatcgtcgaccaagatgttctcgacgacgtcttcgccaacccgagcagcagcgcaagcagcgactgaaccgaaagaagatcagagcgggacgcagcatcggttgattcatctatcgtctctcgacctgctactctatgctagccgctatatcggttaataaatttgggaataagtttgtgttcgtgcgtgtgacatggactgtatggttcgccctgaatttatcgtattgcaatatatagccgtgattgtgtgtaaaaaaaaaaaaaaaaaaaaaaaaaaaaaaaaaaaaaaaaaa

SEQ ID NO: 9415 - DNA, 871 bp, Triticum aestivum
  misc_feature (667)..(667): n is a, c, g, or t
  Predicted polypeptide sequence is orthologous to G483
aacagctacttgcatgattacgccacgctatttatagtgactactatagaatactcaagctatgcatccaacgcgtcgggagctctcccatatggtcgacctgcaggcggccgcactagtgattagcgtggtcgcggccgaggtttagaatattggattagatagaaactagggcgaaaacgaaggtactgtttactagatcagtctcaaatcacctaacaaatcacaatctttttttcctaccgctggtgccataccagcgtcgaagctaccattaggaaccccccctaagacctaatcatgagtaactgttccgggcaacgatgatggaaataaattaacacaagcctgagtttataggcatcaagttcaggatcatgtcatggcttcattgtatcaatctcttggctagtctgagggagactgctgctactcttcaggggcctcctcggcctgttgcccttgaggctgctgccacgcatatgccactgggtgaccctgctggccaccatacatcattcctactcccggtacctgttgtgcttgcacatagtaataaggaggatatgcatcagccggtgcccctagagcagcaggtggcaagcccaccctcggaagcccaagggcttcctccttcatgtcatcccctgggaatgatgtccaccangaagtcgtagatgtcagtccctggtatggcagctgcaatgtcattcttctgcaaggtccggccgcttgtctcctcagtgtgcatccatgacctgagtgtcactctaaggataacacctcgcatgcctttgcaaagacacaggagctctggcgagatcatccggacatctcgtcaggctcattatctttttatcctgccagtggt

SEQ ID NO: 9416 - DNA, 812 bp, Triticum aestivum
  Predicted polypeptide sequence is orthologous to G483
gcggccgctctagaactagtggatcccccgggctgcaggaattcggcacgagggcccaacaaagtaccgacgccggcgcgcatcgagatctggcatttctctgaatccttcgccccccaaagcttctccccagacccagcagctacgatggaaggacaagtcgtggagatgaccgaggccgagcaggccgcccaccaggcgcagctcgagcagcagctcaagtcgttctgggcgaagcagctcgttgagatggagcagttggaggtcggaagcgagcaggacttcaagaaccacaacgacctgccgctcgcacgtatcaagcgcatcatgaagtcggacgaggacgtgcgcatgatcagtgccgaggcacctgtgcttttcgccaaggcctgtgagatgttcatcctcgagctgacgctccgctcgtggagctactcggagcgcaacaagcgccgaacgctccagaaggaagacatccaggcggcgatccggaacaccgacatcttcgactttctcgtcgacgtcatcaactaaaacgcgcgacatcaaccagcaggcgcccgacccgagtctcctccgaacttctcacatagctacacaaacaccggtagagtagattgcgcatcggcttcccttgtttcatatacatacccccatgttccccaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccc

SEQ ID NO: 9417 - DNA, 1463 bp, Triticum aestivum
  Predicted polypeptide sequence is orthologous to G484, G2631
gcacgagcctaaccctagctaagaatcccctcccgcaaccaggtcgtgtctcagggcgcatcgccgaaggccaagccctccctcccctagcagcgggccgcccgttcccggcgggacgcgccggcgccggcgcccccaggctcaagctccgtcgcgctttcgacggcgagggatggatccgatggacatcgtgggcaagtccaaggaggacgtctccctccccaaatcaacaatgaccaagattattaaggagatgctaccgcctgatgttcgagtagcaagagatacacaggatcttcttgttgaatgctgtgtagagttcatcaatcttctttcttcggaatccaatgacgtgtgcagccgggacgacaagaaaactattgcccctgaacatgttattagggctttgcaggatcttggcttcaaggagtatgttgaagaagtttatgcagcctacgaacagcacaagcttgaaaccctggactctccaaaagcaaccaagttcactggcatagagatgacagaagaagaagctgttgctgaacagcagagaatgtttgctgaagcccgagcaaggatgaacaatggagctgccaaaccaaaggagcctgcattagaaccacagaatcaaccccaacagcccccacaacctcatctgcagctgcatcctcaagcacagcagcctccacaacctcaaccgcaactgcatcatcctcaatcacagcagcccctgcatcctcaactgcaaccgtatactcaggctccaccacagcagcccctgcatcctcaactgcaaccgtatactcaggctccaccacagcaacccctacaacctccactgcagctgtatcctcaggctcaacctgagcaacccctgcagcctcaatcctcaggatcaaccacaggaacctgtgtaatctcaactgccgctccatctgcaaccggcaccactgctgctgcaacctccgccccagcaatccccgcaatctcaactgcagctccatcagcaaccccagccgatgcaagtgccgctgccgccgctgccgcaacctcaaccccagccacctgaactgcagcagccccagccgctaacacaactgcaagcggaacatggcctgaactggacagttagtggttcggaacatgtagcgtcactataagttaagactctgcctcctttaaaattgtgcgttaggtttgcctgcatcttgtacaatgtaaatcgtgtgtgatttcagccaccgtgtctctaataatctgaagctctctagtaagcgatgtacttactgcgctggatactgtgtttatgactgttgtagtctcatggtattgtgtgtgacgtgtcagaagctactccattaccagtgtaatcaattgcctgacttaatgttcacccgtgatgatagtaattgatttcagtgtgctaaaaaaaaaaaaaaaaaaaaaaaaaaaaaaaaaaaaaa

SEQ ID NO: 9418 - DNA, 1070 bp, Triticum aestivum
  misc_feature (21)..(21): n is a, c, g, or t
  Predicted polypeptide sequence is orthologous to G486
gcgttccgcaacgcacacatnaagtgtgtagtaagtaagtgacagatcgaacaatgggagggcgcggcaagaagcgtggcggtgcgaagggggctggccgtgagggcaacggggagaagccggcgtcggacgggagcagcgcgttgccgacggccaacgtcgtgcccccgacgaggcaggtgctcccgtcgaacgtcaagatcgccgagtccgcgaagcagctcacccacgactgcgcggccgagttcgttttcagccgcagggcgcgccctgctgcgcggccggcgatgacggcggccgtgtcacctggcgtgccagtattcaccgaagaggagctggagttcctccagtcggtaattcctccgccgccgggcggatattagcggtgcggcgtgcaagctcgtcagccacaggcgcaggcgctgccacctgcggggcatggctataaatgtagtgctgctttgcttgaagaaaaatcccgatgtatccaataagacaataatacattcaacctcagccctgaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaggtgtataatgtgttaaactagctgcatatgcttgctgcttgagagttttgcttactgagtatgatttatgaaaatattatacacaggagctagtgattctaattggttgtgtattttagaatcacagtcccaagcctcatttcaggcccctcagtcctcacagtctggtcaggatccatatcagccataccacattggtaagaggtttacttgctttaaaaacctcccaacctccccctgaacctgaaacataaaaggatgcattggttgtgttaacctgttaattgca

SEQ ID NO: 9419 - DNA, 1177 bp, Triticum aestivum
  misc_feature (805)..(805): n is a, c, g, or t
  misc_feature (852)..(852): n is a, c, g, or t
  misc_feature (878)..(878): n is a, c, g, or t
  Predicted polypeptide sequence is orthologous to G502, G519
cgtaagaccgcgagtggccgccctttttttttttttttaaactattattcagtttcatttgatgaatggcttacactaccatcggactataggtatcaacttatcaataaacccttgcaactaaccaatcaagagacagcaacccctgcaccgaaccaatcatgttctccatgtatgtacacccatccatatacacacacacatgcatgcatgcatgcttgctagcgcacgaccgcccgcccgatatgatgcaatgcggcgaacgctttgaagcatctttggcgcacgtcatgtcatgctggtgagagcccggggacccacggtgtcatcgccgccaccttccaatcttcgtcgtcatcaagcacctgattttgtcttatctcccgtctaatatcttcttaaattatctccccttcatcaggtcaacaatggcggctcgcccgtttcatcgcccaaacgccaaggataggaggtactcgcttcaatcgaccgatcggtttctttgctgcctagaacggcttgccccagtacatgaggatgtcctggaggagcgggtcgccgccgaagccgccgttgggctcgagcatggagccggccgccgggttcacggggtcgccgccggaggcgaacgagcgctcccactcgctgatcttgggctggctctgcacctccccggccgggaactccggcgacagcacctgctccgagcagctcgagtcggcgtgcagccgcggcatcgagtcggacgggcggtcgtagtacgccgcgaagtccgggaacggctgcacgccgccgccgccgccgntggcgttcatcccatgacgggcttctgctcctgcggggagctcacangggcccagggccacccccgtagccgnccatgggccgcggcttccggtcacggacgccggctctcatgccgcccttctggtgtaatgcggacagaacccatcatccacctgaagctgtcttctgcgggcggagcgtccacctcggcaaggggtatcgtgcatgatcattggcctctccccctgggggcctgccaggtaaaaaaagccctcttaatgccacggttgggggtgccagggtttttggccggtggcttccataacggaccggggccggttggcctgaccctggggttttggcccccggggaaaaaaacacctttccccga

SEQ ID NO: 9420 - DNA, 1140 bp, Triticum aestivum
  misc_feature (878)..(878): n is a, c, g, or t
  misc_feature (913)..(914): n is a, c, g, or t
  misc_feature (944)..(944): n is a, c, g, or t
  misc_feature (953)..(953): n is a, c, g, or t
  misc_feature (1105)..(1107): n is a, c, g, or t
  misc_feature (1109)..(1115): n is a, c, g, or t
  misc_feature (1117)..(1117): n is a, c, g, or t
  misc_feature (1119)..(1120): n is a, c, g, or t
  misc_feature (1122)..(1123): n is a, c, g, or t
  misc_feature (1125)..(1126): n is a, c, g, or t
  misc_feature (1131)..(1131): n is a, c, g, or t
  Predicted polypeptide sequence is orthologous to G502, G519
gactaccgcccacgcgtccgcatccgacacagtccaccacgcacgcgcagcagcagtagcagcgcccgggaatctcatcggcagagaagcagcaagaagaagcaatggtgatggcggcggaggggcggcggggggacgcggaggcggagctgaacctgccgccggggttccggttccacccgacggacgaggagctggtggcggactacctctgcgcgcgcgcggccgggcgcgcgccgccggtgcccatcatcgccgagctcgacctctaccggttcgacccgtgggagctcccggagcgggcgctcttcggggcgcgggagtggtacttcttcacgccgcgggaccgcaagtaccccaacggctcccgccccagccgggccgccgggggcggctactggaaggccaccggcgccgacaggcccgtggcgcgcgcgggcaggaccctcgggatcaagaaggcgctcgtcttctaccacggcaggccggcggcgggggtcaagacggactggatcatgcacgagtaccgcctcgccggcgccgccgccaagagggacggcgcctcgctcaggctcgacgactgggtgctctgccgcctctacaacaagaagaatcagtgggagaagatgcagcggcagcggcaggaggaggaggaggcggcggccaaggctgcggcgtcacagtcgacctcgtggggtgagacgcggacgccggagtccgatgtcgacaacggtccgttcccggagctggactcgctgccggagttccagggaatggggacgacaaacgcggcgatactgccaaaggaggaggtgcgggagctgggcaacgacgactggctcatggggatcagcctcgacgatcttcagggcccgggntccctgatgctgccctgggacgactcctacgccgnnctcgtcctgtcggcggttggcgtgatgaanatggagcangacgtcagcccattcttctcctgaagcatcactctctcaagtaccattgtgtctgggagtactgtagtctgtaatattcaattgggtcaggattagtttatccggattattggtataataatgctttaaggatcctggcagcggcctggttnnnannnnnnncncnnannannaacanaccccccaa

SEQ ID NO: 9421 - DNA, 1089 bp, Triticum aestivum
  Predicted polypeptide sequence is orthologous to G502, G519
cacgcgttccgcgcccaccacaatctcaacagccatcggaatcaacagcagcagcggagcgatttcatcgactaacaaatcagcggacatggggatgccggcggtgaggaggagggagagggacgcggaggcggagctcaacctgccccccggcttccgcttccaccccaccgacgacaagctggtggagcactacctgtgccgtaaggcggccgggcagagcctcccggtccccatcatcgccgatgtcgacctctaccgcttcgacccgtgggcgctccccgaccgcgccctcttcggcacccgcgagtggtacttcttcaccccgcgcgatcgcaagtaccccaacgggtcgcgccccaaccgcgctgccggcaacggctactggaaggccaccggcgccgacaagcccgtcgcgccccgcggagggcgcaccatggggatcaagaaggcgctggtgtttgatgccgggaaggcgcctaagggggttaagaccgactggatcatgcatgagtaccgcctcgacgacgccggccgcgccgccgtcagcaagaagggctcgctcaggctggacgactgggtgctctgccggctctacaacaataagaacgattgggagaagatgcaactccaacaccaggggggagaggagatgatggtggagcccaacgcggagaacacggcgtccgacatggtggtcagctcgcactcacactcactagtccagtcgcactcgcactcgtggggcgatgcgcgcacgccggaatcgtagatcgtcgacgacgacccgtagatgttccagcacgcggtcgagtacatgtccagagcccgcactgcgtgtcgcgcacaggagatgatgccatcctgatgtgcccacaaagagcagcggaggaggccgtaggactactgttcgtggacttatctacataactcagagatgtacacgcctcgaatgatgcgcggggagactgtttatctcctctcgctcaccgtttcggggaccaccggtgccgggttccgcccgtttataaacaaaaaaacctctaaaaaatcaaaggaaggttatttgcccacaaacctccatgttaa

SEQ ID NO: 9422 - DNA, 899 bp, Triticum aestivum
  Predicted polypeptide sequence is orthologous to G502, G519
cactaaggcctatttaggtgacttccagaacaagtttgtacaaaaaagcaggctggtaccggtccggaattcccgggatatcgtcgacccacgcgtccgaggaaacgagccatcaacaaaagagaaggctccaggtcccaggaggcggtatcacaacctgcagccgcctttctcttctcttcttcttctcttccagcaccgggcgggcgcggccggggttttcttttctccaaggtggtggagcgggcgagcgaacgcgaggagggggaggatgatgacggcaatggtgaaggccgagccgacggcggcggaggggagcagcgggcggagggacgcggaggcggagctcaacctgccgccgggcttccgcttccaccccacggacgacgagctcgtcgtgcactacctctgcaggaaggtggcgggccagccgcagcccgtgcccatcatcgccgaggtcgatctctacaagttcaacccctgggatctgcccgagagggcgctgttcgggagcaaggagtggtacttcttcacgccacgcgaccgcaagtaccccaacgggtcgcgcccccaacgctccgccgggaccgggtactgggaaggcccccggcgcccacaagccccgtggcgccccaggagaacggccggcaaggacggtccggcatcaagaaaggcggctcgttcttctactccgggaaggggcggccaagggggcggccaagaaccgaactgggatcatggcacgaagataacggaatccgccggaaacccgacccgcggcacccccgggcaagaaaggggaaccccctctcaagcctggacagaaatggggggggcgtggtgccgggttgtttacaacacaaggaaagacactccccttggggcaaaaagagcccaag

SEQ ID NO: 9423 - DNA, 1450 bp, Triticum aestivum
  Predicted polypeptide sequence is orthologous to G502, G519
acgaggcactcgccccaatctcgaacaacggccgtcggatccatcatcatcggcagcggagcgattccatcgaccagctttctacagacggacatggggatgccggccgtgaggaggagggagagggacgcggaggcggagctcaacctgccccccggcttccgcttccaccccaccgacgacgagctcgtcgagcactacctctgccgcaaggcggcggggcagcgcctcccggtccccatcatcgccgaggtcgacctctaccgcttcgacccctgggcgctccctgaccgcgccctcttcggcacccgcgagtggtacttcttcaccccccgcgaccgcaagtaccccaacggctcccgacccaaccgcgccgccggcaacggctactggaaggccaccggcgccgacaagcccgtcgcgccccgcggcgggcggaccatggggatcaagaaggccctcgtgttttacgcgggcaaggcgcctaagggggtcaagaccgactggatcatgcatgagtatcgcctcgccgacgccggccgcgccgccgccagcaagaagggctcgctcaggctggacgactgggtgctctgccggctctacaacaagaagaacgagtgggagaagatgcagctgcagcagcaaggggaagaggagacgatgatggagcccaaggcggagaacacggcctccgacatggtggtcacctcgcactcccactcgcagtcccagtcgcactcgcactcgtggggcgaggcgcgcacgccggagtcggagatcgtcgacaacgacccgtcgctgttccagcaggcgacggcggcggcgttccaggcccagagccccgcggccgccgcggcgcaccaggagatgatggccacgctgatggtgcccaagaaggaggcggcggacgaggccggcaggaacgacctcttcgtcgacctcagctacgacgacatccagagcatgtacaacggcctcgacatgatgccgcccggggacgacctgctctactcctccctcttcgcctccccccgtgtccgcgggagccagcccggcgccggcggcatgccggccccgttctaagcagagcaaagacagagaccgtcagagaccccgagatcgacagaagtggaatggacgacttcttggccgcgagcgagcgagaccgcggtgcagtgtaaatacagcataggaaacgggagggagggaggtggcgtcgtgtcgagagaagccggcgtcgtgccggggcgtgccgttgtacatggagagcccggcgccggggcctggccggctgggttgattcttttgttcttactaccttgtactctcaatgcggatgtagctctttcttctcactcctcactagtagaatcgaccgaccgaatacatatgtagctctgttctttccttctcttcagtagaaatcaaccaaattttgctgttatgctgc

SEQ ID NO: 9424 - DNA, 1167 bp, Triticum aestivum
  misc_feature (11)..(11): n is a, c, g, or t
  Predicted polypeptide sequence is orthologous to G504, G1425
gcgtccgggtnagatttggtctggtccagtgtgtgtgtgtgtgaccgtctcccatcttcttttgatcgtgtgtgcagcgtgcgtgtcgatggcgcagcaggggcagggcgcggcgacgtcgctgccgccggggttccggttccacccgacggacgaggagctcatcctgcactacctccgcaaccgcgccgccgccgcgccgtgcccggtccccatcatcgccgacgttgacatctacaagttcgatccatgggacctcccttcccaggcggtgtacggcgactgcgagtggtacttcttcagcccgcgggaccgcaagtaccccaacggcatccgccccaaccgcgccgccggctccggctactggaaggccaccggcaccgacaagcccatccatgacgccgccaccggccagggcgtcggcgtcaagaaggcgctcgtcttctacaagggccgcccgcccaagggcaccaagacggcctggatcatgcacgagtaccgcctcgccgccgaccccctcgccgccgccgtcaacacctacaagcccatcaagttccgcaacgtctccatgaggctcgatgactgggtgctctgccggatctacaagaagacaggcctggcgtcgccgatggtgccgccactcgccgactacgaccacatggccgaccacgacgacctctccagcggcggcgccttcacctatgccacctgcagacccctgtatcagcagcagaatcaccagcagccgcacgccgggaggctcccgacgttcccgtccatctccgagctgttcgacgactacccgttcgcgcagaaatgggacaccttacgttgagcagggcgccaccaccacctcggcgttcacccctccctgaaccagttcctcccgtcgggaacaataggcacgagtggagcgccgtatacgcgccgtcgagttgtttcaagacctagcgggggagcccaggaacgcaagggggtacccggaaaaacggggagccccaccggcgccaaaaactcaacgggttggccttcagcgcccccaatctgtaatgctgaagcccgtgtccggcgtgtgggcccaccaaaagggtcccagttaaactggcttacaaacctttaggattactccggagggcccctgggcaaaaaatttattcccgctgcagt

SEQ ID NO: 9425 - DNA, 1423 bp, Triticum aestivum
  Predicted polypeptide sequence is orthologous to G504, G1425
gcagcatttttatgcagtagccatcttctcctcctcctccccccgccttccagctagccacctagctcactatcacatcatccagcagcccacaccaactcatattgattccgttcccacctgctcgccatcgccagccatgccaatgggcagcagcgccgccatgcccgccctccctcccggcttccggttccaccccaccgacgaggagctcatcgtccactacctccgcaggcaggccgcgtccatgcccagccccgtgcccatcatcgccgaggtcaacatctacaagtgcaacccatgggacctccccggcaaagctttgttcggggagaatgagtggtacttcttcagcccccgggatcgcaagtaccccaacggcgcgcgcccgaaccgcgccgccgggtccggctactggaaggccaccggcaccgacaaggccatcctgtccacgccggccaacgagagcatcggggtcaagaaggcgctcgtgttctacaggggcaagccgcccaagggcgtcaagaccgactggatcatgcacgagtaccgcctcaccgcagccgacaaccggaccaccaagcgcagaggatcctccatgaggctggatgactgggtgctgtgtaggatccacaagaagtgcggcaacttgcccaacttctcctcctctgaccaggaacaggagcatgagcaggagagctccaccgtggaggactcgcagaacaaccacaccgtgtcgtcgcccaagtccgaggccttcgacggcgacggcgacgaccacctccagttgcagcagttccgccccatggcgatcgccaagtcgtgctccctcaccgacctgctcaacaccgtcgactacgccgcgctctcgcacctcctcctcgacggcgccggcgcctcgtcgtcggacgccggagcagactaccagctgcctcccgaaaacccactcatctactcgcagcctccatggcaacaaacgctacactataataacaacaacggctacgtgaacaacgagaccatcgacgtgcctcagctacccgaggcgcgcgtagatgactacggcatgaatggcgataagtataacggcatgaagaggaagagatccagcggcagcttgtactgcagccagctgcagctcccagcggatcagtacagcggcatgctgatccatccgttcctcagccagcagctgcacatgtgaagaaccagagagcttgggtcgaagagatcatcattgttccatttgaacttgctgtagatcgagaggatcccccgctgtggcagataggcagggatctagctagcttgctgtgtcgtgaacgaccgaccgataagaacggacaaatttcagaattcttggtgtagcacaaagctgtaaattacgggggtttattgtgaaataaattaatccagtattatc

SEQ ID NO: 9426 - DNA, 1335 bp, Triticum aestivum
  Predicted polypeptide sequence is orthologous to G504, G1425
attgattccgttcccacctgctcaccgtcgccatgccaatgggcagcagcagcgccgccatgcccgccctccctcccggcttccggttccaccccaccgacgaggagctcatcgtccactacctcggcaggcaggccgcgtccatgcccagccccgtgcccatcatcgccgaggtcaacatctacaagtgcaacccatgggacctccccggcaaggccttgttcggggagaatgagtggtacttcttcagcccccgggatcgcaagtaccccaacggcgcgcgccccaaccgcgccgccgggtccggctactggaaggccaccggcaccgacaaggccatcctgtccacgccggccaacgagagcatcggcgtcaagaaggcgctcgtcttctaccggggcaagccgcccaagggcgtcaagaccgactggatcatgcacgagtaccgcctcaccgccgccgacaaccggaccaccaagcgcagaggatcctccatgaggctggatgactgggtgctgtgtaggatccacaagaagtgcaacaacttgcacaacttctcctcctctgaccaggaacaggagcacgagcaggagagctccaccaccgtggaggactcgcacaacaaccacaccgtgtcgtcgcccaagtcggaggccttcgacggcgacggcgacgaccagctgcagctgcagcagttccgccccatggcgatcgccaagtcgtgctccctcaccgacctgctcaacaccgtcgactacgccgcgctctcgcacctcctcctcgacggcgccggcgccggcgcctcgtcgtcggacgccggagcagactaccagctgccgccggaaaacccgctcatctactcgcagcctccatggcaacaaacgctacactataataacaataacaatggctacgtgaacatcgacaccatcgacgtgcctcagatacccgaggcccgtgtagatgactacggcatgaatggcgataggtacaacggcatgaagaggaagaggtccagcggcagtttgtactgcagccagctgcagctcccggcggatcagtacagcggcatgctgatccatccgttcctcagccagcagctgcacatgtgaagaaccagagagcttggatcgaagagatcatcattgttccatttgaacttgctgtagatcgaggggatcccccgctgtggcagataggcagggatctagcttgcttgctgtgtcgtgaccgaccgaccgataagaacggacaaatttcagaattcttggtgtagcacaaaagctgtaaattacgggggtttattgtgaaataaataaatccagtattattaag

SEQ ID NO: 9427 - DNA, 1319 bp, Triticum aestivum
  Predicted polypeptide sequence is orthologous to G504, G1425
attgattccgttcccacctgctcaccgtcgccatgccaatgggcagcagcagcgccgccatgcccgccctccctcccggcttccggttccaccccaccgacgaggagctcatcgtccactacctcggcaggcaggccgcgtccatgcccagccccgtgcccatcatcgccgaggtcaacatctacaagtgcaacccatgggacctccccggcaaggccttgttcggggagaatgagtggtacttcttcagcccccgggatcgcaagtaccccaacggcgcgcgccccaaccgcgccgccgggtccggctactggaaggccaccggcaccgacaaggccatcctgtccacgccggccaacgagagcatcggcgtcaagaaggcgctcgtgttctacaggggcaagccgcccaagggcgtcaagaccgactggatcatgcacgagtaccgcctcaccgcagccgacaaccggaccaccaagcgcagaggatcctccatgaggctggatgactgggtgctgtgtaggatccacaagaagtgcggcaacttgcccaacttctcctcctctgaccaggaacaggagcatgagcaggagagctccaccgtggaggactcgcagaacaaccacaccgtgtcgtcgcccaagtccgaggccttcgacggcgacggcaacgaccacctccagttgcagcagttccgccccatggcgatcgccaagtcgtgctccctcaccgacctgctcaacaccgtcgactacgccgcgctctcgcacctcctcctcgacggcgccggcgcctcgtcgtcggacgccggagcagactaccagctgccgccggaaaacccactcatctactcgcagcctccatggcaacaaacgctacactataataacaacaacggctacgtgaacaacgagaccatcgacgtgcctcagctacccgaggcgggggtagatgactacggcatgaatggcgataagtataacggcatgaaaaggaaaagatccagcggcagcttgtactgcagccagctgcagctcccagcggatcagtacagcggcatgctgacccatccgttcctcagccagcagctgcacatgtgaagaaccaaagagcttggatcgaaaagatcatcattgttccatttgaacttgctgtagatcgaaaggatcccccgctgtggcagataggcagggatctagctagcttgctgtgtcgtgaacgaccgaccgataagaacggacaaatttcagaatttttggtgtagcacaaagctgtaaattacgggggtttattgtgaaataaattaatccagtattatt

SEQ ID NO: 9428 - DNA, 570 bp, Triticum aestivum
  misc_feature (425)..(427): n is a, c, g, or t
  misc_feature (545)..(547): n is a, c, g, or t
  misc_feature (555)..(557): n is a, c, g, or t
  misc_feature (567)..(570): n is a, c, g, or t
  Predicted polypeptide sequence is orthologous to G505
gcacgaggatttgcgccaccctagaaccaatttcccagagagcctccgccatggcagaccaccttcaagttcagcggcaacaactaaagttccctcaggggttcaggtttcacccgacggatgtggagatcatcacctcctacctagtccctaaagtgttgaacaaagcattcgatcccatagcgatcggggaggtggacctgaacaaatgtgagccatgggaactccccgagaaggcgaaaatgggggagaaggagtggtacttcttctcccaaaaggaccgcaagtaccccaccggtatacggactaaccgagccacgacttccggctactggaaggccactggaaaggacaaggagatcttccaccatgtgactacaagtctcatcggcatgaagaagacgttggtcttctacaagggtagnnngccaaggggggagaagaccaactgggtcatgcacgagtataggctcgagtgtggaaaacaaggaacacctggtctacccaccgacatcaccaccgccacagccattaatgcatcttcnnngaggagtnnngtggtttgcnnnn

SEQ ID NO: 9429 - DNA, 717 bp, Triticum aestivum
  misc_feature (376)..(376): n is a, c, g, or t
  misc_feature (452)..(452): n is a, c, g, or t
  misc_feature (523)..(523): n is a, c, g, or t
  misc_feature (548)..(548): n is a, c, g, or t
  misc_feature (551)..(551): n is a, c, g, or t
  misc_feature (558)..(558): n is a, c, g, or t
  misc_feature (577)..(577): n is a, c, g, or t
  misc_feature (582)..(582): n is a, c, g, or t
  misc_feature (600)..(600): n is a, c, g, or t
  misc_feature (631)..(631): n is a, c, g, or t
  misc_feature (647)..(647): n is a, c, g, or t
  misc_feature (659)..(660): n is a, c, g, or t
  misc_feature (665)..(665): n is a, c, g, or t
  misc_feature (670)..(670): n is a, c, g, or t
  misc_feature (674)..(674): n is a, c, g, or t
  misc_feature (692)..(692): n is a, c, g, or t
  misc_feature (694)..(695): n is a, c, g, or t
  Predicted polypeptide sequence is orthologous to G509
gggtggcctaccttgcaacacagacatagaagaaaacattggagacaattactcaaacaaccctccgaagctacttgagagcctaagaatcgacggatacacatgcaaggggcagcttcttccatggttgctcaaagataacaagctacctgcacttgtcaaggtaactctgcaaaatacctatctgaacaagggtaatatggaacacctcgccgagctggacaacttgtgctgtctcaggcttatgtgccgcgcctacaccgacagcaggtctccttcctttgtgctaaattcaaaagctcaagtatcttctcgttgagtgtggcaacttgatgagatccgctttgatgttggagcactcctgactcaccaaatngtcttgtccttaacagcatggagatcctactcctgtctctctgggataagcatcctatacatttaaggactcgatnaaccgcgatgaatccaagacagtgatcaagaaatacaaacatcaaacaagaactgctctagaaggataaancagcaggacagaactacgaactgancgntccttancacgaatcattctcaaagncttcncctccattattgtaaagnaatggccattctttgtatccaaatcggaaangcaaaaaggcatatanttaggaaataannatttncatancaancaatggttttaatgtttnanngttccttatgaaaaaaaaaaaa

SEQ ID NO: 9430 - DNA, 531 bp, Triticum aestivum
  Predicted polypeptide sequence is orthologous to G509
cacttctcttgttacagtacgaggaaggacatggtggtgaagaagagagcggcagtgattgcggccctgtccatgctcctacttctcatgctgtccaggccatcccatcaacagttctccaattactcctgcaagtgctaccgagagtgctacttggagtgcaagcacgccttcccgatgctctgcaaggtcgtgtgtggtggcagctgtgatgacaagaatgaccctgtagccgcctgcatggtcgcctgcaccaaggactccctatgcggcgtgccggcggcgccatccggcgccgcatattgtagccatgcgtgcaacgatacgtgggggtcgccatggacgggccaaggttccttgaagattgaagatccggccgatcatgggatcatatgatgtcgaactgctgcaccaatgcaataaaatgtatttggcttcggtgcactacttgtgattggtgagaagtttgtgaatcttataataaagctagttatcgatgcatttggtaaaaaaaaaaaaaaaaaaattcct

SEQ ID NO: 9431 - DNA, 854 bp, Triticum aestivum
  Predicted polypeptide sequence is orthologous to G509
gcttgaccttaggcctatttaggtgacactatagaacaagtttgtacaaaaaagcaggctggtaccggtccggaattcccgggatatcgtcgacccacgagtccgcatactctagcatcacacaccgctcaggctacagcaacatagatatatgccctgcctaatccctgctacctagctagatatatacctagcttctttctctcctctctcgagatcttgtcgatctctttctcctccgtctacctagctagcgcaattggtgcctcttataggcaaggcaacggcatccatccagatctctctccatacccatagtacatattgcaattcacgatacaaattgtagagagagtcgagctgagctgagccaggaggtggtttcagagagaagatagtgaacagatagagagataagcatttccatggggctgcgggacatcgagatgacgctgccgccggggttccgcttctacccgagcgacgaggagctggtgtgccactacctgcacggcaaggtggccaaccaacgcttcgccggaggagccaccgggaccatggtggaggtcgatctgcacgtccatgagccatgggagctgccagatgtggcgaagctgagcacaaacgagtggtacttcttcagcttccgcgaccgcaagtacgcgacggggctgcgcacaaaccgcgccaccaggtccggctactgaaaggcccaccggaaagaccgcgtcatccgtagcccgaggtcttcgtcatcccgctccggccgggccggcatcgtcggaatgggcaagaacctcgttttcttacggggccgttctaaaataatcctcaaagggcccaagcttacccgt

SEQ ID NO: 9432 - DNA, 1097 bp, Triticum aestivum
  misc_feature (629)..(629): n is a, c, g, or t
  Predicted polypeptide sequence is orthologous to G509
gttctgcgacccacgcgtccggtcgcgcaccaaccgcgccaccaagaccggctaccggaaggccattgggaaggaccgcgaggtgcgcagcccggccacgcgcgccgtcgtcggcatgaggaagacgctggtcttctaccagggccgcgcccccaacggcagcaagaccagctgggtcatgcacgagttccgcctcgactcaccgcacctgccaccaagggaggactgggtgctctgcagggtgttccagaagcagaaactggacggcgagcaagacaacgcccgctcctcctcgccgcccttcgccggctcgtcgcaggcggcgcaggagctgcccgtcatggacgcgagcagcgaccagatgatgggttcgggctctgccggcttcgcggcgtcacggcaggaggagatgatctgtggccccaacccgttgatgaacgcggcgatgtggcagcaatacaactcgctgcttcttggccagtacccgcaggaagagatggcgggcagctcgccgatgatggccacaggaggagcgggagatgagtgcggattcttcttcgactcggggttcgaggacacggcttcccttggggccatgcggttcccccaagcgtggagctgatgccggncggtcgtgcgcgcgcgcccagtgatcgttgtgtatacgttgtgaaggaaaaactagcgattgaattatttaattccattgggtactgtaggtatagtgtgtgaggtcgtctatatagatttgtgaaggatcgagtgtgtacgtgcttgcatgaaatggtttggtttggccgtctcggccccttgaatgatgccatgtattgcaatcataaaactcatatgtaaaatttgtaaattaactccaccccatttcaatttctcgtaccaccccacgggaaaccccattgggtttttccccagaaagaaaagaaaaacagtgggtcctttcctttttccacaaaaaaacaaaaaagaaaaagaggggcgcggcgccctcaaagtatccctcgaggggccccagcttttccggtacccccggtttcttgggaagaggcggccccttttgtgggccgcctgtattgtccagtcgg

SEQ ID NO: 9433 - DNA, 764 bp, Triticum aestivum
  misc_feature (8)..(8): n is a, c, g, or t
  Predicted polypeptide sequence is orthologous to G522, G1453
tccaattngcaatgacagcttaatgtagtcttgagtcttgacaacacaaattaatatgtttttgctgatttagcttacattcatttgtgtacagagaaatgcaggatagggcctgaggaggagcagagtgactggtacttcttcagccacaaggacaagaagtacccgacggggactcggacaaaccgcgcgactgctgcagggttctggaaggcgacagggagggacaagcccatctatgcaaagcactgcttggttggcatgaggaagaccctggtgtattacaagggcagagctcccaatggccagaaatccgattggatcatgcatgagtaccgcctcgagaccaatgagaacggccctccacaggcaagctatagctatgttatttcacttgatatacatcgatctctgtccatcttgactcgaatataaacctgcaagctcctcgacaacaagaagagatctagatcatgatgcgccatgctggtacgtcgacgatgatgggcccttcatgcatgatctcaactctcccatgagaggaatgccacctcaccacagcatggcactacaagaacaacacctccagatgctcaacaacacctacaagagagagctgaagctgcaatatcaaatgccaaaccatcatcatgttctcaacaccatccctcacgagctagagagcccttcttccttccactctcttttggtatcgccagacgatcaccaaatcaatgtgcaccatgcccagcaccaccatgttc

SEQ ID NO: 9434 - DNA, 673 bp, Triticum aestivum
  Predicted polypeptide sequence is orthologous to G522, G1453
ggacttggtaagtggaacagagtgtctatctaggtacaagtgtccagtgcaacagatgcgcatggacatcatctactatctgtactcaatgatagtactaattattagaaaatcatgtatacaatgaaatcgatgctgctacggtatgtctgctaactctacttcactgctgtaggtgcagctgcgacgtggatagcaggctgtccaggaagttccaatcgatgccggccgctgcctgtccctgctgcacgacatcatagcccgcgtcgccgccaccggcaacggcggtggtcgtcggcgggctctcgatgagctgcgggatgttgccgaagagactctgcttggactccagcaggtcgtcagagtactggatgccctggccggggaagccgaggccgccggctccggcagcgcatgtggcgctttgcaggtaatggaggtcgccgccttggccgtgcagccatggccgcgcctcgtagtagcccccgaggcccggagcggcggcgtatgccgggaagatgtacgacggcctctggttcggggttggcttctggaacgcccggcacaccacccagccttcctcctgggtgggcgcgtgctcgctggtctgcaggcgatactcgtggatgatccagtcagtcttcctaccgttgggtgcacggcccctgtagaa

SEQ ID NO: 9435 - DNA, 587 bp, Triticum aestivum
  Predicted polypeptide sequence is orthologous to G525
gtcgctgcggcgattgaggatgtgaacctcaacaagtacgagccatgggagctaccggagaaggcgaagatgggggaaaaggagtggtacttttactgccgaaaggatcgcaagtaccccaccgggatacgaacgaaccaggcgaagaatgctggctattggaaggccaccggaaaggacaaggagatcttccacccgccgctcacactcatcggcatgaagaagacgctcgtcttctacaagggcagggcacctaggggggagaagaccaactggatcatgcatgagtataggcttgagagcaacaagcagctaacttccaacccgtccaccgcaacccgcaccgtcaccatcaccaacgcgtcttccaaggaacagtgggtggtttgtaggatcttccataagagcgccggactgaagaaggtggtgatgccgtcatatgtcatgccaatgtccatcggagcggaacatcagcaggggttcgccgacttagatacattgcctcctctcatgggctatgagatgtcgtcatcgctagcaaatccaatgttgcttcctacaacttctccttaccaattgcgcgacat

SEQ ID NO: 9436 - DNA, 597 bp, Triticum aestivum
  misc_feature (547)..(548): n is a, c, g, or t
  misc_feature (554)..(555): n is a, c, g, or t
  misc_feature (587)..(589): n is a, c, g, or t
  misc_feature (593)..(595): n is a, c, g, or t
  Predicted polypeptide sequence is orthologous to G525
gcacgaggatcaatcacagaaaatcgtccctccatatctccccagctcttcttcctcctccgacctcctcctcagctcccgtgtcatctggttcttcttcctcagatagcgaagaaggctagtagatccggtcgagagggcgcggcgatgtcggacgtgacggcggtgatggatctggaggtggaggagccgcggctctcgctcccgccgggcttccggtttcatccgaccgacgaggaggtggtcacccactacctcacccccaaggccgtcaacaacgccttctcctgcctcgtgatcgccgacgtcgacctcaacaagaccgagccgtgggatctccccgggaaggcgaagatgggggagaaggagtggtacttcttcgtgcacaaggatcgcaagtacccgacgggcacgcgcaccaaccgcgccacggagaaggggtactggaaggcgacggggaaggacaaggaggtcttccgcggcaagggccgcgacgccgtcctcgtcggcatgaagaagacgctcgtcttctacaccggccgagcgnnccgcgnngacaagacgccgtacgtgatgcacgagtaccnnntcgnnngc

SEQ ID NO: 9437 - DNA, 745 bp, Triticum aestivum
  Predicted polypeptide sequence is orthologous to G525
ccacgcgtcgccgcaagtaccccaccggaatacgaaccaaccgagccacaaaggctggctactggaagaccacgggtaaggacaaggagatcgtcaatccacattgcacgtccatgctcatcggcatgaagaagacattggtgttctacaagggcagagctcccagtggggagaagaccaactgggtcatgcacgagtacaggctcaagatcaacaagcagtcaacaaccagcctgcccagtgccataggaaatgctgcttctattaacatgtcttccaaggagtatgtggtttgcaggatcttccataagaacgctggaagtaggctttcatccatggtgtcacatgagggcaacggtggtgcaacacccaccgacaagatctggtcgatgagcatgggtacagatggggcatgttgaagtattgataatcagatgatccaagacaacatatatatgtgtgtgggcattaattagtcatccatcagaagatccatcgatatataccaacatctatatgggtttgcagcgcattttatttttagagagtttgcatgcaccacatcagaagatcggtcgatatataccaacatctatatgggttggctcgttgggctgccgctctgtgctagtgtgggtgtatgtgtatcggctgtacatgcaccacatatcggggtatacctagctacattgcatggtaaacttcctaggagtgtacaccaggcatgtttaatcctatatggaat

SEQ ID NO: 9438 - DNA, 608 bp, Triticum aestivum
  Predicted polypeptide sequence is orthologous to G525
ccacgcgtcgatggccatcaccctagaatccatggcagagaaatcctccaccaggacagaccaccttcaagttcagcaacagaagttggagctaccgctggggtttaggttccacccgacggatgaggagatcatcaactcctatgtgatccccaaggtgctcgatgaagccttcgtaaccgcggcgattgaagatgtgaacctgaacaagtacgagccatgggagctaccagagaaggcaaagatgggggagaaggagtggtacttttactcccgaaaggatcgcaagtaccccactgggatacgaacgaaccgggcgacgggtgtcggctattggaaggccaccggaaaggacaaggaaattttccacccgccactcacgctcatcggcatgaagaagacgctcatcttctacaagggcagggcgcctacgggggagaagaccaactggatcatgcatgagtataggcttgagagcaacaaggagctgacatccaacccgtccaccgcaacccgcaccgtcaccgccaccaaggcggcttccaagtgggtggtttgtaggatcttccataagagcaccggactgaagaagggggggatgccgtcat

SEQ ID NO: 9439 - DNA, 725 bp, Triticum aestivum
  Predicted polypeptide sequence is orthologous to G525
ccacgcgtccgacctgcccaccgacatcgtgagagccgcctccattaatgcgtcttccaatacttgttccaccgcaccacccttttaagaaagagcctcccccatggcagtccaccttcaagttcaacaacaacaacaacacctgaatctgccagcggggttcaggtttcacccaacggacatggaaatcatcaccttctacctagtccgcaaggttctgaagaaacccttcgatgttacagtaatcaaggaggtggatctaaacaaatgcgagccgtgggatctccgaaataatgtaaatatgggggagaaggaccaatacttcttctccaagaaggacctcaagtaccccaccggggtacgcaccaaccgggccacgaacgctggatattggaaggccactggaaaggacaaggagattgtccacccgccgaccatgagtctcatcggcatgaagaagactctggtcttctataagggcagagcccccaggggggagaagacaaactggatcatgcacgagtacagactcgagatgggaaagcaacacacaccggacctgcccaccgacatcgtgagagccgcctccattaatgcgtcttccaaggaggagtatgtcatttgtagaatcttccataagagcactggactgaggaaggtggtgatgccttcatattccatgcccattcccatgttcatgggggtagagcaacaaaaggtcttct

SEQ ID NO: 9440 - DNA, 1189 bp, Triticum aestivum
  misc_feature (992)..(992): n is a, c, g, or t
  misc_feature (1005)..(1005): n is a, c, g, or t
  misc_feature (1015)..(1015): n is a, c, g, or t
  misc_feature (1081)..(1081): n is a, c, g, or t
  Predicted polypeptide sequence is orthologous to G525
cgttacgttcctgccgctgccgattgagtccatatcatcatcaccagttccaaatgagggaaaaacaagtgatggagcacggcgagcaggagcagcacgccatggacctgccgccgggcttccgcttccaccccaccgacgaggagctcatcacgcactacctggccaagaaggtcgccgacgcccgcttcgccgccctcgccgtctccgtcgccgacctcaacaagtgcgagccctgggacctgccatcgctggctaggatgggggagaaggagtggtacttcttctgtctcaaggaccgcaagtacccgacggggctcaggaccaacagggccaccgagtccggctactggaaggccaccggcaaggacaaggacatcttcaggggcaaggccctcgtcggcatgaagaagacgctcgtcttctacaccgggagggcgcccaagggcgacaagtccggctgggtcatgcacgagtaccgcatcaacgccaagctccacgccgccagcaccagccgcggctccctctccggcggcagggccgcatcgtccaggaacgagtgggtgctgtgcagggtgttcaagaagagcctgctaggcggcgtagtgtcgtcggcgccggcgtcgtcagcagcaaagaaaagcggcgtggggacgatggaggagatagggtcctccgtggccgccgtcaccccgctccctccgctcctggacatgtccggctccggcgcctccttcgtcgacccggcggcgcacgtgacctgcttctcccacacgcgctggaggcgggccagttcttcaaccgacggcgacgggcggctgcgccacggacacggaccacacgggctagcctcatcgtactccccgttgggcagcttcacgcagtacggggggcagctgcaccacggcgtgagcctgagcctggtgcagctcctgaagagcagcgggtaccacgcggtctcgccgacgacatgcgccgggcggcaatagcancaccagcgggggnttgtagggcnaccgggaaagctaaccgtcccaggaaccggcctcactcgagctgacccgaaatttttcctcttggncaaaattgaaccgagcgggccgggggttatgacaaaaacctcccatcccggttcggggaaagaccaccattttggctttccgggttgactggtaatcccgagggcgaa

SEQ ID NO: 9441 - DNA, 1071 bp, Triticum aestivum
  misc_feature (625)..(625): n is a, c, g, or t
  misc_feature (1018)..(1019): n is a, c, g, or t
  misc_feature (1024)..(1027): n is a, c, g, or t
  misc_feature (1036)..(1036): n is a, c, g, or t
  misc_feature (1048)..(1048): n is a, c, g, or t
  Predicted polypeptide sequence is orthologous to G525
ggttgtacttcgacccacgcgtccggacgaaatcacctctaacatctcgatctacctcttcctcctcctcagctctcgttccatcaggttcttccacagcgtagcaaggcaatctagtagatcctccatgtcggacgtgacggcggtgatggatctggaggtggaggagccgcagctggcgcttccaccggggttccggttccaccccaccgacgaggaggtggtcacccactacctcacccgcaaggtcctccgcgaatccttctcctgccaagtgatcaccgacgtcgacctcaacaagaacgagccgtgggagctcccgggcctcgcgaagatgggcgagaaggagtggttcttcttcgtgcacaagggtcggaagtacccgacggggacgcgcaccaaccgggcgacgaagaaggggtactggaaggcgacggggaaggacaaggagatcttccgcggcaagggccgggacgccgtcctcgtcggcatgaagaagacgctcgtcttctacaccggccgcgcccccagcggcgggaagacgccgtgggtgatgcacgagtaccgcctcgagggcgagctgccccatcgccttccccgcaccgccaaggacgattgggctgtntgccgggtgttcaacaaagacttggcggcgaggaatgcgccccagatggcggcggcggccgacggtggcatggaggacccgctcgcctccctcgatgacttgctcatcgacaccgacctgttcgacgacgcggaccttccgatgctcatggaatccccgtctggcggtgacaacttcggcggggctttgaagctccaccttgaagggcggcccctcccgtttgagcccggaagcggagcctccgggtggctgcatccgcaggagcaagcaatgaccccaaattacttttttattcccggggaacgggcaacggtgaatttttggggggggccgggggaactcccccctacccggggttatgggggtgcccaagagggccgcgaaacttaaaannttttnnnncccccgccncggggcgggttnccttctttcctctggggccgggt

SEQ ID NO: 9442 - DNA, 653 bp, Triticum aestivum
  Predicted polypeptide sequence is orthologous to G526
atcaccttctacctagtccgcaaggttctgaagaaacccttcgacgtgatagtaatcgaggaggtggatctgaacaaatgcgagccatgggatctcccaaataatgttaatatgggggagaaggaccaatacttcttctccaagaaggacctcaagtaccccaccggggtacgcaccaactgggccacgaacgctggatattggaaggccactggaaaggacaaggagattctccacccgccgaccatgagtctcatcggcatgaagaagactctggtcttctacaagggcagagcccccaggggggagaagacaaactggatcatgcacgagtacagactcgagatgggcaagcaacacacaccagacctacccaccgacatcgtgagagccgcctccattaatgggtcttccaaggaggagtatgttgtttgtagaatcttccataagagcaccggactgaagaaggtggtgacgccttcatattccattcccattcccatgtccatgggggcagagcaacaacagggcttcctcgaatctaatacactggctcctctcatggactatgatgtgccatcatcattatagccgctgtcgccgctgcctgcaacttctttgtaccacatgcataacttctgggctggatcatc

SEQ ID NO: 9443 - DNA, 744 bp, Triticum aestivum
  Predicted polypeptide sequence is orthologous to G526
gccaacaccaactagagctcccttcggggtttaggttccaccctaccgatgaggagatcatcacctcgtacctggtccccaaggtgctcaacccaaccttcaccgcgatagcgatcgcggaggtggatctgaataagaacgacccgtatgagctccccaagaaggcaaagatgggggagaaggagtggtacttctactgtcagaaggaccgcaagtatcccacggggatacagaccaaccgggccacgaaagccggctactggaaggccactggcaaggacaaggagatcttccacccactgcccactctcatcggcatgaagaagacgctcgtgttctataagggcagggcgcctaggggggagaagaccaactgggtcatgcacgagtacaggcttgagatcagcaagcagcctgcatatggcccatctaccgccatcgccaaagctgccgccattaatgcatcttccaagaaggagcgtgtggtttgcaaaatcttccataagaacatgggagtcaagaaggtggtgaccccgtcgtacgccatgcacatgcccatgttcataggaggagagcagcaacagggctccctcaactcatgtacgttcccgcctcccatggactacggcgcatcgttgtcgctggcgcctccgttgtttctatctgaagattcttcgtaccaattgcatgccgccagaatcggcctggcgatgacgggcagcttggtggtccccatggtgaaca

SEQ ID NO: 9444 - DNA, 1066 bp, Triticum aestivum
  misc_feature (23)..(23): n is a, c, g, or t
  misc_feature (785)..(785): n is a, c, g, or t
  misc_feature (942)..(942): n is a, c, g, or t
  misc_feature (980)..(980): n is a, c, g, or t
  Predicted polypeptide sequence is orthologous to G526
tcgacccacgcttccgcttgttnctaaaacccgcctctctctccctctttcacacccgcctcttcctcttcctctctctctcggcttccatttcctcttcttctagctagcttgcttcggtgcccggcggagttggggcacgcgcgcgcgcgcggagatgtctgaggcgtcggtggtaaaccaggcggaggtggaggacgcggcggcggcggcggcggccgggctggacctgccgccggggttccggttccaccccacggacgaggagatcatctcgcactacctcacccccaaggcgctcgaccaccgcttctgctccggcgtcatcggcgaggtcgacctcaacaagtgcgagccatggcatctcccaggcaaggccaagatgggcgagaaggagtggtacttcttttgccacaaagaccgcaagtacccgacggggacgaggacgaaccgcgccaccgaaagcggctactggaaggccaccggcaaggacaaggagatcttccgggggaggggcatcctcgtcggaatgaagaagacgctcgtcttctacctaggccgcgccccccgcggcgagaagaccggctgggtcatgcacgagttccgcctcgagggcaagctcactcacccgctcccgcgctccgccaaggacgagtgggccgtgtccaaggtgttcaacaaagagctcacggccaccaacggggcaatggcagcggcggaggccgggatcgagcgagtcagctccttgggcttcatcactgacttccttgactctggggagctgncgcccctcatggaccctcccttgggcggcgacgtcgacgaagtcatcgatttcaagtcacctctgcctacgccaccggtgcccattccggactccaggttaagatgaacagcacatgccgccgcacatgatgtactcgagcccctacttctccctgncggccgccaactccggcgacatgttgccggcgatcggnaggtactgaagggcgagcaagtctcggggcaacgtttggcctcagccgtcccgggagacgggctgagaacgaacccaggccgcgga

SEQ ID NO: 9445 - DNA, 1094 bp, Triticum aestivum
  Predicted polypeptide sequence is orthologous to G536
cgttgccacacgcccttgcacaagcgagcgagcaaccatgtcgccagcagagccgacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgccaccatccgctcctaccgcagcaagatcgaggccgagctcgcaaagatctgcgacggcatcctcgccctgcttgattcccacctcgtgccatccgccggagctgccgagtccaaagtcttctatctcaagatgaagggcgactaccacaggtaccttgcagagtttaagtccggtggggagaggaaggaagccgccgagagcaccatgaacgcgtacaaagctgctcaggatatcgccctagcagatttggctccaacccaccccatcaggcttgggcttgcactcaacttttctgtgttctactatgagatcttgaactcccctgaccgcgcctgcaaccttgcaaaacaagcctttgatgaggctatatcagagctggacagcttaggcgaggaatcctacaaggacagcactttaatcatgcagctcctgcgtgacaatttgactctatggacatccgacaccaatgaggatgacgttgatgagattaaggaagccccagctccaaaagaatctggagacggacagtgaggtgaatgaaaacaacagtctgtgcattgttgggggcaatggaagtcggtcttggttctagtgctcatactgttgtcatcactacctctgtttaattatgcacttaagaagtttctgggctatgtttttctggtgctgataaatgctggctggattcgtgttttctttttaaatctcgccacaagcaaaagacctgctctttttcaccattagaatgtttgctatatctaaaaaaaaaaaaaaaaaaaaaaaaaaa

SEQ ID NO: 9446 - DNA, 497 bp, Triticum aestivum
  misc_feature (149)..(149): n is a, c, g, or t
  Predicted polypeptide sequence is orthologous to G536
tccctcgcaccgcgcggctgatgcaggagccttccgaaccaaagccaaagtcgaaggaggagcgtgtggctgcgatgatcgatcagcttgatgagaataacgcgccctccgtcgccgcgcgtctcgaggccatcgaacggatgcgcacntgctcctgctctgctcaatcaacgggagaagcttcgcggcctccgcactgcagacatcgatcccgagggagcgatgcgatacctggatgcgctggccaagcgcgtcgtggaaggcgaggacaaaggcagaggcgtgcggacaccgggggagatcactgactatgctgacacagacaactctcctggaggcacttactcgcgcgctacgctaatcatgcagctcctccgcgacaacctcggtcaatggatcggcgacgaggatcgcgtgcttcccgaggagccactcacaaagctaggatgaatgtacaaatgtgtgcgaaaaaaaaaaaaaaaaaaaacctcgagggg

SEQ ID NO: 9447 - DNA, 769 bp, Triticum aestivum
  misc_feature (707)..(707): n is a, c, g, or t
  Predicted polypeptide sequence is orthologous to G536
gcacgaggcaccgttccgccgcgcacaggagagcacagcccccgcgcccaggagtaagtttgttcttttaccaacatgtcgagggaggagaatgtttacatggccaagctggctgagcaggctgaaaggtatgaggagatggttgagtatatggagaaggtggccaagactgtagatgttgaagagctcactgttgaggagcggaacctcctgtctgtcgcatacaagaatgtcattggggctcgccgtgcttcatggcgcattgtctcttccattgaacagaaggaggagtctcgtaagaacgaagagcatgtgaaccttatcaaggaataccgtgggaagattgaggctgaactgagcaacatctgtgatggtatcctgaagctacttgactcccacctagtgccttcttctactgctgccgaatcaaaggtcttctacctcaagatgaagggtgactatcacaggtatcttgcggaatttaagactggtgctgagaggaaggaatctgctgagagcacgatggtagcctacaaggctgctcaggacattgctctggctgagctggcaccaacccatccgataaggcttgggcttgctcttaacttctcggtgttctattatgagattctgaactccccagacaaagcttgcaaccttgcaaagcaggcgtttgatgaagccatctctgagttggatacccttgnggaggagtcatacaaagatagcactctgatcatgcagctcctgagggacaacttgacccttt

SEQ ID NO: 9448 - DNA, 644 bp, Triticum aestivum
  misc_feature (297)..(297): n is a, c, g, or t
  misc_feature (447)..(447): n is a, c, g, or t
  misc_feature (452)..(452): n is a, c, g, or t
  misc_feature (512)..(512): n is a, c, g, or t
  misc_feature (554)..(554): n is a, c, g, or t
  misc_feature (561)..(561): n is a, c, g, or t
  misc_feature (576)..(576): n is a, c, g, or t
  misc_feature (593)..(593): n is a, c, g, or t
  misc_feature (613)..(613): n is a, c, g, or t
  misc_feature (615)..(615): n is a, c, g, or t
  misc_feature (617)..(617): n is a, c, g, or t
  misc_feature (626)..(626): n is a, c, g, or t
  misc_feature (629)..(629): n is a, c, g, or t
  Predicted polypeptide sequence is orthologous to G536
cggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcagcagnaaggaaggagggcccgaggcaatgaggaccgagtaacactcatcaaggattatcgtggcaagattgagactgagctgaccaagatctgtgatggatcctcaagctgcttgagaccatcttgtgccgtcttccactggccccgatccaagncctcntctcaagatgaaggtgatactacagatactgctgagtcaagactggactgaaagaagacncgctgagaaacatggtggatacaggtgccaagaatgctcggntgacttntcaatcacctatagnttgacggattactccangtcacaagagatcgaccacnangnctgatctgnaanagtttgcagcacccg

SEQ ID NO: 9449 - DNA, 236 bp, Triticum aestivum
  Predicted polypeptide sequence is orthologous to G536
ctcagagacaacctcaccctctggacctccgacatgcagggctccaacgctgagcagggtgatgccgcagaaccccaggacactgaggcctaaactgtcagaacatgattttctccttttttcagttttcatctcttcccctatgaaagttggcgttacgcgcgtcttgttttttttgtgatgcttgacaatgctaataaatccagcaacccccattcaactcgaaaaaaaaaaaa

SEQ ID NO: 9450 - DNA, 471 bp, Triticum aestivum
  misc_feature (2)..(2): n is a, c, g, or t
  misc_feature (18)..(18): n is a, c, g, or t
  misc_feature (27)..(27): n is a, c, g, or t
  misc_feature (31)..(31): n is a, c, g, or t
  misc_feature (49)..(49): n is a, c, g, or t
  misc_feature (57)..(57): n is a, c, g, or t
  misc_feature (71)..(71): n is a, c, g, or t
  misc_feature (74)..(74): n is a, c, g, or t
  misc_feature (80)..(80): n is a, c, g, or t
  misc_feature (111)..(111): n is a, c, g, or t
  misc_feature (119)..(119): n is a, c, g, or t
  misc_feature (124)..(124): n is a, c, g, or t
  misc_feature (126)..(126): n is a, c, g, or t
  misc_feature (148)..(148): n is a, c, g, or t
  misc_feature (191)..(191): n is a, c, g, or t
  misc_feature (199)..(199): n is a, c, g, or t
  misc_feature (223)..(223): n is a, c, g, or t
  misc_feature (229)..(229): n is a, c, g, or t
  misc_feature (254)..(254): n is a, c, g, or t
  misc_feature (279)..(279): n is a, c, g, or t
  misc_feature (297)..(297): n is a, c, g, or t
  misc_feature (313)..(313): n is a, c, g, or t
  misc_feature (317)..(317): n is a, c, g, or t
  misc_feature (340)..(340): n is a, c, g, or t
  misc_feature (345)..(345): n is a, c, g, or t
  misc_feature (352)..(352): n is a, c, g, or t
  misc_feature (368)..(368): n is a, c, g, or t
  misc_feature (376)..(376): n is a, c, g, or t
  misc_feature (380)..(380): n is a, c, g, or t
  misc_feature (414)..(414): n is a, c, g, or t
  misc_feature (416)..(416): n is a, c, g, or t
  Predicted polypeptide sequence is orthologous to G536
gngttctattatgagatnctcaactcnccanaccgtgcttgtgacctcnccaagcangcttttgatgaggncanctcggnactggactccctgagcgaggagtcctacaangacagcantttgntnaatgcaacttctgcgtgaaaanctgacgctgtggacttctgacatctcggaggacgctgctgaanaaatgaangatgctcccaagggggaatctggngatggncaataaacactgtctatgtgcccanaaacttgtctttcccgcttgttcantgtagattgtaatgtcancccgggtgctggtaantggnggctccaatttgtgttgtgatanggaancttgtanctgccttgcttgctcnacggggcngatnatccgggtgcactgggtattgcctcctgttgaancnttgtgttactttggggggtttaaaaattttctgccgctccaaaaaaaaaaaaaag

SEQ ID NO: 9451 - DNA, 681 bp, Triticum aestivum
  Predicted polypeptide sequence is orthologous to G536
ttttttttttttttttttttttttttttaggaccactcacaataaacagcgatgaaaaggaaaatgcaagtgacaacagtttaaagggcttcccaacccaaccaggcctggctccagtgcccccgcctgaaacaaggtgggacaccgaggccttgcccggcagcatctcatatggggagcccccaaattttcccgacaataatcataacacggctacaagggtcgcacccaagaaaccagggtccagatcacattgcatagtgtcattagacagcagcaaacactagctactagtttctaggcacgtaaagccggctttactgcccctcgctcgagtcacgcttgggtgcctccctgatctcttcagcagggtcctccgagatgtcagaagtccatagggtcaagttatcacggaggagctgcatgatcaaagtgctgtccttgtaggactcctcgctcagggtgtccagttccgagatggcctcgtcaaaagcctgctttgcaagactgcaggcgcgatcaggtgagttgagaatctcatagtagaacactgagaagttaagtgccagtccaagcctaatagggtgagttggagcaagctcagccaaagcaatgtcctgggcagccttgtatgccaccatggtgttctcagcagcgtcctttctctcagctccagtcttg

SEQ ID NO: 9452 - DNA, 1154 bp, Triticum aestivum
  Predicted polypeptide sequence is orthologous to G536
atgcttccaacgcgtccccgagctgtcggatatggtcgacctgcaggcggccgcactagtgattagcgtggtcgcggccgaggtgagcagcagaaaaattttaaaaccaccaaagtaacacaaaggttcaacaagaggcaataaccagtgcagcccgataatcaggctgtcgagcaagcaaggcagctacaagcttccctatcacaacacaaattggagcctccaattaccagcaaccacgatgacattacaatctacactgaacaagcgagaaagacaagtttctgaacacatagacagtgtttattgtccatctccagattcacccttgggagcatccttcatttcttcagcggcgtcctccgagatgtcagaagtccacagcgtcaggttatcacgcagaagctgcatgatcaaagtgctgtccttgtacgactcctcgctcagagagtccagttccgagatggcctcatcaaaagcctgcttggcaaggtcgcaagcacggtcaggcgagttgaggatctcataatagaacactgagaagttgagtgccagcccaagcctaataggatgagtcgggggcagctctgcaagtgcaatctcctgagcagctttgtatgcgaccatggtgttctcagcagcatccttcctctcagttccactcttgaactccgcaaggtacctgtagtaatcacccttcatcttcaggtagaagaccttggactctggagcagtagatgaggggacaaggtgggaatcaagaagcttgaggataccatcacagatcttggtgagctcaacctcaatctttccacggtagtccttgatgagtgtgacacggtcctcattgccacggctctcttccttctgctcaatggaggaaatgatgcgccacgaggcaccggcgggcaccaataacattcttgtaagcaactgatagaaggttgcgcctctcgactgtgagctcctcggagtcaactgtcttgggcaccttctccatgaactcaacattttcctcgtacctcttagcctggtctgcaagcctgcccatgtacaattccccttcgcgggaaagctcaacaggctggcccatctcaattgttggggctcttacaggccccaaagattaattccaaaaaaaacggttgccgaaa

SEQ ID NO: 9453 - DNA, 1290 bp, Triticum aestivum
  misc_feature (9)..(9): n is a, c, g, or t
  misc_feature (17)..(17): n is a, c, g, or t
  misc_feature (21)..(22): n is a, c, g, or t
  misc_feature (30)..(30): n is a, c, g, or t
  misc_feature (35)..(35): n is a, c, g, or t
  misc_feature (40)..(41): n is a, c, g, or t
  misc_feature (48)..(48): n is a, c, g, or t
  misc_feature (53)..(53): n is a, c, g, or t
  misc_feature (57)..(58): n is a, c, g, or t
  misc_feature (81)..(83): n is a, c, g, or t
  misc_feature (94)..(94): n is a, c, g, or t
  misc_feature (98)..(98): n is a, c, g, or t
  misc_feature (102)..(102): n is a, c, g, or t
  misc_feature (105)..(105): n is a, c, g, or t
  misc_feature (117)..(117): n is a, c, g, or t
  misc_feature (119)..(120): n is a, c, g, or t
  misc_feature (133)..(133): n is a, c, g, or t
  misc_feature (150)..(150): n is a, c, g, or t
  misc_feature (220)..(220): n is a, c, g, or t
  misc_feature (258)..(258): n is a, c, g, or t
  misc_feature (589)..(589): n is a, c, g, or t
  misc_feature (1019)..(1020): n is a, c, g, or t
  misc_feature (1063)..(1063): n is a, c, g, or t
  misc_feature (1069)..(1069): n is a, c, g, or t
  misc_feature (1074)..(1076): n is a, c, g, or t
  misc_feature (1078)..(1085): n is a, c, g, or t
  misc_feature (1089)..(1089): n is a, c, g, or t
  misc_feature (1105)..(1105): n is a, c, g, or t
  misc_feature (1107)..(1107): n is a, c, g, or t
  misc_feature (1110)..(1111): n is a, c, g, or t
  misc_feature (1146)..(1159): n is a, c, g, or t
  misc_feature (1164)..(1172): n is a, c, g, or t
  misc_feature (1184)..(1184): n is a, c, g, or t
  misc_feature (1190)..(1190): n is a, c, g, or t
  misc_feature (1194)..(1196): n is a, c, g, or t
  misc_feature (1199)..(1200): n is a, c, g, or t
  misc_feature (1219)..(1219): n is a, c, g, or t
  misc_feature (1221)..(1233): n is a, c, g, or t
  misc_feature (1239)..(1242): n is a, c, g, or t
  misc_feature (1245)..(1254): n is a, c, g, or t
  misc_feature (1256)..(1256): n is a, c, g, or t
  misc_feature (1258)..(1264): n is a, c, g, or t
  misc_feature (1283)..(1289): n is a, c, g, or t
  Predicted polypeptide sequence is orthologous to G536
aaataaagncagggctnggtnnacccggtncccgnaatgnnccgtagnatatncgtnncgacccaacgccgttcccgccgnnncagccgaaagncccngtgnagnaaaaagccgaangnncgcgaaggaaggnaaaagggcacttggaanctcagtttggcaacccaaaagaaaggaaggggaaaaatgtgtcttacccgctttgagaggaaaaccccgntgaaggggagaaattttgtgataaattgggcccaaaanctttgctccagaaagaaggtttgaacggttttaaacaaaaaaatatagggttatgagttctctttggggaaaaaatgggggggaaaaaaacaccccctcaatatttttggggggagacacccctctgtttttgagagaggacgcccaacacctgtctttcttctgttttgtgtttaaacaaaaaaaatattaatatttatgtggcccccgcacgaggggtgttctctttgggaagaggatttatattctctcctccctcttttaatacaaaaaagagaggagagaaaacacccggtggtgagaaacaaagcctctttttattttttttttncttttaacaaagaggagatctccctccccccaccaagatattataaaaataattctctcctcccaaaaaaactattttgtgtgggggggcttctccccaaacaattgttggtggggcgcccccccccattttttctccctctttcctctcttgttgagaaaaagaaacaacaaggggtgtgttttcttttataataaaaaaaaggaggcgggtggctacacctactctctttctcttgaagggtgactaccacaggtaccttcgcggagtaaaagaaaaaaacaacaaagggaaaaaacatctcctttctctcttgtagcatacaagtcagcccaggacatcgcgcttgctgacttgcctaccacccacccgataaggcttggacttgcactcaacttctcagtgttctactatgagatcctgaactctnncagacgtgctgcacttgcagcagcttgatgactatgtgactgntctcgnagtcnnngnnnnnnnnattnaaatgatctgcctacngnggnnaaacaagagacaataaaataaagtaataataaatnnnnnnnnnnnnnnacgannnnnnnnnaatttcaggtanaagggntacnnntanngactggacatataataagnannnnnnnnnnnnngttgcnnnntcnnnnnnnnnnantnnnnnnnaaaaaaaaaataataatgnnnnnnna

SEQ ID NO: 9454 - DNA, 825 bp, Triticum aestivum
  misc_feature (597)..(597): n is a, c, g, or t
  misc_feature (691)..(691): n is a, c, g, or t
  Predicted polypeptide sequence is orthologous to G536
acgcttgaccttaggcctatttaggtgacactatagaacaagtttgtacaaaaaagcaggctggtaccggtccggaattcccgggatatcgtcgacccacgcgtccgggcgaagctggccgagcaggcggggagatacgatgatatggtggattttatgaagaagcttgctaggatggatgtggatatgagcgttgaagagaggcatttattttcagttggttttaagaatacaattggtgcaaggagggcatcatggagaatcctttcttcacttgagcaaaaggtggcagcgggtgagcaggctggccggatgataagtgtctacagaacgaaagttgaggatgaactaaggatggtttgcaatgaaatattgtcaatcatcgctattcattgccttcccttggctaatgcgggtgaaaacgttgtgttctttcataaaatgaaaggtgactactaccgttacctggctgaatttagcactggggttgaaaagaagtctgctgctgaccaatcactcatggcctatcagcatgccatggttgttgcctccaccgagctttcgcctgctcatccaatcaggcttggccttgcgctncatttctcagtgttcttttatgacataatgaactgtcatcagagagcttgccaagttgcaaaacaagcatttgatgaggctactactgagattnattccgctggtatggatgggcacaacgatagcacactaatgatgcagcttctgaaacgacacctagcattgtggaagtcagaactaactgaaggtgaaaacctcgaagatagcgacatcgatatggagggagga

SEQ ID NO: 9455 - DNA, 821 bp, Triticum aestivum
  misc_feature (10)..(10): n is a, c, g, or t
  Predicted polypeptide sequence is orthologous to G545
ctagcattangtgactatagaacagtttctacaaaaaagcaggctggtaccggtccggaattcccgggatatcgtcgacccacgcgtccgacctagtttagatcgcgagcggcgcccttttttttttttttttttccactggacaaaatatacttaataataaggataagagtacaccttatcctcctcgacccagtaccatctgactgaaaaggttcaactgcaacaattaatccatgcataatacaacagttcctgtcatctgcagcttgcagaccaagagcattttttttcttctaaaaatagacttcccctaaactcgggaagtgaatccggacaagcgagggcatcccctcttttattttgtagctaagcgatgacttctccaatgtccactcctggcgcatgtgcttgcacctttgacacactggactcttgtatagctttatgtcctccagattcactgctgcttgcatgatgctcctggcatagctcacgagtttgtcttctgcttgaaacctcccatagatactgagcccagcgaggttgtggtgcttgaaatcagatgcagatggttccaactccagtcccttgtcccactgctccagactgtgagcatcattaatactgccataagtgagttgcttggtaagactgccctaagcaacctgcatttgaacttcagaagcgaaacatttgggtacaaacagaatgtccaaggcaattgttacctgtgttccacaaacttaagattgtcgatttgcttaacattcctgaaaaatgcgatttgacttggacaatgctcctactccaagtgcacc

SEQ ID NO: 9456 - DNA, 625 bp, Triticum aestivum
  Predicted polypeptide sequence is orthologous to G546
tttttttttttttttttttttttttttttttcagagtgaaaactacttcatgatcgagtccatgaaaacaggcagtcacgtcaaagagaatgtacagacatcgatgccaaactcacattcactgattcacaatgcacagacacattatgcatccatgccattgccatgtccggaccgggcgggactcacttgctagagcgtgtcacggcatgaaacgagcggcaccgttgtcgccggcggtcgccgaggcggaggaggaggacgcctcctccatggcttcgcacttgcggcaccgcttgggctcgggcggcgtcttgcggggcggcgcgtcggcgacgacgacgacgacgacgcggcggcaggacgggcaggaggagtgcgcgcggagccaggcgtcgacgcaggcgacgtggaacgcgtggccgcactgcggcagcacgcggatctcctccttctccgcgaactccgacaggcagatggcgcactccgagaggatcccctcctgcgccgcggcggccgggcccccgcgcgccgcgacggccgccgccacggcgtcctcgtacgccagcttgggcagcgccatgagcgccctcttcttgagccccttgctcgcgccggggccgga

SEQ ID NO: 9457 - DNA, 594 bp, Triticum aestivum
  misc_feature (451)..(451): n is a, c, g, or t
  misc_feature (471)..(471): n is a, c, g, or t
  misc_feature (493)..(493): n is a, c, g, or t
  misc_feature (539)..(539): n is a, c, g, or t
  misc_feature (550)..(550): n is a, c, g, or t
  misc_feature (556)..(556): n is a, c, g, or t
  misc_feature (563)..(563): n is a, c, g, or t
  misc_feature (572)..(572): n is a, c, g, or t
  misc_feature (577)..(577): n is a, c, g, or t
  misc_feature (579)..(579): n is a, c, g, or t
  misc_feature (590)..(590): n is a, c, g, or t
  Predicted polypeptide sequence is orthologous to G546
aagcagagctaaacgcctcgacagagagtgcagagcgtccaccgtaccgtagcagagcaacggcgacggtgcgacaccatgcgctctccggcgagcctgctgcaccgcagcacggccgccgccggccccggcgagcctccatcgctgccgccgcctcggcccgagcagcagtcgctcgtggtcaccgtggactcggacatggcggtgatcctggcgtcgctgctctgcgtcctcctctgcgtcctcggcctcgccctcctgtcccggcgcgcgtgccgccgccggtcctccgacaactaccctcctccccccaagggcctcaagaggaaggcatcgacgcgctccccaccgtctccttcgccgcggcagcttcgtcgtcgtcggagtgcgcgatatcctgggcggagttcgccgacggagagccgtgcgcgtgctcccgggatgcggcacngcttcacgtcgcctgcgtcnaccctggtccggatcgcgcaantgccgtctgccgggcgcatcgtgcacccatgagatcagtaaagcancgggggccacntggatntcttgangagtaaacnccganantgcaagtaggnccgg

SEQ ID NO: 9458 - DNA, 829 bp, Triticum aestivum
  Predicted polypeptide sequence is orthologous to G546
tttttaaccgccacgtcgactagggcctatcccaggtgagttagtataacaagtttgtacaaaaaagcaggctggtaccggctccggaatcccgtggatatcgtcgacccacgcgtccgcggaaaaaaagggccacctgtaaggccgtgtagaactccctctcccggcctgtggcctccggacaaccagtcaaccagagaggagagcgcgtcgcgtcgcgcgcacgagcaggcgccggaaacatggccacggcggcgcacgcgagacggctggcggcctcgcgcgacgacccttcggccgccccgacgtcagggaggtcccagttcgacctctcgtcgggggcggccaccgccgtggtgttcctctccatcatcctctgcttcatcctgctctgcacctactgccgctgcgctcggcagcgcgccaccgcggccgcgcgcggcggccgcgccatgcgccacggcttcccgagcgccctcctccgcccggccgacggcgcggcgctgcccgtggtgcgctacgccgacgccggcgccggcgccaagaaggggcagcagccggagggggactgccccgtctgcctcgaggccttcggcgacgacaacggcgtcaaggtcgtcccggcgtgcggccacgtcttccacgccccctgcatcgaccggtggctcgacgtgcgcaactcgtgccccgtctgccggtgcgtcgtggtcttgcactacgccgaccgcgcaggcccgggtgccggcgacgacggcgaccaccaggaggtcgtcctggagcgcgtggtcgccatgatccaagctataagaaaagaggaggcggtgcgagg

SEQ ID NO: 9459 - DNA, 692 bp, Triticum aestivum
  Predicted polypeptide sequence is orthologous to G550
cgcgttgcgtgagctctcccatatggtcgacctgcaggcggccgcactagtgattggaatgggtggggtggggaagacggaaggttttgcgcgttggttgtatcgaatttccctttctaatagcatacacaaatagataagaaagttacgacgatgaaaaaggtaaatgaaaaccttttgatttaccttaccatcagttctgtcttatctctgtgcctcctctagccatttcataattggatatcgtcattcaaatctgttatgacaactgtttggtaagcagggattcgaatcaaacaataaataccaactctaagtgtgatggatagtacctggtgcctaatttcatggtatctttcttggcgcctaccacgggtaaaacccctccttcttttgggaggaaatcaaatgagtaaaggtcttaccaactcctcccattccaatcccgcggccatggcggccgggagcatgcgacgtcgggcccaattcgccctataggagtttcggtattaaccttttcgtgtgctatatttaccttttatttttctttttctccgtttttggtgctcaaagtcgcttgtgagtgagggggggcatgaatggcataacggcagcaccgcaaaattatctatatatattttattatatatcattttgtagactgtaggccgcggtaggggtgtgggtcaaat

SEQ ID NO: 9460 - DNA, 901 bp, Triticum aestivum
  misc_feature (834)..(834): n is a, c, g, or t
  misc_feature (873)..(873): n is a, c, g, or t
  misc_feature (881)..(881): n is a, c, g, or t
  Predicted polypeptide sequence is orthologous to G550
aacacccccttagatgattacgccaacgctatttagttgacactatagaatatcaagctatgcatccaacgcgttgggagctctcccatatggtccacctgcaggcgggcgagtagtgattagcgtggtcccggccgaggtctaaatcttgtggttctcagtaaacatgccatgttcttgtggccattaagcagaacacctgtatgcattaagcaatgctattaacaattattatcattgtacaaccaaacacatgccgacggtctgatctgaacccggtggagtgttagaggctctacaagaaaattacagggtaaaaaacaacaccactatcccaatagtacagttgcacaacatctacatcgccgatcagtgctcagacaaccatcattttcttgatatagcatgcttgaagaaaagtaaaaacacgacaggagtttccgtatcacgtcgtctcctggaaggacgcaaagcgggattgagccgcggggttcgcttgcatgacgcgggctgcgttcgacatttgctccctgccaccagatttcggctggaacgctctaaacatgccacgctcgccaggttcaatcccgagggtggtccagatcgaactctttgcagcttcgtcggggtcatctatccggagcgtcttcggaatccacaaggatctttctgccttttgcccaccttgcggttcagaatctctcgggtgttttccgaggactggagaacactatctgaacatgcactactgcttgtgggaggtgctgctgacatgttataagcaggtccaagccacggcgcgctccacgcacccataggccagggagaaaccantggccagatggaaggcggcattacgggaaaggaatgggntggcacanaatcctggatcggcacattg

SEQ ID NO: 9461 - DNA, 1110 bp, Triticum aestivum
  misc_feature (825)..(825): n is a, c, g, or t
  Predicted polypeptide sequence is orthologous to G550
acccacgcgttccgactccacttgtcggatcttgccccatatggagctcgccggagccgcacaccctcagccgccggagtccgacgtggcgccgccccgtacgcctccgcaggcgccggcagaggattcatgcaaagatacaggagacacaaggatcactgaggaaaattcatgcacaccgccggacttaaatcttagtcaaccaaataattctggccttaatagttcgagtgcgtgtgagaaccagacatccaacggtgatgagatgactgaaccagaatccacactggaagcagctaagaccgagggtgatggatcaaacaaagagaaggtcctaaagaagccagacaagattctgccatgtcctcggtgtaacagcatggacacaaagttctgttactacaacaattacaacatacaccaaccaaggcatttttgcaggggttgtcaaaggtattggacggcaggtggaagcatgagaaacctccctgtcggtgctggtaggcgcaagagtaagagctccagcacaaactgtaacggtatattgattccaggagacagtctatccgctcctggaggtgatgcttccgtcattccattgcctataaaggaaaatcaaccagcagttaagtttgggtctgattcaactctacctaactccatggcttctttgttgagagttgaagagcagaataagaacagcaaccctgcgtcaacagcacatcccagaaatggtgagaaccagacctgtccaccttcagcaacaacttctgataatccacggattgagtcagttaaagtagcagttggggtacatcaaaatgnaattaccggggattgcaacggggtcactcccatgccctctataccctgctttcccggtgccccttttatgtacccatggaatccagcatggaatggtgttcttgccatggcagaaccagtgtgcccagtccaagcttgacccgaaattgttcagaaaatggccatggaagtaacattcatgggaacttccaccaatgtgccgattccaggatctgtggccccccattcttttcctgtaagccgccttcatctgcccatggtttttcctggcctatggtgcggtga

SEQ ID NO: 9462 - DNA, 2204 bp, Triticum aestivum
  Predicted polypeptide sequence is orthologous to G558, G578, G629, G1198, G1806
gaattccggcgacggcggcagtctactaccccgtagttcggatagaggcccctcttcctatcgagtgtttaggcatatatctgcagctttgtcacaacaaaggaatctctctgggagttacattgagcactatgaataatctgcaatggcagaggccagccctagaacagaaacgtcaacagatgatactgatgaaaatcttatgcttgaaccagggaatgctgctcttgctgttgtttctgactctagtgacagatccagagacaaaaacggagatcaaaagacaatgcgtcggcttgctcaaaatcgcgaggctgctaggaaaagtcgtttgaggaaaaaggcatatgttcaacaattggagaacagcaggctaaagcttacccagctagagcaggagttgcaacgagctcgtcaacaaggcatttttatatctagttcagcagaccagtcccattccatgagtggaaatggggcgttggcttttgacacggagtacgcacggtggttggaagaacacaatcgacaagttaatgagctgagagctgcagttaatgctcatgcaggcgatactgagctgcgtagtgttgttgagaagatcatgtcacactatgatgagatttttaagcaaaaaggaaatgcagccaaagcagatgtctttcatgtgttatcaggcatgtggaagacaccagctgagaggtgtttcctatggcttggaggtttccgaccttctgagcttttaaagcttctttcgacccagcttgaacccctaactgagcagcagctgtcagggatatgcaaccttcagcaatcatcacaacaagctgaggatgctctttcacaaggaatggaggctcttcagcagtctttggcagaaacgttggctgggtctatcggctcttctggatctggatcaacaggaaatgtggcaaactacatggggcaaatggccatggccatgggaaagcttggaacccttgaaaatttccttagtcaggctgacaacctgcggcagcagactcttcagcagatgcaaaggatcctgaccacaaggcagtctgcccgtgcacttcttgtgataagtgattactcatcccggcttcgtgccctaagttctctttggcttgctcgaccgaaggaataacaagcgcgtgtgatttgactgcaatacattttcgcaatttgggggtgatggtggtggcagtcatgcaacagacttgattcagagaaacttgcacatactataatccaaagagatgctgtgttcaggtagcttagccatatagtgaagttgagtgcattagggaagggtccttgttgtaccgttaaccgctgtaaaattggcatctaatggttgccaagtaatctttaagatactaatttgcagagagccatccctttagatgtgcatttataactcttttgttgctaatcggaaaaaaaaaaggaggaagagcgagctaggcaagaggctatcgcgaaaaaggctgcagaagacaacaaggatcagccctcaagctctaccgatgctattatggctgaagcggaacttaccttaaatgctcctgctgatcttgacgcagatctactcaaggatgatgatgatgctcagctactacagcaagcacttgctatgtcaatggatgagggtgcttcaggagctgcagccgtggctgatgctgctatggcagaagctgctgcagatgaccaggatttggcattggctcttcaaatgtctgtccaggacgctgaggcggctggtcaatctgatatgagcaaagtgtttgaagacagatcatttgtgacatccatccttaattcgcttcctggtgttgaccccaatgacccatctgtgaaagatctactggcatctttgcatggccaaggagagcaggaggagaagaaagataaggaggacaagccagacatttctgaagatgggaagaactgaaggcaatgaacatctattttctcggaaaagtgcaggcgcatgaagtgaagaagattgcctgcattagctgcttttacactcgggctctatgaatttacttaatcctcttgtaactgcgttgatgataactgccgagagaacttgtattatgtctgctctcacgaatgctccttcatgtttgtcttaagtgattacatgttgcaaattcatttgtacactttatgtctgttgaaggtgaaattgaacggaattc

SEQ ID NO: 9463 - DNA, 1505 bp, Triticum aestivum
  Predicted polypeptide sequence is orthologous to G558, G578, G629, G1198, G1806
tggagagtaggcgaggaggaggagggccggcagcggccgcagcggcggcgggcgacccgcgcgggccgatgccgggtttcggggctcctcagcacaccatcccaacaaatgtgaacgtcatgcagccttctcgagttgctgatttgggggcgctcgcccactctgctggattcagaatagaagatctcgctaatttcagtacaaataatttattcaatctgaagccaaatacacatgcatataccagtgacccccttcagtttggaaattacggaaagtccatttctccgactgatctagctactacggcggcggcagcagcagcggtaacagcagttgatcctcaggccctactacagcaaaagggagtgcaaccaaatctagtagctttaagaactcataacaatgataactggggagagtcaagtatggctgatacaagtcctaggactgatacatcaacggatccggatatagacattgatgaacgcaaccaaatgtttgaacaaggacagcttgctgcccccacagcttctgattctagcgacaaatcaagggacaaattagatcataagtcacttcgccgtcttgcccaaaaccgtgaagctgctaggaaaagccgtttgagaaagaaggcatatatccaaaacctggagagtagtagattgaaacttactcaactagagcaagagcttcagcgtgctcgtcaacagggcatcttcatttcatcttcaggggatcagtctcagtcagcgagtggaaatggagctgtggcatttgacatggagtatgcccgatggttggaggaacataacaagcatataaatgagttgagggctgcagccaatgcacatgctggcgatgatgatcttcggaaaattgttgatagcatcatgtcgcagtatgatgaatttttcaggctcaagggtgtagcagccaaagcagatgttttccatgtgctgtcgggaatgtggaagacccctgctgagaggtgcttcatgtggttaggtggcttcagatcatccgagctccttaagttactggcaggtcaactagaacctcttactgagcagcagcttactggcatatgcaacctgcaacagtcttctcaacaagctgaggatgctctttctcaagggatggaggcattacaacagtcacttgcagaaaccctagcatctggatccctgggccccgcaggatcttccggtaatgttgcaagctacatggggcagatggcaatggccatgggaaaacttggcaccctagaaaacttcctccgacaggctgataatctgcggctccaaacccttcagcagatgcaacgcatattaaccactcgccagtctgcacgagctctgcttgcgataagcgactacttctctcggctacgcgctttgagttcactttggcttgcccgtccacgggaataaattgaatcgattcataaatagcataataatattaggtactgcatcttgagtgttgcattagccagccccata

SEQ ID NO: 9464 - DNA, 596 bp, Triticum aestivum
  misc_feature (13)..(13): n is a, c, g, or t
  misc_feature (47)..(47): n is a, c, g, or t
  misc_feature (52)..(52): n is a, c, g, or t
  misc_feature (68)..(69): n is a, c, g, or t
  misc_feature (89)..(89): n is a, c, g, or t
  Predicted polypeptide sequence is orthologous to G558, G578, G629, G1198, G1806
atacaatacgatnaacactaatgacaaacaattacacatgatatatnccggntcaccagcgctacaanntctccctgttttcttatagnaatttcatcgctacaccatcatcatcatcacaccaaaacatgtatttacacatccttgatcccttgacccggccacctgatcgaccttaattaccctgttttactctgtcatcgtccggaaaacatgcaagcacgcacgcacctacggcgcggctctgaatgcctacctcttctcccttggacccagcgagatggatctcttcgtcctccgctggccagcagatggatggattactacgtacgtacgtactaacttcttctgcgccatcatcgatctctctctgcttccgccattgctacgtgatcgagcacagtttagcttatggcggactcgcgcgggcgggccgcccagagcgtgctgagcgcgcgaaggcgctggaagtagtcccccagcacgagcaggcccttggccgcctgccgcgtcgtcaggatcctgtgcatgttctgcagcgtctccagccggagatggtccgcctgctgcacgaagccgacgaggcccttgagctt

SEQ ID NO: 9465 - DNA, 607 bp, Triticum aestivum
  Predicted polypeptide sequence is orthologous to G558, G578, G629, G1198, G1806
tttttttttttttttttttttttttccaaattctgtcagatagctcacctattcaattcaagatattttggtagtggtgcatggtagaaggtgttcttacaaaatgcagccagaagtaatgaaaataacacaaattgacaataatgaactctgggtgtcctccatttgttctcactccaggatacattaaaccatttgactcaagaaaatctgatgacagttgtacgcattctgacaagttctcccatttctggagcttcctttgtttcccagctctctgtttctcacatatctgctacattacatccaaaaaatttcttcccagttgttttgcttatgctcctactttgaaggttagttccaagatacatttgaatcagtaggctgaatattggctttcagctggatgtgctgcaatgcttagctctccacaattgccttcatctgtcatcagtatctctcgagggcgagaacccagagggagcttagggcacggaggcggttatggtactcgccaatagccaagaaacatcgagctgcctgcctaactgtcagaatcctgtgcatctggtgaagagtctgctgcctcaagttatcagcctgtatg

SEQ ID NO: 9466 - DNA, 758 bp, Triticum aestivum
  Predicted polypeptide sequence is orthologous to G558, G578, G629, G1198, G1806
ccacgcgtccgttctcgaagcttccccgattcgccgccgctccccccaccaaatccccgacgccgcgagccggagctgctacaggaggaggagtcgccggcctccgggcagaagccgcgcgtgaggccaggccgtaccggattcggtgctgcggctctgaggctctcccccatccatccccggcgggggcccgagggccgaccacctaccatggccgcggcccgccggcgccacgccgagccccgctcaggacgaccgcgccgaccgcaccccaccatacggttgtagtaaatcctcggcagctactgacttgggctcttggagagaaattctggcaacgatcgatctcgcgcagcaaagggctgggctcaccgctttgctgttaggaaggggggagcaaagtgatttgctgtctccttgtgattgtggtccgctgagtgatggcagatgctagctcaaggactgacaactcaactgttctagacaacgacggcaagatctataggttagaacaaggacaaagtggtggggcaatcatggcttctaattcttcggataggtctgacaggtccgacaaacccttggaccaaaagacattgcgtcgtcttgctcaaaatcgtgaggctgcaaggaaaagtcgattgaggaagaagtcatatgtgcaacagctagaaagcagcaagctgaagcttgcacaactagagcaggagctccagaaagctcgtcagcagggaatcttcatttctagctccggagac

SEQ ID NO: 9467 - DNA, 865 bp, Triticum aestivum
  misc_feature (22)..(22): n is a, c, g, or t
  misc_feature (521)..(521): n is a, c, g, or t
  Predicted polypeptide sequence is orthologous to G558, G578, G629, G1198, G1806
caaccccccctgcggtagtggnctttcatacgacgttagattgggaccactttgtacaagaaagctgggtacgcgtaagcttgggcccctcgagggatactctagagcggccgccctttttttttttttttttcaaaaatggtacgaacttgttcgatagttgataatctgatgtcatctacaggcagcaatatccactgaacatttgctgtaaacattcatcacatgattctgatccaaacttctcgccaatacaagaacattgtgaagaatctagggagtagggaatacctgaattcctatggggctggctaatgcaacactcgagatgcagtacctaatattattatgctatttatgaatcgattcaatttattcccgtggacgggcaagccaaagtgaactcaaagcgcgtagccgagagaagtagtcgcttattgcaagcagagctcgtgcagactggcgagtggttaatatgcgtttcgcatctgctgaagggtttgtagccgcagatatcagcnctgtcggaggaagtttctagggtgccaagtttccccatggccattgccatctgccccatgtagcttgcaacattaccggaagatcctgtagggcccagggatccagatgacagggtttctgcaagcgactgttgtagtgcctccataccttgagaaagagcatcctcagcttgttgagaagattttcggaggttgcatatgccagtaagctgctgctcagtaagaggtctagtttacctgcccagtaacttaaggagctccgattattctgagaccacttaaccaattgaagcactcttcagaggggttttccccattccccggaaggcaatggaaaactctgc

SEQ ID NO: 9468 - DNA, 850 bp, Triticum aestivum
  misc_feature (19)..(19): n is a, c, g, or t
  misc_feature (39)..(39): n is a, c, g, or t
  Predicted polypeptide sequence is orthologous to G558, G578, G629, G1198, G1806
ttaaccgccgttcgttagntagcttccatacgagttagnatagggaccactttgtacaagaaagctgggtacgcctaagcttgggcctctcgagggatactctagagcggccgcccttttttttttttttttttttttttttttttttttttttttttttttttttgaatcttaaaacatttcacctcgtcaggcggtatgatttatttaggcgattatacaccacaagaacatcacatcataggatctcaaattattctgcaagtttttacatccccattttttcaaaaatgctacgaacttgttcaatagttggtaatttgatgtcatctacaggcagcaatatccactgaacattcaccgtaaattttcctgacatgattctgatccaaactgctcgccgatacaagaacattatgaagaatctagggagtagggaatacctgaattcctatggggctggctagtacaacactcaagatacagcacctaatattattaattatcctatttatgaatggattcaatttattcccgtgggcgggccagccaaagtgaactcaaatggcgtagccgagagaagtagtcgcttattgcaagcagagctcgtgcagattggcgagtggttaatatgcgttgcatctgctgaagggtttgcagacgaaaatatcaccctgtcgtaggaagtttttttgttgggtgtccaagttttcccatggccattgccatctgccccatgtactttgcaacatttccggaagaattcttagggccccggggttccaaatttccgggttttcttcaaccaaattgttgtagtgcttccatccctttaaggaaggacattctt

SEQ ID NO: 9469 - DNA, 365 bp, Triticum aestivum
  Predicted polypeptide sequence is orthologous to G558, G578, G629, G1198, G1806
caatctgaggcagcaaacgttgcatcagacgcgccggattctaacaacccggcaggcggcccggtgtttcctctccattggggagtactaccgccggctccgagcactcagcagtctctgggcttcccgtcctcgcgagaacttcatcgggactgagagccttagcccaacaggaacggagctacaaggaatgcagcaccaccaccaaccgcaacagaatcagttctccggattttgaggcttctcctggagggtgtaacgtaggggtcagtgatgttagaaagagaggagaagacaacgagggactgtaatgttctatcattgattaaagtatttgagaaagcaacaaaaaaaaaaaaaaaaaa

SEQ ID NO: 9470 - DNA, 849 bp, Triticum aestivum
  misc_feature (653)..(653): n is a, c, g, or t
  Predicted polypeptide sequence is orthologous to G558, G578, G629, G1198, G1806
acgcttgaccttaggcctatttaggtgacactacagaacaagtttgtacaaaaaagcaggctggtaccggtccggaattcccgggatatcgtcgacccacgcgtccgatgccatgagtggaaatggagcaatgactttcgatctggaatacactagatggcttgaggaccaaaacaagcaaatcaatgagttgaggactgcagttaatgctcatgcaagtgacagtgacctgcgccttatcgtagatgggataatggcacattatgatgaaatatttaaggtcaaaggtgtcgctgccaaggctgacgtgttccatatactgtcaggcatgtggaagacgcctgccgaaaggtgcttcctgtggcttgggggtttccgtccatccgagctcttaaagctcctggtgaatcatctggagccgctaaccgagcagcagatgttgggattgaccaacctccagcaatcttcccagcaggcagaggatgcactgtcacaaggaatggaagcattgcagcaatcactggcagagactctggctggatctctgggttcctccgctggctcttcggggaatgttgcaaactacatgggtcagatggccatggccatgggcaagcttggaacgctcgagaactttcttcgccaggctgacnacctgcgacagcagaccttgcatcagatgcagcgaatcctgactatccgtcaggcctcccgcgccctcctagccatacacgactacttctcgcgtttgcgcgcgctgagctctctgtgccttgctaggcccagggaataaccaaggatcatcgctcgccggattcccccctaactgatgtgacaccgctgggggtg

SEQ ID NO: 9471 - DNA, 1109 bp, Triticum aestivum
  misc_feature (675)..(675): n is a, c, g, or t
  misc_feature (803)..(803): n is a, c, g, or t
  Predicted polypeptide sequence is orthologous to G558, G578, G629, G1198, G1806
aagcaggctggtaccggtcccgaattccctagatatcgtcgacccacgcgtccgcgaaaaagtcgtctgaggaaaaaggcgtatgtacaacaacttgagagcagtaagctgaaacttgcaagcctggaacaagaactccagaaagctcgacagcaaggaatcttcatttctagctctggggatcaaactcatgctatgagtggaaatggagcgatgacatttgatttagaatatactcgatggctagaggagcaaaataagcagataaatgagctgaggactgcagtaaatgctcatgcaagtgatagtgacctccgtcttattgtagatggaataatggcacattatgacgaaatattcaagctgaagggcgctgctgcaaaggctgatgtgtttcatatactttcaggcatgtggaaaacacctgctgaaaggtgttttttgtggcttgggggttttcgttcgtctgagcttctaaagctccttgtaaatcagctcgagcctctaacagagcagcagttgatggggttatccagcctcgagcaatcctcacaccaggccgaggatgcactatcacaaggaatggaggcattgcagcaatctttggctgaaacgttggctggttcccttggtccatcaggatcttcaggaaacgtggcaaactacatgggtcanatggctatggctatgggaaaacttggaacccttgagaatttccttcgccaggctgacaatctacggcaacaaactttgcatcaaatgcaaagaattctgacaatacggcaagctgctcgagctctccnttgcatacatgactatttttcacgtttgcgtgccctgagctctctctggctttgcaggccacgggagtaaaacatgtgcgccatcttttggcgcctcatgagctgatccaggaaatgtggacaaaatgcgacgcatttgcagaagattggggttcagttccctctgaaaataatttgacaccttgtgttctcatattgtacctcgacgttgtacaagtagccagggagggggtaaggcttgtacttgtaatttacatgaattttatgattggaaatttggtaaaaaaaaaaaaaaaaaaaaaaagg

SEQ ID NO: 9472 - DNA, 1117 bp, Triticum aestivum
  Predicted polypeptide sequence is orthologous to G558, G578, G629, G1198, G1806
cgtgcgacccacgcttccgcccttctgaccaacccggccgcccccagtttcttctcctcttctctctccgcgctgccgtcccgaccccgtcttctgctcctccgcttcacgcggcgccggccgccggccgccggccggcctccctccaaatccgtacgccgagcgggccctccctccctttcgacctcctcccctgccgcagacactgccccccgtgatcccgtgcctacagataatttgactctgaaaaggtgacggctctggcctcggagtgatctgacacataaaggatacaggcgcccttattaccctgcttgaactaaaggggcaacaaagcgatttgttgtcctgttgttttgagctggaaaacccccggtatggctgatgctagttcgaggactgacacatccatagttgtggacactgacgataagaatcaaaggattgttgtacacatttgctccagtgcctaaagaaacaacacacttcttaaattagatatcaacttgcaaaagtgaacaggactactgctgctgcactatcagtttcatcagatggaaaacggacaaaatggagctatcgtgccttctaattcatctgaaccatctgacaggtccgacaggcctatggaccaaaaggtattgcggaggcttgcccaaaatcgcgaggcagcacgaaaaagtcgtctgaggaaaaaggcgtatgtacaccaacttgagagcagtaagctgaaacttgcaagcctggaacaagaactccagaaagctcgacagcagggaatcttcatttctagctctggggatcaaactcatgctatgagtggaaatggagcgatgacatttgatttagaatatccccgatggctagaaggaccaaataagcagataaatgacctgaggactggggtaaatggtcatgcaagttaatgtgacccccgtcttattgtaaatgggatatgggccattattaccaaatatttagccttaggggcctctgcaaaagcggagtgtttcaaatacttcagggctgtgaaaaaccctcttgaaagggtttttggggctgtggggtttccgtcgccttaacctttaaaccctctttaaataaggcgagcccttaa

SEQ ID NO: 9473 - DNA, 547 bp, Triticum aestivum
  misc_feature (8)..(8): n is a, c, g, or t
  misc_feature (522)..(522): n is a, c, g, or t
  Predicted polypeptide sequence is orthologous to G559
gcctgttnttttccctaaatgccaacgggcaaaccatcagtgtctgagtttagttaacaacaacaacaacaacaacaacaacaacatggagtatgcccataactggacgcaacaatgcatcttctaccggaccaaaaccaaaaggttcaacctagaattcccaaagtgacttccttcaacaactacagacaaacgcttcccacgacactgtcaacacctgtgatcgatcgtcccaactgttcaattgaaactaaaaaagccaacaccaaagccactacacctgcgcattatcatcatcatcatcatctccagacctagttgtttcagatgccgccgcttcccgacgacttcccgtcaccccacatcggctgctgctgctgctggggctgtggatggagctggagctgttgcagctggtgtgtcgctagcagagactgcatggactggttgttgtggaacatctgctggttgcttccgaattggtgtggcgcctgtgacatgccgccatagttcatcagcatncccccaccgttgcccgtctggcctg

SEQ ID NO: 9474 - DNA, 837 bp, Triticum aestivum
  Predicted polypeptide sequence is orthologous to G559
tagggcctatttaggtgactccatagaacaagtttgtacaaaaaagcaggccggtaccggtccggaattcccgggatatcgtcgacccacgcgtccgagcccaaaccaccctcgcctctcgctcccattccccttgcccagctccgtgttcttgcgacccagctcctagatcttcctccccctttccctcgcaagaatttccacccgatttccgcgctctggtcgctcttcttttagccaagaatttcctccgattcttttccagcgtaatcttagttctgagccgtatgtgttgttttcttggctgaagcttgattagctccgtggacttgcaaaaaggcggcgcgtttgaggagattcggcggggccctggtgccgggaagatgaacaaggacaggtcccggatctcggcggacggcggcggcggcgacggcctgccgccgcagccgtcgcgccgctcggcgactcccccgccggagtacgacatcagccgcatgccggacttccccaccaggaaccctggccaccggcgcgcgcactccgagatcctcagcctcccggacgacctcgacctctgcgcgcccgggggcggcgacgggccctcgctgtcggacgagaacgacgaggagctattctccatgttcctcgacgtggacaagctcaactcgtcgtgcgggccgtcgtccgaccaggcggagtcgtcgtcagccgctgctgccggcgggggcgaagcggcccaggcgggccacgtgatgaggccgaagcaccagcacagccagtccatggacgagtcgatgtcgatcaaggccgaagacctggtggggcgcccgggattga

SEQ ID NO: 9475 - DNA, 644 bp, Triticum aestivum
  Predicted polypeptide sequence is orthologous to G561
tttttttttttttttttttttaagaaaataaataataactttattattgcctctagggcatatttccttcagtatctctgtcccaggggccacagcaaatccaggcgggccagcgcacacaccagggcttggggcggtccaagaatacgcgggcggtgcactcccggacggcacattagttgccggggatctggggatatcagatacctgcaagggaacaatcgaaaagaatgttagcaaccatgtagaatctagcatttaagacgatttgtttacctcgaagcctgcatccactccgttcttcgctgcgtgcttgcggatctgaagcttcatcgacagatcggagtacgacgccatccgaggaagtggtagctgctcacacccttccatgccatgctcatggtagtcacagaagatgatcttcaatttgtatagtcaattaaaccaaatgaaatcagtgaccatttcgcataactcgcatgcatgtgctagtaaacgaacggattttgcttggctaacctgaggaacaatgaggcacccctgaagagaaagctgaggtgggtcatgcaacaaatcatccctcagttttgctgcagcctctctcaacccctccactacttagtcacacaaatcatattccgata

SEQ ID NO: 9476 - DNA, 663 bp, Triticum aestivum
  misc_feature (415)..(418): n is a, c, g, or t
  misc_feature (630)..(632): n is a, c, g, or t
  misc_feature (638)..(641): n is a, c, g, or t
  misc_feature (661)..(662): n is a, c, g, or t
  Predicted polypeptide sequence is orthologous to G561
ccacgcgtccgggacctcacacccaccccctctctcctctctctctcgtcgagaagaaagaaaggaagcgaaagctctagtctcgccacctgcacacagaccgctcgtgaggcgagagagaggccgaggccaccaaaccaaaaaggaaaagaatttttttcttggagaagaacaccgtacgcataagcatcgaggagggaggcgggggcatacaggagagggtggaagggaaacctagtcaaacagagacggatctgccctccgccgccgacgccgacgccgacaacgatcgcctggtacggagatccccgccaactcacgactcttcctgcctgcctgctacgaaccctaggacccgccgtcacgcggtttcgatacgaattgaacgcggcggcggtcgaatgacgaaaccctnnnntgggatggatgcgcgtgggtgggaagagccctttttttccttccatctctctccaagttaggcaggcggggcatgggctgctgcctaattcggacattaactgtgcgatgtgggtttgccgaatccgggttcccgtctcagattcccaggttcgatcttgatccccagctatccccacctgcctctgccgtcctcgaatccttcgtcgcagnnncgccgnnnntacctcttcttgccgcgatnng

SEQ ID NO: 9477 - DNA, 1123 bp, Triticum aestivum
  misc_feature (675)..(675): n is a, c, g, or t
  Predicted polypeptide sequence is orthologous to G561, G562
tcatgctccaacgcgtccccgagctgaggatatggtcgacctgcaggcggccgcactagtgatttcgagcggccgcccgggcagcatttgatagtgttcttttggtgcaggctgagacagaggaattggccacacaagtagaatcgcttacagctgagaacacgtctctaaaatctgaaatcggcaagctaacgaaaagctccgagaagctcagaatagagaattccgctctagtggtgaaacttaagggcaccgcagcaccgaccagcgcagaaatgcctctggacaaaacagcagttgctgcaccctcctcctctcctcgtgtcgtggagaatttcttgtcgatgattgacgacacaagcaagtcaggtgtaaaaaatcacatggagcacagcgagcccaagctccgccagctcctcggctccagcgcgacaacggatgttgtggctgcaaactgattgatcagcctctctctggcgcagactaataccttgcatgcggcctggggtttcagcaagctcatgctgctcacataacatatcggcgtgacagtgtaggtatttttatttggtgagtatattcaggaactccggcggtcatatctactccgtattccggttcccgacggctactgtactttaggcactgatgctgaagtctcggtgtgtccatgtntacactgtaattttaatgagcagtgttgtaatataggggtgttgcgcttcatgccaacctttctaaaaaccttttgagaactccaaaaacctgcccgggcggccgctcgaaatcccgcggccatggcggccgggagcatgcgacgtcgggcccaattcgccctatagtgagtcgtattacaatccactggccgtcgttttacaacgtcgtgactgggaaaaccctggcgttacccaactttaatcgcctgcagcacatcccctttcgccagctggcgtaataacaaaggggccgcaccgattgcccttccaaacagttgcccacctgaatgcgaatggccccccccgttacggggcataaggcgggggggtgtggtgggtaccccccaggggaccgttaacttgccagggcccatagccccggccctttcggttttttccttccttta

SEQ ID NO: 9478 - DNA, 649 bp, Triticum aestivum
  Predicted polypeptide sequence is orthologous to G565
gtcgccctaactttgaaacacacacaacacatgggaaatgaacccaaacaaactacctaggtccctacaatcaaacaacaccagataaatagaaagaattggataaaaaaaatatgcctagcagggcgacgaaagcagtttgaggatgtaagactatgaacatataaatctaaatgacaggagtgcttgtttgcaggtaggtccataattagaaggtgctattactttcacctgcagatatggagctaccctctgacttcgcagcagcatctgcctccaacttcacagccactgaacctttgccaatgtccagcccctggaaccgcccaagagagtcttgctgcatcatatctgggaacgtgtttgggtgggatagcatctggtggcttgggacattgggatgaggtggttggaattgggatggcagctgatgaacacttgaatggtgctgaggtgtgtgttgctcggaaagctggaagaaagacgggttgtatggaacatgatgcattcccgtattatatgcttcatcaggctttgtcatctcacctgtagcgatcttaagcctctccagttcctgcttgagtgtattattcagagcatcacgcagttgagcttgctgttccatggcctgcaacctaatcttgagctc

SEQ ID NO: 9479 - DNA, 544 bp, Triticum aestivum
  misc_feature (431)..(431): n is a, c, g, or t
  Predicted polypeptide sequence is orthologous to G565
ttttttttttttttttttacaaaaatcagcaactgggattacaacgaatttcaactaaaatggaacaaatggaatgaaaaattaagtttacaggaccagaaacagcacaaggatgtcagaggctatgaacaaaggaacctaatgaaactgagaactcgatcagggtaggcataggcctggttagaatgtactgctgctttcgctggcagagatcgagctgctctctgacttcacaactggatgccctttgctgatgtccaaaccctggagccgtgcaagatgatcttgttgcatgatatctgacagcgtgtttgggtgggatagcatctgatggtttggtacattaggatgaggcaggtggaatgggggtggaaatcgggcacccccctggtgctgggctgtgttttgctgggactgtgggaagaaggacnagttgtataggacatgttgcaatcccacgctatatgcatcactggaatttgacatctcacccgtagccatcttgagcctctccacttcctgcttcagtgcgtcattcaaagct

SEQ ID NO: 9480 - DNA, 852 bp, Triticum aestivum
  Predicted polypeptide sequence is orthologous to G565
agctatgacattaggcctatttaggtgactctctagaacaagtttgtacaaaaaagcaggctggtaccggtccggaattcccgggatatcgtcgacccacgcgtccgtcaaactccggttgcagtccatggaagaacaagcgaaacttcgagatgctctaaatgatgccctcagagaagaagtccagcggcttaagatagcggcaggtcaagttccaaacatgaatggaaaccccttcggcggagggctgcagcagcatcagcaacagcagcagcagattccgaactatttctcgcagcagcagatgcactaccaaggtcatccgcatcaccacccccaaaaccactcccagaattcttcgaatggaggccagtcgctgagtggtcagtctctaagcgactccatggatttcatgtgaggagtctctgggcaacctcggggcgcataccgaccacagttcggtagctgtaaagataactgatgtatactgtatgcacatgaatcattcgtagggtagctagatgttctttgtaccattaatcaagaaaattcatccgtgtgtgtcgcagttgatcatctctttcttttggggttcatgcatgccttagcctgaagtctgaacgaaccatgcttgacatgttccctgtagttgtcaccctgtaaaggtgttatagtgaatgggatggtttctgggtggaggtcaaaaaaaaaaaaaaagggcgggccgctctagagtatccctcgagggggccaagcttacgcgtaccccggctttccttgtacaaggtggtccctatagtgagtcgtattataagctaaggactgggccggcctttttaaaacggcgtgaat

SEQ ID NO: 9481 - DNA, 652 bp, Triticum aestivum
  Predicted polypeptide sequence is orthologous to G568
tttttttttttttttttttttttttgaagtaaaattagattcttatttagaaatacaatacaaaatgtggatgctcgtgtaggcacacatacacttattcggttgaacacacccactcagacaccatccatctaaacagctcgagagagtgtgagtatgatcagaagtcacaggtagctactctcattagtcaagtgctctcagcccgaaggcaacgtacgtacaaggagctgtatcgtacatttgcacatacaatacaaatccctattcgtacgtagtgataaacgtgcatgtgctgtgctgaaaaagattgtgagcgttaatacgccatctgcagggacttgacccagtcccagtcctcgtcggactcgagaaacgacgctaaggctcttacgtcgtccatccagtcgccaccgcccgacgatgccaccaagctgctgccgctgcactcatctgcgtctcctcccacggcccgcgtctccatgaccggcgggggcggcgcatcccggctgaggaagagaccgcctgtgcacctcacgggcttgggcacccacaccgaggccgacgacagcagccccgcagccttggcacttgtaccatccccgcagttagaggaaagccatgctgtcgacgccccgggtggaggagccgg

SEQ ID NO: 9482 - DNA, 760 bp, Triticum aestivum
  Predicted polypeptide sequence is orthologous to G571
cccgggtcgacccacgcgtccggctttcgcacgtggacccgctgacggagcagcagatcgtggcggtgtacgggctgcagcaatcggcggtgcagacggaggaggcgctgagccagggcctggacaccctctaccaggcgctctccgacaccgtcgtctccgacgcgctcacctgctgctccacccccaacgtctccaactacatgggccagatgggcctcgccgtccacaagctcaccaccctcgaaggcttcgtcagacaggcggagaagctgaggcagcagatgctccaccggctgcaccaggtgctgacggcgcggcagatggcgcggtcgctgctcgccgtctccgactacttccaccgcctccgcgtgctcagctccttctgggtcaaccgcaacaggatggcgccccaggaccagcagctggaggccggccctcacacctagctctcaatcttatcgatccaccaccatgcgtgcctgcgtgcgtgcgtgcatctcgctcatcctatgcatatgcatgcatgcatgcgccggcatgcatgtctctgagaaagttgaaggcagcgcgcggtgaccgtgcaagcttatattagcagtgcagagggggagacaagggaccgtatctgaatgataaccctctaacaaagaatgtcctaccgttgtgtcttggatttggatttattagtagtagcagctagatagtatggtccatcgactcatgtactcctggctgatcgacctgaactgattagctt

SEQ ID NO: 9483 - DNA, 790 bp, Triticum aestivum
  Predicted polypeptide sequence is orthologous to G583
ttcggccgagggcgtgctcgagctcggcgccaccgaggtcatcttccagaccaacgatagcttggggaggatccgctcgctcttcaacctcaacggcggaggagggggctctggatcctggccgcccatcgcgccgccgccgcaggaggcggagacggatccgtccgtgctctggctcgccgacgcgccggccggggacatgaaggagtcgccgccgtccgtcgagatctccgtctccaaaccgccgccgccacaaccgccgcagatccatcacttcgagaacgggagcaccagcacgctcacggagaaccccagtctctccgtgcacgcgcagcagcctccgccccagcaggcggctgcggcggcgcagaggcagaaccagcaccagcagcagctccagcatcagcaccagctccagctccagcaccagcacaaccagggtcctttccgccgggagctcaatttctcagatttcgcgtccaacgcatccgtcacggtgaccccgcctttcttcaagcccgagtctggtgagatcctaaactttggcgctgacagcaccagccggaggaacccttcgccggcgccccccgccgcgacggccagcctcaccaccgcgcccgggagcctattctcccagcacacggcgactgtgacggccccgtcaaacgacgccaagaacaacccgaagcggtccatggaggccacctcccgcgcgagcaacaccaaccaccaccagaacgccacagccaacgaggggatgctgtccttctcgtcggcgccgacgacgcgg

SEQ ID NO: 9484 - DNA, 700 bp, Triticum aestivum
  Predicted polypeptide sequence is orthologous to G583
ggtcgacccacgcgtccggacgcttcattcccaaatcgaggcgctcaagaaggagcgcgacgcccggccggccgcgccgtcgtcggggatgcacgacaacggggcgcggtgccacgcggtggagatcgaggccaagatcctggggctggaggcgatgatccgcgtgcagtgccacaagcgcaaccacccggcggcgaagctgatgacggcgctgcgggagctggacctggacgtgtaccacgccagcgtctcggtggtgaaggacatcatgatccagcaggtggcggtgaagatggccacccgggtctactcccaggaccagctcaacgcggcgctctacggccgcctcgccgagccgggcaccgcgatgcaaatccggtaatgaccgaactccatccaccaggtagtagcaatgaaaccgtgatcctattactcaccaccgtatgatcggcgtcgtcgtcgtcgccgccgtcgttatagcccgatggacatcgagatggagaaagaaggcgacgatcgtgccatgttgttgttgtaaaatctctctttaggaggatggatggatggatgcatgtgtacatcatcatcatcatcatcatcatcatcatcatcttgttgtgtttttgcaagtagtgtgttagcagaacgaagcgccggatccgtcgttggtaattactgtatctcatgaccctgtgatcga

SEQ ID NO: 9485 - DNA, 871 bp, Triticum aestivum
  misc_feature (618)..(618): n is a, c, g, or t
  Predicted polypeptide sequence is orthologous to G584
aaccgctactttcagttattacgccaacctatttagttgacactatagaatactcaagctatgcatccaacgcgttgggagctctcccatatggtcgacctgcaggcgggcgcgctagtgatttcgagcggccgcccgggcaggtgggctttttttttttttgtttttttttttttttttaagataaaatcctggaatgtataactcatgccgtcagtatgtccaattacgtctcaatagtacaccctcaaatcttaaatataagccgttttccagttcaaattcctaaatataagacatttttgctgttcaaaaacacaggtcgaatacatatcacatcatttgaaaccactctccgattgcgcatgcagacccatctcagtagttggagtattcatgtccagcgatcatagcacatactgtacagagcaagtcctctaactaggccaatcacggcataggtattcggtggtacagtaacttttatttttgttggtcgagcggaatatgctgccattttattacatcaaataccattgcttcatatggtttgactcttcaactactcccgggcgtggggcctgctgatctttactggagttccttcaggtactccgnatgttcagtaggcccctcggccagctctgtccgggacacgctaatcctcgcggccatggcgggcgggaccatgccatgtcgggcccaattcgccctatactgagtcctattccacttaactggccggggttttaaaaccatttgacgtgggatacccttgcgttaccgaacttaatcgcctttgtcaaatccccttttcgcccagtggctttatttctaggaaggcgcgaccaattgccctttcccacagttg

SEQ ID NO: 9486 - DNA, 1045 bp, Triticum aestivum
  misc_feature (33)..(33): n is a, c, g, or t
  Predicted polypeptide sequence is orthologous to G591, G793
tacgccagagcggccgccctttttttttttttntgtagctctccgcatccctcacatacataggggtattgaaagatgtaggagcatgatcaggttattgcttaccatatccttgaaaattaaaagtacctttgaacaaaagatggaaaaggggtagtaggtgacatcatataccgtcgatacaacttccagtggagaggatcctttaggtcttttcctgcctccttgtagttagtggatcagaaccagcagtttttatcttaacactttgataacaggttcatgcatgcctactagcagctgcggggatgggtgttgcagctgctgttactatactaggcagtgttgttgggttcaggcttcactggttggccgtcctgtgaatgttgtgtgtcatagatagccatggcaagggagactggcatcatgcagagagcctttgattggagaaattgcattgcggcaccgatgtcctcgtccatcagcttcgcaacctgtttttccgtgccatccgttgaccacttttcccatatctgctgtttgctcccaccatcgcctgcttcccccttaactgaaagtggaatgtcagaaaccagctgtgcaacagcaccagcaccacccaatctgctcatgcttaacacctttacttgaagcctaaggaacttcacataatccaggatctcatctagcataactgccctatctgtcttgttcgtattggggacaattcctgtagggccctcatcctttccggtatcctctctcttcttagcctctccgcgatgctgtggggatcagtcgcctgaacgggacgcgcccgcaccttcgggctcggggccgggggctgggggccctcaagccggcccgccctgcttcgggttgtggggcgtggaacaatctttgggggaaggttgcttgggccaaaggttcggcggctggaagcccccccccaaaacccgggggaaaaaacgccgggaaattgacacccccccccttccccgggggtttcccggggtttctccccatatccgccccctttgcggga

SEQ ID NO: 9487 - DNA, 1177 bp, Triticum aestivum
  Predicted polypeptide sequence is orthologous to G592
ggccgccctttttttttttttttaaagaaatcccacttaagataccgagtatgaatttgtactaacatcaggttaggacgatgggaaagtagatattcaatactgaggtatgggtaggtggaagaaaatgtctgaggatacaacaggagcataataaataacattttgcttctgtctaacttatgagcacaccatgccctttatttactctaggaatatctcgtacactttagctatttttctaagtgcatgcccattgatccgagtaagccgcttcttcaagggggaagatagaagtatgaggctgtcatgcccactgctgaaattagactggacattattctatagggcttgggacacagaatatccttgtgaccttgtccatgtagggaatgaggtcttgcagcctccttagcctcttattgatccttgttcttctttccctcccaagcgatgttctatgggtcagttgtgcagccacgcttggcgtggactctgcagtcggcggagtcctactacagctgcaggtagtcgtccatgctgggcatgtccaactcgagagggctaactaaatctgggcgtcgatgttgctgaagctggtgaccatgcagacattgctgtcgccgagcacctcggccttcttgctgtcgggcgctgagaacatgatgttggagttggtgtcgtcccaggtgctcatggagaagatcctcaagaggtctctcgagccgttgccggcagcgatgctctcgccgacgtcctgctgcctcaaagaagctccacaaggagcccaacctcctctgtcgtgccatcgcatcgatgttgcctcttcctgccgaatgcagttaccgatttcccatctttctctcatgccacccatgttgcattgcctgtttgtgctggtgtagatgaatttatatccaaccgaacgtcgctagccctagttggatttaccactatcaaatggctgccgctgcaattcttttccggtgaaaattattgtggccgaaacattttctagatgggattggtccccccttaacccaaccttgatttgtaccctcaaggggaaaaccgaactctgatttaaaaatcccgtcttttatatctgaattccaataaacacactcggaaacctgtcactccaagaacccccatcctcacaaaagggccctccggg

SEQ ID NO: 9488 - DNA, 176 bp, Triticum aestivum
  Predicted polypeptide sequence is orthologous to G594
ttttttttttttttttttttttttttttctttgcatgtaccggctattgcgagtattgacgcgtgatgagtgagcgttgacacgtaacatattgacatgtaaccggtgccttctcgatagctcaatgtatcgtccttttctgaagttgctatcagtctataaatagggatcccttc

SEQ ID NO: 9489 - DNA, 610 bp, Triticum aestivum
  Predicted polypeptide sequence is orthologous to G597
tgtagtttgtacaaaacattgaaaagctagtgtcgcaagcataaatagactggaatatttagagatatctactactatctccgtccggaattaattgacgctcaaacggatgtatctaggaagtacagtactactatattggaacagcgatattgattattagaattactgacttccaggtggtggccctcgcagaagcatgctttctctcttcagtttttctgccctgacagtctctaacttgcgcctatcaatactcttctctccaggttcttttggaggtctgcctctttttttaggttgaatatcacctgatgtacttctttgttttgaaagctcacctgatgcagttccatcctttcgaggcctgccccttttcttaggttgatcactaggtttcagacatactagagcattttctcctgctgatgttgacgcctgaaccaaccctgggagtggtaggttgtttgactgttggccatttactgctctaaccaccatctgattgctagcaacattacttcttggtctagccaccttagttctgtagttgggaacaccattctgatgtttgaatttgtccatcacaagtgttttgagcggaatggtt

SEQ ID NO: 9490 - DNA, 901 bp, Triticum aestivum
  misc_feature (845)..(845): n is a, c, g, or t
  Predicted polypeptide sequence is orthologous to G597
acccgctagttagatgattacgccacgctatttatgtgacactatagaatactcaagctatgcatccaacgcgttgggagctctcccatatggtcgacctgcaggcggccgcactagtgattagcgtggtcgcggccgaggtatgaaatttacatgaattgattgaacataaaaacataattatttcgtggcgcctcatagggtcacaagatcatacctaaatacatcatctcaagacaacaataaacaactaactggcacagaaattcaagctgagacgacctacacagcagctgcagttaccactcataccagctacattgctccctaattaaacttctgatttatacgactaaattggagctagttagacagaatgacatttctacttcctgccagggaggcagttcaccgacagtctatcgatgtccgaattcggtcaaggatgctgagttcatttccagggcatgctggacaagatcggcggctggttattgttgttggaggcgtagccttgatgtctcgggcttgcggtaccaccggacaattcgctcaatgtgcctcttgaaggggggctgttggccgccatctcagtgctcggaacgaccttcagtggtacgggctcagaaggagcctgcggctttggctcttttttcccacaagcattgaagcttcccactactatctggattggagaagctgctatgagaagtcctgcgaaccctccaccaagagacgaccgtcaggaccagccagcgaaacgctgagcccccctgttcgggtacgctggcctccgttgtccgttacaaagatcgacccagagagtgacagtatctcaaatcggncctcatatgttacagttccacctgatgtaccagtttgacgaaatgtacatttgata

SEQ ID NO: 9491 - DNA, 1058 bp, Triticum aestivum
  misc_feature (15)..(15): n is a, c, g, or t
  misc_feature (800)..(800): n is a, c, g, or t
  Predicted polypeptide sequence is orthologous to G597
ccgtaccgaagggtnccaccaacaaggtgaagaagcaagacaaggtcatgtctgcgcttgctttcatcgggactgcaggagctggctttactccacatgtaattgctgttcaagctggagaggatgtggctgcaaagatcctgtcatttgcgcagcatggagttcgtgcagttgttgttctttcagcaaatggcgccatttcaaacgtgacccttaggcaatctgccacttcaggtgggacggtcacatacgagggccgatttgaaatactgtcactgtctggatcgttcaccgtgcaagagactggaggccatcgtagccggaccggtgggctgagtgtttcactcgcaagtcctgatggccgcgtcttgggtggcggaattgctggacttctgattgcctgcacacctattcaggttgtggtgggaaccttcaacacggtcgccgagaagaaggcgccgaagcaccaagctgctgctgcacatgagcccgcatccgcgccaccgaggatgacgccgaacttcgtgccggcgccgatcgccgtgccgccgctcgcgaccgctcccatcagcgtcgggatggcccagaacagcccgccgtccaggggcacgctcagcgagtcctccgggagcccgatgaaccagggcgtgccggccgcggccactcccagcaacagcggcctgtccagcatgccctggaagtgagctcagtgtctgtctgcatgccatcgtcgtcagtgaccagcttgacgtagaatcctgaagcagaagagagggaaaaaaaaacctgaactagatgtnaccgttgccttagcgtaatttcgtggtcgagactgtttggttaggcgttgaactgtttattgtgtcgtcgtgggttgttgttacccggatgtcgtggattaatgtgtcgggatatcgtcgtgtcgtcgtccaatttaaacgggtggtatgataaattatgaactttgataaaaaaaaaaaaaaaaggcgccgctctagatatcctcgaggggccagcttagcgtaccagctttctgttacaagggtcctatagtagtc

SEQ ID NO: 9492 - DNA, 1109 bp, Triticum aestivum
  misc_feature (726)..(726): n is a, c, g, or t
  misc_feature (754)..(754): n is a, c, g, or t
  misc_feature (859)..(859): n is a, c, g, or t
  misc_feature (998)..(998): n is a, c, g, or t
  Predicted polypeptide sequence is orthologous to G597
cacgcttccggtgtttgaccggcgatgggtttatgggttttcgcagcttcctaatccctagtcctaacctcgcttgagcgctcgtgagcttagttagccgtgtgaaaatcgcggcgttgagtcttctcgtgcaagaatcggttgctgctgccgctagccatggaggtgaggtccgagcaagggctaatggcgggaagggatctgttcggcttgcctaagagccagccagcgccggcgccggcagcgccaggagcgccgccgtcctccgcagccatgcagagcgtgcgcatggcgtacaccgcggacggcacgcccgtgtttgccccggtgagctctgcggtcgcgccgcctggttaccaaccggctgggtctgcagcaccaccacatggctctagcatgtccgctgctcgggccgccggaggtaatggcgtcgcggcgccgccgggcatgggtgaaccgtcggcgaagaagaagcgcgggcggccaaggaagtacgggcccgacgcggccatgtctctggcgctggtgaccgtgccgacggctgcaggctcgccagctgtgacacagggtgcttctgggcggccgttctcacccacgctgccgggaaacttcgtgccgtcggcgtcgccggatggaggaaagaaacgcggccggcccaagggatctaccaacaagccccgcgtggatggtgctgggccggcaggagttggattcacacctcatgtncttacagttcaagctggagaggatgtantcgtcaagattatgtcattttctcagaatgggactcgtgcagtttgtgtttctctcagcaatggttcccatatcaatgtaacacttcgtcaaactggtacatcangtggaaactgtacatatgagggccgatttgagatactgtcactctccggggtcatcttcgtaacggacaacggaggccagcgtacccgaacagggggcctcagcgtttcattggccagtccctgacgtcgtctcttggntggaggggtccgcagactcctcatagcagcttctccatccagaatagtagtgtgaagctctcatggtgggtggaaaaaaaaagcaaaacggaggtctcctttgaacattta

SEQ ID NO: 9493 - DNA, 1193 bp, Triticum aestivum
  misc_feature (27)..(27): n is a, c, g, or t
  Predicted polypeptide sequence is orthologous to G597
cggccgccctttttttttttttttttntagaaggtgaagatctccccaggtacatgtccatgaaaataaaaactgcacgttagtgacagcgagagctacagcattacagacggtggctaaattaatcttacttagggaaaaacagcatgccagagagcaagaacctaaatctcctagctaccaggtcggccattgctggtcgacggcagacgttacagcagtaccagctcctctccagcccagccaacaaatggggctctcttcgaaggcttgagcatgcggtgtgggttcgacatcatcttcatgtcagcgtcatgcctgttgttgttctgatggtgcgccgagagcgaccagccgcctgatgcgtaggcggggggcatgtgctgctgctggtgctgctgcccaccagagtggttgtagggcatcccgccgtggttgatggggctgccggagtcatcggatgatgcgctggatgtgccctctgagggagggctggccactggagctggcacataggtggccatctgtggaggtgcggacatcggttcaaccttccgtggctcagcgggctttgattttttaccttcggctatgaaactagccacgacaacctgaacaggtgtcgcagccgttagctgcccagctacacatccaccaagaacccggccatcagatcctgcaagtgcaacgctcaatccaccagtcctgctacgggtgtcaccatcttctgcaagcaggaatgaaccagatagggagatgatctcaaatcgaccctcataagttccagtccaccagatgtacctgggggccgaggtgttacataacttattgcaccatttggtgaaaagaatgcaaacggggcgaggtccttgctgtgagaaaggacattatttttggaacaacatccttccccggccttgagggaaaggatattgcggattaaaggaaatgccccacgaaccgaagtgcttcgaaccggaacccttggttcgaccaatttccggggaattccggaccggttacacaccggcgttttgggacaaaactggtcctataggtgccccataaatggcctcaggggcaaaaccttgccccggtgtgtaaatgttattccgccccggggccttaggataaatccgggagggtggtccggccgcggtctctcttgtgggggccaacaacgcgggaggggg

SEQ ID NO: 9494 - DNA, 841 bp, Triticum aestivum
  misc_feature (21)..(21): n is a, c, g, or t
  Predicted polypeptide sequence is orthologous to G598
gaccccacgtttagttagtancttatcatacgactttgtattgggaccactttgtacaagaaagctgggtacgcgtaagcttgggcccctcgagggatactctagagcggccgcccttttttttttttttttttgtcacatatgaacaaatgctctgaatgtttgcaggtttgtggcaaacacactattcattccatcttcacaccagttttgcgtgcatatacaagccaaacaaaaaagcgccaccgtgtgatccgtgatcgccaccggcggccagtatacaacggaggcagcagcagcaggtttcaaatcctttttacaattaggtttcccggccgatcggatgcagcagcacacgccctttacgacctataggcaaaaacacatacgtaggattctccagttgaggaggccggcgggctagaagaatgagcgcttggtgggcaccctgcccacggccttcatgaagttggccagctccagcaccttggccagcttgagcccccgcttggcctccgccgacgcccgcttctcctccgccttgtgccgcgccttggccacgtcgttctgcgtcttctccaccgccttggcgcgctgctcgtccagcttcctctcaatcttcttgagccaggcggacgccttgtcgacctgctccgtctcccagccgttgatgaccacctcctccctcttgaaccggtttgttgatctttgcgatctcccgcgtctggcacgccgaccaccttggtctccaactcctccttcttcaccttgggtcgcttccaccggcgggccggccggggggacgacctcaaggtcaaaccgggccccccttccggttttg

SEQ ID NO: 9495 - DNA, 1049 bp, Triticum aestivum
  misc_feature (761)..(761): n is a, c, g, or t
  misc_feature (826)..(826): n is a, c, g, or t
  misc_feature (832)..(832): n is a, c, g, or t
  misc_feature (839)..(839): n is a, c, g, or t
  misc_feature (847)..(847): n is a, c, g, or t
  misc_feature (851)..(851): n is a, c, g, or t
  misc_feature (1006)..(1006): n is a, c, g, or t
  Predicted polypeptide sequence is orthologous to G598
ccacgcttccggacacagcaagaacgagtcagtcaagagggcgaggcgtccactgctgattcgcctcctcccgcgcgtggtgccccgtccccgccggccggcgccgacacatgttgcatgagcggcacgcaccaccctccgcgtccgacgacgaggacgatgccctaggggccaacgacgaggagggcactctggtgaccaccaccgccagcaccaccaacaccaccttccacgacgtcgacgaggtgatcgaggtgcgcgaggtccaccccctgtcgccgccgcacccgcccttcacgccgcccacgcgcaccctgtccgccgcctccaccgcctgggacagcgccagcagccaccgctccgtcacctccgaggagcagttcatgacgatgagccgcgagttcaccgccatggtcgccgccggcgccggcaccggggcggccaacagcaaccccaacagtaacaacagcaacagcaaccaccacccaggcggcccctacgacggcggccccgaccagctgaccagcatcggcgaggacgagctggaggagcacaacccgctggccatcgtgccggacagcggccgccccttcgccacgccgcccagcaggagcggcggcagcagcggcagggcggcgcggctcgaccttgaggtcgtccccgcggccggcccgccggtggaggcgagccaggtgaagaaggaggaggtggagaccaaggtgtcggcgtggcagacggcggagatcgccaagatcaacaanccggttcagagggaggaggtggtcatcaacggctgggagacggagcaggtcgacaaggcgtccgnctggcntcagaangatgagcntcantcatgcactttctgcgccaaaagggagactgtgtacctgtgagaatatcatgggacgttagcacgttcatctcacggcgataggactgttctatgagagtggcggcccttgttcggggagaaccactagtagtgcaggtgaaaatcatgcctgcntgctggccagttagtgtattctatctggaagttcatcccggca

SEQ ID NO: 9496 - DNA, 1146 bp, Triticum aestivum
  Predicted polypeptide sequence is orthologous to G598
gcggccgccctttttttttttttttacttcccattctcacaccagtttcttcgtgcacatacaagccaaacaagaaagcgccgccgtgtgatcaccaccggcggctagtatacgacggaggcagcagcagcagcagcaagttttcaaatccctttttacaattaggtttcccgaccgatcggatgcagcagcagcagcacacgcccttactttttacgtactacccataggcaaaaacacataggatttctcccctcctccggctgggggaggctagaagaaggagcgcttggtgggcaccctgccgacggccttcatgaagttggccagctccagcaccttggccagcttgagcccccgcttggcctccgccgacgcccgcttctcctccgccttgtgccgcgccttggccacgtcgttctgcgtcttctccaccgccttggcgcgctgctcgtccagcttcctctcaatcttcttgagccaggcggaggccttgtcgacctgctccgtctcccagccgttgatgaccacctcctcccgcttgaaccggttgttgatcttggcgatctccgccgtctgccacgccgacaccttggtctccacctcctccttcttcacctggctcgcctccaccggcgggccggcggcggggaccacctccaggtcgagccgcgccgccctgccgctgctgccgccgctcctgctgggcggcgtggcgaaggggcggccgctgtccggcacgatggccagcgggttgtgctcctccagctcgtcctcgccgatgttggtcagctggtcggcccgccgtcgtagggccgaaggggtggtgctggtgctgttgttgccgtggccttgttgttggccgccccggcgccggcgccgggggggaccatggccgttaacctcgcgggtcatcgtcatgaactggtcctcggaagggaaggaacgggtggttgctgggcccgtcccaggcgggtgaccccgcggaaaacgttccctgtggcgggttaaagggggggtctgcccggcgggaaaaggggggggacactgcgccctccaataacgggcccaacctccggaaaggggtgttggtgggtctggcaccacaaaggccctcccgttggttgtccccgggggaatgccctc

SEQ ID NO: 9497 - DNA, 640 bp, Triticum aestivum
  Predicted polypeptide sequence is orthologous to G600
gctgtaggtggtcatctccgggagaaatccttgctccggtcttcttcggagccggcaatgactgggagaccggtggatggcggcatcttcgccgcgtgggttgcggcatctttgccgcgtggtttgctgaggcggccttttcgggggcgctgatttctttttggtaacgatgatggcgtcgagaggaactctggtcgcggctcgggcttcgatagtcggatcttcctggcgtgtccgaggtgctctttagggcacggtcggcgcaagtcctgcatatttttcttgtgatgatcgtcgtcagagtcggagctgtcggttgtttgcgcatgtggccttctgttggcatgtgccatcatggtttctgtgtagctgtttgcgggttggccttgacgatgaaggtctacggtgaagtcggagtcgcccgttcggagatagccggtgatgacgatgacgcttgcgactgctcggcggatgtcctttcctctttgtagctctgtgattctgtgtcggtggccaggttggccggtggtacccattttatatgggttggattgtatcggttttagcctggttttccatcaattaaccgggcaattctcactccttcttaattaatgaaaatggcaagtcttttgccttg

SEQ ID NO: 9498 - DNA, 587 bp, Triticum aestivum
  Predicted polypeptide sequence is orthologous to G600, G2768
actatcgtttacggctcctgatgattcccttgcttcccttcgatactccctgccccggtctcggtctcggtctcggtctcgatcaccatgacagtcksgctccctctgcctctsccgctccctttccctctcgcggaaatgttcacgctcccgatcccgctccctctcccttccgtttaatcgatccatttcacgtctcctcccatctggtttcctgggctcaaattcgtctcktctcacaactggtggccccatgttcattgccatgctgttaacagctaattcagaaaggtccctaggaactgttggcatcatgtatgccgggggcataaatggatcttgtgaaagaactcccccaccaaaaggatcaaatggacctggtggaggatagcccatgtaaggcatgggacctggaaatggtgcacccatgtaatctattggcaatggcatccctcctccccagtaagggttaaaacctccttgcgggcccaaaggcattccagcaaaattttcaggtccaaaatcttgataattattattccattgctcctcggcattccctggtgctcgcaccttcttcttctttt

SEQ ID NO: 9499 - DNA, 672 bp, Triticum aestivum
  misc_feature (365)..(365): n is a, c, g, or t
  misc_feature (383)..(383): n is a, c, g, or t
  misc_feature (434)..(434): n is a, c, g, or t
  misc_feature (460)..(460): n is a, c, g, or t
  misc_feature (487)..(487): n is a, c, g, or t
  misc_feature (514)..(514): n is a, c, g, or t
  misc_feature (529)..(529): n is a, c, g, or t
  misc_feature (549)..(549): n is a, c, g, or t
  misc_feature (553)..(553): n is a, c, g, or t
  misc_feature (572)..(572): n is a, c, g, or t
  misc_feature (574)..(574): n is a, c, g, or t
  misc_feature (591)..(591): n is a, c, g, or t
  misc_feature (608)..(608): n is a, c, g, or t
  misc_feature (621)..(621): n is a, c, g, or t
  misc_feature (626)..(626): n is a, c, g, or t
  misc_feature (637)..(637): n is a, c, g, or t
  misc_feature (640)..(640): n is a, c, g, or t
  misc_feature (643)..(643): n is a, c, g, or t
  misc_feature (647)..(647): n is a, c, g, or t
  misc_feature (665)..(666): n is a, c, g, or t
  Predicted polypeptide sequence is orthologous to G600, G2768
attgcccacaggaaaaccagacgcctccacctggatatacctgctacagatgtcgggttccagggcattttattcagcattgcccaaccattggcggttccagggcagtttatatttactgtgatgttagtgttctttattagcatgatagcatcttcactttgttttttcaaataaattcattgttcagtatttactgctctactttattcataaatccattgttcatttttgtttattaaaatagccatgtctatctgctattcctaggatttccttaaataactatgctaataaatatatccatctcaagagagaattaatcctacttcccttgcagactcctgaacatcaaggaccatgtnggactaaacttgcatgtngggtgcaccaaggcgaagtcccacccatcaaagggataacaactaattggncaaactttggtgaagacagggttggntaatttgggagaagtcttgcgtcaagntaaaagggaaatgtcttcgttgccacnttttgcaagtgggtnaaggtgtcacatacatcaancaangttccggtgattcactgcnanatgtgcttacagacatnggtcatgtacgtcctgnctaccaaacgttnttggnccttgtagtanacnacntgtncattggtgcccactggtnnttggaa

SEQ ID NO: 9500 - DNA, 610 bp, Triticum aestivum
  misc_feature (14)..(14): n is a, c, g, or t
  Predicted polypeptide sequence is orthologous to G602
cgacaccaccaaanaattagaagccgcttttggattagttaattgtgaattacgattcaggtcggattttgacagcgaaatcaacgcggcgatctttggtactagtaccagtagtgcagtctaagcggtgccgagcttgtgcgaggagcagagcatcgtgtctatggagacccagcaggagcccaccaaagcgggcgcggtggtggcgtcgccgggggtcgccggtggcggcggcttagttctcgagaatgaacccccagcgccaacaacagcgcagcaaggacctccgggttcagcaactgacagagacgcggtgctggccaaggtggagatgaatcggaagctgtcgatggtgaaggcgtgggaggagaaccagaagagcaaggcagacaacagggctgagcacaagatgtcgtccatcctatcatgggagaacacaaagaaggcggcggtccaagccaagctccgaacacgggaggagaagctggagaggaagaaggcggagtacgcggagaagatgcggaaccgggccgcgatgatccacaaggaggctgaggagcagcgggccgccgtggaggcgaggcggcaggaggagatgatcaagtgccag

SEQ ID NO: 9501 - DNA, 643 bp, Triticum aestivum
  misc_feature (266)..(266): n is a, c, g, or t
  misc_feature (271)..(271): n is a, c, g, or t
  misc_feature (281)..(281): n is a, c, g, or t
  misc_feature (330)..(330): n is a, c, g, or t
  misc_feature (334)..(334): n is a, c, g, or t
  misc_feature (340)..(340): n is a, c, g, or t
  misc_feature (349)..(349): n is a, c, g, or t
  misc_feature (355)..(355): n is a, c, g, or t
  misc_feature (366)..(366): n is a, c, g, or t
  misc_feature (369)..(369): n is a, c, g, or t
  misc_feature (387)..(387): n is a, c, g, or t
  misc_feature (391)..(391): n is a, c, g, or t
  misc_feature (397)..(397): n is a, c, g, or t
  misc_feature (430)..(430): n is a, c, g, or t
  misc_feature (440)..(440): n is a, c, g, or t
  misc_feature (464)..(464): n is a, c, g, or t
  misc_feature (469)..(469): n is a, c, g, or t
  misc_feature (484)..(484): n is a, c, g, or t
  misc_feature (501)..(501): n is a, c, g, or t
  misc_feature (503)..(503): n is a, c, g, or t
  misc_feature (514)..(514): n is a, c, g, or t
  misc_feature (521)..(521): n is a, c, g, or t
  misc_feature (526)..(526): n is a, c, g, or t
  misc_feature (540)..(541): n is a, c, g, or t
  misc_feature (567)..(567): n is a, c, g, or t
  misc_feature (573)..(574): n is a, c, g, or t
  misc_feature (589)..(589): n is a, c, g, or t
  misc_feature (599)..(599): n is a, c, g, or t
  misc_feature (601)..(601): n is a, c, g, or t
  misc_feature (604)..(604): n is a, c, g, or t
  misc_feature (622)..(622): n is a, c, g, or t
  misc_feature (639)..(640): n is a, c, g, or t
  Predicted polypeptide sequence is orthologous to G602
ttttttttttttttttttgatatcatggagggaatattactgcaagtaattgttttctcagacaacgcgaacaatgcatgctatatatgtaccaccaaaaatctgtctttgcagttacatgtatgcaacatgaagagtagctcccagcaaaaaaagataacatgaagagtcacaaacttaactcacagaaaacaggacacattttcagaatgtaaagaagaaaaacaactacacagaacagatcacctccaacgcgtaagattgangtgcntcttatgccncggaaacatccgagaatttcttggggagccagcccggttgcacggtacntgcntgccanctcctcggncttganaactcttcacnatnccgggccactacattgcnctcntccctnaagcttcccctgtgggcgattgcctttgggccncaacttccanggtagttagcgtctctttccaacnctcgncctcctttaattganccacaagggggctcctngngtccccacaangaatgancacanttctaccacctgtnncggcttggcttccctccaaccaagcntgtaannccactccggtcactncaaaaacacncnttnaggaacccgtgagttccngggggtcgggaattcgnnaaa

SEQ ID NO: 9502 - DNA, 859 bp, Triticum aestivum
  misc_feature (616)..(616): n is a, c, g, or t
  misc_feature (773)..(773): n is a, c, g, or t
  misc_feature (822)..(822): n is a, c, g, or t
  Predicted polypeptide sequence is orthologous to G602
acgcttgaccttaggcctatttaggtgacactatagaacaagtttgtacaaaaaagcaggctggtaccggtccggaattcccgggatatcgtcgacccacgcgtccgcgtccgaccagcacaaacaagactgtactctgggctcctctgactccgtgtcttgctaaaatatctttggtcgactcgttgcgaggttgatcagatggcggaggaagcgaagcaggatgtggcgccacccgcgccggagccgaccgaggacgtcgcggacgagaaggtggcggttccgtcgccggaggagtctaaggccctcgttgtcgccgagaatgacgctgagaagcctgcagctacagggggctcacacgaacgagatgctctgctcacgagggtcgcgaccgagaagaggatttcgctgatcaaggcatgggaggagaacgagaaggccaaagccgagaacaaggccgtgaagttgctggcggacatcacctcgtgggagaactccaaggccgcggaactggaagccgagctcaagaagatgcaagagcagctggagaagaagaaggcgcgctgcgtggagaagctcaagaacagcgccgcgacggtgcacaaagaggcggaangagaagcgtgccgcggcggaagcgcggcacggcgaggagatcgtcgcggcggaggagaccgccgccaagtaccgcgccaagggtgaagcgccgaagaagctgctcttcggcagaagatagatatcgcttcatcttcagcttctctctgtttgaccgnttgcatgtctcctgcccatggcatcacttgtgtatttatctttgggggngatcttagtttgtatggtatcatcaaatgcgtcgtga

SEQ ID NO: 9503 - DNA, 611 bp, Triticum aestivum
  Predicted polypeptide sequence is orthologous to G605, G1944
tttttttgatacatgtaaatttttaactattggcggcatcgatcagttcagttcagttcagttcacatggtgtataaatttccaactatttgaattcctccgaatttctccgcacgtttgcagagccctgagagcttctgagcagggctggctggctggcgagctctcctcctcttcaccctccggagacggggaccttggccgcctccgacgacggcgtcctcctcgcctcggctgcgggcggcgccgatgccaccggctgggcggtccagttctccaccctgaacgctgacgcacccttgccggcccgtgcctggcttccgctgtacgagtcctccatgtcgccgccgctggagatggtgaaccccatggccggctgcgccgccaccgtcttcatctcgatcaccggcttcttgccgttctgctccatctggtagctcggaaggaagcttcccaccacaacctgaaccgggcttgcggcaacaaggaggccagtcacgccgcctccgatgacgcggccatcggcggtcgccctttctttttttttttttttttagacaaggctgaacccaagcttagtgcgagattcagtaccctaattagcaaggtca

SEQ ID NO: 9504 - DNA, 1128 bp, Triticum aestivum
  Predicted polypeptide sequence is orthologous to G605, G1944
cgccgacccacgcgtccgcctctggcggcacgttaacttatgagggacgctttgagttgctgtccttgtctggttccttcatgccaactgaaaacagtggcgcacgaagtcggtcaggtggaatgagtgtttctcttgccagcccagatggtcgtgttgtcggtggtggagttgctggccttctggtagcggctagtcctgttcagattgtcgtgggaagcttcctgccaagctatccgatggaaccgaagcagaagaaggcgagggtggtcgcggcaccaatccttagccaggcaccccctgctgttcagctctctagtgcggatacgcacagcagcgagcaagggcagcacagctcggccgccccaagaatgaacgtcgtaacttcttcagcgtacagcgcagaccagaactgggcatccaccgttgttcagtcggctcctgccgaggcatcaagaagcgcatcgtcgggcgatctgaacctcactgcctctggatcctgaagcccatcgagccaaacccgaggaattcatccacagagtctctgtgtggtgcatttcctttctgacatgtaaaagatgtatccactaggttggttttcaaaaaccccactaggttttctgtcgggcagctcaagagtctaactgcatttgctgtagctatgtgacgttagtacctgtcgatcttgttggacattgtgtagctacactctattgttagtgtgtcttagcctcttaggcctacttcatctgttggattacatggattaattttgagttagagtttttctcaaaaaaaaaaaaaaaaaaagggcggccgctctagagtatccctcgaggggccccagcttacgcgtacccagctttcttgtacaaagtggtccctatagtgagtcgtattataagctaggcactggccgtcgttttacaacgtcgtgactgggaaacctgctagcttgggatctttgtgaagaacttacttctgtggtgtgcataattggacaactactacggagatttaagccctaggttaatataaattttaagggtttatgggtaaactaactgctttgctggcggttgaaaatttgcttcctgggttgatttggaaaatttttcccggcgccta

SEQ ID NO: 9505 - DNA, 889 bp, Triticum aestivum
  misc_feature (563)..(563): n is a, c, g, or t
  misc_feature (614)..(614): n is a, c, g, or t
  misc_feature (644)..(644): n is a, c, g, or t
  misc_feature (662)..(662): n is a, c, g, or t
  misc_feature (691)..(691): n is a, c, g, or t
  misc_feature (736)..(736): n is a, c, g, or t
  misc_feature (850)..(850): n is a, c, g, or t
  misc_feature (863)..(863): n is a, c, g, or t
  misc_feature (872)..(872): n is a, c, g, or t
  misc_feature (874)..(874): n is a, c, g, or t
  misc_feature (876)..(877): n is a, c, g, or t
  Predicted polypeptide sequence is orthologous to G605, G1944
aacagctatgtacgatgattacgccacgctatttaggtgacactatagaatactcaagctatgcatccaacgcgttgggagctctcccatatggtcgacctgcaggcggccgcactagtgatttgtcgcggccgaggtgaatgatctcaaaaaccgaatgggctattccaaagtatacatttggtattctttttgggaacagaaaaatctctcaagagatggaagtgtcgacaaatatgagctatcctctagaagagttgatatcaatgttggaacttcgtgtgtcaaatatcccagagctaggccaccctcccgtcgatacaacggagggcggcgacgttaggttttggttatgtcctgagctgggcgacaccacatctggcccagcgccggtgagcgagtcgggaccgaaagccggtggtttcgcggctttcttggactttgatttggatcctccttgcacaaaagtccctagcaccacctgcacagtactggcagccaccaatgctccacccaggacacctccaatgacatgcctctccgggctgcagagcgtgacgctnatcccgtcggtttgattttgctggccctcgttcggattgtaagagccggantaactcaggatttcatacaatccctcgtanatggcagggttattgtangaaggaggatgatctgccgggtggcgcangacgggcctggagacggaccccatcgctgagagcacgcacaccgncctcggtggctggctcgcgaatgccgcgatcttcccgcgacgtcctctgaaggagatgctgtgatgatgtgggggagtaaagctcgtccagctgaaccaaggaacgcattgccngagggttactgcntgggactcngncnnggacacgctatc

SEQ ID NO: 9506 - DNA, 1421 bp, Triticum aestivum
  Predicted polypeptide sequence is orthologous to G611
ttttttttttttttttttagcataaatttttattgccatcttggtccacttcaacatgtagatgttcaggcaactccagtttgaaaaccatgtacaagttctcaagagtacaggcaagcatgttcacacacaattatgttatcattcagactatcaataaaagcttatttgtcagtcatccacaaggttggtacttgggactttatttcttaaggaatacacattctttttatcaggccaacaatcggtctgccttgtataatgaactgggatagaagtttgttgtatggcaatagtttacagcagcttctatcatcggagctgctcttcagctatcaagcaactttgtgtgctcgacgatgagaaccagacgcttcatccttctttgctccttctggtctcctagcccaggctggggcttggtccggtccataccggtaatcatagaagagttcggcactagcttcaatatgctcccttgcatagataccaacccgatggtcaccggccaccatcatcacctttgcatagcagttggggctggaggagtgatttgcgaacttcaatttatcccccttccgatatgcatccaatacaaactggtcatttaaatcaaagaggaacgaagagtttgcccggtcataaattttgccgcgtttgtctgcttctttgtgagaaatcaattcaccagtgtactctccaagatagtcattcttatgcacagggttcttaatgaacgcaccccatcctgcaacgtccgattttccaagcaaaatcctttgttgttgttttaggaggagcttcatgtttccgcactggtaaccatcacctctttctggtggctcgcctagtgaaccatctccacagctcacccagcagtttctgcaaacatccggatcacattcccgactggcagcaaaacatgggcattgcctgcttctgcactgactttttgcacaatgacagcctctaaatctgtttttgcagctttttgaacacccacagtatttctcacagcatgtcccattttccacacaggggcaatttttgttgcacatttcctggcacccacatggtgtatactgtctgtcacattgcttcccatcaccaacttttttcctaatggctggatgccctgcagccttcgaaggatatttgtgctttcgagttctgccccttcgacgacagacttttgttctcacaaccatgccttgctccatgtagttttgttcagtttctgtgaaatcgcccgaaatggatttactcatgtttgctgcaccattgttgtacatgtagctagccacttccatgcaggttttcaggccacataataggtttctgactattagacagctatttttcccaaatatctctattcccttcagatataaatccctctctagggtactccaatgagaaag

SEQ ID NO: 9507 - DNA, 834 bp, Triticum aestivum
  Predicted polypeptide sequence is orthologous to G611
aagcttgaccttaggcctatttaggtgacatcccagaaaagtttgtacaaaaaagcaggtctccaccggtccggaattcccgggatatcgtcgacccacgcgtccgggcagatacttccctcacaacgttggcactgatatgtctgtggccatgttcagccggctccaggtatctagctatggttgtcgctgctacggaggccagaggaggaagctacgctcttccatggcggccagaggaggaggaggcacttctctggtcagatcagtggctaccatgtcgccgtcaacgtccaccctcctcgacagatcaacttactcccaaggcaactgctcctgatcttgaacacgagcttggaaatctggcaccgacatatgcagctgccggtcaaatttctccatattttggtttggagatttttggaaggaacagttgtttaattgctcagaaccatctctcaaatggaaacatacagcgaagtttttcagtatatgagttatattggaaacagcagcgcatctggaactctcagtaggggtgattttcttgtcaaaggatatataaagggacattagttgcgctggttatcatgctttattaaaaggcaagctagagtccattgttcaaagtacacctggaaatccgcaagctaccattttataaggagaaggattacagaaaggaaggatcaagccttgtcggcaatataatccatgtggcggtcaatcagcatgtggggaaccaatgtccatgtccctataaatgggggcatgctgtggaaaaatatttggtggggcctgggcggaaaagggaattaaggatgcacacctggg

SEQ ID NO: 9508 - DNA, 571 bp, Triticum aestivum
  Predicted polypeptide sequence is orthologous to G616
ttttttttttttttttttgatgattatgaatcttaattaaccatgacaacacaacaaacttgtacatggattgcatcacaacactagcactaggcgggtaatgacatcattacccgacgcaacgccagcaaactgatcctggttcttcccaaaacgagccgctgtcgttttggttcagaatttctcacttctgcatactcctcgtcggaataacacacccatttccagcaacggatgacggatccattgtcgacaccgaacaatttgttcgactcatctccatgattcattactggatcataatcaccttagccctccctaacaacatcaacagccgccaggttgactggatcatattccggcacctagtccagtggaacgtgtcacgccttctgaagcgtcagtccaatactttattgcatcctcactctgcattgccacatttgacgcttgctcgacaatgtcccctctgcatcatctgctgatacctgcatgcaaggtcaccatagagccgtcgtcgcccgcactgacgactatatccatctgcccggcactacacgccaccagctaa

SEQ ID NO: 9509 - DNA, 747 bp, Triticum aestivum
  Predicted polypeptide sequence is orthologous to G616
ttttttttttttttttttgagcaaatgcattcattcaacatatatagaacattcattgttttacttcactcaaatagctacaacctttaaggatccacaaatcagatatacaagagaggcatgttacaaaaaaatggccaaagttcctaagagaccaattgcatgatcactggattgctacagaataatacggaagaccaactcttcaatcgccaagccgaatcaacttccatatgaacaaaatgtgtcaacccagttctcaacaaaacagtcacgagaacatcttcagtcaacttgtggacttgctactgtctaccatttgtccagtcaagaggcgctgatccacaaccttgtttggggagttgaggtcagggtcgtcgtcttgggcttggggtcttagttgtcctcctcatccatggagtcgggtgccacattgtttgttgttgttgttattattgttgtagttgatcaaaagggcgacttggtgggtttgtggtccttatccaattccaaccgaccatgcccggtgctgaaccggaggggttccaactctaccttcagaccatatagcaccaagttttgcttctcatatgcttaatttactattgcccagactgatcacacctaggcggcacaatggtccacccatcagcatcagggataggcttcgaggacctcggttcatcctgcttcatcctcgagcatcagtggctagtcaccatcatcatcatccaaactataaatcat

SEQ ID NO: 9510 - DNA, 705 bp, Triticum aestivum
  Predicted polypeptide sequence is orthologous to G618, G2057
gaggcttcttccagaggggtccccttcagtccagtaaccagccctccgaccgaggatggccggagaccgtcgaagctgacgacaacaacccgatgcagcagcagcagcagcaccaagggggcttgaacccttccgtgtcggcaatcgggttcggtcccggcgtcagcttctccggattccgcgtccccgcgaggatgcagggcaacgaggagcacaacggcggcaatggcgacaagccgccgtccgtctcctcggcttcccaccactgacagcagcagtggatgacagatgacttcaccaccaacctccacagtgtaccagcaacgacatcggccatcagctcctccacttgcatcactggtgctaatttgattccgcttcatcatttataggagctggtgattgcattgcaactaggaggagcgaaattcggagctggttctacgtctggttggttggtatggttggttttccatctcttctgctacgtgtgtcattgtcttttgcttcaagatcactcggagcttcttagaattaggcttgtgagagtgcagcgacacagcaagctggtgagccagcctctttgtggcattgcattaggtgtagttgatgttgtagtttgctgtaggtcaagctcgattgctttctttctttcacttgttgctgtatgctactactagatgttattctcaaacttataaatgg

SEQ ID NO: 9511 - DNA, 1098 bp, Triticum aestivum
  Predicted polypeptide sequence is orthologous to G620, G1821
gcacgagcaagtgcgagtgcgactacctgcattgcaccttggctagccctagacatggagaacgacggcgtccccaacggaccagcggcgccggcacctacccaggggacgccggtggtgcgggagcaggaccggctgatgccgatcgcgaacgtgatccgcatcatgcgccgtgcgctccctgcccacgccaagatctccgacgacgccaaggaggcgattcaggaatgcgtgtccgagttcatcagcttcgtcaccggcgaggccaacgaacggtgccgcatgcagcaccgcaagaccgtcaacgccgaagacatcgtgtgggccctaaaccgcctcggcttcgacgactacgtcgtgcccctcagcgtcttcctgcaccgcatgcgcgaccccgaggcggggacaggtggtgccgctgcaggcgacagccgcgccgtgacgagtgcgcctccccgcgcggccccgcccgtgatccacgccgtgccgctgcaggctcagcgcccgatgtacgcgcccccggctccgttgcaggttgagaatcagatgcagcggcctgtgtacgctcccccggctccggtgcaggttcagatgcagcggggcatctatgggccccgggctccagtgcacgggtacgccgtcggaatggcgcccgtgcgggccaacgtcggcgggcagtaccaggtgttcggcggagagggtgtcatggcccagcaatactacgggtacgggtacgaggaaggagcgtacggcgcaggtagcagcaacggaggagccgccattggcgacgaggagagctcgtccaacggcgtgccggcaccgggggagggcatgggggagccagagccagagccagcagcagaagaatcgcatgacaagcccgtccaatctggctagtcgcgtgcgcggcgcgcgttagcttctgcgtcctgtgtactgtaataatttgccgtgtcgatccggccatggtttgtgtgtgcgtagtgcttatctaatgtgggcttgtcctctagtaattcatgtattgcttatctaatgtggacttgtcctctagtaattcatgtactctttgctgttgaaaaaaaaaaaaaaaaaaaa

SEQ ID NO: 9512 - DNA, 594 bp, Triticum aestivum
  misc_feature (39)..(39): n is a, c, g, or t
  Predicted polypeptide sequence is orthologous to G622
tagtgctgtgctgccaccgccggcgacgaggcggacaanctttttggtgctgcaatcagttgcgcccttcgacggcggagtttcatccgtgcgcgccgaagctggaaacggcgtttttgggagctgcaagcagtgcaggtcagcggccgcgacgagccagagggtggcgacgtgatgggcggcgagctcgcacggcttggcagacgacgatggccatcgttttttaccgggaggacgcggcaccagcggggacgcgacctgtgccggggatagaacgagcgttgaccagatctgacggttgagggaagattaattcgacggctcgcgcttgaccggccgaactattgggccggtgcgccggcgcctatcagtcccctacacgcaatgccaaacgcagcctaacatttaacataagaagttaaccaaaaaagggaacaacaaaatacttgaaatttttatagaacctatcactcaactttcaggtgcttgtgaattatgcatggtctccaaaagaggctgaagaagcctccggggaagtaagcaaacttactggcactggtttcccgtggagataatttggatcatcatttattt

SEQ ID NO: 9513 - DNA, 814 bp, Triticum aestivum
  misc_feature (86)..(86): n is a, c, g, or t
  Predicted polypeptide sequence is orthologous to G622
caccgctagtgcactaaggcctatctaggtgacttgattgaacaagtttgtacaaaaaagcaggctggtaccggtccggaattccngtggatatcgtcgacccacgcgtccgaaagtgcaaagagtggcattttcagttcagattctggccaaataacaacagcagaatgtatgtcttggagggtgttacgccatgcatacagtccttacaattacaagctggtgatacagtgaccttcagtcggatagaacctggagggaaacttgttatgggcttccgaaaggccacaaacactgtcagtttgccagactcacagatttcagccattgcaactggttcccttctcggtgattcattcttttctaacacaaatgagaatctatccatagtaagtggttactcaggatttcttcagtcaatgaagggagctgcagatctccagccaagctctctatttgatcatcatgccaactcagctgatggggatgttagttggcttaaggcagatagatttggtggcaggccagatgaggggtcttttcagtttttacacaaaagaagccgcaatattggttccaaaagcaggaggcttttgatggataacgaggaggccctggaactgaagctttcctgggaagaggcacaggagttgttgcgtcctgctccatctgcaaaaccaacaattgtgatgattgaggactatgaatttgaagaatatgatgaacctcctgtctttgcaaagagatcaatttccaccagtcgttctacagggggaacaagaccaatggattcagtgtgatgattgctcaaatt

SEQ ID NO: 9514 - DNA, 460 bp, Triticum aestivum
  Predicted polypeptide sequence is orthologous to G630
ctgatccggtgggcttgtggcgacagaggtggcaggggaagccgacggaggggatgtaagcagagataccaaccatcaaaattcagagagcaacaatatcaatgaagacctggaccaaacttttcatggcaatgtttctaaagttcaggcctctaacattgatttaacaaaaccatatgcatcaggtagcatgttgcttgatggtatcagaaaaatgctgcaaaagagtgatgaaaggaaacagaggaggaatgttttgaaggagcaaagcagaaagaggtcaagggctcagatgggtgtttgcataaaggaagagcaagaaaaagaacgcctacttcctttgtctttttttggcaagcttgtttgacaagaaaagtgcacagacctaaactgggcacaaggccaacatctgttcccaatccttttatttacaacaaacaattattacaaaaaaaaaaaa

SEQ ID NO: 9515 - DNA, 691 bp, Triticum aestivum
  Predicted polypeptide sequence is orthologous to G634
cgcggcaccaacaggcggcggctcggcaaggggccgtacggccgtgggtccaccgccccaggcaccccaacggctgtcgccggcggcggggccgacgccatcggagccgccgtcgcaccggacgtgctgttcatcgcctcgagctgccggaagaagcggtacgtcttgccgtcgttgcggccggcgcggctgtccttggtgcgcttgtagtacttgtgaacgttctcgaacttctccttgcacttcttggcgttccgcctgtacccctcctcggccagcttcctggagacctcttcccagagtgggcccttgagggtggcgtcccggaaggcggcgtccatgtccgaccggatcttgagcagcgccagggtctcctgccgcggccaccggtttcctccagcgccgccgcccaagccttcctcgccggccgcgagcgcctcttcgtcgcagcccacagcgccggcacctgctagctcgttgttgagctgctgctgctgaggcggcggcggcccaggcgccggcgggcggctgctgatgggcgagggcgcctcggccatcgagatccgctgctggccggtgctcctggacggcgagaatggcggcatctctgggggatgcaggccgaactgctgtcccgggcctccaccctgatgctgcggttgctgctgctgctgctagtacacactgggtg

SEQ ID NO: 9516 - DNA, 596 bp, Triticum aestivum
  misc_feature (233)..(233): n is a, c, g, or t
  misc_feature (251)..(251): n is a, c, g, or t
  Predicted polypeptide sequence is orthologous to G635
ttttttttttttttttttttaaacaataaaatttgtaagatgggccagggcttatatgaacatagaagcaacagtcttacagcctagatgactgattacagagatgagaggtggttagaagtaatagctagcactgtccaaaagttgtgaactaatagaaggtcggttcatgccaaaagcaaattgagattccatgacccgcaatggacagcaatataatacatgtttcctanaagcatacagaggagtanaatcatggcaggcgcaaattgagaccccgatatatcacttcattcacaaagtgagcaagcaggaacattgatggaagctacagtttgtaataaaatctcaatgtgaatgtgccacaacagaacccaaagcatcttgtatttcgtcaacggtagccatcacactagttagatatatctactcattatcaagaatgtctgagaaactttgtgcttcatatcaaagatcatgcctcggctcatccagatggttgtcgtcaccagcctgatctgccccagtggcagagccagaaacttggattagggaagccaagtgctgtcaaaatagcttatggagggccaaaccat

SEQ ID NO: 9517 - DNA, 1635 bp, Triticum aestivum
  Predicted polypeptide sequence is orthologous to G635
ctggtgccgaattcggcacgagatcacgatgaactggaggaagttctacagattgttaaaccgcagcatttcttgcctgttcatggggaactcttgtttctcaaagaacatgaattgctaggaaggtcaactggcataaagcacactactgtaattaaaaatggggagatgcttggtgtatctcatctaagaaacagaaaggttttgtcaaatgggtttgtttctttagggaagcaggactttaagctaatgtatagtgacggagacaaagcttttggaacgtccactgatctctgcatcgatgagagattcaggatcgcatctgatggcattatctttgtcagcatggagatcttccgacctaaacctgcttcaccacagtctggcttgaaagggaaatttaaaataacaacacggtgtctatggcttgataatgggaggctacttgatgcactttacaaggctgcgcatgcagcattgtcaagctgtcctttgaattgcccacttagtcacatggagcgaatggtatctgaaatcttgaggaaaatggttagaaagtacagtggaaagagacctgacgtcattgtagttgcttcagagaacactacagtaggtttctcagaagaggtaataaataggcatatgagtctagactatgagaaaacacggccagagaacccagagcgtgaggctgaagagagcatccctgaggtcatgagaacaacacctgacgatgcaaccactagctccaatggtgaatcattcttctctcctgatttacatcagcctaaaacattggatcatttttgggagtcgttcaagtcccctacagcagtaaaaattgcaagaattgtcaatgcttcagctcaagggaacaaaccaaagctcggcaagatcagcataatagataaggattccagcacgtcagctcctgctgcagctaaatcttcaagaaagaacaagtggaagcccgaggaaattaagagcttgatacagctgcgtggagaaatgaatgagaaattccaaaccgtcaaaggaagaatggttctgtgggaagagatatctggtagcctgttgaagcaggggataactcgtacaccagcacagtgcaaatctgtgtggacatcattgcttcagaaatacgaggagagcaagaaggatgaagaaaacatgcagacatggcaatatttttcggccatggatagttttttatcatgcgaaggggaaatggcaaccaaatgaaacagatctgtaataaattgcttagcgatagttatttggagatcagtgtattgtaggtagcccgtgaatcgacgacaagatcaacagcctctccaggaagtaatcctatcacgtcattctttgccattgcatgagatgcttggggtagttaagtgaaactaggtttaccaatccaccatgttgtattagtttttgtgggatcagcaactagatctatcaattgattagtcagttaagttgcaacattagcatgtaaaaaggcgcactcgttacggaatggattaattctggcctcacatttaggctgtaacaaggtggagattgagtccgatcgtgttcctgtgattgaagctacaaaactactactccctctatctcaaaaaaaaaaaaaaa

SEQ ID NO: 9518 - DNA, 170 bp, Triticum aestivum
  Predicted polypeptide sequence is orthologous to G636
tctcagttcctcttgtgctgtgcttttgtcgacaagttgtggacctgttgaactgttgcaaatccaaagcacgcgaagaccgagaaaacaaagttgaattgaggctgtgaaaaaagttttcttttattattattattattattattattattattatcaaaaaaaaaaaa

SEQ ID NO: 9519 - DNA, 636 bp, Triticum aestivum
  misc_feature (553)..(553): n is a, c, g, or t
  misc_feature (594)..(595): n is a, c, g, or t
  Predicted polypeptide sequence is orthologous to G636
ccacgcgtccggaggccgggacgccccgcagcgcaccggccccgacttctgccggcttatcagtcgcgctggttcccgtcgccacggagcagcacgtcgtcgaggccgctggtctgggaggaggggagagcgtaggggggccgtcgtcgtcacggtggcccaagacggaggtgcacgcgcttatccagctgcgcatggacatggacaatcgctaccaggagaacggaccaaagggcccgctctgggaggagatctccgccgggatgcggcggctgggttacagccgcaactccaaacggtgcaaggagaagtgggagaacatcaacaagtacttcaagaaggtgaaggagagcaacaagaggcggccggaggactccaagacatgcccgtacttccaccagctcgaggccatctaccgcaagaagcacaacggcggcggcagcagcggcgccgcggccaacaacgccgtcgtgcctgtccctgccgtcgcggagcatcagaacctgaaccggcacgagatcgagatcgaggggaagaagatcaacgacaccgnacagaggaacaacggaggagtcggagccgcgcaggtaccgnnacagcacgggcagacaacgccgccgacggccacgtccgacc

SEQ ID NO: 9520 - DNA, 834 bp, Triticum aestivum
  Predicted polypeptide sequence is orthologous to G636
agcttgacattaggcctatttaggtgacactatagaacaagtttgtacaaaaaagcaggctggtaccggtccggaattcccgggatatcgtcgacccacgcgtccgggttttctttttgtcttttgaccactgaggttgctattacagaaacaaatcaacaaatggtataggatggtgccaagggctgctggtgctcatgaaccgaagaggaagctggtgcctggttttctttcggcacgggggtctactgaacggcaaggaaggtgctgcctgtcggggccgaactcgtcaccaccgtcgcagctgtcgctggggcagcaggagcgctactgcttccgccctctttgtgcttctggaactctatggtgtacttcatcttgtcatcctcgtcgccgtcgtcgtcgtcgccgtcatcggtgtagttgccttcgatgtcgtcgctgtccgtctcgtccgtcgccgtcacctccgtctgctgggactgaatgtttgactccattgccatcacgttgtcttcagacttcttggttgtagcgatggcatcaagcacggtactggccgcggccacctcgccgtcgccgggcggggcatctgagcttccccctccaacggtgtgcctcctgtcaaagtcgttgctgatcttaccctcgagctcgcgccaggggttatgctgctcggaggcggaagcgttgaccgcggccacagcgttcccggaggcagtgctagagcagccgccggcggcgttgctcacggcaatttgcttcttgcgtagataacctcaagctggtggaagtaggggcacgtcttgtattcctcggggcgcctcttggtgc

SEQ ID NO: 9521 - DNA, 681 bp, Triticum aestivum
  Predicted polypeptide sequence is orthologous to G646
tttttttttttttttttttttggcacgatgaacagagataaaatgttgtgtactctgatagtctgatgtgttagagctagctagccccaagtcgatcaccaaacacaaatgaacggctagagcacaattccgaggaagaagaagaagagaagaacaccagaaagaaagaaagaaagaaagaaagatatcaaacaccatatccaccatcttattaaacctttgtgccctatctccagctgcagcttggaagcgcatgcatgcacgcacagccgacgctccgatcgcatgagctatgcatgcatgggcgccgccgtccatgttaccaggtgccgccgccgccgatcatgccgttccagaaccccggcgtgtcgggctgcccaacgggggtgccattgccttgttgctccttgttgccttgctcgaactgatggtcgccgccatccacgcccgcgccagaaccaccgccgctctcaccgccagcggcgccagagtttgccgtcggcttcaagtcctcgaacgcgaacagcaaccttcccgacctgtcctgcagcccttgcatcgcggcactggagccgtaccccgccgtggaagccccgcccaccggaccgtgcgcgtccagcgagaagcctagcaagctctgcgactgcggtggcgccggcctcgtgccgaattcctgcagcc

SEQ ID NO: 9522 - DNA, 545 bp, Triticum aestivum
  Predicted polypeptide sequence is orthologous to G652, G1335
aaagactacagatacataccgagagaaaatgcagattactggtgtggtcaagtggttcaacgaaaccaaggggttcggcttcatcacccccgacgacggcagcaaggacgtcttcgtccacttcaccgcaatccaatcccatggcttcaagaccctcgccgagggccagcgtgtcgaattcgaaattcaagacggccaaaaaggcccgtccgccgtcaatgtcaagcccctagaggtagaggaggataagaggatttcgagcaaattgtaagaggatgctccacccatccacccgcgtcgatgtgtaatatcctatgctgcgttcggaaagattgctattgtttgtcttctcttctcacatgtacactgaaatctgcactgtttctcttttcttttttattagtacatcaagtctacaggggttaactgctgctccgttcgggtttgcaaggaatgtggattttgtttgagtcaattcttttttacttttttaaaaagtttatactacaaagaatatcgatgtttaaagtaccaaaaaaaaaaaa

SEQ ID NO: 9523 - DNA, 1124 bp, Triticum aestivum
  misc_feature (11)..(11): n is a, c, g, or t
  misc_feature (33)..(33): n is a, c, g, or t
  misc_feature (654)..(654): n is a, c, g, or t
  misc_feature (729)..(729): n is a, c, g, or t
  misc_feature (811)..(811): n is a, c, g, or t
  misc_feature (912)..(912): n is a, c, g, or t
  misc_feature (917)..(917): n is a, c, g, or t
  misc_feature (919)..(919): n is a, c, g, or t
  Predicted polypeptide sequence is orthologous to G652, G1335
acgcttccgtnagggttttggtccttcgttttncggcggcgcaagacgggggagaggttcaagggaaccgtgaggtggttcaacgtcaccaaggggttcggcttcatctccccggacgacggcggcgaggaccttttcgtccaccagtccgccatcaagtccgacggctaccgcagcctcaacgagaacgacgccgtcgagttcgagataatcaccggcgacgacggacgcaccaaggcctccgacgtcaccgcaccaggaggaggggcgctctccggcggctcccgccctggcgaaggcggtggtgaccgcgggggccgcggcggctatggaggcggcggcggtggctacggcggtggcggtggtggctacggaggcggtggtggcggctacggcggcggtggtggcggctacggtggcggtggctatggaggcggcggtggcggcggccgtgggtgctacaagtgcggcgaagatggccacatctccagggactgcccccagggcggcggtggcggcggcggctacggcggtggtggctacggaggtggtggcggcggcggccgtgagtgctacaagtgcggcgaggagggccacatctccagggactgcccccagggcggcggcggcggcggctacggaggcggtggcggncgtggcggtggcggcggcggtggcggctgcttctcctgcggcgagtccggccacttctcccgcgagtgccccaancaggcccactaggcggcacagctcttcagatctgagtgccccgtttacccttgctcctttacctacctcctgattctgcagncagtcataccctatacctatcagtactagtattagtcgccgtagcgtttccccctgctgctcgatgcgagcttgggttcagaagaattgctggtggtgtgntcgtnangatccaagttattttgctgtctctctgtgatgaggacacagatctatctatgtgttggatggacttagtaatcgaagttcaaaaaaaaaaaaaggccggccggtctaaagattcttcgaggggcccaagtttaccgttccccgctttcttgtcaaaggggtccctaaagggggtcgatttataaccaggcccgggccgcctttta

SEQ ID NO: 9524 - DNA, 1111 bp, Triticum aestivum
  misc_feature (649)..(649): n is a, c, g, or t
  misc_feature (726)..(726): n is a, c, g, or t
  Predicted polypeptide sequence is orthologous to G652, G1335
gacccacgcttccgagggtttcccgtcagggttttggtccttcggtttcgccggcgcaaaatgggggagagggtcaagggaaccgtgaagtggttcaacgtcaccaaggggttcggcttcatctccccggaggacggcagcgaggacctcttcgtccaccagtccgccatcaagtccgacggctaccgcagcctcaacgagaacgacaccgtcgagttcgaggtcatcaccggcgacgacggtcgcaccaaggcctccgacgtcaccgcaccaggaggaggagcgctcgccggcggctcccgccctggcgatggcggtggtgaccgtgggggccgcggcggctacggtggcggtggctacggcggtggcggtggcggtggcggctacggaggcggtggtggcggttacggcggtggcggtggcggctacggtggtggcggcggcggccgtggatgctacaagtgcggcgaggagggccacatctccagggactgcccccagggcggcggcggtggcggcggatacggcggtggtggctatggaggaggcggcggcggcggccgcgagtgctacaagtgcggcgaggagggccacatctccagggactgcccccagggcggtggtggtggcggcggcggcggcggctacngaggcggtggtggccgtggcggcggcggcggcggtggcggctgcttctcctgcggcgagtccggccacttctcccgngagtgcccccaacaggcccactaggcggcacagctcttcagatctgagtgccccgtttaccctcgctcctttacctacctcctgattctgcagcaagtcatacccttatactatcagtactagtattagtcggcgtagcgtttccccctgctgctcgatcccgagcttggttccagagaaatggctggtggggtgttcgccgttagatcccaattattttggtggttctctgggatgaggaccaaatttttttttttgtgggggggccaatttttcaaatgaagttggggtttaaaaaaaaaaaaaaaaaggggggcggcccaaaaaatccctccggggccccggttagccgccccccctttttgttaaaaggccccctgctgaa

SEQ ID NO: 9525 - DNA, 1180 bp, Triticum aestivum
  misc_feature (18)..(18): n is a, c, g, or t
  misc_feature (969)..(969): n is a, c, g, or t
  misc_feature (1151)..(1151): n is a, c, g, or t
  misc_feature (1154)..(1154): n is a, c, g, or t
  misc_feature (1156)..(1161): n is a, c, g, or t
  misc_feature (1163)..(1167): n is a, c, g, or t
  misc_feature (1169)..(1170): n is a, c, g, or t
  misc_feature (1172)..(1173): n is a, c, g, or t
  misc_feature (1175)..(1175): n is a, c, g, or t
  misc_feature (1180)..(1180): n is a, c, g, or t
  Predicted polypeptide sequence is orthologous to G652, G1335
tccgaccaccacaccganctagggtttcctgctagggttttagcccttcgtaactggcggcggcgcaagatgggtgagagagtgaagggaaccgtgaagtggttcaacggcaccaaggggttcggcttcatctccccggaggacggcagcgaggacctcttcgtccaccagtccgccatcaaggccgacggctaccgcagcctcaacgagaacgacgtcgtcgagttcgaggtcatcaccggcgacgacggccgcaccaaggccgccgacgtcaccgcaccaggaggaggtgcgctcgccggcggctcccgccctggcgacggcggtggtgaccgcgggggtcgcggcgggggtggctacggtggaggcggctacggcggcggtggctccggctacggcggcggtggcggcggctatggcggcggtggcggcagctatggcggcggtggcggctacggaggtggtggtggcggcggccgctacggcggcggcggcggcggcggccgtgagtgctacaagtgcggcgaggagggccacatctccagggactgcccccagggcggtggtggcggcggcggtggctaccgaggtggtggcggccgtggcggtggcggcggcggtggcggctgcttctcctgcggcgagtctggccacttctcgcgcgagtgccccaacaagaccatcgtagcggcgctgcccgtcagatctgagttgcccgttccccttcggtcctttttcctaccgcctaactcctgaggaagtcataccctattcctatcagtattagtataagtccccgtaatgtttcccggtgctctcgtaggaggaaaaatcaaaatgccacctggttcgaaaagtattgtggggggcgtgttcgttcgtagaagctatcttgttggcgcctccggtgggcacaaactatctatcttatttattggataaacggaccaaattgggcaccacctttanctttctggtttggaaaaaaaaaaaaatggggcgccgtgtttaattcccccccgggaccaagtttcccttcccccctattggcaaaaggggccccatagagggcatattaacgaacgcgggcgcttttccaaagccgcgcgcggaactgggcgttggcgattgctccgcaactctcctttggnggngnnnnnngnnnnngnngnngnttttn

SEQ ID NO: 9526 - DNA, 1123 bp, Triticum aestivum
  misc_feature (295)..(295): n is a, c, g, or t
  misc_feature (298)..(298): n is a, c, g, or t
  misc_feature (1046)..(1046): n is a, c, g, or t
  Predicted polypeptide sequence is orthologous to G652, G1335
cataccggccgcccttttttttttttttggttgcaatctcctcattcgcaccgaaaatttatcaccaataagccaggatcatcacgaccttagacatcaactgagagtacgggtacgggtaccagaggaccaattcatagcaaaattaaccatcacacggactgactgactgactgactttcccctaggattgattccgagaacggaaggggggaggaagataaaataagcgaggcggctgcggctgggcgctcaggcccagatcgatcgagcggggggggtttttttttgaggnatncaggcgccacctatagagggggaggggcagagatatcccctcacttggtgcagtcgcgggagatgtggccggtctcgccgcagtggtagcaggtgcggtcgccgccggcgccgcctcctccgccgaacctcccgccggcgaccccgccaaagccgctgctggtggggcagtccctcgggatgtggtccgggtcgacgcaggtgtagcagttaccgtcgcctccggcggcgtagccggcggctcctcccgcgggcgccgccggtggaccagtcccttgagcatgggggcttgttcggcggcacttgtaccaggcgcagccgtcggcggccacgagccggggccctggcagggagccgcccccggtcgggtgggcgcggtccccgcactttcactcgggcccgctgttctgctccccccggcgtgatccgtctgggcccgccacacagggccggtggccgaaccggcgaaccggtccccgcctcgtcgagacgggtccccacgcccacccccgccgcacgcgcgaccgcggcgcatccgcccggggggagcgccgcatgtgcgggtacgggggcagcgcgtcgcccttcgcgccgggcggtggcgatccgcccccgtcgcgggcgccctccacactatccggtggggcggtgcctgtgcccgccaccggccgagcgtcggtcgcggccgtgtcgcccgccgggggtgtgcgctcgcacgtgcccggcctcgtccggggtcttggcgcccngcggtccccgcggcgcccgcagtccggcccgtcggccggtggtaggccctcgtcgcgtcttctcactggcttcgtgt

SEQ ID NO: 9527 - DNA, 637 bp, Triticum aestivum
  misc_feature (548)..(548): n is a, c, g, or t
  Predicted polypeptide sequence is orthologous to G652
cggcacgaggctctctctctctctctctctctctctgtgtgtgtgtgtgtgtctctctctgcacgcgcggacgccatggacaaacctccggcgggagcagcagccaacaaggctggcaatcctccggcggcagcagcagccaacaaggttcgcaatcctccggcggcagcagcggccaacaactttgccaatcctccggtggcttcgctgcaggtggtggtgatagctcctgcagcgaatgtggtcgtcaatcctgcagcgaatgtggtcgtcaatcctgcagcgaatgtggtcgtcaatccaccagcagaggcggcgtcagagcgtggagctgcggaagttctgtggctgattgtttccctcttcattttggtgatcggcgtggttctgctgctgaactggtgcctctaaaagtagagaaactatgtcacgtctggggacgaaacgtactgtagactgaggagtgcgccacccgaccgatgaggacgacggtaaataaagtggcgcaggcatgggttaagttaaagctatcgtgcgtcgcgtactancgcgcgcgcgcgcgtgtgtggagcttataagctttgtgctgtaaaactgaaacaatctactacgtctgaaaataaagtaaactgaactc

SEQ ID NO: 9528 - DNA, 861 bp, Triticum aestivum
  misc_feature (683)..(683): n is a, c, g, or t
  Predicted polypeptide sequence is orthologous to G652, G1335
agcttgacattaggcctatttaggtgacactatagaacaagtttgtacaaaaaagcaggctggtaccggtccggaattcccgggatatcgtcgacccacgcgtccggcgcggatgaaggggacggtcaagtggttcaacgacaccaaggggttcggcttcatctcccccgacgacggcagcgaggacctcttcgtgcaccagtcctccatcaaggccgacggcttccgctcgctggccgagggcgaggtggtcgagttcgccgtctcggagggcgacgacggccgcaccaaggccgtcgacgtcaccggccccgacggatccttcgtgcagggcggcgcgggcggcggcgggggcggcttcggatcccgcggcggcggcggatctcgcggcggcgggggcttcggcggccgctctagagtatccctcgaggggcccaagcttacgcgtacccagctttcttgtacaaagtggtccctatagtgagtcgtattataagctaggcactggccgtcgtttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgnctgagagttttgcttactgagtatgatttatgaaatattatacacaggagctagggattctaaattgtttgtgtattttagattcacagtcccaaggctcatttcaggcccctcagtcctcaagtctggtcatgatcataatcagcccttacacattttgtagaggttttacttggct

SEQ ID NO: 9529 - DNA, 838 bp, Triticum aestivum
  misc_feature (579)..(579): n is a, c, g, or t
  Predicted polypeptide sequence is orthologous to G653
ggcctgccagctgttctacgtaccagctatactacgcgacggatgggcaatccaagtttttgatccttcagtcggtcccaaaggatgcagccaggatcagcaggctcgacacgagcttattgcgtcgtgcttacataatgcattgttcgggtgcctgcatgctgggtggccaacacgaaaggataactggtctaccatttcccctgttttatggataccacaattaccagggaggaaactggtaatttcgtcatgcacatcattaggtaccacgatggagagagtataccgatcaccaagaacaaccttgtgaaaactaaaagtacattctgcaagaagttatgaagctccaggggaacagttcatcattgccagccgatgcactatggtcagttcatgcccctaccgatggttatgaagctccaggggaacatttcatgcgacccatttagcgtgcccactacggacattcaatgaatattcattgtgtcaatccatgttgtatcgctatacatgactaagtgtgtatcgtacatttcctccaaaaccatctacctaaatggacaacctattatattnttcatgcgttatcattctaaaaaaaaaaaaaaaaaaatcggcacgaggagagagagagagaactagtctcgagttttttttttttttttttttttaaccgcacatactaattgaaagccgaaacacgtcgggaaccaggaacgatcgtcaccttaaacaacatgcattaatgcctgcttgaaaaatgaagagggaaaaacccgtgggactaccttattttttgggcattcttaaggtaaagaagtcccgtttcgaataa

SEQ ID NO: 9530 - DNA, 692 bp, Triticum aestivum
  Predicted polypeptide sequence is orthologous to G653
tttttttttttttttttttttttttttgcacaacgatttctttgaaagggacatgatattcatggttcaccaatgtgatcgagtctagcacagcagaggacacgaaattgataggtcccggtatcctcagaactggaacatggcatacaagcaggttgtaaaacagagggcttccgaattttcgccctcaagcctcactggagatatggtacattcagggagggaattcttgcagcggccggtggtggtgccggctgtgcttcggcgcgcttgactgatgcgcatttgatcagatggttgtagctccctttctccttgaaaagttgggagaaatggtgcttgcagtataggataccttccaaagctgcataattggatggcgaaatggcacagccaccgtgagaacatttgaagcaggacttgtggtaggcctgtccttcaactgtcaccttctctagaggatacgctgttttactgcaagtggcacacttctcctgtgtccctgaaaacatgcgtgcggctttgctaggtgatcttgtcagctcaggagtcaacttctccgatgcgggtttcgcgggtgattggaagctcttgttgtagctcccggtctccttgaacagttgctcgaaatggggcttgcagtatggcactccttcaatcgaggagtagttgccaagggagagggtggactt

SEQ ID NO: 9531 - DNA, 1160 bp, Triticum aestivum
  misc_feature (14)..(14): n is a, c, g, or t
  misc_feature (981)..(981): n is a, c, g, or t
  Predicted polypeptide sequence is orthologous to G653
cctcgtgcttactncgacccacgcgtccgtgcaaggtgtgcaccaagacggtgtaccccatggaccagctctccaccgacggcgccgtcttccaccgcgcctgcttcaagtgccaccactgcaagtccaccctctcctttagcagctactcctcgtttgaaggggtgccctactgcaagccccatttcgcgcagctgttcaaggagaccgggagctacaacaagagcttccagtcacaatcacccgcgaaatctgcgacggagaagctgactcctgagctgaccagatcgccaagcaaagctgcgggcatgttttcgggaacacaggacaagtgcgccacttgtggtaaaacagcataccctcttgagaaggtgactgttgaagagaagtcctaccacaagtcctgcttcaaatgctctcatggaggctgcgccctctcgccgtccaactacgcggctttggaaggcatcctctactgcaagcaccatttctcccagcttttcaaggagaaggggagctacaaccatctgatcaagtgcgcatcggtcaagcgcgcagcagaggcgcaaacagcacaggcggcggcacaggcagcgccggcggcagctgaatcctcctgattatgctgtcatctttaaagtgggctttgagggcgaaagtttggaaagccttgctctttttttacgattgtaacctgctgtgtgctgtgttctagctctggggataccaggaccatatttcgtgtccccttatgtgctagctcgatcacgttgttgaaccatggagttggatgtcatttcggaagaaattgttgtgcatcaaaaaaaaaaaaaaagggcggccgctctagagtatccctcgagggggcccagccttacgcgtacccaagctttcttgtacaaagtggtccctatagtgagtcgtattataagctaggcactggccgtcgtttacaacgtcgtgactgggaaaactggtagnctgggattcttgtaaggaaccttacttctggggggtgaataatgggacaactacctacgaaatttaagttctagggtaatttaaattttaagtgtttaaggtgtaaacaaccggatatgctgccgcttgaaagtttggtttctgagtttatttttgaaattttaaccgggagctgtgtt

SEQ ID NO: 9532 - DNA, 232 bp, Triticum aestivum
  misc_feature (120)..(120): n is a, c, g, or t
  misc_feature (129)..(129): n is a, c, g, or t
  misc_feature (191)..(191): n is a, c, g, or t
  Predicted polypeptide sequence is orthologous to G664
aaaatctccggcttaccatttgtgtgaaggccataacccggcgtgacgtcattccctggactccgggtaatccgccgtgacgtcatcttccattaagcccgttttttactccaccagatncgcaacggntcttatctttactaccatcccgaaaatcgaggcgtttcatggggagataaccacgccgtggnctcctcgttttgcgccatgcattacattcaaaaaaaaaaaa

SEQ ID NO: 9533 - DNA, 371 bp, Triticum aestivum
  misc_feature (292)..(292): n is a, c, g, or t
  misc_feature (325)..(325): n is a, c, g, or t
  Predicted polypeptide sequence is orthologous to G664
gcagatggccggcgagtgctgcagtatacgagtattctgttagcccaatgagccaattttatctacctgtgtcgacttataggcaaactgataatgaggacgttgagatcagatacatacctaaagggaattctaagatgggcgttatttctatcgaaaaaacatctcatttacaaagttcccttcaattcaaacttttccgtcgatggtgaagaatttgggtcaaacattatctttaagcccacccacaaaagaagacgacctaaaccaatgttatttaacaagatagagnttccgcaaattggacaagaactcaaaaactccnggcttaatggggataaatataaatatattaattcaaaaaaaaaaaa

SEQ ID NO: 9534 - DNA, 590 bp, Triticum aestivum
  Predicted polypeptide sequence is orthologous to G670
gcgccttctcgcagaggaggaggacctcatcatccacctccactccatcctcggcaacaagtggtctcagatcgccgcgcagctgcccggtcgcaccgacaacgaggtcaagaacttctggaactccttcatcaagaaaaagctccgccagcgcggcatcgacccggccacccacaagccgctcgccccagccggcgctgccgctgccgccacgcctgtcagccgctccgccgtgttcagcgaggccgagctgatactgtcgtcccccgtgggaggaccgcacatgccgccgctggtgtcggcggagagctacgtgtacagccggggcagcatggacggcgccggcggcgtggtgggcgggtgcagcgacgatgggtcactgtcctcgctgtcggggtacaacaacaacaaccagacggcggacttcgccgggtacctggatgcggacgccctgcacggcgcagtcatcccgtcggtgtcgagctccagcacgcttaactccatggccggcgtgagccccggcggcgtggccaacggcaacgctacggacgagctgtgctgcaacaactacaacaagaacaacccgagca

SEQ ID NO: 9535 - DNA, 535 bp, Triticum aestivum
  misc_feature (244)..(244): n is a, c, g, or t
  misc_feature (366)..(366): n is a, c, g, or t
  misc_feature (386)..(386): n is a, c, g, or t
  misc_feature (398)..(398): n is a, c, g, or t
  misc_feature (403)..(404): n is a, c, g, or t
  misc_feature (423)..(423): n is a, c, g, or t
  misc_feature (432)..(432): n is a, c, g, or t
  misc_feature (450)..(450): n is a, c, g, or t
  misc_feature (457)..(457): n is a, c, g, or t
  misc_feature (470)..(471): n is a, c, g, or t
  misc_feature (473)..(473): n is a, c, g, or t
  Predicted polypeptide sequence is orthologous to G670
atggaacctttgcagaggcaaccacagcgatgcagaaccagagccaatcactatacgatgatgtgatcaaagcagagagccagttcaacatggaagggatatgtgcttcttggttccagaatcagcagccacagcaacagctgcaagcagcatcagacatgtatgataaagacttgcaaagaatgcccttgtcttttggagcatatctaggtaccatgttctgccatacatggaacagagaagntcagcagaactgagacttgtctcacatttccgtgagcaggtatgctgagggcttggcatagatacatatgcgggttggatacagaacaaccctccacaaccttcccttggggtaataaagtnatgcaatgccaacggaaagnagtctgtcatcnagganngcgtccaattgcacagaanaattccggncccctttcttccccttgnaatgtgnttctccggtcacnnancaattttggtactggattttgtcaacccggtttacaaataaatgacaggatgggaaaaaaaa

SEQ ID NO: 9536 - DNA, 1104 bp, Triticum aestivum
  misc_feature (33)..(33): n is a, c, g, or t
  Predicted polypeptide sequence is orthologous to G670
ccgacccacgcttccgggagaggagtgcccctnaacctttccctgctttccactgaaatctctctatctgcaaccatacacactgttgctcttcttgctcaattctgctctcagcaaccatttctccatatataagtcactatcccctctgcatttcccaccccttcttcagccatggattcctgaagaagctccgtgctaccagaggaggcttctgctgtgagcaattgcaagctgtgtgagttccgcgaacctcgtcgggtctgcgaatttcaagctcgcaggctctgcattgcactgaaatggggaggcattcgtgctgctacaagcagaagctgaggaaggggctctggtcccctgaggaggatgagaagctcatgaaccacataaccaagcatggccatggctgctggagctctgtccctaaacttgcagggctccaaaggtgtggcaagagctgcaggctgaggtggataaactacctgaggccagaccttaagagaggtgccttcgctcaggacgaggaagacctcatcgttgaactccatgctgtgcttgggaacaggtggtctcaaattgcagcacagatgcctgggaggactgacaatgagattaagaacctctggaactcgtccctcaagaagaagctgcggcagaagggcattgaccccaacacccacaagcccctcaccgaggctgatcgcagtggagcagctcccaccatcagcaccgagaggacctctggtttcagtgacgtcaacccgtcaagcgctggtgctcaagggaacttcggtcacctcctcagcgagacagcccaatcgtcaatgctgctgccggtgtatgacaagaagcaccctgaaactcaagcttggcacgaactaaggtggcagcaaaggagttgtccctgaacaacttactgctggtcacgagagcccatcagctgtccgtcataaggtccacgcttgtatttcccttccaggagcaattagcttacacatgatggggcagggggaatggtgcaatttaacaggaacccccctgggttaccagaaggattcaactggggcaacccccaggggggggcaacggttcccatcagcctct

SEQ ID NO: 9537 - DNA, 1218 bp, Triticum aestivum
  misc_feature (822)..(822): n is a, c, g, or t
  Predicted polypeptide sequence is orthologous to G675
aaccaacgcgttggcgagctctctctatggtcgacctgcaggcggccgcactagtgattagcgtggtcgcggccgaggttagggaggagaggcagatagctttgtctccctccttcccacctgcaccatcctaccccaattctacctcaatcctatcaatggggaggtccccttgctgcgacgagaatggcctcaagaaggggccttggacacccgaagaggaccagaagctcacggactacatcgagaagcatggccatgggagctggagagcactgcctaagcttgcaggactcaacaggtgtggcaagagctgcagactgagatggaccaactacctgaggccagatatcaagagaggaaagttcacacccgaggaagagcagaccatcctccagctccactccgtccttggcaacaagtggtcagccatcgcgaagcacctccccggacggactgacaacgagatcaagaacttctggaacacccacctgaagaagaagctgatccagatgggcttcgacccgatgacacaccgaccgaggaccgacttcttcgccgcgctgccacagctcatcgcgctcgccaacctccgccagcttgtggagcagcgcccgtgggacgatcaaagcgccagccagctgcaagccgatgcagtgcaggcagcaaagctcgagtacttacagtgcctgcttcagtccgcagcagccattgcaactagtcccagctccagcagcatcaacaccatccccactgacctagagcaaatcggcctcctgagtccttcgcagatgtcttccttgtcttcgctgtcatctccanggatcctggagggtatcaatggccaagacttagtatccgggcaagtgcctgacatccaggtacctagtagctcattctttgaacatgaacagcctatcatcaatggtaccaaccagaactcagattacagttgcaacagcggtgaaggggagaatggcacccagaaacgctgctcctgtcagaggactcccttcggcacttaccgactttcctatttcaaactcggggatgctgcagcacctcagctgtgacgctagggcacaacacccagttcttaattggtcgattcatttatgattagttatgacccagttggatgattctgaccgcaagggttggcaccttgggttgcttttcaatttggtttcccaaattaaccctattgggaatgggtca

SEQ ID NO: 9538 - DNA, 218 bp, Triticum aestivum
  Predicted polypeptide sequence is orthologous to G681
tggatgtagctagatggcaatggcgcatgcttgggtggaagagattgtgatgtaagatggatgtacgtacgcagctatcgatctggtgtgtttcccctcatggaagaagaaaccatcaagcttcacattgcgtctgggaattttatttgtgtacagtgtactcactttgttgtttggcatggcaatcgatcgttcatttgcgatgcaaaaaaaaaaaa

SEQ ID NO: 9539 - DNA, 1874 bp, Triticum aestivum
  Predicted polypeptide sequence is orthologous to G715, G1646
gcacgagcccacccacaaccctagctcccccgaacccatggatcccaccaaatccagcaccccgccgccgccccccgtcctgggcgcgcccgtcggctacccgccgggggcgtaccctcctccgccgggcgcccccgcggccgcctacccgccgcagctctacgcgccgccgggcgccgccgccgcccagcaggccgcggcgcagcagcagcagcagctgcaggtgttctgggcggagcagtaccgcgagatcgaggccaccaccgacttcaagaaccacaacctcccgctggcccggatcaagaagatcatgaaggccgacgaggacgtccgcatgatcgccgccgaggcccccgtcgtcttcgcccgcgcctgcgagatgttcatcctcgagctcacccaccgcggctgggcgcacgccgaggagaacaagcgccgcacgctccagaagtccgacattgcggccgccatcgcccgcaccgaggtcttcgacttcctcgtggacatcgtgccccgggacgacgccaaggacgccgaggcggccgccgccgcggccatggccacggcggcggccgggatcccgcgcccggccgccggcgtgcctgccaccgacccgagtatggcatactactatgtcccccagcagtaatgtatcatcgatctaaacttgcgcatttctaatcggagaatgtgttgttgttctgtgactgtccttggtgctgttgttgctgcggcgtaataagatttatgggcctcccctgagcttatgaattgagctgttcggttctagtattacagtaggattgttgtaatgggggaggccgtatgattgcttccgtagtgcatgactaactggccacccagtgtaatctgataactattatctggcgcctcccatggttactatgtatttatgttcttcacacagtcctctttgtctctaccacttcgaggagttcttcggaaggatgggctccaagatgcttctggtcaccgctctcttggtgggcatagcctctcagagctatgccaccaggagccttgacggaaaccacttggctgatcagaagtacggcggcggcggctacggaggtggcggtgggggctccggaggtggtggtggctacggaggaggtggcagcggcggcgggggtggctatggaggaggcggcggcggtggctacggaggaggaggcggcggttacacaccgatgccaacaccgtcgacccccagccacagcggatcctgcgactactggaagggccacccggagaagatcatcgactgcatcggcagcctgggcagcatcctgggctccctcggagaggtgtgccactccttcttcggcagcaagatccataccctgcaggacgcgctgtgcaacacccggaccgactgctacggcgacctgctgcgcgagggcgccgccgcctacatcaacgccatcgccgccaagaaggagaagttcgcctacaccgcctaccaggtcaaggagtgcgtcgccgtcgggctcacctccgagttcgccgccgccgcgcaggccgccatgttgaagaaggccaactacgcctgccactactaggaggctaggctaccggccggccgccccagctggtggtcgtcggtggctaaataagtccatatatgcatgcacgtgtcgtgcatgttttcatgcagtttcccggatgcgcgcgcgcgtgtcctccgctatgcctttatgtgtttgcttgccgtttgatgatgcatgccatgccgtctcatatatacgtagtgatgcttaatgctttgcttgcttttcttatcttcgttggtgatgtaagaataatttgattgaggagttattagtgaaagacatagtatgcaaaaaaaaaaa

SEQ ID NO: 9540 - DNA, 1070 bp, Triticum aestivum
  misc_feature (955)..(955): n is a, c, g, or t
  misc_feature (994)..(996): n is a, c, g, or t
  Predicted polypeptide sequence is orthologous to G715, G1646
agacccctcacacctgccgccctgtttttttttttccactgctaattacgatgcacaaaaatatttggagaaatggcgcgacggaaattatcttatcagttagacatgcatgagcatcatacggcctgcctcgatcagaagaacctagccgggttcttctcggatcgaatcacttgtaacatagaggaggcccctcaaataatggcaacatcttaaattattcagcggtgaacaaacaaacataggagagcactaaatcaacagcacaatcttagatgcaagtgggatccgctgtaacatactgcaggtgttactgctgcgggacgtagtagtaccccatgtcggcggcgggcatgccggcggcggggtggggcatcccggcggcgacggccgcctcggcgtccttggcctcgtcccgcggcacgatgtccaccaggaagtcgaagacctcggtgcgggcgatggcggcggcgatgtcggacttctgcagcgtgcggcgcttgttctcctcggcgtgcgcccagccgcggtgggtgagctcgaggatgaacatctcgcaggcccgggcgaagacgacgggcgcctcggcggcgatcatgcggacgtcctcgtcggccttcatgatcttcttgatgcgggcgaggggcaggttgtggttcgggaagtcggtggtggcctcgatctcgcggtactgctccggccagaacacctgcagctgctgctgctgctgcgccgcggcctggtgggaccccgggggaaacgcgggcggggggcgcttggggcgcgtataagggcccccgcgtccggttacccgggggggggggggggccgggttaactggcgccggccgggttaccgtctggccgccccccatcatgcggcccccggggcccgaaggggtgggggacttggggccctactccacgttaaggttcttcggccacacggacgtganggcgcctcaaaccagcgcgcgccagcttatcccacggcnnnccagccccgcgcccagggggcttgttggtcccaggcgcggtcaccctgggctgcgccaccatccgcccggggca

SEQ ID NO: 9541 - DNA, 1028 bp, Triticum aestivum
  misc_feature (8)..(8): n is a, c, g, or t
  misc_feature (10)..(10): n is a, c, g, or t
  Predicted polypeptide sequence is orthologous to G715, G1646
gggagacncnagagcggccgcccttggttttttttttttttttttccaaaagggacaaataactagcttgttgttagtccttagtggacgcaagacatgccatatacttgcacaattacaattacattgcgcgccgtggtaaatagcattgagtatacaatgcgcgcatacagctctggcatcgatcactcggagcttggaggcccaggagggaaaccagctgagccaccatggccccccgtgtacccttgcccttcctcgccgaagctcccggcaccctggtccacgtccggcccgccttgctgccacgccggttcccacgccggaacatgccaggccggcatcatcggtgccgccggctgccccatcggcggatagtagtacggcagcccagcggcggggcccccaccggccgcaccaacccctccggcggcaaacccgagggctgcgctgccgggctcctccttggcctcctcgcgcggcacaatgtcgacgaggaagtcgaagacgtcggtgcgcgcgatggcagcggcgacgtcgttgcgctgcagcgtccggcgcttgttctcctcggcgtgcagccaggagcggatggtgagctcgaggatgaagagctcgcaggccttggcgaagagcacgggcgcctccgcggagatcatgcgcacgtcttcgtcagccttcatgatcttcttgatccgcgccagcggcagctggtggttcttgaagtcggacgccgatgcgcgctccgcctcctggcgctggtacgcccagaaagcctgcagctggggctgctgctgctgaagcaggtggtggtgtggcaccggcggcggcccaggcacgccaggcaccggggctcctccggccgcgccccgtgccggcgggtggggtggtgtagggcaactggtgggtcctccattggcgatctagcttgcgatctgcaaacttaggggaatgtataacctggggcttgggagaatcaaaagaaccccccgtgggtgagacttggagttccttcttggcttcaagat

SEQ ID NO: 9542 - DNA, 832 bp, Triticum aestivum
  Predicted polypeptide sequence is orthologous to G715, G1646
atgaccattaggcctatttaggtgacactatagaacaagtttgtacaaaaaagcaggctggtaccggtccggaattcccgggatatcgtcgacccacgcgtccgtctagcttggcaatggccgcgagggcgtgtcctgctgcttctggttaccgtgtgtgctgaagcatctgacgcgcttgcgccgagcagcaggagctagccgttcatgctcttcttccctccccttggcatctgaagcagtaagagctcaagttcacagagggcgttcgtccgatctacaaagcccagctgtacatcgccttagctagcttgcagatcgcaagctagatagtaatggagaaccaccagctgccctacaccacccagccgccggcaacgggcgcggccggaggagccccggtgcctggcgtgcctgggccaccgccggtgccacaccaccacctgctccagcagcagcaggcccagctgcaggcgttctgggcgtaccagcggcaggaggcggagcgcgcatcggcgtccgacttcaagaaccaccagctgccgctggctcggatcaagaagatcatgaaggccgacgaagacgtgcgcatgatctccgcggaggcgcccgtgctcttcgccaaggcctgcgagctcttcatcctcgagctcaccatccgctcctggctggccgccgaggagaacaagcgccgcacacttgcacgcaacgacgttcgccgctgcattcgcgcggaccgacgtcttcgacttcttccgtgaaatttgtgccccgcgaggaggcccaaggaggagcccggcagcgcagccctcgggtttgccgcccggaaggg

SEQ ID NO: 9543 - DNA, 664 bp, Triticum aestivum
  misc_feature (11)..(11): n is a, c, g, or t
  Predicted polypeptide sequence is orthologous to G718
gggccggcggnaggaggcggaggaggagggggcgtgaggtgccaggtggagggctgcggggtcgagctccgcgacgcgaaggagtaccaccggaagcaccgggtctgcgaggcccacaccaagttcccccgcgtcgtcgtcgccggccaggagcgccgcttctgccagcagtgcagccggttccatgcgctgtcggagttcgaccagaagaagaggagctgccggaggcgactgtccgaccacaatgctcggcgcaggaagccacagccggacgcattctcctttgcaccggcaaggctcccgtcgtcattgatgtttgatgatagacggcaaataagttttgtctggaataaagatccaagccatgcaaggcctttcccatgttctccatgggacagcccatctgacttcaagctcccgcaagtgaaggaaataagagaggtatcaatcaatggacaagttcattttgataaatctcatctacctaatgctgttccagcactgagtcatgacatagctgagctgctaccaatgaaaggtccggacgcatctgtaaccgcttcgaaattaggtggagcaccggatcttcagcatgctctctctcttctgtcagctagttcttgtggattacctgatcctgtacagcaagcatcttgtctcgtcc

SEQ ID NO: 9544 - DNA, 713 bp, Triticum aestivum
  Predicted polypeptide sequence is orthologous to G718
cggcacgaggccttctcttctccctcagagatggggtatggctcttccaagagctccatgtccgcgtcgatcgattcttcgaacagggctgggaacaacatggagttcagatttgcgcctgtcaaaaaccctgataggaacacgagcaagaacaccgagctgggtaaagttgataacacgagaactggaacatctccgtcgcctgtggtggcagtgagcagtggagagccggtgatcggcctgaagcttggcaagagaacttacttcgaggatgtctgtggagggcagaatgtcaagagctcgccatcgggtgctgcgagcgcgccaaacaaatctcctgctttgggcaagaaggcaaaggcgtaacaacagaagccacataactcgtactgtcaggttgaaggctgcaaagtcgacctctcttctgttaaagattaccatcgaaagcacagagtctgtgaacttcactctaaggctccgaaagttgttgtcgctggtctggagcgacgcttttgccaacagtgcagccggtttcatgctttagctgagtttgaccagaaaaagcgaagctgccgtaggcgtctcaatgatcataattcccgcaggcggaagccacagccagaagcaatttctttcagttcatcaaggatgtctacgatgttttatgatgcaaggcaacagccaaatttcctatttggtcaggctccttatgt

SEQ ID NO: 9545 - DNA, 653 bp, Triticum aestivum
  Predicted polypeptide sequence is orthologous to G720
acgcagaatgggtacggatttcattgttctagcaccatggataacagaagtggcatgcctcaaaattctatccaacatcagccggctgaggaggtaattgacgaggttgtgaaagaagcaataaacaagccatggttacccttgcccttaggcctcaagccaccttctactgatagtgtgctagctgagctctctagacaaggcatctccaccatccctcctcgcaatcaacgcctctaaatcctgctgatgtggctccacatcacccggaactgacatgtctggagtttggaccacccaccttcgctgcacctgcatgcacttcccccattaattgaccgatcaacgtttggagctacgcgccttttgggagcgcgtagctttttgttttgtatcgcggacatcatgccaaacgaagaaacaaaagaaagaaaactgatccagtttatcgccacagtgaaaaggatcaagtgcggtcgctttcattggtgacaaaaattgtatggactagaaatagccgcgtagatttgaatgccaccgcagtttcgatatgtggttgtaaatagtttctaacatgagacatggaacccttttgcttattttgtttttgttcaaatattttgtttgaattttgaaaaaaaaaaaaaaaaaaa

SEQ ID NO: 9546 - DNA, 793 bp, Triticum aestivum
  misc_feature (354)..(354): n is a, c, g, or t
  Predicted polypeptide sequence is orthologous to G720
aacagctaggtagatgattacgccacgctatttgtgtgacactatagaatactcaagctatgcatccaacgcgttgggagctctcccatatggtcgacctgcaggcggccgcactagtgattagcgtggtcgcggccgaggtgggcaggtcaaagaactctttacatgatcatctcagactgatacacaggttgtacctcaaatgatgtcgacaagtgccttggcatggccatctcagaatagccaacgaaattacgaccccactgtatgatgatcggttaagccactccccacggaaaacagaacgtatctctcagcttaggtacatttctggtacatgactacatgatgcanactgcttcgacgacaagcagatacttgaactgcacacacatggggcgatatccatctgacagtgtgcaaatgacactactcagaagctccaccgtcaccattgaagacatttgtaagtgttcgaatgtgtccagtcgctgcccgtatcagacctgtaaatgggagggagggttttcgaaggcccccacttgaattctgggtgggaactgaaaccctatttaaaaggggggggacttttgtacccttaaaccccccatccaatttccccattttctctcccaaccaaaaaaaggggggccccccaattctccaacctttggggaaaaaagcgggggggtggcccccttttttttggacaaaggggggccccatcttacatgtgggggggggtctccccccacggttgctacttgtaaaaacacctgtgttttttcggaaa

SEQ ID NO: 9547 - DNA, 748 bp, Triticum aestivum
  misc_feature (583)..(584): n is a, c, g, or t
  Predicted polypeptide sequence is orthologous to G732
attcggacgagcccggacctccgggcccagatggagaagaggaggaagaggaggaaggagtccaaccgggagtcggcacgccgatctagggtgcgaagcaacaacacctcgacgacctctcctcgcaggtggatcagctgaagaaccagagccagcaactgagcatggtgctgggcatgaccacccaaaaccttgtggcactgcaagcacagaactcggtgatgcagacacagaagatggagctggagagcaggctgtgcgccctgggcgagatcatctgctgcatgaactcaatcaccaacgccgcgaaccccgccgccgccatgggcgccacggcaagcggtgcctacgacatttttggcgccggcagcacatggagccagcccatagacttgtaccagtgcttctagggaagaagaagaatggatggttgatgttgtcatagctggtagggcctctgtgaaggcatcaggttctgtatcaatcatgtagggccttcgtgtcaccattgatgcgtgcccccctctctcttgattgtttattttgtgaggttgggttgtaatggttggtgagggaagggtanngagggaattgatgggccattttgtcaaagagagagagaggctagggattttctactggctcctgatggtgatgtctagctagtaagatgtggaattggtacctcttgatatatagtatatgcaaagtgcttctccatcttcatgtactccctgactttgtacta

SEQ ID NO: 9548 - DNA, 645 bp, Triticum aestivum
  Predicted polypeptide sequence is orthologous to G732
ttttttttttttttttttttctccgtcgatgtcacactataaatcagtcgaaacaggtacagccactctttaatttccttgcccctgcccacccaatagcactactctacttgggaggaaaagcataagcacatactactactagacgcatcgacaacacagagctgcacggaaccagcatgatgcgatctgctagcagtagtaggggtagttgcagtacaactccgtttgcaggatcggctgctggggcaaggcggtgccgttgacgccggcgagcgggatggaggaagcacccatggcggcggccgcgtcgatgtactggatcagctcggcgagcgactcgaggcgcgcgcccagctccagcgcccgcgcatgcaggagctcgttctcggcctggacgaccgcgcaccggcgcgcggcctcctgtgccgccgctgccacggcgcagttccgggcgcgcagtgctgccgcctccgcctccagctcgtccacctgcagcagcttgcgcgcgcgcgaccgctgcgcggacagccggttcgactccttgcgcttccgcttcctctcctcggtcagcgccgcaggcggcgcccgtgtcgcctccgagccgttcaacgacgacgtgacgggaccctgcagcccggggga

SEQ ID NO: 9549 - DNA, 1131 bp, Triticum aestivum
  misc_feature (787)..(787): n is a, c, g, or t
  misc_feature (924)..(924): n is a, c, g, or t
  misc_feature (1029)..(1029): n is a, c, g, or t
  Predicted polypeptide sequence is orthologous to G732
gacgtaccgatataacctgcttatgcttaagagcccccggagttgcctctcgattcgcatctaagtcctgctttctcccttccccttcttatttcagtccctgtagtttggttttccttaagagtctactccctgttccgttgcaaataagcccctgagctctgtcctattctagcctcaactccttggtctcgggaggagttcgtcgcagattcgatctagagagcctccccgcaccacccatgtttaccctccccttcctctgacggccgccgtcccccgatgaagctgcgcgtccgctgccgctcccactccttctccgtcgccttcctctactggttctacgacttctcatgaactcctcgccccccgacaacgccgcatccatccagcctctagttgattagatccagcctcgtttcttccactttcttgccttcttcctccccaccatcaaagaaaagagatctcttttctggttcttggatcaagaacccgaccgaccatgtcgtcgccgtcgcgccggagctccagccccgagagcaacatcgacggcggcagcggcagcggctccgccggtgacgagcgcaagcgcaagaggatgctgtccaacagggagtcggcgaggcggtcccgcgctcgcaagcagcagcggatggaggagctcatcgccgaggccagccgcctccaggccgagaacaagcgcgtggaggcccagatcggcgcctacacgaccgagctgaccaaggtggacggcgagaacgccgtgctccgcgcgcgccacggngagctcgccggccggctgcaggcgctcggcggcgttctggagatcttcaggtggccggcgcgcccgtggacatcccggagatcctgacccgctgctccgcccatggcagtccccgttcgcgccccagctggccacgncggcggcatgctgacgcgttccagtctgagccaagaaagtcatgcacggcgacattgcgccacgtggatagggtgatgatactggtgcgctgctgaagatgctanaccactagttggttgctcagtgttaatatgggaacctagacaccataagactaatttggggatggaacctccaatgcccaccagtgaattggtaaaaaagga

SEQ ID NO: 9550 - DNA, 1647 bp, Triticum aestivum
  Predicted polypeptide sequence is orthologous to G735
ccacaacccatgggttagccatagccaaaacccgtggtgtgtcacccgcgtcattgggcatctccgtcctctcttcgccggttcccacggggttaaaaagtttaagccataccattcctcgcccaattttgttctaatcaatcacctttgccccagttccatttcggaaagcttccatggagcccgtgttcttctcactggaggaggcgatgcccgagcccgactctaacccctgccggacctcgtcgccgccgctggaggcacacatgctcgtcgcaggactcggaggagtgggcgccggcgaggtcgtcggcgggtgcgcgacgaacgagtgcgcgacagaatggtgcttccagaagttcgtggacgagccgtggctgctcaacgtccccaccgcgccagtggcgaaccccgaagcttcgacgctttaccctaatcccacggccgaggggagccgcaagaggccgtacgacgtccatgagatggtgggcccggaggaggtcatccccacgccgcctgcggcgagcccggtggtggaccccgtggcgtacaacgcgatgctcagacggaagttggacgcgcatctcgccgccgtcgccatgttgaggaccactcggggaatttgcccacaaagctcccatgacaatggagcatcgcaaaattcagattccatccaaggctcagaaaaccacaccggagatgtcagtttgcatcaacttagctcttcctcattggagccatcaccatcagatggtgatatggaaggggaggcacaaacaattggaactatgcatattagtgcagagaaagcgaataagaggaaagaatctaacagggattcggcgagacgctcaaggagtagaaaagcagctcatgcgaaggaactagaggagcaggtctcactattaagagtcgcaaataactctttgatgagacatcttgcagatgtaagtcacagatacgtcaatatctctattgacaatagggtactaaaggcaaatgttgaaaccctagaagcaaaggtaaagatggccgaggaaactatgaagagggttacatgcaccaacaatttcccccaagcaatgtctagcatatcatctctcgggattcctttcagtggctccccattgaacggtatctgtgataatccattgccaacccagaacacctcacttaactacctccctcccacaacaacaaattttgatgtgaacaacaactacatccccgagccagctctggcgttccagatccaggatcaaataccttcgctacatatgcaacctatgtcatgcttggatcatcacccgcagaggatgcacataggtattcctacatcagcacctactccgcaacgggaatctactacattggattcaactgaaatagtcaacatggtgatgtagtaggaattttatgggagacctgagcaggaattacttttctcaaattgttttcgttgttgttgttgttaaccgttgggggtatttagaatggtttcttcaacttgttaagtggacatttcttagacttgtttaagaaatatatattgttgttgtttcagaataagaacctagacatagttggtctttgataactaatacatatattgaaggttattggacaataaagtgatgtggttgagtc

SEQ ID NO: 9551 - DNA, 707 bp, Triticum aestivum
  Predicted polypeptide sequence is orthologous to G735
gcacagttttactaaatctgctgtgtttaggaaacatagcgacgaggacactagaggtcacagccaaagaacaaatagcataggattatcaacatccaccaccaagatatgtgtctgcccaataaccatttcttgggactttcctggcttgaagaagctggctgttcctacgaggtcgatccggatgaagccggtccgccacacatcctctgctggaggtgctccaggctcgccacacgatgcagcgagtcaggtctgcccatcttgccggtatccatggcctcattgaggaaattgtcatcctcttgcgccgaggaggccatctcgggcatgtatccgttgttacctccggcctcgcttgtggagaagtaagcgctaaggtcgtccgggacggccgcgtcggaggtggcctctgatggggagccggtgaagggcatgctgagggacgacatgtcagagcccgcagggaacagagcgctcatgcctgtcacccgcttcaccgagtcctctgccatcttcacctttgctctcaaggtttcaacatctgcttttaataccctattgtcaacggcagcaccattgtatttctgattaacatcagcaagccgccttaacagtgaggagttttcaactcttaactgtgatacctgtgcttctagctattcaggtgagctgcctttctgcttcttgaacgcctggccgattcc

SEQ ID NO: 9552 - DNA, 628 bp, Triticum aestivum
  misc_feature (347)..(347): n is a, c, g, or t
  misc_feature (410)..(410): n is a, c, g, or t
  misc_feature (417)..(417): n is a, c, g, or t
  misc_feature (447)..(447): n is a, c, g, or t
  misc_feature (457)..(457): n is a, c, g, or t
  misc_feature (469)..(469): n is a, c, g, or t
  misc_feature (475)..(475): n is a, c, g, or t
  misc_feature (507)..(507): n is a, c, g, or t
  misc_feature (554)..(554): n is a, c, g, or t
  misc_feature (567)..(567): n is a, c, g, or t
  misc_feature (574)..(574): n is a, c, g, or t
  misc_feature (594)..(594): n is a, c, g, or t
  misc_feature (610)..(610): n is a, c, g, or t
  misc_feature (617)..(617): n is a, c, g, or t
  Predicted polypeptide sequence is orthologous to G735
tttttttttttttttttttgacaacgcacagttttactatctgctgtgtttcaggaacatagcgacgaggacactagaggtcacagccaaagaacaaatagcataggattatcaacatccaccaccaagatatgtccgcccaataataatttcgtgggacttcctggccccaaggagcgggctgctcctacgaggtcgatccagatgaagccggcccgccacacatcctcttctggaggtgctccaggctcgccacacgatgcagcgaatcaggtctgcccatcttgccggtatccatggcctcgttgaggaaattgtcatcttcttgcgcagaggaagcatctcangcattacccgttacctccggcctcgcttgtcgagaagtaagcgctaaggtcgtctgggacggncgcgtcngaagtggctcccgatggggagccggtgaangcatgctganggatgacattcngagcancaaggaacatacgctcatgccgtcaccgcttnacggatcctctgcaacctcacttgcctaaggttaacacgctttaaancctatgtaacagnacacatntattctgatacacacaatcnctacatgcagtccaanctaatgnatacgtcttca

SEQ ID NO: 9553 - DNA, 847 bp, Triticum aestivum
  misc_feature (509)..(509): n is a, c, g, or t
  Predicted polypeptide sequence is orthologous to G735
acgcttgacattaggcctatttaggtgactctatagaacaagtttgtacaaaaaagcatgctggtaccggtccggaattcccgggatatcgtcgacccacgcgtccgggtgaatatagctgaagaagctgtcaggagagtaactggggcaagcttgatgttctccactacgtcaaacagggcgcccttggcttcatgtgtatctgttgcagcttctgctgatgctgctcccgcagaggaaagcatgagccatttcctccagggtttacttgaagacgatatgatcaaacatgacctctcagaggtagcaacccctttgcccagtggggaagagatgacctcaaggccggcccctttgcgacgcgtcgcgagcctggagaacctgcagaagaggatccatagagattcagtgcactctgaggacacgtcgattttctcggaccatgaagtccctgccaatgctcagtaactggattgtgtaattctccagtgggctaagttttgtcgtanagtatggaggctgtggcgtccgtgtatatctggatgctgaactttgtgtatactatttttgaagtaaataacctgcacttcagtcttctgatccaaaaaaaaaaaaaaaaaaagggcggcccgctctagagtatccctcgaggggccccaagcttaccccgtaaccctgcttttccttgaacaaagtgggtccccttatggggagtccgaatattaagctaaggccctggccctccgtttttaaaaccgtcgtggactgtggaaaaacttgccaactttggaaaatcttgtggaaaagaaaccctttactttctggggggtgggaacaaataattgga

SEQ ID NO: 9554 - DNA, 432 bp, Triticum aestivum
  misc_feature (302)..(302): n is a, c, g, or t
  misc_feature (313)..(313): n is a, c, g, or t
  misc_feature (333)..(333): n is a, c, g, or t
  misc_feature (374)..(375): n is a, c, g, or t
  misc_feature (381)..(381): n is a, c, g, or t
  misc_feature (400)..(400): n is a, c, g, or t
  misc_feature (402)..(402): n is a, c, g, or t
  misc_feature (416)..(416): n is a, c, g, or t
  Predicted polypeptide sequence is orthologous to G736
acttcataagttcgaaacgacctctttttatctgcttggttcttcatcaattgcctcgccctgttcaggtgctgctgtaaaagctcctggacggtatctcgctcttcaatccatgactggagtgctggcaccgaacaagagttctctgctgtaatctcccagtgcctcggctcatacccaaacatggctttgaagggtgtcatccctatagccgagtgggtgggacttattgtaccagaactgtgccagcgggatccaaaaactccaccgtcttcggaaagcttgaagtgaaacatctcaanaatgtttccanacactggttaacccgttccntctggccatctgtttgagggtgggttggccttgctgaatannattgtntgcccgcggccttaaatancncctgccaaaatggntgtgaaaaaaaaaaaa

SEQ ID NO: 9555 - DNA, 562 bp, Triticum aestivum
  Predicted polypeptide sequence is orthologous to G740
ccagcgcttactggtcaggtgaagtggttcaacgagagcaaggggttcggctttatcacccccgacgacggcagcaaggacgtcttcgtgcacttctcggcaatcgttgacgccggcttcaagaccctcgccgagggccagcgtgtcgaattcagaatcgaaagcggcgcaaaaggcccgtccgccgccaatgtcaaggccatataggaggaggagcaatatcggcatccttttgtaatttgctccacccgaccgagcaaatggagtccaagagtatgctgctttaggaaggattgttatttgtttgtgttctattctcaccagtgcactaaaatctgtactgtttctttcttttcttttcttttcttttcacatcaaatctacacgggttaattactgttgcgttcgggtttgcaaggaatgtggattttgtttaagtcaaatctttaaacttcgaataagtttgtacaaagatgtactgtatcaatattcacagtaccaaatcaatatcaataaattatcatgaaatctcttcttataaaaaaaaaaaaaaaaaaaaact

SEQ ID NO: 9556 - DNA, 700 bp, Triticum aestivum
  Predicted polypeptide sequence is orthologous to G740
acaaaaacatctcggaagatcacatacgagcaattaaatagaaaacaacaacatatgcgtgcatgccccagctcaggagaagagagacactgagacacagctggtagcctggtaccagcgaggaaggaaccaaaaaaagggccgaggcccgggcgtcgctgccccgtttgttgtcgtcccggcagcagccgtgcggcccgtgccagtcccgcaactctggtggcctcacattagccgtacatcggacgacctcggcaggaccgcttgtcggtgcagatcggagcaatccagaaaatagagttgggaaatcaccgggccggcctcgtagcagcgcagccaccggcgggtcgtcatagactcatagcaccggcggccgcccttggagcgcagctcagcaccgagcgtagccacggaaattgaagcatcaccgcagcctcgcggcacctccgtggtgtcgacgcttgtcgtagcacgcctctcgccgtggcccgtcgccgccttgcaacatccctcagcgccgccgccgggaactgccatcgtcccgcaaccatggcggctgtcgccttgcagcactgtcatctccccctctcgcagaagagcatggcgagctccggcggccgggccgcgagagaggcgagcctattaggcatgggtgctgttgaaggaggagcggcgattgaaagataaatggtggcacaga

SEQ ID NO: 9557 - DNA, 563 bp, Triticum aestivum
  Predicted polypeptide sequence is orthologous to G740
tttttttttttttttttttggtaattctattgatactgatttggtactgtaaatatctttctttgtatacactcatttaaataaaaaaaaaaatttgactcaaacaaaaaacatattccttgcaagcccgaacggagcagtagttaacccatgtagtcttgatgtaaaatgaaaaggagaaacggtgagaagagaacacaaacaagagcaatccttccgaacgcagcataggatattacgcatcgacgcaggtggatgggtgaagcatcctcctataatttgctcgaaatgctcttatcctcctctagctctagggccttgacattgacggcggacgggcctttttggccgtcttgaatttcgaattcgacacgctggccctcggcgagggtcttgaagccgttgccagcgattgcggtgaagtggacgaagacgtccttgctgccgtcgtcgggggtgatgaagccgaaccccttggattcgttgaaccacttcaccttaccagtaatctgcattttctctcagtatgtatccgtagtcttttctctgtctaaatctcgcct

SEQ ID NO: 9558 - DNA, 496 bp, Triticum aestivum
  Predicted polypeptide sequence is orthologous to G740
tttttttttttttttttttttttgatttaaacaaatccatattccatgcaaacccgaacgcagcagtagttaacccgtgtagattttttgtaaagaaaaaaagaaagaaacagtacagatttcagtgcactggtgagaatagaacacaaacaaatagcaatccttccgaaagcagcatactcttggactccatttgctcggccgggtggatgggtggagcaaattacaaaaggatgccgatattgcttctcctcctatatggccttgacattggcggcggtcgggccttttgtgccgttttcgatggtgaattcgacattctggccctcggcgagggtcttgaagccggggccagtgattgccgagaagtggacgaagacatcattgctgccgtccgagggggtgatgaagccgaaccccttggattcgttgaaccacttcacctgaccagtaagcgcaggcattttctctcagtatgtatctgtagtctcttcct

SEQ ID NO: 9559 - DNA, 447 bp, Triticum aestivum
  Predicted polypeptide sequence is orthologous to G740
gcacgagaaacacatacacacagagagagtatggcgccgaggcaggtagggatagtgaagtcgttcaacgatgaaaagggcttcggtctcatcacccccgctggcggcggcgcggatctgtttgtgcacttccgcaacatccaagcctccggcttcaaatccctcaaggagggccagcaggtcacgttcgtcgccgtccaaggccagaaaggcatgcaagccaatgaagtcatcactgaggagtaattaagtaatcttccggcgcccgcttctatctcgtttattctggatctcacactctgtaacacgtactacgtccggtctgcttgttgtccaataattgtgtggggctgaacaaccatgtatgcacttttgtcatgttgactttcaactttgggtcatcaactattgtgttacaatactaaaaaaaaaaaaaaaaaaaaaaaa

SEQ ID NO: 9560 - DNA, 1061 bp, Triticum aestivum
  Predicted polypeptide sequence is orthologous to G744
aatcccagaccgccgcccttttttttttttttttttattttttaggtcacctagacatatttgctgagtggaaagggaatgatcctcggaatatcttatgtacatcgccgttggattttcaatgtagaaacacatgcatggcttgatttatactgctatttacctttctatgtaccatgagaacaagcattttacacagccgtgttacctacactctaagaagatagcacaaacaagacatcatatattacacatcttgcctacaaacaggggacgaaccggggccaatgagccatttgtccacacagggctgatggaaggtgtgacaacacttcggcagcctcctcgccatctctcccgtcacgatatcctgtaggcaaatagggcaagacaagttttcaccagctggctcttgtttctgatcaatcaccacatggtatggcaacttcttcaagttatcctgtgagagcccatcggatgaaatttctccagtgatatcatacggatcatcattgccaaactctgcaataccaacctgccaacgatatgacatatacactgatggctcgtactgctctcccacaaaccgagcatgaaggagctgatccacgaaatcccccatggatgatgtactctgcggtgttgacctgtcggcgcaccaataagcgcgggaagcctccatgacctcaatggacaggacagcgccagcaaatgcccccagcccagctccccggagaacgcggctgtccgaagctctcccagccaacgcgccggtgaccgcccccgttaagcctccagcgaccgcaaaaaggccggtgagcaacaccggaaaggaccccgggaacgaccctggggaggtacggaggggcgggggccctcctcctccgccgccgacgacgccaagggtccggggggggccgccttctctgtcgagcctccatcaggatccacggccacgaagcctccgcccttaaatttaaaaacggggtcggcttgttgggtgcccccctggcttggggaaaagaagaaaaagggttgtctcccccgcaaaggggaagggg

SEQ ID NO: 9561 - DNA, 1068 bp, Triticum aestivum
  Predicted polypeptide sequence is orthologous to G744
aaagctatgaccattaggcctatttaggtgactctccagaacaagtttgtacaaaaaagcaggctggtaccggtccggaattcccgggatatcgtcgacccacgcgtccggagccacccttcctctatgccccagccagcgcgcacgccacagccgacgccgtgctaagcttcggcgcggaggcctcgtgtccgtggatcgtgatggaggcggcgacaggagaggcgatcccgccgcgacacccggcttcggcggcggcggagcaggagcgccccgccccgccgtacctccccaggctcgtcgccggcgttctctccggtgtgctcaccggcctcttcgcggtcgctggaggcctgacgggggtagtcaccggcgctgttggctgggagaagcttctgacagcggcgtcctccgggagagcccccaccgggggcccttctgctggcgcccgccctgttccattgaggttcttggaagagttccccccgctccaattgattcccccccttcgcgcccaacactctgctgaagttaactccctatccatgcaaggctctccttcgtaaacaccgcctaccttcacaccctattgtgatcctcctcttccccctcgcctcctgaacccgcccgccccagaggacacccaccatctccacacactaccacacccggataatatcccatctacttgtattcactcgagagtatgcacgcccctcagaagcggacggctcggggtcggtcctcctccctaccctagcttgaccttattctcgccattcattctatgctatatctctccttgtgcggacggcgctcgcctgcaccggtagctcgcgtccactcgacgccgtatcgctgaatactgcatcgcccgcctcagcgtccgccccgccgcgcacgcacctactccccgctaactatattgtgagtgccccacccacctcgcttttatgctctcgctcactcccgtcctatagtcccgccacactaaccctagctgtgctgttcgtcaccacgtactagcgctcctgcgcttctatccgcatcgctatagatctgtacatg

SEQ ID NO: 9562 - DNA, 832 bp, Triticum aestivum
  Predicted polypeptide sequence is orthologous to G744
acgcttgacattaggcctatttaggtgactcctagaacaagtttgtacaaaaaagcatgccggtaccggtccggaattcccgggatatcgtcgacccacgcgtccgcagaaagcacaggaaagcgagaccatggacgtcgcaaaagcggctcatcccgagcagtatcacttcatcacgggaagcccctcgcccaagctgctaaagctggagcctttcgctgccgatatcctctagcctcccggccagccctcctctcccggagagcctctcgccgcccactccaacgagccgcgaggcgccaaaaataaacccgtactacctctccgcctgatcctcgcggaggcggtcgatggaggttgccgcggcgggagagccggcgcccgcgggcgagtggctggaggagcgcggcgtggacgccgtgtacctccccaggctgatcgccggcgtcatctccggcgcgctcaccggcctcttcgctctcgctggagcattgactggagccgtcaccggcgcgctggcgggcagggcctccgacagcggcgttctccggggagctggactgggagcgatcgccggggccgtcctctccatcgaggttctcgaggcgtctcgcgcgtactggtgctcggaccggctcggcacatgctccatggcagatttcatagagcagctccttcatgcccggtttgtgcaacagcagcttggatcctcggcacatatggcgtaccgttggcaggtcagtttcagtattatcaaccttatcgtccacgacaacgttttgcacagaacggagagcgaaatgccaccgaaccgatggcgatgtttacatgg

SEQ ID NO: 9563 - DNA, 1129 bp, Triticum aestivum
  Predicted polypeptide sequence is orthologous to G748, G1900
tcgacccacgcttccgccgccatggccgcgcttagggaccggggggacgcccccattaagctcttcggccgcaccatcccgctcctcgacgccgcggccgaggttgtcaccaagcttggaaatgatgcaaacagcaatgatgtcatgccttgtgtctcaaacaagcttttgaatgtcgaagcaactcctttctgttccaagaatagagagcagaatgatcaagctatcagcaaacatggggtggaagtgagaactggtttcaaatctgaggagattaaaactgggtctgatggatctggccaagacaaggtactcaagaagcctgatataatcgtgccatgccctcgctgcaatagcatggaaacaaagttctgctacttcaacaattacaatgttagccagcctaggcacttctgcaggaattgccagaggtattggaccgctggtggaaatattaggaatgtccctgtaggttctggaagacgcagaaataagcatgcctctcacttccgccatgctatgatgtcgtgtgatgctaacatagctgctcctggagatgtttccaatgagatccaccatctagctcttccacttttaccgcaggttcttccagggccaattaaagaaaataaaacagtaaaggagttcggatctcaagtgccagtttgtaagcctatgtcctcaatccataatattgaagaacagaaggatacttaccttgttgccttggcctctggtgataatagcgaagaacaatcatgtccatctccagcgacagtgtcgggttgctcagaaaatcagacgccggatagcgcagtttaaaaagaaccaagcaatgtgttaggatactataatggcatcacattgcctcaccctcacggacctgctttggtgtttccctggaagtctggatggaacagtattgctgtcatgccagctgctcagtgctcaccagagcccattcaagggttggaaaatgtaagccaggcctgccccgggggccctccttgattatggcagtcccagaattgccccctgttgtcccttcctattatgccccaccatttgggactgattccggttgcccaagggaagtgaattcaccagtccggaaaaagggccccaaaaa

SEQ ID NO: 9564 - DNA, 668 bp, Triticum aestivum
  Predicted polypeptide sequence is orthologous to G760
gctttcctccctgcctcctcgtgctcccctccacctccaaccaacccaaaccaaaccctagatcgatcctaagcccccgacccaaattccccgccgaccggtcgatcactggatccgatggccggctcgccgccgccagcagaggaggtgccgatggcgccgggcttccgcttccacccgacggacgaggagctcgtctcctactacctgcgccgccgcgtcctcggccgccgcctccggatcgacgccatcgccgaggtcgacctctaccggctcgagccctgggacctgcccccgctctcgcgcatccgcagccgcgacgcgcagtggtacttcttcgcgcgcctcgaccgcaaggtggccggcgccggcgccggcggccgcgggggccccggcaaccgcaccaaccgcgccaccccgcgcgggtactggaagaccaccggcaaggaccgcgaggtgttccaccgcggccgcgccgtcggcatgaagaagacgctcgtcttccacgccggccgcgcccccaagggcgaccgcaccaactgggtcatgcacgagtaccgcctcctcgacaacgacgggccccaggatatgcatgtggtgtgtagaatcttccagaaggttggatctgggcctcagaatggagcacagtatggtgcaccatacatgga

SEQ ID NO: 9565 - DNA, 823 bp, Triticum aestivum
  misc_feature (686)..(686): n is a, c, g, or t
  misc_feature (725)..(725): n is a, c, g, or t
  Predicted polypeptide sequence is orthologous to G760
acgcttgaccttaggcctatttaggtgactttccagaacaagtttgtacaaaaaagcagtctggtaccggtccggaattcccgggatatcgtcgacccacgcgtccgcttccagaaggctgggcctggtcctcaaaacggggcacagtatggagctcccttcgtcgaggaggagtgggaggcggatgaggatgatgattttggtcctctgccagtgcagagggacgtttttggtgagcatgaggctcctggtgctatggagaaaggatatcttcagatgaatgatctcattcaggacttggctggtcaaaatgagaatggcagtgttgttttgccggtttctgacacttcaaacaccagcagccattctgaagacgtagaaggaaattcaggggacattttgaatgacccaagtctttgttctaattttcttcagtatattcatcctggagaacaaaatagcccaatgcttgttgaaaatatgttatctaatgccaatgttggagattttcttaatagttctagccccaatgatgaattcctagagctgaaggatttggagttacctctaggcaatgattccactatctggccttctgatggttgggcctggaaaacagctttccccttggatgctgtaaacaggtccaacaatgaggttcctctgatcactggtgatcagccttntcagccagatgagttggcccagttgttgcagacactacnagatgactcctcccagttgggctcaactatgaccgatctcccacactcttctattacaaattcagtcaagccagaagatgattctcttgtgtattttg

SEQ ID NO: 9566 - DNA, 1127 bp, Triticum aestivum
  misc_feature (818)..(818): n is a, c, g, or t
  Predicted polypeptide sequence is orthologous to G760
caggctggtaccggtcccgccattcgtacgctatatcgtcgacccacgcgtccgcagcaagcttgtccttcagatgaccagaacttgtattcaggactgcagcaagcctgtccttcggatgagcagaacttgtatttgcaacccaatggtctgccatttccacagcaattggatgacaacgcgccgttttatgagacatcaagcgatcacaaatgggaagttggaaaggatggttatgtaaatgtggatgacatttctctctttgaggatgatgatattatggctctcttaaatgcctcagatgacgatttcagttcaaatcttttgggcccagttgacggctctaattctcaacttccagcagcatcgaactttgaccagaaggatgaagcaaaggctcaatatggcgcgtcttcgtctggttcccatgagaacctttatccagacaccatggttccagatgtgccaatggatgacaatgctggcaaaagatacttcacaaacatgctgggttcatacccagccccacctgcaatggcttcggaattcccgccaaccacaggaaaatccatcgccgcgctcagcgggcctagtcagattcgtgtcacagcgggcatcgtccagctcggtgaccacgccgataactcggaccactggcccctgcagaagaatggagtcttcaatctgctcctttctttcacggtggagagcaacgtgtctacgaagtccattacttttgacgacgagccagccaccacacgggtgagcaccgtgccgacggtgctgcgcggcggcctgtacctcttctttgtctcggncatgatcctcatgttgagtttcaaagtagggtcctgcatctacagcaggtaagttaagggcccgccccggggccgttcttattctggtttagcgggaacatacatggctgcgccccctcgacgacggggtgggagcaacgactcgaagacagtttacttttacgcactagtttgtcatgtcatacgacctgacttgtgagagttatgtaaagcaaatagcctccgacttgaaaaccccggtcgtttgcacccctcgggctggaacttggggttcatctaggaccgtaatattctgtttattggccgcga

SEQ ID NO: 9567 - DNA, 857 bp, Triticum aestivum
  misc_feature (602)..(602): n is a, c, g, or t
  Predicted polypeptide sequence is orthologous to G778
acgctatgaccttaggcctatttaggtgacactatagaacaagtttgtacaaaaaagcaggctggtaccggtccggaattcccgggatatcgtcgacccacgcgtccggagatacaaaagagagatgggatgtgtgacgaagcagagaacgtcgtgatcaagggcgaagctccaatgaggtcgtccacttctaccaagaggagccgggctgctgccatccataacgaatctgagcgtaagggacaggatcaaccagaagatgcagacattgcaaaagctcgtccccaactcaagcaagacggacaaggcatcgatgctggacgaggtgatcgaccacctgaagcagctgcaggcgacggtgcagatgatgaaccggatgagcagcatgatgatgcccatggccatgcctcagctggcccagatgtccgtcatggccaacatggcccagatggcccagatggcgcagatgggcctgggaatgatcaacatggccgggccactcgcgcagcccgcctacccgggcctcacccagcccatgatgcacacgtcccacccgttcgtcaccatgcagccctggaacgccggcgccggcgccgacgggnagaagcagcccgccgccgccgccgtgccgggacgctactccgcctttcctcggctgccaaggggcgcaacagaacgcgcaccagcaagctcaaccgaacggcttggaggcctaccaggatgatggccatgtgcccgaagctaagccagcagcagaccaagccagggcaccttcaaagaagggttcgaactacgtcgtaaaaacccccggccaggtatttcccttttgaacctaaaatcctggcccaccccccccc

SEQ ID NO: 9568 - DNA, 1085 bp, Triticum aestivum
  misc_feature (8)..(8): n is a, c, g, or t
  misc_feature (17)..(17): n is a, c, g, or t
  misc_feature (29)..(29): n is a, c, g, or t
  misc_feature (514)..(514): n is a, c, g, or t
  misc_feature (662)..(662): n is a, c, g, or t
  Predicted polypeptide sequence is orthologous to G783
gtatactncgacccagncgtccgctcccnccctccccccttcccctcgagcgatcacggacaggagaaccataggtagaccaaaccctcgaagagcagctcttaggctcgcgctccatagcctcagcccttccccgcttcaattggagggtgaggtaccggatcgagcttctcggtcagcatggtgcccagggacatggtgaatgcccccgccgagaggctgcacgtccaggggtctgtcgtgaacaggaagtgcgagaagaaggtgccaaagaaaatccataagtcggagagggagaaacggaagcgaggcacacagaatgacctctttaatgagttgggagccatgctagaaccagacaggcagaacaacgggaaggcatgtgtattgggtgacactacacggatactgaaggatatagtttcacaagtggaatctcttcggaaggagaatagcacactgaagaatgaatctcactatgtagtgttggagagaaatgaactgcgtgatgacnacagcatgcttcgcaatgaaatcctggagcttcagatcaagcttagagtgcgtctgcaaaggcatcctatttggagccaggatactaccagatcagccgttgcagtaacttaatccacaagcgggattgtcaccagtacagcattcgncacactcatcagtcatcacctcgagcgcactttcactgccacctgtaatcactgagcaatgctatgccgccccaccacgagagctgcagctctacccggaagcttcatctgcatccactgaagacagcgaactgtcacaagaacaggtggatttccagtagtgtgacacggccccaggcacggtacccaaacacagcggtgatgttcgcagtaaacgaattcccaatccttcccacgatgggggaggagccacaatattgtagtgcccctagcgaggacaccgtgtgcacagggtttaagtacattacacattttgtttcacgggctgaaatgtttctagggtgagtggagtgactgcaacaaaacctatttagcttttattgtaaccccaactgtttcccaccttggcctaacgggtaatta

SEQ ID NO: 9569 - DNA, 1026 bp, Triticum aestivum
  misc_feature (18)..(18): n is a, c, g, or t
  misc_feature (762)..(762): n is a, c, g, or t
  misc_feature (795)..(795): n is a, c, g, or t
  misc_feature (867)..(867): n is a, c, g, or t
  misc_feature (876)..(1025): n is a, c, g, or t
  Predicted polypeptide sequence is orthologous to G789, G1494
tcgacccacgcttccgtncgatgagcctggccgactgcggcgacaacgccggcggcgtcctgtcggacctcgtccaggctcgcgccgggaaggcggcgatggaggagggcgcgtcgtcgacgctgagcgcgatgggggcgagcttctgcgggagcaaccaggtgcaggtgcagggcgcggtgagcgagcaggggcgcgccggccacaccactgcctatggcggcggcggagcgggcagcgctctgccttcggcggtagggagcggaaatgcaaacgccagaggcaggggccacgaggccaccgtggcctcctcgtcgggccggtccaactacagcttcggcgtgaccaccaccactggcaccgagccgacgagcacgagccaccggagcagcaagcgcaagcgggggctggacacggaggactcggagagccccagcgaggacgccgagtcggagtcgttggcgcttgagcgcaagccgccgcagaagctcacgacggcgaggaggagccgcgccgccgaggtgcacaacctctccgagaggaggagacgagacaggatcaacgagaagatgcgagcgctgcaagagctcataccccactgcaacaagactgacaaggcgtcgatgctggacgaggcgatcgagtacctgaagacgctgcagatgcaggtgcagatgatgtggatgggcggcggtatggcgccgccggcggtgatgttcccgggcatgcagatgcaccagtacctgccgcagatggggccgncgtccatggcgcggatgcccttcatggcgccgncgcagcagggccacggcgtgagcctgccggagcagtacgcgcacttcctcggcgtcaacccccacacggggnaggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 9570 - DNA, 703 bp, Triticum aestivum
  Predicted polypeptide sequence is orthologous to G791
gaggaaagctgacaagctgctatcctaagtgatgctactcgcatggttattcagcttcgttcagaagcacagcagctcaaggaaactaatggtagccttgaagaaaagattaaagaactaaaggctgagaaggatgagcttcgtgatgagaagcagaagttgaaattagagaaggagagtttagagcaccagatgaagcttatgacctcaactccagcctacatgcctcatccgaccctgatgccagcgcctttccctcaggcgcccttagcaccattccatgcccaggggcaagctgcagggcagaagctgatgatgccctttgtcagctatccggggtacccaatgtggcagttcatgccgccatcagaagttgacacctcgaaggacagcgaagcgtgccctcctgttgcgtaattgcttcggtcgactggccacgcttgcaccatgtgaattaatcacaactgaagcccccccctagtcgttgatccattgattgggtataactatttgttcttatgtggtagttcattggtaacgaagtaaagctgctgatataagcgtcctactatatagaggctactactgctgccccttcaatggctgtacaatttttgtggagaaaagaagaatgttcgttcttgttctccatagcaacaatgtgacgctatctatatgtcatatatatttcataaaaaaaaaa

SEQ ID NO: 9571 - DNA, 595 bp, Triticum aestivum
  Predicted polypeptide sequence is orthologous to G791
ttttttttttttttttttttttttttttttttaattggacagatggaatttatttactaatatgtaatatacaacggtgtcatctttcgtcagttcacatgtcaccggttgatacttcgatacagcgaagcttcggtttaatcctgggtttagctaggtagtaaacactgacgaccaaactgggcttgaatggaaggcagtttcacctctttcctacaaggcgaggcaaattgatctttgctttgacttatgcaacaggagggcatgacttggtgtcatctgtggtatcaacatcagaaggcggcatgaactgccacatcggaaatcctgggtagccaatcacaggcatcatcatcttctgcccggcagcttgaccttgaggagcagtgaatgcactggctgggataaccggagggtgtggtacgaagcttggtcgagcattcaggaactttatctgctgctccaggctctctttctctgccttcagcttttgcttctcatcacgcagctcgtttttctcagccttcaactctttgattttctcttggagactctcatttgattccttcaacttctgtgcctcactacgcagctc

SEQ ID NO: 9572 - DNA, 1123 bp, Triticum aestivum
  misc_feature (27)..(27): n is a, c, g, or t
  misc_feature (857)..(857): n is a, c, g, or t
  misc_feature (861)..(862): n is a, c, g, or t
  misc_feature (902)..(902): n is a, c, g, or t
  misc_feature (907)..(907): n is a, c, g, or t
  Predicted polypeptide sequence is orthologous to G791
cacgctcccgtttacgcccgcctaccncccccggctcgtgccatccccccgcccgacactagaccggaaagatcggccccggatagcggcggggagcgctcccggtccgctgggacttcggccatgagctgcggcggcgtggggcagggcgggtggctgctggactacggcctcgtggaggaggagatccaggcctccgacttcatctacatggtcgacgacccgccggtctccagcgtcatactgggcttcgatgctcccaggagggaggacgccgcggcggctgcccaggacaactccggcgccaagaagagatcccgtccagagtcgagcgcgcagcccggcaccaaggcatgccgcgagaagctccggcgagacaggctcaacgagaggttcagtgagctgtgcgccgttttggagcccgggaagccacccaaggccgacaaggtcgccatcctcagcgacgccacccgcctcctggaccagctgcgcgccgaggcccagaagctcaaggcctcgaacgagtcgctccaggactccatcaagagcctcaagtcggagaagtcggagctgcgggacgagaagacgcagctgaaggccgagagggagaggctggagcagatgctcaagggcgtcagcgcggccgcggccgccccgcggcagtacgtcccgcacccggccgccgcggccgcgccgcagttccaccccgccgcggcgtacgcgcacgccggcaagttcgtcccggcgtacgccgcgggctacccgccgccggccgcgttctggcagtggataccgccgacgtcgctggacacgtccaaagaccccgcgcactggccgccggtcgcgtgattcatcanctcnnatacccccgcacgtcgccacccctcgaggatttccgtgtntgaanctggcccttccgtaaaagtgaccaagcgcccgcccgaaaatacgtcggtttggtgatgattgtgtaccggctcaagattgtgtgtggatataagatcagggtccccggatccggttccggggacactcccactgcccccccgggtaacccccctagggaaagcctgaattggtccaactaaggggcccgattatccttttgggaaacaaaaacggc

SEQ ID NO: 9573 - DNA, 1033 bp, Triticum aestivum
  misc_feature (27)..(27): n is a, c, g, or t
  misc_feature (30)..(30): n is a, c, g, or t
  misc_feature (878)..(878): n is a, c, g, or t
  misc_feature (888)..(888): n is a, c, g, or t
  misc_feature (972)..(972): n is a, c, g, or t
  Predicted polypeptide sequence is orthologous to G791
ctgcgacccacgcttccgcgagttctnctncgggggcgccggcgacggcggggagggcctcgccgccttccgcgacggaggacttgggattgaggatgtcagcggaggtgactctggtcttgggcactctaatttggggaaaagggccagagatgaaccatcttcatctggtccaaagtcaaaggcttgccgcgagaaaatgcggagggataaactgaatgacaggtttcttgaattatgttccgttatgaattctggcaagcacagtggtcttgaagaatgttcggctagcaatcctgggaagaacgctaagttggataaagcaagtatcttgagcgatgcaacacgtatgttgacacagctcagaggtgagaccgaaaagctgaaggaatcaaattcgaatcttcgagagacaatcaaggaccttaaggtggagaagaatgagctccgagatgagaagttgagcctgaaggcagaaaaggaaaggctggaacaacaactcaaagcagcaagtgctgctcctacaggatttgctcctcatatgccttatccagctgcattccaccctgccgtctaccctccatttgcaccaccctatcaagtcccagccaacaaaggagctccgatacccgctgcattccctggaatggcgatgtggcactggttgcccccaaccgccatggacacaactcaagatccaaagctttggccgccgaatgcttaggcgcgccgaccctgggatgctcgacttgcgctgccattcgcccattggcaagtcagaacgtttgtcaggtccctgagatgaaaggaagctcgcaattgcagttattgtgtttagcctgttgttttggggtcacttgtcccatagagaggtgatnacctgtaatnatctggatcttaccctcttgcttggaaaatatattcagtgctaccatacctcctgtatgagtgttatgtatgaaaatgcactgntcttgttctggagtttctacctacaagtacttgtttgatgcatttggcagtacctgttttt

SEQ ID NO: 9574 - DNA, 1162 bp, Triticum aestivum
  misc_feature (21)..(21): n is a, c, g, or t
  misc_feature (599)..(599): n is a, c, g, or t
  Predicted polypeptide sequence is orthologous to G791
gtgccggaattacccccattnccgacgcgaccgcgaaaccctagccccccggcaaccttcgctggacccggagagccgctccggcgccatggcatccccggaaggatcaaactgggtattcgactgccctctcatggacgaccttgctgccgccgacttcgccgcggcatccacaggaggcttctactggaccccgccgatgcagccgcagatgcacactcttgcgcaggccgtctccgccaccccggctcccaatccctgtgctgaaatcaatagctctgtttcggtggactgggaccatgccaaaggacaaccgaaaaataaacgtcctaggtcagaaactggtgctcaacctagctccaaagcatgcagggagaaagtgagaagggacaagctaaacgagaggttcttggaattgggtgctgtcttggatccggggaaaacacctaaaatcgacaaatgtgctatattaaatgatgctatccgtgcagtaactgaattgcgtagtgaggcagagaagttgaaggattcaaacgactctctccaagagaagattagagagctaaaggctgagaagaatgagctgcgagatgagaagncaaagttgaaggcggagaaagagagcctggagcagcagattaagttcatgaatgcccgtcagagcctcgtaccacacccttctgtcatcccagctgctgcattcgctgccgcccaaggccaagcggcagggcacaagctgatgatgccctgtatgagctacccagggatttccatgtggcagttcatgccgccctcagatgttgatacctcggatgaccccagtcatgccctcgggtgcctagggcagcagaatcatttcctcatctatctcatggggaggatgctaaaaagccttcgttaaagtatatctactagtctcagggttatatgcagaatccggtagtggtctactatttggtaaaccagaaccgaacggagcttgttccacggggaaattgatatttttgaacccgtgtttttgtagtaattataacccccgtggacaaaaaaaaaaaaaggggggcccttaagttccccgaggggcgattaacgtaccccttttggaaagggcctaagggcgattaaaagagcggcccgttaaaccttttggaatgtatttgtt

SEQ ID NO: 9575 - DNA, 1136 bp, Triticum aestivum
  misc_feature (9)..(9): n is a, c, g, or t
  Predicted polypeptide sequence is orthologous to G791
ggtgatacnagagcggccgcccttttttttttttttagttagaaaaggaaagcatcccattcgaattgtgattcgtttctaggcggagatcagaacaagaacgagcattctttctttctcgagaaaaaatgtattatacagtggacgaagggtagtagactctatagagcgcacaactgccagcattctcctcatcaacaaaaactaccgcatgagaacaatagttaatctgaatcagagagactatgcgcaaccaatggatcaaacaactatgctgttttaggtgaccaggggttcatgcgatttaagcggtccaagcatatcacgcaacaggcgggcatgcttcgctgtcctttgaggtgtcgacttcagagggcggcatcaactgccacatcggatatcctgggtaaccaacaaagggcatcatcagtttctgtcctagagcttgtccctgtgcatggaagggagccatcggagcctgagcgaacggggagggcatcatagtaggatgaggcatataggctggagttgccgtcaaaagtttcatctggtgctctaatgtctctttctctagtttcagcttctgcttctcatcacgaagttcatccttctctgccttcaactctttaatcttgtcttctagacttccattagtatcctttagctgctgcgcttcagcacgaagctgagtaaccatgcgagtcgcatcactcaggatagcagctttgtcagcttttactggcttaccaggatccaatgtagtacccaattcaaggaacctgtcattcagcttgtctcttctcactttttccctacaagccttagatgttggcctaccaaaagggctctgacttaagcggttattggtgccggaatccttggggaaaactaaattggtcaattgggtgcctaattccccactgggattggaccaagaaaacgatgctttcccggggaaaacgccccaagcagcggccgggaggtccttcaagattccgcaatcgaggaaccaactgtctccccccttcggtcggagggaaaaaaattggggccgggggaacttacctcccgtttgtgctccagcggtcccccaaaggggggggggcaattttccgccccatcttgtgttgggtgtt

SEQ ID NO: 9576 - DNA, 845 bp, Triticum aestivum
  Predicted polypeptide sequence is orthologous to G791
atgacattaggcctatttaggtgacactatagaacaagtttgtacaaaaaagcaggctggtaccggtccggaattcccgggatatcgtcgacccacgcgtccggtcggaggccgccttttttttttttttttttcaatgaaagaacacaaatgttctacatgacatattttattttcttcaaagatcagctatgcaagtgctcacatgttcaactttatataaacaaaacaggtactgccaaatgcatcacacaagtacttgtaggtagaaactcaagaaacagaccagtgcaattccatacataacactcatacaagaggtatggtagcactgaatatattttccaagcaagagggttaagatccagattaattacaggtatcacctctctatgggacaagtgaccccaaaacaacaggctaaacacaataactgcaattgcgagcttcctttcatctcagggacctgacaaacgttctgacttgccaatgggcgaatggcagcgcaagtcgagcatcccagggtcggcgcgcctaagcattcggcggccaaagctttggatcttgagttgtgtccatggcggttgggggcaaccagggccacatcgccattccaggaaatgcagcgggtatcggagctcctttgttggctgggacttgatagggtggtgcaattggagggtaaaacgcaggggtgaaatgcagcttggataaagccatatgagggaacaaaccctgtaggaacaacaccttgccggcctttgagatggtggtccaaggccttttccttttttttggccttcaaggcctcaaccttcctccttcccgcaaagactccttctcct

SEQ ID NO: 9577 - DNA, 693 bp, Triticum aestivum
  Predicted polypeptide sequence is orthologous to G805
ttttttttttttttttttgcataatgtctcttctctccaagaatttggataaaacctaattggtaagatccggaggatacaaattaaaaggtgagaaaaataagttctttagatcgtttggcgatccacctatgtcgcttgcaaagattttatagcaatttgccctgatgcaatgaaatgcaagttgcaaccgtatgaaccgtgcaagaatttggagaaggatcgaacaaagccataacaagcgatcgagtcaagaacagaaacaaaccaaagaagaacaaatccaaagacgaaaattggtaagccaaagctgtcgaacggaccagcggtcacgaagccctacgagtcgctgccgctcatgctctcgttcggctcgccacccccgtgctgcagatgctgatgctggttctgatgttgatggcgagtagtcccttcagccgctccattgtgccccgccaccgtgacctccgacgccgctgcatgctgcccacggtacgcgttgagcgcggcgaggatccccatgtgcccctcgcccgccgctgctgatccaccgccgccggcctggccgagccccagctgctgcgcgtgcactgccatcggcgcggggatgttcatgaaatgtagcccgctcggcacgccgcggtacacggtcgccgagccgccgccgccgccgcttccgggttgcgggaacgt

SEQ ID NO: 9578 - DNA, 1077 bp, Triticum aestivum
  misc_feature (34)..(34): n is a, c, g, or t
  misc_feature (104)..(104): n is a, c, g, or t
  Predicted polypeptide sequence is orthologous to G807
aaggcgagaccggccgcccttttttttttttttntgccaaacaccaccatttcccctggataatttggaggccagcggggcgggatagcgcgaggagctgctantcttttacatgtttgggttcaggtcggtgttagtcgcaaccagacgagcacagcagaaacacaacgcacggtcgttagtttttacgcctgccagaaaaccttatagatacaaaaagatcggagtcctcccacaccagctgtcgacaggcatttcacagttcagtatgattgggggggggggggggatagtatctagttttattacccggttggaccccagggcgccttgagagagggtcgctgtgagtaggtacctcaccctctatggttggatgacagcaaccccatttgttcagtgagatttgccaagttctcggtcctggtccatccattctcctcttgcgcttcccttgtgtccagcagacctgaatccacctcgtcgttgtcgatggagagagggctggcacaaaggaactgctcccagaaggaatcaatgattcccggaagcttctgggtgtcatcggtctcatcagtgtccatggggtccatgggaacagagtcatcactgccttccatctggtagggggaatatacacccaggaccaggcattgcatagttctctacaggaatattaatcgggtcctccgttatgagatcctgcagatctgggaaatcctggaatgctgatttcccttaacaccgggtggtcgagccctttggaataagaccatgccgccagtccatgttgggaacacgtggtgcgaaccctgcgtgcaatcagttgccttcccagaaaccgggacagttggatcttaggggggcgtttcgagctcaccaaagtggctggaacgccccaaagctcctcggcccctaaatgtccagtccctgcgtgttcgcgtggtccctccgtccagggggtgacgtgctcaaattcgcgtcgttgcagacacagcgcgtctaacaggtggtggccgtgttgtgcagcgttcggtgccgagggcccgcgacgtccggctcacgttgccccgtgcc

SEQ ID NO: 9579 - DNA, 788 bp, Triticum aestivum
  misc_feature (649)..(649): n is a, c, g, or t
  misc_feature (680)..(680): n is a, c, g, or t
  misc_feature (744)..(744): n is a, c, g, or t
  misc_feature (747)..(747): n is a, c, g, or t
  misc_feature (767)..(767): n is a, c, g, or t
  misc_feature (781)..(781): n is a, c, g, or t
  misc_feature (785)..(785): n is a, c, g, or t
  Predicted polypeptide sequence is orthologous to G811
ggccacgagccacagagaacaacaagcccacaccgagcagagcaggaacagcgagcggcttccttatccggttgtagactcttcgtccatgggaagcgagtgcaagggccaccagccgcaggacgacggcggcgtggcgccgttcgtggcgaagacgtttcacatggtcagcgacccggccacggacgccgtggtgtgctggggcggcgccagcaacacgttcctcgtcctcgaccccgccgccttctccgacttcctcctcccctcctacttcaagcaccgcaacttcggcagcttcgtccggcagctcaacacctacggttttcgcaaggttgacccggacgtgtgggagttcgcgcacgagtcgttcctgcgcggccaggcgaagctgctgccgctgatcgtgcgcaagaagaagagagccggcgccggcgcggccgggagggagctgtgcgtggaggaagaggaggtgcggggaacgatccaggcggtgcagaggctgcgggacgagcggaggggcatggaggaggagctgcaggccatggaccgcaggctctgtgcggcggagaaccggccgggccagatgatggccttcttggcaaagctcgcggacgacccgggcgtggtgctttccgccatggtcgccaanaaagaggagctggcttgcggccggtgccggnggcaaggattcaaagcccaaataaaagcggcggatcgggccgacccggatcaggcgggccaaancanggccggccgttccctttttntaatctgggaaggngttntct

SEQ ID NO: 9580 - DNA, 643 bp, Triticum aestivum
  Predicted polypeptide sequence is orthologous to G811
tttttttttttttttttttagtagtttgtagctttccttgttcacatactgtttgccacaaagtactcctaccacgtcgtctaaaaaacaacctcctactaagtacagtacacacatgtgtcggtgaaacaccctctaatcgaaccgaactcagtagccggtgtccacacggaaagcgtacggcgggtcgtccaccggcacctcgctaaagccatcgcctccggtgtagaaaccagtgaagtcgaccctgggttcccgcacgaaagcctcctgccggttgatgccgcacaacatcccgtcgccgtcgatgcgcatcttcttgccgacctgggcttccccatcgagaagcagccgcggcctcttggcctccgcgccctcgccggggaacaatccgccgccgccacccgagttgcctacgaggcggcgcagcacgtcggggtctccgacgaccttgaggaggaaggcgagcatgagcttgggccggcgctcggcgtcctgcacccggcgccacatcgccgccaggcggtccttggtggccctctgctcctccttcaggcgggccacctccatggccaacatcttgctgctgatgtcttcatcctcctcctcgtcgtggctgtccttggcgcgcctgccgccgccg

SEQ ID NO: 9581 - DNA, 1078 bp, Triticum aestivum
  misc_feature (28)..(28): n is a, c, g, or t
  Predicted polypeptide sequence is orthologous to G811
tacagcggccggcctttttttttttttntacacacagtaaagacgaaccctatactcccaaaaaatgtcacgcatacacagttgtacgcacacgcacacaagaacttgtacagaaatccctctctctgtgaatcaagataagcagagcgcgcgcggcttaacatggagaaggaattgacaacagaaccaacagaacgagtagggatcaactgactgacataggtgttgagctggcggacgaagctggagaagttgttgtgcttgaagtgcgcgggcagcatggtctgcgagattattaaggggtcggcgacgacgaagctgttgttccccttcccccacccgatgaccccgtccgtcccggggtcctccaccatccggtacgtcttccacacgaacggcgccgctccgccgccgacgctcgccgccgccatcggtctctctctaactaaagtcccgcaggatttgtcctgagatttcttgataaagtaatgggagcagagcataaagctcaaaggtgctacagaaaaagggaaggggggcgcgtcgccaaagaaggcaagatccgccggtctgttttctactccttcagtccatgtcagtgtcctcgtgctccagtcgcggacgcgtgggtcgacgatatcccgggaattccggaccggtaccagcctgcttttttgtacaaacttgttctatagtgtcacctaaataggcctaatggtcatagctgttccctgtgtgaaattgttatccgtcccgcggcctaagctagattctggaggctggatcggtcccggtgtcttttatggaggtcaaacagggtggatggcgtctcaggcgatctgacgggtcactaaacgagctctgcttatataaacctcccacggaaaagccctacggcccattggcgtcaatgggggggggttgttacaaatttgggaaagccccgtgaatttgggtcccaaaaaacacccattggactccacggggtgggaactgggaatccccgtgagtaaacggggtttccccccccttggaggtctgccaaaacgcctctccggggggagggggggccacatca

SEQ ID NO: 9582 - DNA, 1036 bp, Triticum aestivum
  misc_feature (652)..(652): n is a, c, g, or t
  misc_feature (655)..(655): n is a, c, g, or t
  Predicted polypeptide sequence is orthologous to G811
gttaaccagaccggccgcccttttttttttttttaaacacgaatttgcaacctgtgtcataccttggaacaaggcaaagtgggaacatatagcggtcaaaatggcagagtcacgcaatgccaataattcggccataatccaagcagttagcacacgcgggcggcacaatttctgtcgggcgtcactactcagtacccactgtccactccaaacgcaaacgtgcagccggcaccagcaccgcccgacccggcggccgcctccaccggcaccggcacattggcgaacgcgtcgtcggtgtagaacccggcgaagtcgacggcgtccggcccaaacgcggatacgttgccgaagtcgccgtcaagcagcagcctcgccctcttctcgccgccctccaccggctcctgatcgccgccggctgcgttgccgctgttgccgaccaggcgctgcagcgtgtcgcggtcgccgacgatggtgaggaggaacgcgagcatctgcttgggcttccgctccgtctcctgcacgcggcgccacatggcggccaccctgtcgtcgatggtgctctgctccttcttcagcctcaccacctccgtggcgaccatggtcatgtcgtcgtcggtgaggccagccgccgccgcgtccttacgcttgccgncgncgccgcccgcggcggcggcggtgccgcggcggacgatgttgcgcaggaggtgcgtctggccccggaggaaggagccgtgggcgaactcccaccggtccggatccaccttgcggaagccataggtgttgagctggcggacgaagctggagaagttgttgtgcttgaagtgcgcgggcagcatggtctgcgagaagacgagggggtcggcgacgaccaagctgttgttcccctttccccacccgatgacccggtccgtcccggggtcctccacatccggtaggtcttcacacgaccggggccgttccgcggcgaaagctcgccgccgccattggtctctttctaactaaagtcccgcaggaattgtcctgaaattctttgata

SEQ ID NO: 9583 - DNA, 1105 bp, Triticum aestivum
  Predicted polypeptide sequence is orthologous to G811
tcccagaccggccgcccttttttttttttttttttgggcgccaatcagcccgtctgaaattcaactatgccgagggggagtacactgtacatacataaacaccaaaacatcacacgtgtacacctatctatcaactctcgactcccaaggtctatcagtagaacacctgtcccagattacagaaggggaacggcacggccctgctctgggccgcctgatccggcgtcggccccgatccgccgcctcttatctgggcttgaatccttgccaccggggccggggggagccagctcctccttcttggcgaccatggcgcgaagcaccacgcccgggtcgtccgcgagcttgccgaggaaggccatcatctggcccggccggttctccgccgcacagagcctgcggtccatggcctgcagctcctcctccatgcccctccgctcgtcccgcagcctctgcatcgcctggatcgttccccgcacctcctcttcctccacgcacagctccctcccggccgcgccggcgccggctctcttcttcttgcgcacgatcagcggcagcagcttcgcctggccgcgcaggaacgactcgtgcgcgaactcccacacgtccgggtcaaccttgcgaaaaccgtaggttttgagctgccggacgaagctggcgaagtggcggtgctcgaagtacggaggggaggaggaagtcggaaaaggcggggggggtcgaggacgaggaacgttttgctgggccccgccccagcaaaccacggggttcggtggccgggtcgctgaccatgtgaaaagttctctggcaacaaacgggggccagcccgcccgtcttcctgggggctggtggcccgttgcaccgcgttcccaggggacgaagagcttacaaccgggatcaaggaacccgcgtgcgggtccccccacgtctcgggtggtggcttggttggtcctcgtggggggagtcccccccttactaaccaagctcttgtcgcgccgcgtttcttacctccttcaggaccagggtaggtgttcttcgtgccccacgtcgcgggcccggttggtccagggaattttccgggaaattccggaaagggtgtacgcccggc

SEQ ID NO: 9584 - DNA, 883 bp, Triticum aestivum
  misc_feature (858)..(858): n is a, c, g, or t
  misc_feature (879)..(879): n is a, c, g, or t
  Predicted polypeptide sequence is orthologous to G811
aagcttgaccttaggcctatttaggtgactctatagaacaagtttgtacaaaaaagcaggctggtaccggtccggaattcccgggatatcgtcgacccacgcgtccggtggcactagaccattcgctagtgaaagatgagcggcgccggcggcatggagtgctcagggagcggcggcacggtggcgccgttcgtggcaaagacgttcgcgatggtggacgacccggccaccgacgcggttgtcaggtgggggccggccagcaatagcttcgtcgtcgccgaccccttcaccttctcgcacgcgctgctcccggcccacttcaagcacgccaacttctccagcttcgtccggcagctcaacacctacggctttcgcaaggttgaccccgaccgctgggagttcgcgcacgcctccttcctccggggacagacgcacctcctgccccgcatcgtccggcgccggagcggcggaaagggtggcaaggaagacgccgacggggaggaggatgaagacctcaccagccagatgttggccctggagggggttcccctgaagaggaccagaggggctccgaggaccgcttgggcgccaatgcgggccccgggttgcaggaccccccagcgtcggccccaggctgattgctccactttcctccccccagggcccccgggaaacccccgacctggtttgggtccgctcccatttagctcctctaagcttgccgcgcctcccattttttcccccggccaatcctccgcgatattctcattaggtcctctgcgttctctctctcctcgccgcctcccccccctcgcctgcgcccctcaactcatattttgtcttcagtccctctactgnccaagtgtcttctctctctcncgtg

SEQ ID NO: 9585 - DNA, 950 bp, Triticum aestivum
  misc_feature (5)..(11): n is a, c, g, or t
  Predicted polypeptide sequence is orthologous to G811
ttttnnnnnnntttctttccttttaaagctatgacattaggcctatttaggtgactcatagaacaagtttgtacaaaaaagcttgccggtaccggtccggaattcccgggatatcgtcgacccacgcgtccgcactataccacccgcgagtgaaagatgagcaccggcggcgccggcaaggggtgctcggggagcgacggcggcatggtggcgccgttcgtggccaagacgtacgcgatggtggacgacccggcgaccgacgccgtggtcgcgtgggggccggccagcaacagctttgtcgtcgccgaccccttcgccttctcgggcgcgctgctcccggcctatttcaagcacgccaacttctccagcttcgtccggcagctcaacacctaccgcttccgcaaggtcgacccggaccggtgggagttcgcgcacgcctgcttcctccgcggccagacgcacgttcctgccccgcatcgtccggcgccgcatcgagcggaggcatggctcttcaaggacagccacgaccgaggaggaggatgaaagacatctgctgtcaagatggttggccatggaggtggccccgccttggaaggaggattcatagggtccttcaagggaacgctttggacggccaaaggcggtgtcgaccggggtgcgaggtaaggtcccaggcggccgggccccaaggatctatggttaggcccattcccctccccaaagggacgtacgtgagaaaccacggaagaggaatgggggactaacttgatgagggaatattctgatttgacctgtaacctctgaattgttctccacgcggtaagaaatgtgaaatagtcctaaaaaggtcgggctggtattatttatcacgaagggggagagtcgcggttttgtgatacgaaagaatagcgcttttcgtttaaatcaaaaaggaattttgggacaggcaa

SEQ ID NO: 9586 - DNA, 670 bp, Triticum aestivum
  misc_feature (244)..(244): n is a, c, g, or t
  misc_feature (266)..(266): n is a, c, g, or t
  misc_feature (280)..(280): n is a, c, g, or t
  misc_feature (294)..(294): n is a, c, g, or t
  misc_feature (297)..(297): n is a, c, g, or t
  misc_feature (309)..(309): n is a, c, g, or t
  misc_feature (354)..(355): n is a, c, g, or t
  misc_feature (359)..(359): n is a, c, g, or t
  misc_feature (393)..(393): n is a, c, g, or t
  misc_feature (415)..(415): n is a, c, g, or t
  misc_feature (426)..(426): n is a, c, g, or t
  misc_feature (438)..(438): n is a, c, g, or t
  misc_feature (443)..(443): n is a, c, g, or t
  misc_feature (476)..(476): n is a, c, g, or t
  misc_feature (485)..(485): n is a, c, g, or t
  misc_feature (511)..(511): n is a, c, g, or t
  misc_feature (517)..(517): n is a, c, g, or t
  misc_feature (519)..(519): n is a, c, g, or t
  misc_feature (560)..(560): n is a, c, g, or t
  misc_feature (572)..(572): n is a, c, g, or t
  misc_feature (580)..(580): n is a, c, g, or t
  misc_feature (586)..(586): n is a, c, g, or t
  misc_feature (590)..(590): n is a, c, g, or t
  misc_feature (605)..(605): n is a, c, g, or t
  misc_feature (612)..(612): n is a, c, g, or t
  misc_feature (633)..(633): n is a, c, g, or t
  misc_feature (643)..(644): n is a, c, g, or t
  misc_feature (649)..(649): n is a, c, g, or t
  misc_feature (669)..(669): n is a, c, g, or t
  Predicted polypeptide sequence is orthologous to G812, G2467
cgttcctgacgaagacgtacgacatggtcgatgaccccaacaccgacatcatcatgtcgtggagcgccggcaacaatagcttcgtggtgtgggatccgcacgccttcgccacggtgctgctgcccaaggcacttcaagcacagcaacttctccagcttccgtcaaggcagctcaaacacctatgggcttcaagaaaggtgggttcctgacaagatgggattccccaaatgagggttccctaacngggacaagagcacctttcttgnaaaacatccaagcnccgttaactccccntcnatactgcctccnaacaacatcccttgggtttttacctttaaggtggggcactttccnntatnatgccaaaattttacccgcttaaaaaggacaacnactgtttttatggaaaatttgngaaacctaagnaaggacagcaanacacnaagccgttttaaccatgggaggatagtacttgnaccaacaanacacaacaaatgatcatcatggaacntctgcngnacctgaatctgaacaatgatgcaagaatggatgagaaggantcatgaccttcncaaaaagnggcccncatnacgtgcctaacttancgtggtntagacacacctgacaaaattnccgttttttnncaggncaggattttcgggccggcgng

SEQ ID NO: 9587 - DNA, 840 bp, Triticum aestivum
  misc_feature (817)..(819): n is a, c, g, or t
  Predicted polypeptide sequence is orthologous to G831, G1202
acatgctatttactttaggcctatttaggtgacactatagaacaagtttgtacaaaaaagcaggctggtaccggtccggaattcccgggatatcgtcgacccacgcgtccgcgcctccaacaggctcacctatcctgcgcgcgccttcgacatggcgcattgctcccgctgcctcatcccctggcagctctacgatgggctgtacttgatcgaggtggatcgcattctacgtcccgggggctactggatcctgtccgggccaccgatcaactggaagaagcactggaaggggtggcagaggaccagggaggacctcaacgcagagcagcgagccatcgagtctgtcgctaagagcctgtgctggaagaagatcaaggaggttggcgacattgcgatctggcaaaagcctaccaaccacatccactgcaaggcctcccgcagaatcatcaagtccccgccgttctgctccaataaaaacccagacgctgcctggtacgagaagatggaggcttgtataactccgctcccggaggttagtgacatcaaggaggtcgccggcggtgagctgaagaagtggccgcagaggctcaccgccatgcccccaggattgctagtggcagtattgagggggtcctcactgccgaaatgtttaacgacgaccccaggttatggaaaaaagagagttgggcactacaagtccgtgataagccagtttgggcagaaagaccggtaccgcaccttgctggatatgaatgcacgctttggcggcttcgctgcggcattgcgcggtgaccctatgtgggtgtgacaatgtccnnncaccatgggaaatcaacgatc

SEQ ID NO: 9588 - DNA, 816 bp, Triticum aestivum
  Predicted polypeptide sequence is orthologous to G837
ccacgcgtccgaaaatgtgacacctgtggatcaagcaagcaatattggcagtgaacataataaggggactcgagcaacctctgagccagagctagatacagagaacgatgtggacattactaacaaagaaaaaccaatagatcaaggtagcgctgttgttgcggaggagaaagcccacactaaagcaacctctgaaccacatacaatcaaagatgtagagatgactaccagcactggaatccccataggtcaaagcagcaacattgctatggaagaaaaaatcgctggtgaagataatgctggaactcaggcaacctctgagccacaattgatcaaagatgtggaaatgacatcagtaatggatgaaaaaagcaacgttggtattggagaaaagccccaatctgaagcgacatctgcagtcaaagatgtggagatgaccattgttgctggaatagaagcagatcacacacaactagcagatggatcaactgaaaatggagcaggagaacctcaccatgaagaggcatgcatagataagtctgacttcagcgaattgtcaggtcatcataacaaccatcaattaattccaaatggggtgctacccgctacagatgaagctttatgcagacaggagactgaggagggtgaccttgtgggttgcagtgcggccctaagagaagacaactagattcagatattagtgttgcatccaatttactttttgcagatgtggggcatgaagggatgcaccagtagatcagctagcatcagtgattagccatgctctcttcattctccaggatcacctatttagat

SEQ ID NO: 9589 - DNA, 509 bp, Triticum aestivum
  misc_feature (199)..(199): n is a, c, g, or t
  misc_feature (203)..(203): n is a, c, g, or t
  misc_feature (205)..(205): n is a, c, g, or t
  misc_feature (354)..(354): n is a, c, g, or t
  misc_feature (391)..(391): n is a, c, g, or t
  misc_feature (447)..(447): n is a, c, g, or t
  misc_feature (462)..(462): n is a, c, g, or t
  misc_feature (474)..(474): n is a, c, g, or t
  misc_feature (483)..(483): n is a, c, g, or t
  misc_feature (493)..(493): n is a, c, g, or t
  misc_feature (506)..(506): n is a, c, g, or t
  Predicted polypeptide sequence is orthologous to G839, G1196
ctggaacttgccaacttgaatttgaagaacagtcgtgggtacacagcactccacctagctgctatgaggagagaaccagctattattatgtgtctcttaagcaaaggagcagtggcgtcgcaattgacagatgatggccgccttgcaagtaatatttgtcgaagattaacaagactaaaagattataatgcaaaggatngagnanggccaagagtcaaataaagataggatgtgcattgacatcctagagagggagatgatgaggaatcctatgacagcggaagattcagtcacctcacctttattggctgatgatcttcacatgaaactaagctacctggaaaataaaagtcncgtttgcaaaattattcttccctgctgaaacgaaagntgcgatgcaaattgcgcaagcaaacgtcacaccaaaaattggggttttttctgcancaagtacttctggtnaactgagggaantccatttgnatgagacccncttacaaaaaaanaaa

SEQ ID NO: 9590 - DNA, 1052 bp, Triticum aestivum
  Predicted polypeptide sequence is orthologous to G839, G1196
gcacgagcagggccaagagtcaaataaagataggatgtgcattgacatcctagagagggagatgatgaggaatcctatgacagcggaagattctgtcacctcacctttattggctgatgatcttcacatgaaactaagctacctggaaaacagagtcgcgttcgcaagactgttcttccctgctgaagccaaggttgccatgcaaattgcacaagcagacgtcacaccagaagttggtggtttttctgcagcaagtacttctggtaaactgagggaagtcgatctgaatgagacgccagtaacaaaaaacaaaaggctgcgttcaagggtggatgcactagcgaaaacagtggaactgggccgtcggtacttcccaaactgctcgcaggtgctcgacaaattcttggaagatggcctgcctgatggccttgatgcgttccagcagcaaagcggcacccctgatgagcaacaggtgaagaagatgcgcttctgcgaggtgaaggaggacgtgcgcaaagcatacagcaaagacacggccgataacagcatgttttcggccctgtcgtcaaactcctcgtcctcggcgatgaagtgaaggtactgtaacaggctgttttctcgagatgtcagggctaaagagggatcgctggtcatgcgcatgtatagtgcccaccatcgtgtaaaaccgaatatgaacatgaaaggaggccccaaaatagtagaagatgatatatactttgctggacttggagtttgttggagaaggctgtgccatcccatcccagattcccaatatcaatttcccatgctggttgcgaagacggagccgtggatcatccagcttcgacgctatgcatgcgtgcagcctgctgtgtttgtttcgcatagctgcaatacttatatgtttaataatactagagagtagtaggcaattgaggctgtagcggaagttggaacctaccttaatgtaagtgaaaggggacagttgccctttgtcgaactgttgttatcaatacatagttgattttcgtaaaaaaaaaaaaaaaaaaaaa

SEQ ID NO: 9591 - DNA, 876 bp, Triticum aestivum
  misc_feature (1)..(1): n is a, c, g, or t
  misc_feature (804)..(805): n is a, c, g, or t
  misc_feature (848)..(848): n is a, c, g, or t
  Predicted polypeptide sequence is orthologous to G839, G1196
naacacctatttacatgattacgccaacgctatttaggtgacactatagaatactcaagctatgcatccaacgcgttgggagctctcccatatggtcgacctgcaggcggccgcgctagtgatttgagcggccgcccgggcaggtatcactgtgaagagtgcccaccggcgatcgaaaatcatctactgaagcctgtcacatgtcaaaccacagtaaactacaagaaatgcaccaagcaacaatcaagctagaaccgatatgcttgcttggttacatctacatacatggtttcggtgcactacaaactgtcaacaaaaccttgctagcttccccccaccccacctctctcaaaccatcacgcgcgacggatccggcgttaacctaccgacatggcgacaccgagcacatgtatcaccgcgacagcctcgccttcttgtgaccatgtctactaacctttccatcacctctcggtgaagacgaggacgtcgatgaggctatggctgcaacagccttgtctttgctgaaggccttcctcacatcctctttgagctcagagaagcgcgtcctcctggtgtactggtcctcggcactgccgctttcgaggaagtgcagatcggtggattcttccatgaggaacttgtcgagaacatccgaacaatgcgggaagtactttcgccctagctcaactgtctttgtcaaggcatcgaggcgttcacgcagtctcctgttctgcattgtaggggtctcatttaggtcaacctccttcaggttattgaaaatagctgacgtgagaccggcaactnnctcggtgagtcagacctcgggcgcgacacgctaatccgggcgncatggcggccgggagcatgcgacgtccg

SEQ ID NO: 9592 - DNA, 1054 bp, Triticum aestivum
  misc_feature (590)..(590): n is a, c, g, or t
  misc_feature (682)..(682): n is a, c, g, or t
  Predicted polypeptide sequence is orthologous to G839
acccacgctccgtggttccgtacgcggggatcgtgagtggtggacgattcccctctccaaatacatgtctatcccttaagggaagggatttagtgtccttccgcttgtgacggctgaatcggttgatgcgtcagatccgtcagtgtatgtcatctgcttcctgttcgcatgccgatgcggaaatttgtctccgtggaacgccacccctgctggttcatcttcactggtttatgatgcccacggccaacgccaactgatatcttctccgacgacggttggtggttaagctgaagaatgctttcttgagtctttctcgtaaggcgccagaaggaaacgggccatccaatatatggtttctgtttgccgatcaaatgatgtacgtgttcccttctgctcacaagatgattctggcctgtctccaaacatcacagaaaggtaattgtgttggtaagctgatgatgcgcatgcgaggacgtgcgtattgtacaacttgatgtaccaatacattggtagggtaggacggcctttgccatgtcgggtgcgctcgcttggcaggccacaagacaataaaaagtatatctggtggtgtntgcggggtggagatcgcacgggaacaatctatttgttctattttgcccgggttctccaccctgccatggtgtctctgtccttctcctgtgtngtagattcaccggatcatctgaagtacaccgcgatcctacatagctaatatgtgaacaggcctgggcgcagcggtaactacgttgtgaggatcattttaactacgcacgagggtacatctacctacttctttcagcggtatatcaaattaaattttaagtgacccagaaacgttagtgcttttctgaaggggtcatctgaactgacctcaaagttgtcgatcaaaaattcttgtgccttcatctcacttaatgagttactgtacatggtggattcagtcaaccacaggtgatcataccttaaatttgtaaaaaaaaaaaagggggccgtctagagttccctcgggggccaaggttaggttcccggtttttga

SEQ ID NO: 9593 - DNA, 1106 bp, Triticum aestivum
  misc_feature (15)..(15): n is a, c, g, or t
  misc_feature (682)..(682): n is a, c, g, or t
  misc_feature (713)..(713): n is a, c, g, or t
  Predicted polypeptide sequence is orthologous to G846
ccacgcgttccgctnctgttggtaataaaagaaaaccaccaagcaaatctcagaaaaggaataagaaacttaaggattcagatattgaccttgacagtggcccagttgcccgggtacggtggtttcgggtggttcttgatgaagctcagacgataaaaaatttccgaactcaagtggctaaaggctgttgtggactaagagcaaaaaggagatggtgcttatcaggaacacctatacaaaattcaatcgatgagctctacagctatttccgtttcttgaaatatgatccatattctacatatagctcattttgtacaatgataaagcacccaattgctagaaatgcagtccatgggtataagaaactacaaactgtgttgaggatagttctcctgcgtcgcacaaaagaaactaagataaatggagaaccgatcataaacttacctccaaagacaattaagttgcaaaaggtggatttcacaaaggaggagcgagctttttatttgacactggaagaacgttctcggcaacagttcaaggaatatgctgctgccggaacagtcaaacaaaactatgccaatatccttttattgttgttgcgccttaggcaggcttgtgatcatcctcttcttgtgaaggggcatcagtcggtatttaaaggcgatggttctatagagatggncaaacaactttccaaggaaagggtaataganttgcttgcaaggctggaagtatcagcgctttgtgctgtatgccgtgacacacctgaggatgctgttgtggcgatgtgtggtcatattttctgctatcagtgtatatacgagcgggatacaactgatgaaaacatgtgccccgtccctaattgcagaaacacgtttagtactgaatcagtattttcatcagggacattaagatttgtatctccggcagaccagtactcatgccatagcgagttcatcagcagacgatgggctatcttctatcagtcaaagcaggtacttcttctcaaaatccaaggacccgtcgattatttgattctataattacatgcatgcttttagaaagggattccattgattaattccaaccgggttccccgggtaaca

SEQ ID NO: 9594 - DNA, 778 bp, Triticum aestivum
  Predicted polypeptide sequence is orthologous to G849
gacagacagacagacagacagacaggcaaagagtttgcctcatcttcataccatcataaattttctagttacatacaccgaacagattggtcctcaaacccagacagaaccggcaccaggttttggctgactgacaatctactaagatagaaaccatacataacagtcgcagaacaagacgcggcccagacccgctccggggtctctgcgcaccctaggtacacacattgccatttgactctcatccagcaacaccaggcgcacgcatttgcttcgtttctctttctctcttcttttttttttacacggggaggatggacggatcggtcggtctagtctcggccttcctcctcgtcgcgcttggcgtggtgcacggtccagtaggcctgcgccgccagcacgcggtccaggaggccctgcggcgggatcgccctcccccgccgcagctgcggggggatgctcgccgtgtgcaccaggttcttccacttgtccttgaggtcgacgtaggtcctctcctcgttgtcgcgaaacgcatggttcttgacgtttttccacctgccgaacccaagcagctccacagcttccaccagtagctccacctcagcaacggagaagggcctccgcttacgcctttgcccgaaatccctctgtcttgacctgggaacaactggcacgatggccagcgcatctgggtttgaagtcccataggggaagatcgcttggcagatttctgacctgacttgcgcagccccttcacagggataatcacccagagtgc

SEQ ID NO: 9595 - DNA, 875 bp, Triticum aestivum
  Predicted polypeptide sequence is orthologous to G849
caccagccattagcttgattacgcccagctattttggtgacactatagaatactcaagctatgcatccaacgcgttgggagctctcccatatggtcgacctgcaggcggccgcactagtgattagcgtggtcgcggccgaggttttttttttaaaaaatgtcaaatgaaatattatacgcgtagatagtgagctatagaccatacaggcagcagttgcaggttcacaacaaaccaaatgtaacagcaattatgcatctgcctttagggggaaatttacacatcatagagcaaatcaccactactggacaagcaaacaaacatccgaccaacatgggtgtgtgacaatggaacatgagtgcagcataatcaggcacctgcatgagtgcaagtcttggaaaacaggaatacagctggttccgcggattggcaacctttgtaattatatcagtgttttcagcatggcccgttgtcacggaccataggcgccaccgcgtcttatcccgccataggcaccaactcgtccacctctgcgcaccaccaggttacatcatggggcatcctgctgaactgccggccctggaaaatttgcagttgcagagaagctcagtggtattgctagatcagtcgcttgggaaggctggtcagcctgtctgctgctaatgttggcatcgttcccacccatgaacggtgcaccctcctggacatggaccaagccaccaggcgacataggtgacatatcagatgcgtccgccagcgattgtctaggtatgggtgcagtaccatcagacactgaaccaggtagtggtacaggaagtggcccagttacggcagctccagcttcagttgcaggtggcagcacatcaaaccagatctt

SEQ ID NO: 9596 - DNA, 589 bp, Triticum aestivum
  Predicted polypeptide sequence is orthologous to G852, G2633
tcaaaacgctgctggatagctaccacagttgctacaggcttgaggagagggacggggtcctttaccttggttggaagagcagagtgttggtcgtgtcttctgcatggtgctgacatgtcctgaggagaagctcatgtcatatggaacctgagcttataaggtcggttcagttgtctgtctgctcactggccatctaattcactggaactggaacctgagcttgagtgatttgtcctttctccagtttcagatggaacttgagcttatataagggctttgctgcttgtgggcggcaccaagagttgctgtgatgataccgcgacagccgtgacttagaagaaggcacagtgattaaataaataaacatgttcatagctaggaatttggtgtgttgtggtttgctcccgttgttctaggattgacatgcttgtaatatactgtactacatactaattagaggatgtttagagacgattaaaaggggtatgcaggcacaagaggcgcctgttgcatatgtcctcaccgtcgttgatttgtgtaatgatgacgtgacggtttattataacctcttctgctgctaaaaaaaaaa

SEQ ID NO: 9597 - DNA, 580 bp, Triticum aestivum
  Predicted polypeptide sequence is orthologous to G852, G2633
ttcggcacgaggggaaggccttgtggccggctctctttctctggaagtaagctgtataaatccttgaagtgcaaagaacctacaagctctgagctcatgtcttacatgcatctcctctgtgagatctgcccgttctacaagtttggttacatgtcggccaatggtgccatagcagaggctatcaaaggcgagaacttcgttcacatcattgatttccaaatcgcacaggggagccagtggataactatcattcaggctcttgcagcgaggcccgggggtccaccattcctaagaatcactggtatagatgactcaaactctgcttatgcccgaggtggtggactggatatggttgggacaagattgcatagcatctctgcttcgtgtggccttccctttgagttcaatgctgtccatgctgctagccatgaggtttatattcagcatcttgacacaagacctggggaggctattgtagtgaattttgcctatcagctgcaccatactcctgatgaaagcgtgagcgtggaaaatcaccgggacaggatcataagaatgatcaagagcctgtcccctaggg

SEQ ID NO: 9598 - DNA, 698 bp, Triticum aestivum
  Predicted polypeptide sequence is orthologous to G852, G2633
cacaaatcccgagagtgaggacacatgcaacagccgcctcttgtgcctgcataccctttaatcgtctctaaacatcctctaattagtagtacagtatattacaagcatgtcaatcctagaacaacgggagcaaaccacaacacaccaaattcctagctatgaacatatttatttatttaatcactatgccttcttctaagtcacggctgtcgcggtatcatcacagcaactcctggtgcagacaagcagcaaagcccttatataagctcaggttccatctgaaactgataagctcaggttccatatgacatgagcttctcctcaagacatgtcagcaccacgcagaagacacgaccaacactctgcccttccaaccaaggtaaaggactccgtccctctcctcaagcctgtagcaacttgtggtagctatccagcagcgttttgatggtgttgttcaccaccgaactcagcgggtacggcctgaatccagccattgcaaacctcgccttccatttcccaaacacctcgtgcctctcaaccctttcagcaccctcgcacgcgattaaattgacgatatcccttgccacacagtgttgctccgtgctaatccgcctcttatcatcccttggtagagcaacatctattgactcaaacatttgccgtatagtagtcgagggtcttcaagtaccttggcaaga

SEQ ID NO: 9599 - DNA, 651 bp, Triticum aestivum
  misc_feature (385)..(385): n is a, c, g, or t
  misc_feature (510)..(510): n is a, c, g, or t
  misc_feature (514)..(514): n is a, c, g, or t
  misc_feature (534)..(534): n is a, c, g, or t
  misc_feature (591)..(591): n is a, c, g, or t
  misc_feature (596)..(596): n is a, c, g, or t
  misc_feature (598)..(598): n is a, c, g, or t
  misc_feature (627)..(627): n is a, c, g, or t
  misc_feature (630)..(630): n is a, c, g, or t
  misc_feature (636)..(636): n is a, c, g, or t
  misc_feature (648)..(648): n is a, c, g, or t
  misc_feature (651)..(651): n is a, c, g, or t
  Predicted polypeptide sequence is orthologous to G852, G2633
gagttttttttttttttttttttttttgattaactgaaacatatacccaaacttactactacacatcatcaacctgttctaggctaggctggtagtgactgccatcacagcattaggcatttaggctatatgtgttctactacaactcagtatctatcaccataggcttcctatagatagttccagtgaccagccaaacatatctaaaccactaagaggtacttcgaaggttacaagaaacattctccatcaggtcaacattctctgaagtcaacactagtgccatgccgatgagacgatcaggggcctgttcttccagccgaggtagagcacgccgtccctctcggcgagcttgtagtccggcgagtactctgcagcagcgtcntgatggtggcgttcaacagcgcgctgagcggggacgggctgaaccggcatcatcagccgcgccttccactgccgaacactcgtgccgctcaaccgctcctcgccctcgcaggcacaagtcacatncccnggcaagcatgctctcatgtnatcgctccgtctcctcggaacgcaagtcatggcccaaaatgcgttataaccactccncaacncnccaaagggcttttgggttgcccgccacantanacttgnaaagcttcaacnagn

SEQ ID NO: 9600 - DNA, 883 bp, Triticum aestivum
  misc_feature (24)..(24): n is a, c, g, or t
  misc_feature (722)..(722): n is a, c, g, or t
  Predicted polypeptide sequence is orthologous to G852, G2633
ttgtcccgaccctgagttagtggncttatcatacgacgttgtattgggaccactttgtacaagaaagctgggtacgcgtaagcttgggcccctcgagggatactctagagcggccgcccttttttttttttttttatcaagaaacaatattaaatctcacatgttgcaaaacaggttgtttagacaatacagtacatatttcgaaacaactcagtccatgaggacatagcacaacaatgaagttggttatcatatcacataataaaactagtgctagtgccatgcggacgaaaccaccaggggcttattcttccatccgaggtatagcaccccgtccctctccgcgagttggtagttcgccgagtagctctgcagcagcgtcctgatggtggcattcaccagcgagctgagcggacacggcctaaagccgacatcatgaggcgccccttccacttgccaagactcgtgcgttccacctctccaacctcgcagctagattgaaattcctcacaatctccctccccagtgagtgctgctccatgttgatcctctccctgtcctcctttgggagcgtcgggtcgatggactcgaatattgcagtgtaatattctagcgtttcttggaaccctctgttttaaggtacgacgtgttcgtgttaacctccttgccccccagggttaccacctttgggagaacaggttttcacccagccttaagatccnggtttcggggggttgcccgtgcctaccggcctcttccggaattgtggtgagttcccgggtttaagattccttgcaagaaccttccccagggattgaccattaaaatgcccctttttccttttttcccccggggaaggcacccgagttggattctaaggggg

SEQ ID NO: 9601 - DNA, 840 bp, Triticum aestivum
  misc_feature (626)..(632): n is a, c, g, or t
  misc_feature (641)..(641): n is a, c, g, or t
  misc_feature (693)..(693): n is a, c, g, or t
  misc_feature (747)..(747): n is a, c, g, or t
  misc_feature (751)..(754): n is a, c, g, or t
  misc_feature (773)..(773): n is a, c, g, or t
  misc_feature (775)..(792): n is a, c, g, or t
  misc_feature (794)..(795): n is a, c, g, or t
  Predicted polypeptide sequence is orthologous to G852, G2633
cccccgctattagatttaggcctatccaggtgacatgattgaacaagtttgtacaaaaaagcaggctggtaccggtccggaattcccgggatatcgtcgacccacgcgtccgcatgaacgaacgggatcagctccttcgtatggtgaagggccttcaaccaaagcttgtgaccctggttgagcaggatgccaataccaatactgctccatttcagacaaggttccgtgaggtctatgactactactccgctcttttcgattcactggacgcaacacttccaagggaaagtccggacagaatgaatgtggagaggcagtgccttgctagagaaattgttaacatcttggcttgcgaaggccctgatcgcgtggagaggtacgaagttgctgggaaatggagggcgagaatgacgatggctggattcgcaccgtgcccatttagcagcaacgtcatcggaggaataagatcgctgctgagctcgtactgcgacaggtacaagttcgaggaggaccatgggggacttcacttcggctggggagagaaacgctcatcgtcgcctccgcgtgggcatagggcgagctcgctgactgggttgcttagcactgctgtattagattgtgcaagnnnnnnnatgtaaaanggtggaacagggggggaaccacggaggatttcttggttgattttttctattnaaggattttgtttgcaaaaataatgagtttgcctgatcgccgggtaaacatgtnggcnnnngcagtgttcgtgagaatancnnnnnnnnnnnnnnnnnntnnaccccccccaattatattttttgtggtcaaaaataaaaaaaaaaa

SEQ ID NO: 9602 - DNA, 1115 bp, Triticum aestivum
  misc_feature (19)..(19): n is a, c, g, or t
  misc_feature (23)..(23): n is a, c, g, or t
  misc_feature (29)..(29): n is a, c, g, or t
  misc_feature (686)..(686): n is a, c, g, or t
  misc_feature (755)..(755): n is a, c, g, or t
  misc_feature (973)..(973): n is a, c, g, or t
  Predicted polypeptide sequence is orthologous to G852, G2633
gccgttccgactgggttanattngggcgnaggttatgcaacattgctcactcatgttgtctgccctttgagttcaacgccgtaaatgcagctagtcatgaggttacacttgaacatctcgatataagaaagggagaggctattgctgtcaactttgcatatcagctgcatcatactcctgatgagagtgtctgcatagaaaaccaccgggataggatattgagaatggttaagagcctttctcctagggtggtaacccttgtagagcaggaggctaacacaaacactgccccattcttcagtagatacatggagacccttgactactacacagccatgttcgaggcaatagatgttgcttgccccagggatgacaaggtgaggatgagcactgagcagcactgtgttgcaagagatattgtcaatttaattgcatgtgaaggtgcagaaagagtggagaggcatgaaccatttggaaagtggcggtctaggtttgcaatggctggctttagaccataccccctaagtgcattggtgaacaatactatcagaacactgttaaatgattacaacagttactacaagctagaggagaaagatggtgtcatttatcttggatggaagaacagaaagctggttgtatcttctgcatggcagtgagattcctgaatatggaagaagcttgtntaggttctttcatggctttgtcttcggcacatagatccaagggtggaacctaatcagcgaatgtgagtnccataatccaaaggactgtggctgcttgcttcttggcgcccagctgtcaaccctccgctgcgcacaccattcagatttgatgggtataaactgaatactcgtcgtggcatcctggtgtaatacaggcacaaaacgtgctgctgctaccgtctactgaccatctgtagctgctgaccacgtcctgaaatctaaaggggatctttatgtccctgggtagnttcattttccctcctctcatcttatgcgatactggaaccttatgctagccatggtaccggcacaaattgtctgggtaaatggtgttttcccaaaaaaaagtaattggttttgtcccattgttggatgattatgggatgtttt

SEQ ID NO: 9603 - DNA, 1141 bp, Triticum aestivum
  Predicted polypeptide sequence is orthologous to G861, G1140
ggcatgcatccaacgcgtccccgagctcacgcctctggtcgacctgcaggcggccgcactcgtgcttcgcgtggtcgcggccgaggtctcactctcattccaagctccttcagcaagcagacgcgccatctcagctggatttgcatgaggacagcaattgtgcaagactaagggacgagcttgcagaagcaagcctctggctccagcagatgagaggagaggagctccagagcttgaacgtccagcagcttcaggccctagagaagagcctcgagtccgggctcggctccgttctgaaaaccaagagccaaaagatcatggaccagatcagcgagctagaaagaaagagggtgcaactgatagaggaaaacgcaaggctaaaggagcaagcgtccaagatggagatgcaagtcgccgctgattcaccggcggtgtatgaggaaggacagtcatctgagtccgtcacgaacacgtcgtatccacgccctcctctcgacaccgaggacagctccgatacctctctcaggctcggattaccattctacaactcgaagtgattggctggaaattatccgaagcaaagtgatgcttggtcacgacaagctcctgaatcgaaccgcgcgctgcatcgaataaacagtttgagtgcgctggatgatgtgtgtaatctaaaagaagactggcttctgttatatatagtatagtgtggcacaataagagaacaggttcttttgatattacctgctactggtttttcccgtccttgtcctgtgctgtaaggttttagtagacccctgagtgtccatcagaactctgaattgcttcaacccctgcaagtaaaatcaccactggcacagtggcatattgatttgaacataagaaaaaaaaaagttgttatgatgttcttgaagaggcaaattttgttttcgaacctcgggcgggaacacgctaatcccgcggccatggcggccgggagcatgcgacgtcgggcccattcggcctatagtgagtcgtattaaaatcactgggcgtcgttttacacgtcctgactggaaaaaccctgggttccccaattaaatgccttgaagaaaatccccttttgccagttgggttaaaacaaaaagccccacccaatcccctg

SEQ ID NO: 9604 - DNA, 1099 bp, Triticum aestivum
  misc_feature (17)..(17): n is a, c, g, or t
  misc_feature (19)..(19): n is a, c, g, or t
  misc_feature (801)..(801): n is a, c, g, or t
  Predicted polypeptide sequence is orthologous to G861, G1140
acccacgtcttccgatncnagccagccggtgctctttgtttgtttgtttgtttgttcgtgcggctgagcaggaggagggaggaggacggcggcgccggagcagctgggagcggttcaggcagggcggatcgagatggcgcgggagaggcgggcgatacggcggatagagagcgcggcggcgcggcaggtgaccttctccaagcggaggcgcgggctgttcaagaaggccgaggagctcgccgtgctctgcgacgccgacgtcgcgctcgtcgtcttctcctccaccggcaagctctcccagttcgccagctccagtatgaacgagatcattgacaagtatagtactcattcaaagaacctggggaaatctgatcagcagccggctattgatttaaatttagagcactgcaagtatgacagtttgaatgaacaactcgcagaagcaagtcttcgacttagacacatgagaggtgaggaacttgacggactgagtgtcggtgagttgcagcagatggaaaagaatctcgaaacaggattgcagagggtgctttgtacaaaggaccggcaattcatgcaacaaattagtgacctccaacaaaagggaacacagctggcagaggaaaatatgcgcttgaaaaaccaaatgcatgaggtgccaactgctagcacggtggccgttgccgaagccgaaaatgttgtccctgaagatgctcattcatctgactctgtgatgacggcagtacattcgggaagctcacaggacaatgatgacggttctgatatatccctgaaactagcgtnaccttggaaagtagggacgtggggagggcaccatgagttgccttggtagagagaagatgtgaaatgctatggggaatcactccaagataggctggctgggatgatcccatagtagaaggcagatcagtttaacccgatcgagttgtcgttttatgtctccgtttgcacggcgcagttgtcccccttgttgctggggaatcagtcactgaaactgtaccgtatcttcctgtcttcccctgtaacggcctgtatcattcgtgcaaccattgtatttccctgcccggcttttggtcttttt

SEQ ID NO: 9605 - DNA, 1170 bp, Triticum aestivum
  misc_feature (31)..(31): n is a, c, g, or t
  misc_feature (865)..(866): n is a, c, g, or t
  Predicted polypeptide sequence is orthologous to G861, G1140
atgcttccaacgcgttcgggagcgtacccanatggtcgacctgcaggcggccgcactagtgattagcgtggtcgcggccgaggtttttaacatgcccttcaacttcccgccaaaggaaaaaaacttctgattgttgttcaactttctttttcatcaaaatgttacttcctccgtcccaaaatataagatcacttgagcttatataatttgagacggaaggagtagaacgctgaccaagacatgtatttatagagcataatctaagataccgtcatggtacatacataacatggatagtgtcaacaacgatgaacatcaggtagctctaaaagtttagtcaaggtcctagcaaacaccaacagttaaaacgggggcatcacatcatgcagccacaaggatgataaatcaggttaactgatctcgcttccgccgcaggattattgcagcccaggtttatccataaccccaagagcttcttcactgatgctgcagctccatgaggaaccgaacggacgacaaccgttgttacttccacgggaggcagggcaatcctaatttcagggaaacatcagaaccatcatcattatcctgtgagcttccggagtgtaatgcagtcatgacggattccgaggactgtccatcttcagcaacaatattttcagtatcagcaaccactagcttgccagctgttggaatctggcctacttggttccttagtttcatgttctcctctgccagctgtgaactctttcgatgcagttcatttatctgttccaagaattgttgatcttttgtctgaagcaccctgtgcagaccagtttctaggtttttctccaactgctggagttcatcaacactcaacccnnttcagctcctcactctcatctgtcttagtcgaagactagcttctgcaagctgatcgttcaaatttgcatacttgctatgctctaagttcaagtcaagagcaggctggtctgttttccccaagttcctagaatgcgtgctgtacttgtcgatgatctcattcatactggacctgccgaactgggaagcttgccggtgaggagaagagatgaccgccacttcgggttcaaaagacaggaaagtccctggccttcttaaaaggccgggcgggctttgaaaaaggtacctgccggcccccggaactcg

SEQ ID NO: 9606 - DNA, 563 bp, Triticum aestivum
  Predicted polypeptide sequence is orthologous to G866, G883
gcgcactccgaggccaccaccaacggcggccgctgccactgctccaagagaaggaaaaaccgcgtgaagaggaccatcagagtgccggcgatcagctcgaagatcgccgacatcccgccggacgagtactcgtggaggaagtacggccagaagcccatcaagggctccccttacccacggggctactacaagtgcagcactgtgcggggatgcccggcgaggaagcacgtggagcgcgccaccgacgacccggccatgctggtggtgacctacgagggcgagcaccgccacacgcccggagcggccgggcccagccccctggcgaccgcgtctccggtggccgccgctgtctccgccggcaacggccatgtctagtcgttccaaagctaggattagcttctctcttcttttttgagctgcttgccccccgatctgatgtccgtgtaaaaaaaggaacaaggttgtagaaagagggagtgcacaccttcgatgccgcaaaaactctcaaacttgatgaatcgcatatctccgattggtgctcgctcaaaaaaaaaaaaaaaaaa

SEQ ID NO: 9607 - DNA, 1227 bp, Triticum aestivum
  Predicted polypeptide sequence is orthologous to G866, G883
cgatgatgaccatggatctgattggaggatacgggagggcggacgagcaggtggccatccaggaggcggcggcggcggggctgcgcgggatggagcacctcatcctgcagctctcccggacaggcaccagcgagagctcgccggttgggtcgtcggaggcgccggagcagcaggtggactgccgggagatcactgatatgacagtgtccaagttcaagaaggtgatttctatcctcaaccaccgcactggccacgccaggttccggcgcgggcctgtggtggcgcagtcccagggccccgccgtgtccgagccggcgccggtgagggcgtcttcgtcgaggtccgtgaccttggacttcaccaaggcgtcttctgggtacggaaacgacgctggcttcagcgtctcggccgcgagctcatccttcatgtcgtcggtgaccggtgacgggagcgtgtccaacggacgcgggggcgggtcctcgctgatgctcccgccactaccttcggccagctgcgggaaaccgccgctggcgtcctccgcggcatccaccggcgcgggtgccgggcagaaacgcaagtgccacgaccacgcgcactccgagaacgtcgccggcggaaagtacggcgcctccggtggccgctgccactgctccaagcgcaggaagtcccgggttcggcggatgactcgcgtgccggcgatcagctcgaaggcagcggagatccccgcggacgacttctcgtggcgcaagtacgggcagaagcctatcaagggctccccctacccacgaggttactacaagtgcagcacggtgcgcgggtgcccggcgcggaagcacgtggagcgcgaccccagcgacccctccatgctcatcgtgacctacgaaggcgagcaccggcacacccccgcggaccaggagccgctcgccccgctaccggagctctgaaatctctttgccattaccgtcgtcctcacatgttaattcaacttagcttgtcgccatgttcccttcgttactgctagctaccatatattactactaataagcaagtagaatttctttttcttttggccgcatcagtttagtcgcactaagcatgttgtaaaagaacaagtgtagttggaagctttgagctttgaagaagaaaaggtgcgtggtagacaagaaaaaaaaaaaaaaaaaaaaaaaaaaaaaaaaaaaaaaaaaaaaaaaaaaaaaaaaaaaaaaa

SEQ ID NO: 9608 - DNA, 879 bp, Triticum aestivum
  Predicted polypeptide sequence is orthologous to G866, G883
ctagcttttggtgaactatagaaaagtttttccaaaaaagcaggctggtaccggtccggaattcccgggatatcgtcgacccacgcgtccgatctcaaagtcacacaaccaagccgagaaccgccgcgagcagcagccagggccgcgcctttccccgtccttctccggcgccgaccatggccgtcgacttcgtgggacgcggctacgccccacgtggcctcgccctcgcgggcggggagcagcagctggccttccacgaggccgccgcggcggggctcagcagcctcgagctcctcgtcgcgtcgctctccccccgcgccgactgcgcgccgccgccgctcggggagatcgccgaccaagcgttatcggggttccgccgggtcatcgacatcctcggccgcagcggccacgcccgcttccgccgcggccctgttggaggaggcgccgcctcgttgactccccctcctgtctcttctcctcctcggatgccggcccggccaccggcaccggcagcctcgcagcagttggcgcccagaaaagcctgacgctggacttcaccaagccttcgaaggcgccggcagcggcagccgctgcttcggtgacgtcgaacgtctttcttctcgtcggtgacggcgggggccgagggcagcgtctccaaaggcccggggccaactggtgtcctccggaaagcccccgctcgcggctgggaccaaacgcaagcaacagcagccgcaaacgccctgcgcgaggggggcgcaacttcgaagtttcccgccgccgccggccggtgggcccgggggccacttgctccaaaaaaaccccaagcccccggggtggaaataacaccaccgcgcggtgccccgcgcggtaaagcctcgg

SEQ ID NO: 9609 - DNA, 1085 bp, Triticum aestivum
  Predicted polypeptide sequence is orthologous to G866, G883
tactgcgacccacgcttccgaccaagacagcgagccaagatctgcagagccacacgcgaccacacaccggcgaccatggccgtggacctcatgggctgctacacccctcgccgcgccgacgaccagctcgccatccaggaggccgccaccgccggcctccgcagcctggagctcctggtctcctccctctccggcgcggcgccgtccaaggcgccccagcagcacccgcagcagccgttcggcgagatcgccgaccaggccgtctccaagttccgcaaggtgatctccatcctcgaccgcaccggtcacgcccgcttccgccgcggccccgtccagtcggcgccgccgccgccgcctcctccagcaccggtcgctccacctcctcccccacctttgaccgtcgtggcgccggtgtcggtggccgccccgctcccgcagccgcagagcctgacgctggacttcaccaagccgaacctgaccatgtcgggcgcgacgtccgtgacatccacgtccttcttctcttcggtgaccgccggcgagggcagcgtgtccaagggccggagcctggtctccgccggcaagccgccgctgtccgggcacaagagaaagccctgcgccggcgcgcactccgaggccaacaccaccggcagccgatgccactgctccaagagaaggaagaaccgcgtgaagacgacggtgagggtgccggcggtgagcgcgaagatcgccgacatcccgccggacgagtactcgtggaggaagtacggccagaagcccatcaagggatccccttacccacgggggctactacagtgcagcacagtgcgagggtgccctgcccggaagcacgtggagcgcgccctggacgacccgccgatgctggtggtgacttacgagggcgtcgcacgccactcgccggggccgatgccgatgcagattgcggcgtcgccgatgccaatgcgatgggcgctccgtagccgtgctagtgtgtccgcgggcacgggcagtctgactagttaattttttcttctttcccctttggggggggtgctcggtgggtcccaactgcttgattccgggtaaga

SEQ ID NO: 9610 - DNA, 330 bp, Triticum aestivum
  Predicted polypeptide sequence is orthologous to G877
tagcgtggtcgcggccgaggtacgagggcagttaatgaatatacttgcgacccttttactctcagactctcctccttttctcgctgctgaacccctgccaccatcatgtccagactggctgtctccatggttgtggcgccaaggtcaccgcatcttacatcctgatgcatgttgaagcatgaggctggaatacaaggtgtgttaggttgaagcatgaggctggaatgggtcttgtgcgaggactagcgtttgctttagtcaaaccaaaatacttctaaaattgcagctgcacttgttggtctgatgtacctgcccgggcggccgctcgaa

SEQ ID NO: 9611 - DNA, 721 bp, Triticum aestivum
  Predicted polypeptide sequence is orthologous to G881
cacagaaaggggtttttttacacggaggtgcagagaagcgcggaggacagctcggtggtagaggcgacatacgagggtgagcacaaccacctgcgccccatgggggcggtgagccgagctgcgcaacgcgtgcggaggcttggtgttgtgctccatctccatcaactcctccggcccaaccactatgctggacctcaccaagaacctgggaggcgtgcaggttgtcgaggcaggggaggcgcaaccggacctgaataaggtacagatcttggtgttgattctgcctcacttttacagccggcagtggttcggtttgctgcaggaactgtgcagagcatgaggatgatgtaggccgctgcgccacctctcttgtcatcctggtcactgcttagccaatttctttgattcagaggcttgtgcccctacaggcgttgcatggcaatccgcgcttctgcgagcaacaacaaaaacagggcgaaacaaagcaagcacaaaagaagaattgagatgctacatacaaccaatggtatccttttaacgccgccgccgggggtccttccgcctgagccaggatctcttctaccctgcaccgctgctgtgaactcatccatgctgacagtcggctccatgctacaactgctgcagcctgcagacatgtacaggaacaagcaagaaatcagaaatggttagggccgctatgccttgaaaagagccaaaagga

SEQ ID NO: 9612 - DNA, 520 bp, Triticum aestivum
  misc_feature (26)..(26): n is a, c, g, or t
  misc_feature (330)..(330): n is a, c, g, or t
  misc_feature (358)..(358): n is a, c, g, or t
  misc_feature (393)..(393): n is a, c, g, or t
  misc_feature (410)..(410): n is a, c, g, or t
  misc_feature (438)..(438): n is a, c, g, or t
  misc_feature (450)..(450): n is a, c, g, or t
  misc_feature (452)..(452): n is a, c, g, or t
  misc_feature (490)..(490): n is a, c, g, or t
  misc_feature (502)..(502): n is a, c, g, or t
  misc_feature (504)..(504): n is a, c, g, or t
  misc_feature (513)..(513): n is a, c, g, or t
  misc_feature (519)..(519): n is a, c, g, or t
  Predicted polypeptide sequence is orthologous to G892
ctcgagtttttttttttttttttggncaacaataataaataagtaaccggacaaacatggattaacaagttccccaccggagagatcgatcagtgaatggatggacatctgacatctccaacaataacaggcaaacacaagactaagcagttaacccacaccaacacacactctgcacctcaacaaattaatcatcatgctggagcagttagttactgtagctcacaacaacatgcagctcctcgcgccgaccaattaaacacaagaagaacctactggcgacccatctgcatcgctcgacctcggcgagggaagagagatcagtagtangtgcacgaaaccgttactgggggtcggnccttgacgacgatgccccgagtccggcgaaagtancaattccaaggaagtgnccgggcgttggcgggcgttattaaaggntcaatggcgacngnggtgtgcgacaacaaggttgtttgggggttgtaacacnggcccgcccggntnggttaaaancgcaanc

SEQ ID NO: 9613 - DNA, 515 bp, Triticum aestivum
  misc_feature (212)..(212): n is a, c, g, or t
  Predicted polypeptide sequence is orthologous to G896
caggtccaatttttcattgttgttatccactgacggggagcagtgcagcttgctatcgttgcaggtcagttgggcgttggtgcagtacgcaagcacttgagaggacgattggcacgcacttcagtttcagccgtgcgacgctgcagtatggatgcacgcggcaggaggttcgttgctgcagtttgcttggtgtgggcgaggaggttcttcanctggcccatgtagtttacctggtgcagggggggcggttgatggttgcggttaaaaggaaaattgggtggggtccactttctttgggatgaaaaaataagtgcaaatgtggttcactaattattttctcagggttcagttaactatattttgtgtgatgagagccgctccgacgtctgatgtagttaactgaaccctgagaaaagttatatggactcgtttgaaaattgtttaccaaagaagttcatttagaattgtgttgcggctcatttctctcgaccatgcggtttgcttcttcgcacgtg

SEQ ID NO: 9614 - DNA, 551 bp, Triticum aestivum
  Predicted polypeptide sequence is orthologous to G896
ttttttttttttttttttgattttaatcagtgatattgattctactgcagtacaactgaaatgtcccgttcagtttgctcacaagtgcagtgcagaacaggaccacagcatcattggtaaggcaaacgagccaattacatgactcggaacaactccggcgcggaagaagtcacaggagaaagggcttccggtagatgtcgaacatctcagaagagcagagctggggctcctgcacggcgctggaagtgatcatcttgcggacgaaggagccgatcctcccggggaggcggcggccggtcccctggctgtcgcggatcgtcgccctcatcgcgctcagcagccgcccgtacgtcgtccccggctcggactccacggccctgatgaagctgtccgtcatggcgccaatagcagcggtatcggagaacccctggacgctcgattccgtcgacttctggtcgtcgttgcagccgctgatggagatggcgaggcctccgttggtgcctttcggcttgcccggacggacgtggttctcccactgccacctgcagccc

SEQ ID NO: 9615 - DNA, 638 bp, Triticum aestivum
  Predicted polypeptide sequence is orthologous to G896
gaggaaacaacctccgaatcagatcaacttctcctcttctcgtcgcacaagatcaacggcgcacgcgatgacgctgagcaacagccgcccttctcggttcctctgcctcctcgtgctgctgctcctcctcaccgtcttcgcgcggcgctccggcgccaccaggcccctgcggcaaccggcagctggcggcggtgggggtgtggccgccgcggccgtgcggacgatcgccctccccgccgcggccttgacgagggacgcggaggaggtcgtgccggtcgggaagcgggtcgaggcgctgctcggcatgaagcccaggtcgagagcgccgccgtcgggccccagcaaacgaaccaacgacatcaagagctgacgatccggcggcctgctctgctcggctcttctctgatgccggtcgatcttttcttcttcttcttcttctcttgtgctagctcgtttaggctctgagcaaccgactggttgaccagtcgtatactagattgtttcatttgttctttgtagctaggtctagcgtgcctccacaatgattttctctcgggtatgctagtgtaaattattgtaacatatattgctgatatactcctgcttgtaatgtgatgtaaaaaaaaaaaaaaaaaaaa

SEQ ID NO: 9616 - DNA, 586 bp, Triticum aestivum
  misc_feature (372)..(372): n is a, c, g, or t
  misc_feature (374)..(374): n is a, c, g, or t
  misc_feature (390)..(390): n is a, c, g, or t
  misc_feature (453)..(453): n is a, c, g, or t
  misc_feature (461)..(461): n is a, c, g, or t
  misc_feature (495)..(495): n is a, c, g, or t
  misc_feature (500)..(500): n is a, c, g, or t
  misc_feature (518)..(518): n is a, c, g, or t
  misc_feature (520)..(520): n is a, c, g, or t
  misc_feature (527)..(527): n is a, c, g, or t
  misc_feature (529)..(529): n is a, c, g, or t
  misc_feature (562)..(562): n is a, c, g, or t
  misc_feature (585)..(585): n is a, c, g, or t
  Predicted polypeptide sequence is orthologous to G896
gctaacgaacccgaccaccccccagtagctcggcagccatgaactgcggaaggggtcccgctccggccaccatggtgcgctgcaggcagtgcagcgccagcgtcgccgcgccggccggcgcccgtgccgtccagtgcgcgcagtgctgctgcgtgacccgcgtgggcggggctggccgacagctcagtgtggtgcgccccatcccgaacttcggcggtggccgcggcaagaagcgcgccgtgctggtggggatcaagtacaccaagactcgcgcctgcgagctgaggggccccatcaacgacgtcaagtgcatgaggtactcctcaacgagcgcttcggcttcgccaacgactgcgtctcatcctcaacgantnaaggaaaggaaccctncaagcaaccgacaaaggcaacatccgcatggcatcattggctgatcagggtgcaactcccggnaatccctntgtcaatttcccggggcgggccccaagtcctgantggangggacaacggatggatgncnaggcatngnccgttaatcttcaaaagggccatctggccacanttacaagcatttcggccccctgnc

SEQ ID NO: 9617 - DNA, 715 bp, Triticum aestivum
  Predicted polypeptide sequence is orthologous to G896
gcagaggcagaggcagaacaagccgctggccagtggccatggagtgcggccagtgcagcgcgcgcttggctgtcacgcggggcgcgagctccgttcagtgcgcgcactgccgcagggcgacgcgcgtcgaacggcacggcgccgtcgtgcacggggccgtcggcttcgtcaggagcgtgttcacgaacattggccgggcgaggccgcacccggggtacccgccggtgcacggcaacaagcgcgctctcttggtcggcatcaactacaccggaacggcggccgagctgcccggccccatcaacgatgtcaagtgcatgagcttcctgctcaccctcaagtacggcttcccaggcgattgcatccttgtccttaccgatgaagagcgcgacccctacaggaggccaacaagggccaacatcctagtggcgatgcggtggctggtgcatgggtgcagctccggggactcccttgtgttccacttctccggccacggtgatcaggagaaagacaaggacggcgacgagcaggacggccaggacgagagcatctgcccgctggactggcagctgaacggcgccatcctggacgacgagatcaacgaggccatcgtccgcccgctcgtgcagggcgtcaggctccacgccatcatcgacgcctgccgcagcggcaccgtccttgatctccccaacctctgccagatcaaaaagaacgggga

SEQ ID NO: 9618 - DNA, 844 bp, Triticum aestivum
  misc_feature (5)..(5): n is a, c, g, or t
  misc_feature (22)..(22): n is a, c, g, or t
  misc_feature (526)..(533): n is a, c, g, or t
  misc_feature (541)..(546): n is a, c, g, or t
  misc_feature (548)..(549): n is a, c, g, or t
  misc_feature (551)..(551): n is a, c, g, or t
  misc_feature (555)..(556): n is a, c, g, or t
  misc_feature (558)..(558): n is a, c, g, or t
  misc_feature (560)..(562): n is a, c, g, or t
  misc_feature (564)..(564): n is a, c, g, or t
  misc_feature (569)..(569): n is a, c, g, or t
  misc_feature (775)..(775): n is a, c, g, or t
  misc_feature (816)..(816): n is a, c, g, or t
  Predicted polypeptide sequence is orthologous to G896
cacangccgtgcgttagctagnttacaatacggcttagtttagggaccactttgtacaagaaagctgggtacgcgtaagcttgggctcctcgagggatactctagagcggccgccctttttttttttttttttttttttttttttttttagcaccagtttgatgtattcttcaaattcatgcatcaaagtgaacattgatggcacgttcagacactactggtataattacctcattacagaacggatgcaggatgagcttgactactaaatggagagatcacaagtgatttgcctaagatcagtgccaatcagaaccacggttatggttccataattacaagataaacggcttcctgtagatgtcgaatgcttcggacgcgcacagctgaggctcctgtgcgctgctgaaggtgatgacccggcggaaaaaggagccgatgggcccagggatgccggagtcaccgccgttgtccgtgtgccttgtagatgcactatgggcattttccagtcttcctaggtgttttnnnnnnnnaaaatccnnnnnntnnanaaanntntnnntnatggnaccggtggaggttgagcccaagaacgctttctcttttgactctcccccaggtctggtacttccccatccgttaaaggaaattgccaggtccgccgtttatgccttcttcgcccttccgtttaagggttttcattttcccatttctcccacccattttttgtatttcccaaaaattttttgggggtttcagattttttccctctttnacaggtgtttcaaattggggttgaattcaaatcattgcccnagtcgggggaaaatttttcttttttttc

SEQ ID NO: 9619 - DNA, 832 bp, Triticum aestivum
  misc_feature (533)..(533): n is a, c, g, or t
  misc_feature (535)..(537): n is a, c, g, or t
  misc_feature (539)..(539): n is a, c, g, or t
  misc_feature (604)..(604): n is a, c, g, or t
  misc_feature (611)..(611): n is a, c, g, or t
  misc_feature (613)..(613): n is a, c, g, or t
  misc_feature (619)..(619): n is a, c, g, or t
  Predicted polypeptide sequence is orthologous to G896
caccgctagtgcgattaaggcctatctaggtgactatgattgaacaagtttgtacaaaaaagcaggctggtaccggtccggaattcccgggatatcgtcgacccacgcgtccgaagcaagcagcgctcacccagtaagctaacgaacccgaccaccccccggtagctcggcagccatgaactgcggaaggggtcccgctccggcgacgatggtgcgctgcaggcagtgcagcgccagcgtcgccgcgcctgccggcgcccgtgccgtccagtgcgcgcagtgctgctgcgtgacccgcgtgagcggggctggccgacagctcagtgtgatgcgccccatcccgaactttggcggtggccgcggcaagaagcgcgccgtgctcgtcggtatcaagtacaccaagacgcgtgcctgcgagctgaggggcccatcaacgacgtcagtgcatgaggtactcctcacgagcgctcgttcgcaacactgctcctctcacgatagagaggacctgagcgcacagcacatcttgtgcgtgncnnncnaggtgatcgcatcttggtcttactggctgatgcggggtgcagttcgggggaagtctcgtgttcanttttctngngccggngcgcaagtcccctattgtgacagggacaaccgggggggcgtgttggaggactctctttccccgggtcacttctccaggggggcccccttctgggagaagaaaaataaagggggctttggccgccccctttgtgggggggccaaatcccccctctttttaatctttgcaagatggccaccggctccttatccccaatcggggggccctttccaa

SEQ ID NO: 9620 - DNA, 459 bp, Triticum aestivum
  Predicted polypeptide sequence is orthologous to G896
agggaacaacatgctcgtcgcctgcgtgatgctcctcgtggtcctgctgatggcgacgcagatgggggcggcggtggccggcgacgccggcgcgggacgccgtcgcctgctcgatgcgtgccagtacagaaactgcaactgccgcacttgctacattttccactgggcctgttgcggcttgtgctgcccgccggcgtaggggacggcggcacacacggcccgctgcagtttctcacatgcagaggtttgaataatgcacatgtacgtggttacagtaacatgtggctgctcttgtctgtcccaatgctagtcgtggcctttgaaatttgacaaatttaacctgtgatttaatttcgtccataggtcaaatttgtcaattttgccgcaatttactacggtcaagttctgcgtttgcgcgactgtgtatgcacgcttaagtggatgatctgtctggttttg

SEQ ID NO: 9621 - DNA, 779 bp, Triticum aestivum
  Predicted polypeptide sequence is orthologous to G896
gcggccgctctagactagtggatcccccgggctgcagggaagttgatgggatggatgaaaccctctgcccattggattttgagacacagggaatgattgtggatgatgagataaatgctgcgcttgttagaccacttccccatggagctaaacttcatgcactcatagatgcttgccacagtgggactgcacttgatttgccgtttctctgtagaatgagcaggactgggcaatacgtatgggaagatcacagaccgcgatctggtgtctggaaaggaactagtggcggggaagctatttcatttagcggctgtgatgataatcagacatcagcggatacttcagccttgtcaaagatcacttcaactggtgcaatgacattttgcttcatccaagctattgaacaaagccaggccaccacatatgggagtatcctgaattccatgcgttcaacaatacggaatacgggaagtggtgcctcaatggctggaggtggtgcggttacatcactcatttcaatgcttcttacaggggggagtgctagtactggtggattgagacaggagccacagctaactgcgtgtaatacatttgatgtgtatgcgaaaccattttcgctatgatacatttgtggtattctccactgcgttctgtgattctatcacgaggccgggtttaaactatcatgtacagttaacaggtgcaatggctcctctatatatagagctaactttgtatcatttgatgctcatattcaaattaaagtgtttgcccccttt

SEQ ID NO: 9622 - DNA, 1198 bp, Triticum aestivum
  misc_feature (20)..(20): n is a, c, g, or t
  misc_feature (29)..(29): n is a, c, g, or t
  misc_feature (827)..(827): n is a, c, g, or t
  misc_feature (1000)..(1000): n is a, c, g, or t
  misc_feature (1005)..(1005): n is a, c, g, or t
  misc_feature (1010)..(1010): n is a, c, g, or t
  misc_feature (1026)..(1026): n is a, c, g, or t
  misc_feature (1035)..(1035): n is a, c, g, or t
  Predicted polypeptide sequence is orthologous to G896
gcttccgagcaaacgcacgncgtagcgcnagcttaactaagctaaaccaggtagccagccatgaacatgaactacggctccatgggtcctggcgcgatggtgcggtgcaggcagtgcagctcgagcatcacggcgatgcccggcgcccgcgccgtgcagtgcatgcagtgcagctgcgtgacgcgcgtcagcggccgtggccggcagcagcacggctacggccagggttacgggaacggcggcgggatgctgatgccgccgatgcgtcccaccccggccttcggcggcggccgcggcaagaagcgcgccgtgctgatcgggatcaagtacaccaaccggcgctcctgcgagctgcggggccccatcaacgacgtcaagtgcatgcggtacctgctcaccgagcgcttcggcttccccaacgactgcgtcctcatcctcaccgatgaggagaggaacccatgcaggcagccgaccaaggacaacatccgcatggcgatgcactggctggtgcaggggtgcagctacggcgactccctggtgttccagttctccggcctgggcgcgcaggtgcccgacgacgacggcgacgagctggacggcatggacgaggccctctgccccgtggactcgttccagcagggccccatcctggacgacgagatcaacgaggccatcgtccgcccgctggtgcacggcgtcaagctccacgccatcgtcgacgcctgccacagcgccaccgtcctcgacctccccctacaatgcaccgtgtccaagcagaccgggcgctggaggtggagggacgagcgccctatgaccggcgcctgcanggggcacagcgggaggcagggcgtgctcatcagtggcagcagcaccgggaagagcacatgagcgtgctgcctgagccctacgcacgatcggcgcatgacgccagcttatcagagcggtgagtggagcgggcaccactacggcgccgctcactcatgagggcatatgccgcganagggnaatgnactgaaggcccatcgnggtcatccnagtcgaaattcagggttgagagccagggccttgctaaagttagtcacccaacgttgtcttaaccacccaatctgtcaagggggggttgcctcaataactaattttccggagaaaagccgaaaaatagggcaaagtggaattcaacccgcgccaaaaacgaaca

SEQ ID NO: 9623 - DNA, 1182 bp, Triticum aestivum
  misc_feature (722)..(722): n is a, c, g, or t
  Predicted polypeptide sequence is orthologous to G896
cgtgcctttttttttttttttttttttttttttcccttttgtattgtcttttttttttgggggggaaaacttgatttatttaaggggacaacacaacacacaacggccatgttacagtgatttaaagtacaggggaaaacgaggtcctcaaaaccttttgtttgacctatgcagggctcattcttgatggcttggcaacaggtgaggaaatacatcgtcccacatactagtagcaagcatcatatttaattaaccggcccagtatgggggggggtcttttcttgattcggtattaattaattcgtcaactgcagtagcctggggcgcaatgacttcaaaccgggggtacggtcgggttctacatgcaaaagggctccctctcgacgtcaaacttgtaggcaaaggacagttgaggctcccccaccccgttaaattttgcaaccttgcggatggaccccccaatggggccttgcaggttgcatttgcacctgctgtcccccatgatggccctcatggaggtgaccaggcggccctaggtggtgggcggttccaaccccaccgccctgataaacctgtgcgtcatggccccaatcgtggcgtagggctcaggcagcacccccatgttgctcttcccgttgctgctgcccctaataaacaaggcctggcctccgttggtcccccccccggggccggtaatagggggctcgtccctccacctccancgcccggtcttgttgaacacggtccattggtagggagagtccaagaccggggcccttttgcacggctttaaaaaatggcgtggaactgtaacccccgccccaacgggggggacaatggccccttgaatcctctcctccagaatggggcccttgttggacaaatttccaccgggaaaagggccccctccatgccgccacccctttgcccctcatcctggggcccctgcccccccgggcaaaaatgtggccaccaagggattcccctatcttcccccttaaccacaaagggattcccagtgggaattttctctttggccggttgcctcccgggttcccccccccctctgggagacagacaaccactcagggggaacccaacgccctgggacaggtccgacccctctctatcttaaggggcccccactccaggaacgccgtggggtattatcccacaaaagcg

SEQ ID NO: 9624 - DNA, 526 bp, Triticum aestivum
  misc_feature (255)..(255): n is a, c, g, or t
  misc_feature (272)..(272): n is a, c, g, or t
  misc_feature (313)..(313): n is a, c, g, or t
  misc_feature (324)..(324): n is a, c, g, or t
  misc_feature (337)..(337): n is a, c, g, or t
  misc_feature (393)..(393): n is a, c, g, or t
  misc_feature (441)..(441): n is a, c, g, or t
  misc_feature (444)..(444): n is a, c, g, or t
  misc_feature (459)..(459): n is a, c, g, or t
  misc_feature (468)..(468): n is a, c, g, or t
  misc_feature (479)..(479): n is a, c, g, or t
  misc_feature (496)..(496): n is a, c, g, or t
  Predicted polypeptide sequence is orthologous to G898
ccactgcctatgctcgtgtcacccaaggggataccaccaacgagcttgtgagcacagtactatctctggggatgaactctagtgatgaccactcgcaagtgtcgaacagcatcttggcaaaccgtgcacctgctaataaggaggtctcaaaggaaccaaagttcacctgtccattctgctttggacgagctggtcgatgcgacgatgcgtcatccgactatctgcggccacatcttctgcgacaagtgcatcaantctccgtccaggtcaanaacaagtgccctacctgctgggaggggctcaccatgaaaanttccaaccccntctactcccctgnccacgatgggactaaactgattcacccttctcctcaactggattttgtatcctaanccggaatatacttcaaccgggttatggttaccatgattttccgggaanccngaggctttttacganccttcctgnctgatccttcnttttaaataacccatcnctccctgtggggaaatccaaaaaaaaaaaa

SEQ ID NO: 9625 - DNA, 701 bp, Triticum aestivum
  Predicted polypeptide sequence is orthologous to G898
cggcacgaggcaaaggtcgcgcggcgctctgcgaaggcgcggcggcaaccccatctacgcaggccgcccgccgcactccgatttcaagcaggaatcacggaccaacccgatcctcccgcccatagatactctccctccacgcatcgcctcatctgaccacctcgctgcaaaccaagatccgcatctgccgattagggtttactacgattggtatttggtgagcagcttcgaaaggggatgggtacggtcggcgcttggaggcgagcacaggatggttccgtcactaccggtgaagccgtcgaggacctggatcgatctcccatcgccgccgccggcggcggcggcggccagcacgaggctccgaacaccgcgggcacacgggccgcgcccattgacgtcgaagcgctaggcgacgagaggaggtcgagagctaagataaagcgccgtgtggttgttgtggatctggaggcggatgctgatcaggaaggttgtggtgatgcaagaacaacatttaaccgtctcagtgggaacaaaaggcggaaggttccacctgttatatccctttctccggacagggaagaaagatccagcaatcagcgaaacagcacggtgcgagtcagtagaccaagtgccaatgctgctccaaacgaaccgacgttcacttgcccggtgtgcctgaacaagatggagctgccgtccgc

SEQ ID NO: 9626 - DNA, 860 bp, Triticum aestivum
  Predicted polypeptide sequence is orthologous to G898
acgctatgaccattaggcctatttaggtgacctacacaacaagtttgtacaaaaaagcaggctggtaccggtccggaattcccgggatatcgtcgacccacgcgtccgtgctcttaaaattcaggttgattacagaactggagaagggtaaggtgagtataagcatcagaggtatatagcatgagtaataccagcggcgcacggcgtgccgcgaggaggcaatcgctggatggatctgctgataaagttgttgtggacttggatgcaagctccgccggtggcggggaaccatcatgggctctcggtcttccctggtgcacgcacatcgcctattgatgtggaggctctcgatgatgaagtgcaggcgctatcgccttcacaagtgcctcccccggggttgaacaggataactagagggcaacctgtgacgccatttgctctggatgaagatgctgttctggaagagaattggagaattataaggcaatgtgcgacaccattttatctcgatgaagatgctgccatggaagagaatcggagaactagaagtcaatttttgacaccactttatctggatgaagatgctgccctggaagataatgcagctatgccttctcataacatgtggaacaaacgccagagggttgcgcctctgatatgtctctccccggaaagggaagaagggtccagcctgcagtcgaacaatgcggtgcaaattagccaagagcctgctaaggtggtggttccaaaggaacgaatttcccttgcccggtgtgcattaacagctgatggagccttcgacaacaaatgtggccatatcttctgcgcgagtgcattcagcaaccattcagtttcataaa

SEQ ID NO: 9627 - DNA, 639 bp, Triticum aestivum
  misc_feature (436)..(436): n is a, c, g, or t
  misc_feature (476)..(476): n is a, c, g, or t
  misc_feature (490)..(490): n is a, c, g, or t
  misc_feature (534)..(535): n is a, c, g, or t
  misc_feature (542)..(542): n is a, c, g, or t
  misc_feature (553)..(553): n is a, c, g, or t
  misc_feature (561)..(561): n is a, c, g, or t
  misc_feature (575)..(575): n is a, c, g, or t
  misc_feature (581)..(581): n is a, c, g, or t
  misc_feature (589)..(589): n is a, c, g, or t
  misc_feature (603)..(603): n is a, c, g, or t
  misc_feature (615)..(615): n is a, c, g, or t
  misc_feature (617)..(617): n is a, c, g, or t
  misc_feature (622)..(622): n is a, c, g, or t
  misc_feature (627)..(628): n is a, c, g, or t
  misc_feature (637)..(637): n is a, c, g, or t
  Predicted polypeptide sequence is orthologous to G903
ccgaggttttaaacaagacatcatattattaataatattatagtagccaaatacacttgttgtcatgcgccagcatacaacttatttttacaatgacccaaatgacgaaacagacaaatacacatgcatattcatttttcagcaatacatacgctccaagtaataagcgcatatatatatgagctgtgacccggaaaccaattctcaacatacatacgctccaagcaataagcgcatgccaagaacgtacgtatcagaggtttatttagtataaaacattattagtcacgatgacaaatttactcaaatgttaactgtggacttgtggacgcagacctcatagcatggctgaagaactccaatcacgagcccttactgagggctgcggcgctgtggtgcttacatgcagttgcagcgtttcacaccatcgacaaanactctggttcgcacatcgcgctcaagatgacttctgaaanaagtctgggcagtnatcatgcagcacttcggctgcatgagttcgagggcggtcgatannaaatacngtgcaccatcnggacattntcgaccagacatgncacacngaggaatngggttttggttganccccgggggggnanatttnccgcnngggggaaanat

SEQ ID NO: 9628 - DNA, 720 bp, Triticum aestivum
  Predicted polypeptide sequence is orthologous to G911, G1113
attcggcacgaggctccctccagcgagaacgtctctgtagttctagttcagttgatttcatctgcggcacaggtcagcatgcagaacaacgcgacagaggttcctgcccaaggccatggccttgggcaggtgagcaacaacgacatcaggctgtccggctccgtcattgggggcactttcgtcgttgtcgttgttttggtgggcggcgctattcttctgcaccgattcttcaggttctacaagctggagaaagcactgcgagcgctgaagatccccccctccaggttccaaccggagggggcaatcaactcagtgtgcaccatctgcattgcagatttccgcccccgcgcgcgcgtggcagtgctccccacgtgcgggcacgtcttccaccgccactgcctccgggaggtggtggcggggcagagcccacgctgcccgctctgttgggcagctctgctgtgaaggtttgatgaaggaggaggatcgacaggtgatgaggaagggggcgctgatgctcaaagacaatgccagcaacacgatgcgcacctgcgcagcgatccaggatgacaacagcggctgatgaagttggcagctgggtcattaaagcatggcagcgtttccccttttcgttgcttgtctgataactttgacccctgcgtgggtagacttcctgtgtcttgtttggttggcacctgttttgagctgatagttcccttggat

SEQ ID NO: 9629 - DNA, 1115 bp, Triticum aestivum
  Predicted polypeptide sequence is orthologous to G912, G2107, G2513
cggccgccctttttttttttttttgggtttaagttccacaattttcttatgctgactgggaacagcttcggtttgttccatgcatagagtcaaagcagctggctggagtgttttagtagctcgagagcgcggcgtctgctccgctgccttcggtgtcccagcacgcgccggcgaccggcggttgcggcggctcgaggagaagcccctccgcgaagtacgcatagtatgtgtccaggtccatttccccggacatatccagctcgaacatgttgcagcccagtgtggccggcaccgcaaacattccgtcgccagaaggtagggacgacgacgacgacgtccacgacgagccggtattttccatggacgactgcgcggattggctacagcttccgtcatcgacggggacggtggcggccagggacgtggtggcggcgccgctggcggcctcccggcgttggaagtccgcgacagcgctgagagccgcgcgccggacgtctgcaaagtcggagagcgcggacggcacggcgaggagccaagcggagtcggcgaagttgagacacggggtggaggggccgatcaggccgagcatggcggcatcgtgcgcttgcgcggccgcctcggcagtgaggtgcgtgccgagccagagccgctcgccgcgcttgccggggacgcgcacctcgcacacccaccggccggcgctgccgcggcgccgcacgccgcggtacaccgggtggcgcgtctccttgaacttggtgcgccccggcagacgcttcaggtgcgaggaggacgacggcgaggacggggagctccgctgctggtcggagccggtcatgtccattggtactgcaggtggtcggtgctggctcgagcttacgtacggggggccgaggtcgatcttatggatgtgaaagccggctgacctttacctggggagggtgggttattttctaacccctcagtccagcaagggtcctcgggccccaaatccgggacccggtggttgccaaattccggggaaatccggaccggacccaccgtgttttttgtacaaccttgtctcttagggccccaaaaaaggccaaggggcataacgttccctgtggggaaaagattac

SEQ ID NO: 9630 - DNA, 1129 bp, Triticum aestivum
  misc_feature (691)..(691): n is a, c, g, or t
  Predicted polypeptide sequence is orthologous to G912, G2107, G2513
gtcgcccttttttttttttttttttttgggccgaaaaaataacccaagtacaattgcgccctccccaagaatagacagcggaggctttcacaatgaacgagcacatagggacatatggggaaaatattcccttctgtttcctcccatatttggtggaacagaagcagagaaaccgtctaaaaacttttaactgcttagtcgaacaagtagctccatggcggtgtctcgacgccaccgagctcaaagtcttcccgccacggtctggtgtccggcgactccgtgaactccgagtagcacgatccggcatccatgccgccaaaccagtgctcattcaacagctcgctggacatggacagggcgctcggtgccggcaagccatcgatttccttctcgtcatcggttgtccgcgcaggggacaatggtgccatggacgcgaccgggtgctgcctttggaacgccaggacggcgacggcgacggcatccttgatctccttggccgtgctgaacgggccggcgaggacggggagcatccgccaggcggagtcggcgaagttgaggcaagcggcgcggccggagagcgcgagaacggcggcgtcgtgcgcgcgcgctgccatctcggcggtggtgaaggtgccgagccaaagcctggagcccctcatcccgagcacgcgcacctcgcacacccaccggncggcggggccccgtcgccgcacgccgcggtacagcgggtggcgcgtctccttgaacttggtccggccggccggccgcttcggcgtttctgacacaccgtcctgtgcccatcacacggggaaggggcatcagcggggtccatcgatcgatcgcagtgttgccggggagctgccgactgtggggtaattaacaaggagtttacctgctgcgttaaaaatttgaaaaaatggattctggaaaggagaccggtgaggttttccatatcttcagtcaaggtcagggtcccgtgcccaattgcgaaccttggttaacaattccgggaattccgaaccgttccaccctgtttttggtaaacttgttctttaggttccctaaatagcctaagggtaaaccgtttctgggggaaatggtttccgcccgcggcttaggtaaatccgga

SEQ ID NO: 9631 - DNA, 1034 bp, Triticum aestivum
  misc_feature (964)..(964): n is a, c, g, or t
  Predicted polypeptide sequence is orthologous to G912, G2107, G2513
gggtcaccccagagcggccgccctgtatctttatttttttttttttttttaagccatctagggttcatttctcacaaaagtagaaaccgggaacttcaaactgcctactacaaccttcaaaaaaaaaactgcctactctgttcgttcccaaattgggaagaacacaacgcaactatcgacaactttacactgcgtgctgaattagtcaaacaaatagctccataacggcgtcggtgtctcgacgccggtctgctcggcgtcctcccgcctcgctctgtcgtccggcggcgccatgagcatcccctgcgccaagctctcgtagtacgacccagcgtccatgccgccaaaccactgctcctcgtcgagctccagcaagtcgacggacgacatgtaaaacagagagttgctcgggctggcggccgcctccaccgttggacacgcgactggaagaataatctgctgctgctggaacgcaacgacggcaacggcgacggcaagcttgatctcccgcgcgctgccgaagccgaacgatccggccgcaagcacgggcagcatccgccatgcggagtcggcgaagttgaggcaggcggcgcggccggagagcgcgagcaccgcggcgtcgtgcgcgcgcgccgccatctcggcggtggtgaaggtgccgagccagagcctggagcccttcaccccgggcacgcgcacctcgcacacccactgcccgacccggccacggcgccgaacgccccggtacagcgggtggcgcgtctcgtggaacttggtccgccccgccggccgctttgggggatcccacgacaccgtcctgtgaccctgctcatgctggccgggacttggaggcagcgtcggcgacgtccatctgattcgaaagctagtgaagagggttgagcaccttgaacgatggtgttttttccctaccccttcagtcccatgtagggtccccggtgctcantcggggacccgtgggtcaaagatttccggggattcccggacgggtaccagcctgtttttttgtaaaaact

SEQ ID NO: 9632 - DNA, 1148 bp, Triticum aestivum
  misc_feature (16)..(16): n is a, c, g, or t
  Predicted polypeptide sequence is orthologous to G912, G2107, G2513
aggcgacccacgcgtnccgcccacgcgtccgcgactggagcacgaggactgacaatggactgaaggagtaaaaggctccatccaccgatcgatcaaaacctctcaacacagccgctgattcttccagtactcctgctccacacctcccacgagcgtctccgccagctctcgactcagatggacgtcgccgacatcgcctccccgtctggccagcaggggcatcggggacaccggacggtgtcgtcggagccgccgaagcgccccgcggggcggaccaagttccacgagacgcgccacccgctgtaccgcggcgtgcggcgccgtggccgcgtcgggcagtgggtgtgcgaggtgcgcgtgcctgggatcaagggctccaggctctggctcggcaccttcaacacggccgagatggcggcgcgcgcgcacgacgccgctgtgctcgcgctcatcggccgcgccgcctgcctcaacttcgccgactccgcatggcgcatgctgcccgtgctcgcggccgggtcgttcggtttcggcagcgcgagcgagatcaaggccgccgtcgccgtggccgtcgtcgcgttccagcggaagcagattattccggtcgccgtcgccgtcgtggcgctccagcagcagcaggttccggtcgccgtcgccgtcgtggcgctccagcagaagcaggttcgggtcgccgtggccgtcgtggcgctccagcagctgcaggttccggtcgccgtggccgtcgtggcgctccagcagcagcagattattcttccagtcgcgtgcctggcgccggaggtttacatgtcttccggcgacctgttggagcttgacgaggagcaggggtttggcggcatggacccggggtcgtactacccgagcttggcgcaggggattctcgtggcgcccccggacgaaaaaccgaggccgaagcacggggagcaaagggggtccagaacgcccctatggagctgcttggccccttaatttaaaaatactttcaaggtggttaatttaggaaaaaacattctgggcgaggggtcccttcattggaggaatattggggggggtcccgggttctaatttggggggaaagggctaaatgttaaaaaaccaaattttgggttcgaaaaaaaaaaaaaagaggg

SEQ ID NO: 9633 - DNA, 941 bp, Triticum aestivum
  Predicted polypeptide sequence is orthologous to G912, G2107, G2513
ctcaaaccaacctgcaactctcaacgcagcgactttccactagtttttgacgctgcaactgatggacaccgccgctgccggctccccgcgtgaggggcacaggacggtgtgctcggagccgcccaagaggccggcagggcggaccaagttcagggagacgcgccacccgctgtaccgcggcgtgcggcgccggggccggctcgggcagtgggtgtgcgaggttcgcgtgcgcggcgcgcaagggtacaggctctggctcggcaccttcaccactgccgagatggcggcgcgcgcgcacgactccgccgtgctcgcgctcctcgaccgcgccgcctgcctcaacttcgccgactccgcctggcggatgctgcccgtcctcgcggctggctcgtcccgcttcagcagcgcgcgggagatcaaggacgccgtcgccatcgccgtcctggagttccagcggcggcgccccgtcgtgtcaacgtcggagatgcacgacggcgaaaaggacgcccaaggctcgccgacgccgagcgagctgtccacgtccagcgacttgttggacgagcactggtttggcggcatggacgccggctcgtactacgcgagcttggcgcaggggatgctcatggagccgccgtccgccagaacgtggagcgaggatggcggcgaatacagcgccgtctacacgccgctttggaactaattatccgactaattaagccatgtacagttttggaaactactccctcggtaaactaatataagagcatttaaatcattaaaatagtgatctaaacactcttatattagtttacggagggagtaggctactagtggttgtgttcttccaaatatgggaagatacagagtaagcatcaggagcaatttttttcccgtatttgaaagcttccggtttctatttgcagggaaggactgaatttgta

SEQ ID NO: 9634 - DNA, 882 bp, Triticum aestivum
  Predicted polypeptide sequence is orthologous to G912, G2107, G2513
acgcttgaccttaggcctatttaggtgacactacagaacaagtttgtacaaaaaagcaggctgctaccggtccggaattcccgggatatcgtcgacccacgcgtccgcaaaaccacttcacactcgatcaacccaagagcacccaggacctccaagccggccaaggaacagagcatcgaaggaagaagaagatgtgtccgatcaagaaggagatgagcggggagtccggctcgccgtgcagcggggagaacttctactcgccctccacgtcgcgggagcatcagcaggcgaagcaggcggcgtggacgtcggcgccggcgaagcggccggcggggcggaccaagttcagggagacgcggcacccggtataccgcggcgtgcggcgcaggggcaatgccgggcggtgggtgtgcgaggtgcgcgtgcccggcaggcgcgggagcaggctctggctcggcaccttcgacaccgccgaggccgccgcgcgcgccaacgacgccgccatgatcgcgctctccgccgggggcgcgggctgcctcaacttcgccgactccgccgagctgctcgccgtggcggcggcctcctcgtacggacgctcgacgaggtcccccgggccgtgggggggggggggaggggccttctgcggcggggagcggaggtgccaagggggatgcgatttgggggggcggggggggcggggccttccttccgtaggcgggggatcaggcccagcccttgcggggaccggggaaccccccgggttcggggggggggggcagggggtaacttgggccgcggcccgtctatcgacgtcgactggggatgggggggtcgggctaaatgggctcggctctactttatcaaggtagagctcccctccgg

SEQ ID NO: 9635 - DNA, 1146 bp, Triticum aestivum
  misc_feature (944)..(945): n is a, c, g, or t
  misc_feature (949)..(950): n is a, c, g, or t
  misc_feature (952)..(953): n is a, c, g, or t
  misc_feature (962)..(962): n is a, c, g, or t
  misc_feature (972)..(973): n is a, c, g, or t
  misc_feature (979)..(979): n is a, c, g, or t
  misc_feature (1010)..(1010): n is a, c, g, or t
  misc_feature (1099)..(1102): n is a, c, g, or t
  Predicted polypeptide sequence is orthologous to G912, G2107, G2513
gacccacgcttccgcccacacaaacaaccacccagcatcacctcactcaccaccattgttacaaacacatcgacaccagctatataccacctcgtgcaaggccatggaccagtacagctaccgcggcggcggggacgacaatggccagggcgggtacgcgacggtgacgtcggcgccgccgaagcggccggcggggcgcaccaagttccgggagacgcggcacccggtgtaccggggcgtgcgccggcgcggcgcggccgggcggtgggtctgcgaggtgcgcgatcccaacaagaagtcccgcatctggctcggcaccttcgcctcccccgaggccgcggcccgcgcccacgacgttgccgcgctggccctgcgcggccgcgccgcgtgcctcaacttcgccgactcggcggccctgctcgccgtcgaccccgccacgctccgcacccccgacgacatccgcgcggcggccatcgcgctcgccgagactgcctgccccgccgcgccggcctcgtcgtcggccgtggccgccgtggcgtccgcgccggcgcccccgatgatgacgatgatgcacgagtccgcggcggtgcactacgacgactacccgatgcagtacgggtacggcggcattggggacttggaccaggattcctactactacgacgggctgagcgccgccggcggcgactggcagagcggctcgcacatggacggagccgacgacgactgcaacgaccgcggtgggtacggcgccggcgaggtcccgctctggagctattgatcgagccgctccattgaaccattttctagcccgcatgcgctgctccgatgggggctgtggaccacatcacgctaggatcacgagaagcaccggagtccccgcgactatagtacccgcgttatagttatgtgggccctaacccaacaggcaccggcatgctcannaaannannccgggggcncccccccggnngagccngagcccccacgggccccccgcgggggcgcangtgggcccggtgtcgccgcgccgtgccacgccccccccgctgcttgggtccccggaaataagggccgcccgcccccccatctcccgcannnntgcgctcggccgccgatcgtcgggtgccgtcccctgacccccca

SEQ ID NO: 9636 - DNA, 1130 bp, Triticum aestivum
  misc_feature (791)..(791): n is a, c, g, or t
  Predicted polypeptide sequence is orthologous to G912, G2107, G2513
ttcgacccacgcttccgcgactggagcacgaggacactgacatggactgacggagtagaaataccgctcctctctcaagtgtctcaacgcagcagctaaacacgctaagctacctcgctgcttaattactccacagtcgacaggctcccggcgacactgcgatcgttcgatggacgccgccgacgccgcctccccgtgtgatggccacaggacggtgtggtcggagccgccgaagcggccggccggccggaccaagttcaaggagacgcgccacccgctgtaccgcggcgtgcggcgacggggccccgccggccggtgggtgtgcgaggtgcgcgtgctcgggatgaggggctccaggctctggctcggcaccttcaccaccgctgagatggcagcgcgcgcgcacgacgccgccgttctcgcgctctctgggcgcgccgcttgtctcaacttcgccgactccgcctggcggatgctccccgtcctcgccggcccgttcagcaccgccaaggagatcgaggacgccgtcgccgtcgccgtcctggcgttccaaaggcagcaccgggtcgcgtccatggcaccattgtcccctgcgcggacaaccgatgacgagaaggaaatcgatggctcgccggcgccgagcgccctgttcatgtccagcgagctgttgaatgagcactggtttggcggcatggatgccggatcgttctactcggagggcctgttcatggagtcgccggacaccagaccgtggcgggaagaactcgagctctgtggcgtcgagacaccgncatggagctacttgttcgactaaagcagttaagttaaaatgttgtatagatagtttctctctcctgttccacaaatatgggaggaaacagagggggatatttccccatatgtccgtatgtgctcgttcatggtgaaagcctccgctgtctatttttggggagggcgcatttgtacttgagttatttttcggacatcaatttgagtgttttttggcgttgagttgatcattggagtgtctagtgaatacgaatggtacttccaattaaaaaaaaaaaaaaaaaaaaaaaagggggcggcctaatttcctcggggggcaagtttaggttcaggtttttgta

SEQ ID NO: 9637 - DNA, 1134 bp, Triticum aestivum
  misc_feature (770)..(770): n is a, c, g, or t
  misc_feature (1006)..(1006): n is a, c, g, or t
  misc_feature (1008)..(1008): n is a, c, g, or t
  misc_feature (1018)..(1021): n is a, c, g, or t
  Predicted polypeptide sequence is orthologous to G912, G2107, G2513
aagcagtcggtaccggtcccgattccctggatatcgtcgacccacgcgtccgcgactggagcacgaggacactgacatggactgaaggagtagaaaaagctctgaatatacagccacctgcgttacaccacaaaccactctcaacgccagctgcgaccgatggacaccaacgccgcctggccgcagtttgacgggcaagagtacaggacggtgtggccggaggagcaggagtaccggacggtgtggtcggagccgccgaagcggcgggcggggcggaacaagttgcaggagacacgccacccagtgtaccgcggcgtgcgccgccgtggccgggaagggcagtgggtgtgcgagctgcgcgtgccggccggaagccggagttactccaggatctggcttggcaccttcgccagtgcccagatggcggcgcgcgcgcacgactcggccgcgctcgcgctctccggccgcgacgcgtgcctcaacttcgccgactccgcctggcggatgatgcccgtccacgcagccgggtcgttcaagttggccgccgcgcaggagatcaaggacgccgtcgccgtggccctcaaggagttccaggagcagcagcgccctgccgacgagtcaacggcgccgtcgtccacggccgaggagagcgcgctctccatcatccccagcgacctgtcggggctcgacaatgagcactggatcggcggcatggaggccgggtcgtactacgcgagcttggcgcaggggatgctcatggagccgccggnccgacgagcttggcgggaggaccgcgaacacgacgacggattcgacacgtcgctgtggagctactagtgtgatcaaactgattagcaatgtaaagatctagagagtactgctagtgctagattgtgtttcaccaaatatgggaagaagagagagtaagcatcgggggaaaggtttccccccaatgtgaaaccgctcggtttctactcccggaaggggcccaattgagcttctaaananaaaaaaaaannnnaaaaaaaaaaagggggggggccgctctaaaattttcctcgaggggcccaaggctttaccggtacccggttttcttgtcaaaaggggcccctattagggggccgtatttaaggc

SEQ ID NO: 9638 - DNA, 1141 bp, Triticum aestivum
  misc_feature (966)..(966): n is a, c, g, or t
  Predicted polypeptide sequence is orthologous to G912, G2107, G2513
ggtcggtaccggtccgcgattcccgtgatatcgtcgacccacgcgtccgcgactggagcacgaggactgacatggactgaaggagtagaaactcagttctcacccacccaaacaccgccgctgaaacctccagttctcagcacacatcgacctgctcgaccgtctccactagcgctcgtccaagatggacgtcgccgacgccgcctccccgtctggccaggagcagcaggggcacaggacggtgtcgtctgagccgccgaagcgacccgcggggcggaccaaggtacatgagacgcgccacccgctgtaccgcggcgtgcggcagcggggccgggtcgggcagtgggtgtgcgaggtgcgcgtggccggggtgaagggctccaggctctggctcggcaccttcaccaccgccgagatggcggcgcgcgcgcacgacgccgccgtgctcgcgctctccggccgggctgcctgcctcaacttcgccgactccgcctggcgcatgctgcccgtgctcgcggccgggtctttcggcttcggcagcgcgcgcgagatcaaggccgccgtcgccgtcgccgtcgtggctttccagaaggagcagattatcccagtcgccgtcgccgtggtggcgatccagaagcagcagattatcccagtcgctgtcgccgtcgtggcgatccagaagcagcagattatcccgtcgccgtcgtggcgctccagaagcagcagattccagtggccgtcgccctcgtggcgctccaggaacagcaggtcccagtcgccgtcgccgtcgtggcgcttcatcggcagcaggttccagtcgcgtgcccgggaaacctcggcccgggcagcgctctgttttacatgtcgtccagcgacttggtggagctcgacgaggagcagtggtttggcggcatggaggccggtcgtactacgcgagcttggcgcaggggatgctcgtggcaccgncggacgaaagacgaggaccgaggacggggagcagagcggcgtcagaacgcgctatggagcactggtcccctaattaccatgtaagttgacccctcggccggaataattgtgccaaaggataaaatgaatgttttagacctaaatcgttagaatctcaattccaaaaaaaaaaaaa

SEQ ID NO: 9639 - DNA, 1106 bp, Triticum aestivum
  misc_feature (24)..(24): n is a, c, g, or t
  Predicted polypeptide sequence is orthologous to G921
ccacgcgtcccgcaagctgccctntaagcttcccggtcttcttcttcttcgcattctttcattcttgagctactgcgaatttaagaaagacatggacgagcagtggatgatggggcagacttccctcagcctcggcctcaacgtcggccggccgacggcgcggcggggtgcccctccggtgaccaagatcctcgtggaggaggacttcatgtcctccaagaagaatcacgaggtcgaggcgctggaggccgagctccggcgcgtgggcgaggagaacaggaggctcagcgacatgctccgcgcgctggtggccaagtactccgaccttcagggcagggtcagcggcatgatggcggcggcggccgcggccaacaaccgccagtcacccacgacgtctgagggcggctccgcggcctcgccgtccaggaagcgcgctcgcagcgacagtcccgacaccgcagtccaggaagcgtaccctgccagcggcggcttcgccgtcagcgtcaacgtcggccccgaccaggcggagtgcacgtccgtccacgagccgggcaacagcaagcgcgtccgcgccgacgagtgcaaggccagccgggtctccaagctctacgtccacgccgaccccgccgacctcagcctcgtggtgaaggatgggtaccaatggcgaaagtacggccagaaggtgaccaaggacaacccatgcccgagggcctacttccggtgctcgttcgcgccgtcgtgccaggtgaagaagaaggtgcagcgcagcgcccaggacaagaacgtcctggtggccacgtacgagggcgagcacaacacgcacagcccgccgagatcgcaggctctggcggccggaagtccgccgacgcagccgccgtccgtgcatcgccagcgccgccgttcgcccagaaaagccgaggcagcaatcaaggaaccgaggcggatcggccgcggacaggaagaacctggcgaacaaatgccagcgaacctaaccagggaccccgggttaaggggggctcggtttcgaaacttcgggggaattcccaatctccgcggccgaatattatcaagcaaccggggcgttccggttgggccccctaaaataa

SEQ ID NO: 9640 - DNA, 1147 bp, Triticum aestivum
  misc_feature (11)..(11): n is a, c, g, or t
  misc_feature (22)..(22): n is a, c, g, or t
  misc_feature (842)..(843): n is a, c, g, or t
  misc_feature (853)..(853): n is a, c, g, or t
  misc_feature (949)..(949): n is a, c, g, or t
  misc_feature (974)..(974): n is a, c, g, or t
  Predicted polypeptide sequence is orthologous to G921
tgcgacccagncttccggtttnagatcgcgagcggccgcccttttttttttttttttcttcgtacaaattcggtactatgttttccgtagagctaatgaaataattatatacaattaatctgctggataagcgagcaattcaaaattaatgaccatgacctaaacttttcagctacaaatgctaattaaatggagacgaagacgaagacgaagccgctcgcttgatcaactatcagacggcgagagctcgaggatccggccggagagcgcggagacgagcgccgccttgaacccagggtccctcgtcagcgtcgcggccatctgctccgccaggttcttcctgtccgcggccgatcctgcctccgttgtcgattgctgcctcggctgttgctgggcgagcggcggcgctggcgatgcacggacggcggctgcgtcggcagacttcctgccgccagagccttgcatcttcggcggctgtgcgtggttgtgctcgccctcgtacgttgccaccaggacggtgttgtcctcggcgctgcgctgcgccttcttcttcacctggcacgacggcgcgaacgagcaccggaagtaggccctcgggcatgggttgtccttggtcaccttttgcccgtatttccgccattggtacccatccttcacgacgaggctgaggtcggaggggtcggcgtggacgtagagcttggagaacctgctggccttgcactcatcggcgcggacgcgcttgctgttgcacggctcatgaacggacgtgcactccacctggtcgcggtcggggacgacgttgatgctgacggccgcggcgagcggcggcaaaggattgcggnncgcggtgtcnaggctgtcgctgcgggcgcgcttcctggagggcgagggcgcggagccgccctcagacgtagacacgactgctggtttgtggccgggggccgcgcgncatcatgccgctgacctggcctggnaggtcgagtactggccacgaccgccggagcatgtcctgaacctctgttctctcgcccaagcgcggaactccgctggaggccctaacctgggggtcttcttggaaaaactaaatcctcctccccaagacctggtcccggaggggcaccccccggcccttggcggccaatttagg

SEQ ID NO: 9641 - DNA, 1120 bp, Triticum aestivum
  misc_feature (1018)..(1018): n is a, c, g, or t
  Predicted polypeptide sequence is orthologous to G921
acgacccacgcgtgccgcggaaatagttctccatcccaagcttctcttctcccttctcttctcctctcgcgcgcgttgcctcgaaccggaaggaacagcgtccattccattacagtagagcttggtgtttgagagacgatcaatccgtcgtcgaccaatggatccatgggtcagcagccagccttcgctgagccttgacctgcacgtcggcctcccgccgatggggcacccgcacagccaccaccaggcggcgccgatggtcgcgctggccaagcccaagatcctcgtcgaggagaacttcatgcagctcaagaaggaccctgaggttgcggttcttgagtcggagctacagcgggtcagcgaggagaaccggcggctgggcgagatgctcagggaggtggcctccaagtacgagaccctgcagggccagttcaccgacatggtcacggccggcgcccacgccggcggcaataaccactacaacaaccagccgtcctccgcgtcggagggcgggtcggtgtcgccgtcgaggaagcgcaagagcgaggagagcaacggcacgccaccgccgtcgcaccagcagcagcagcagcactacgccggcggcctcgcgtacgcggcggcgccggaccaggcggagtgcacgtccggcgagccgtgcaagcgcatccgggaggagtgcaaacccgtcatctccaagcgctacgtccacgccgaccccgccgacctcagcctggtggtgaaggacgggtaccaatggcgcaagtacgggcagaaggtgaccagggacacccctgccccagagcctacttcgggtgctcctttcgccccggctgcccgtcaagaagaagtgcagaggagcgcccgagacagaccatactcgtgggacgtacgagggcgagaacaccacagccagccccgttgtccaagcgcagcagcagacgaaggctccgggcgggcaaaacgccggaagccacccaggggcgggcagcctcacacccggagaggatcacagcanacaaaccgagcgccacggtacccgcagggggattcgcccccgggaacccaattaaccttcgacctgggggacaattgcataccttacagggccccacttcgg

SEQ ID NO: 9642 - DNA, 1142 bp, Triticum aestivum
  misc_feature (15)..(15): n is a, c, g, or t
  misc_feature (757)..(757): n is a, c, g, or t
  Predicted polypeptide sequence is orthologous to G926, G2632
ttccggggagaaganttcggtgtgctttcctactgcggcatggactgagggtcatgttcaccgtgtcttttgctccgagcttgacactggttgcgctttgcctcggaaagtaacaaaccatgacttctgtcgccgacggtgtttcaggtgatcatagagctgatgagcaacagcagaagcaagctgctcaagggaaccaggaagaggccccagctactagtataggtagtcaggcaatggtggcaacacctgccacagattatgtcacaccctatggccaccaggaagcttgccatgcaatgggtcaaattgtcgatccattctatggaagcctttatgcggcctacggtggacaacctatgatgcatccaccaatggtcggaatgcatgcagccgcaataccgttgcctactgatgcaattgaagagcctgtgtatgtgaatgcaaagcaatataatgccatattaaggcggcgccaatctcgggctaaagcagagtcagaaaggaagcttatcaagggccgcaagccatatctccatgagtcaaggcatcaacatgccttgaaaagggccaggggagccggaggccggtttcttaacgcaaagtcagatgacaatgaagagcattctgattccagctccaaagacaagcagaatggcgctgcaccccgcagcagtggccaatcctcccaatctcccaaaggcgcaacttcggccgataagtcggggaaccatgaatgagatgctagaaggtccgncggacgcgacgatccatgccaacagttttgtacagtatatatatgctagtgagcgagagagagtcgcgccggcgggtgccataagatatatccgctctgctctatagtagtggtagacttatccgacgattttttttgcagaaattggtccgggtttgctggttgggttctacattccgtacaagactaagttttttcctttggtggttttggggtcccggggttacccgcgggtcgggccggaaggttttgtagcttataaagaagtataattagggccaaatgtttcccttggggggattgggccttaactggggggcaccctatccgggggaaaaaaaaatttgggtaaataaaaaaaaaaaaggggggcgctcaaaattcc

SEQ ID NO: 9643 - DNA, 1152 bp, Triticum aestivum
  misc_feature (745)..(745): n is a, c, g, or t
  misc_feature (893)..(893): n is a, c, g, or t
  Predicted polypeptide sequence is orthologous to G926, G2632
ccacgcgttccgagtagacagagggagaggagacttgcagaggagaggagagaagaggcggaacaagggaggagggaggggtcgccggaagggggacatgctccctccgcatctcacatctcgcagcttgaactgagagcaagagcagaagcccatgagatgagacgcaagcaaaatatgcaagaaaatggcacaatcatgattcagtttggtcagcaagtgcctaactgcgagtcctcagctagcgattctcctcaagaagtgtccggaatgagcgaagggagctttaatgagcagaatgatcaatctggtaatcgcgatggctatacgaagagtagtgatgaaggcaagatgatgtcggctttgtctctgggcaattcagaaatggcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccactaccgattgaaccagctgccgccgaagagcccatttatgtgaatgcgaagcaataccatgccattctccgaaggagacagctccgcgcaaaattagaggctgaaaataagctggtcaaaagccgtaagccgtacctgcatgagtcccggcaccagcacgcgatgaagcgggctcggggaacaggcgggcggttcctcaacgcanaggagaagtctgaagcttcaggcggcggcaatgcatcagcgaggtctggccacgccggcgttcccccggaatggcggcatgttctcgaagcacgaacacaccttaccatccgggtgatttccattaccgggcgagagggggcggcttngggtgggcacgcaggttgccccctgggcaaatcatccttggccttatgtgtgttggcaaatggacggtcaatccggtcccggtgatatggttaaactgaattttaaagtccggtgcaattgtgttaattggggggttggttaaacaggccctttggttgggggaggggacgaaatcatctgcacttggagccgggtctcctgtttggtggtaggtttgtgtgggaatggcaggttctgtttaactcgtgaccctgttta

SEQ ID NO: 9644 - DNA, 1378 bp, Triticum aestivum
  Predicted polypeptide sequence is orthologous to G927, G1334
gcacgaggagattcccctctccgcggcgcagacgaccacccgccggccgcccctgccgtcgctctgctaggcagcgatgatgagcttcaagggccacgacggattcgggcaggcctccaatggtggtggtggtggtggagcctccgtgccatggtggacggtgtcccagatgctgtacggggagccgggggccgccttgtcgtcgtcgccggaggcggagcctcgccgggacgcccagttccaggtcgtgcccagagctcagggcatcctggatccactgccggcgcccaagagcggggctcctgaggtcctcaagttctcggtgttccaagggaatttggagtcgggaggcaacaaaggagagaagcccatggagcactccgccaccatcgcactgcagtcgccgctcccggaatacaacagtcgcttcgaatttggcccgggtccttccatgatgtcttctggttatccttcagccgagcagtgctatggcctgcttaccacttacgcgatgaaatctacgcctggtggccgattgctcttgccactgaatgcaacagctgacgcgccgatttacgtgaatgcgaagcagtatgaaggcatccttcgccgccgccgtgctcgtgccaaggtggagcgagagaatcagctggtgaaaggaagaaagccgtatcttcacgaatcacgccaccgccacgcgatgcgccgggcgaggggcacgggagggcgcttcctcaacaccaagaaggaggggaatggcaaggacgctggaggaggaggcaagagggcagagtgcgccccgcccacgcgcttcgccacgtctccgagctccgtcatcccgagcaacccgcactcccggagcagcatctcgagcctctccggctcggaggtgtcgagcatgtacgaccacgacgacgtggaccactacaacagcatcgagcacctccggacgcccttcttcaccccgctgccgatcatcatggacggcgagcacggggcatccgcccccttcaagtgggccacggccgccgacggctgctgtgagctcctcaaggcgtgacttgaggggggtacacgcaggcacccagatcaagagccggccatggccggctctggctccgtctggttgtctgcaggcaaatcattcttggctctactgcattggggtgtccttccacgtcgcattacctcttccctgagaactccggtgctggttctcagggatcttgtgatgatggggctccccatatgcctgtaaaatagtatcggaagcactagcagtgtactacgggtatgaactctgtggtactatcaggtatctgtgtcagaactcagaataagtatcaaacttcagggtctaaaaaaaaaaaaaaaaaaa

SEQ ID NO: 9645 - DNA, 1199 bp, Triticum aestivum
  Predicted polypeptide sequence is orthologous to G928, G931
atgctccctcctcatctcacatctcgcagcttgaactgagagcaagagtagaaacccataagatgagacgcaagcaaaatatgcatggtattcttcacttctaatgtttcagttccactatcctatcctacttgactggctatgtgctgtatatactgatttcctgctgctgttagagttataacatctttttgtattcctctggcagaaaatggcacaatcatgattcagtttggtcagcaagtgcctaactgcgagtcctcggctagcgattctcctcaagaagtgtccgggatgagtgaaggaagctttaatgagcagaatgatcaatctggtaatcgcgatggctacaccaagagtgatgaaggcaagatgatgtcggctttgtctctgggcaattcagaaacagcatacacacccccaaaacctgaccgcactcatcccttcgccatatcatacccatatgctgatccttactatggtggtgcagtggcagcctatggcacacatgctattatgcacccccagatggtgggtatggtaccatcctctcgagtgccactgccaattgaaccggctgccgccgaagagcccatttatgtgaacgcgaagcaatatcatgccattctccgaaggagacagctccgcgcaaaattagaggctgaaaataagctggtcaaaagccgtaaggtatcatttttatgcatgatttcattttaaaaacacaagtactatcgttggccccatcggcatcttttggtttattttccctgtagtagaaatgaatttagtccacatgcactctacataacataatattcatgcctctgttcagccgtacctccacgagtcccggcaccagcacgcgatgaagcgggctcgggggacaggcgggcggttcctcaacgcaaaggagaagtccgaggcggcctccggcggcggcaatgcatcagcaagatctggccacgccggcgttcctacagacggtggtggcatgttctcgaagcacgaccacaccttaccgtccggtgacttccattaccgcgcgagagggggcgcctagggcgggcctttgccccctggcaaatcatccttggcttatgtgtgtggtgaatgaccgtcaattcggtccaatgatattgtaaaactgaatttagagtctgcaattgttacttgggggtttggtagacggtcgttgt

SEQ ID NO: 9646 - DNA, 696 bp, Triticum aestivum
  Predicted polypeptide sequence is orthologous to G937
caatgccgccgccggcggctccccagtatttcggcagggacgacaagattgttggcacacaaggcctgcctgctctgcccatgatttctccggctgcgaacaggcagttttctccccctgccgacgaccgtcatcaggccttcgccgcaaaatttgcatccgccatgccgcctccggggcctggcttgcagactcatgagcagcagtcgaggaagacaaggcggtgctggtcgccggagcttcaccggcactttgttgcctgccttgcaccaactcggtggccctcaagttgccactccaaagcaaatcagggaggtgatgaaagttgatggcctcaccaacgatgaagtgaaaagccacctccagaaataccgcctgcacaaccagaggtgccctagctcttcttcagcaagccatccggttatgctggtgggcgatctctgggctcatcaggagcaaagcagctcgcagtcccggtcccctgaaggcccccttcagctctctgtttcaggggtggccgtctcggcactcaccggcagcgacagttccgaggaagatgacaggtcggtaggctatagccggaggtgatctgaaggcttcgggactaccgtcggagattttcatgagagaggtagagatagctttgcggcatggatgacaataacggcatgcactctcgatccagagggtgtggtg

SEQ ID NO: 9647 - DNA, 1169 bp, Triticum aestivum
  Predicted polypeptide sequence is orthologous to G938
gcggccgcccttttttttttttttccggtgtgatttggtgaaaaaaccccagtgtactttacatggcctggatgggagggatccttacagttgcaagacgccatggactgatcgagaatggaagccttatgaattctaatggcctagagctactgcatgctaatcatgggtggttcctccttgggtgttcagtagaaccagttgggcccaacgtgcttctgctgctgcggctgctgcatggcgccggcgtagtccgccgctgacaggtcgaaccccggagggaaggtgcccagctccggcgccgccatgccgaacggcgcgtcgtcgcccatgaagaacgccgcgctctgctgctgctgctgctgcatcacgttgttcgcgccagaaagcgaacgcggcgccagaaggttgccgctgccgagctgcatgctgggatcggcggcgtcgttgactgcgcctgcacctctgtgcgcggccacgccggtctcgtacatgctcatcagcccggcgaggcatctctggtcggccgcgggcaggccgaagtcgaacccgccgagcgcctggctctgcgggctgtagggcgcccccgggaagaaggccgacggcggcttgatctgtattatggcggcggcggggtggttgtacctgcaggcgtactggtgggcggtgcgcgcgttgcggtcgaggaagccgagcgcgtggcccgggtgcgggcactgcacgttctcgcaggtgaaaacgcgggtcgttccgttcagcatcatctccggctcggggtccgcggcgctcgtgttctgggcgcgggtgaagttggcgtttgtggtttcttccttcatcagcgcaggcggcatgatcatgaactcgttgctcgaaggaacttccatggtaaggtccacaaacgggggctgcctcggagcgcgccttcatctggttcgcggccctcctcgcaaagaattgaagttcttatccccggagctgggttcaaacaaaccccccccgccgaaggcccgcgggggaaggaaggcccgggggtgcaatttgtggctaaccccttcccccccttttagcaggggaacccagttaaaaattcccgtgggggctatttgttccgggagcctttggatgtcccacaagaggggggaccctgtttaaattggggcgacagttct

SEQ ID NO: 9648 - DNA, 1159 bp, Triticum aestivum
  Predicted polypeptide sequence is orthologous to G938
tcgacccacccttccgcggcggcgagcaaggggcggccgaggcggccggcgtcgcagcaggaccagcaggcgcggcgcaagaagatgtcgcgcgcgcaggacgggatcctcaagtacatgctcaagatgatggaggcgtgcagcgcgcagggcttcgtctacggcatcgtccccgagaacggcaagcccgtgggcggcgcctccgacaacctccgcgcctggtggaaggagaaggtccgcttcgaccgcaacgcccccgcggccatcgccaagcaccggtccgacaacgccgcgccgctctgcggcggggaagatggggcggccgcggcggccggcccgcgctccctgcacgagctgcaggacaccacgctcggctccctgctctcctcgctcatgcagcactgcgacccgccgcagcgccggttcccgctcgagaagggcgtgccgccgccgtggtggccgcaggggccgtccgaggcgtggtggcccgaggcgggcgtgcccgacgacctcggcccgccgccgtacaagaagccgcacgacctcaagaaggcgtggaaggtcgccgtgctcaccgccgtcatcaagcacatgtcgcccgacgtcgacaaggtccgccgcctcgtgcggcagtccaagtgcctccaggacaagatgaccgccagggagatcgtcacgtggctcgccgtgctcaaggcggaggaggagctcagccacgagctgcaccccgggcgcctgcctccccccgcgggcctctcgcggggcgccgtcgttcgacgccagctcccggggagtacaacgtcaacttcttcggcgaggaggccgcgaaccaaattaaggcgcgcctcgagggcagccccgttcgtcgaccttaccatggacgcttcctcgagcaaggattccatgaccatgccgcctgccctgaggaaggaagaaaccccgagcccatttccacccgggacccaaacggagcgccgcgaccccccgcctgaaccgattcttacggaaaaccccgcgttttccagccgagacggtcgtggccacccgcggccaggggccggttctttaccgtaggggccccgcccaccaacagcgtccgtgtcaaccacctcccgcgccgccccagaacagcgcgcaggcatcttccggggccccaaac

SEQ ID NO: 9649 - DNA, 1072 bp, Triticum aestivum
  misc_feature (32)..(32): n is a, c, g, or t
  misc_feature (768)..(768): n is a, c, g, or t
  misc_feature (818)..(818): n is a, c, g, or t
  Predicted polypeptide sequence is orthologous to G938
gggttccggcgacccacccgtccggtttttcncttcctcgctctccccggtcatggcaacggttgcaaagcggataaaactagcaagtgggagatcgacgcaggtgaacaccaccacagctacaagtagtagtggaaggaagtggaatttcttgtgtggagaaaaagagctgcttgagtgaccatgatgggaggtgggctgctgatggatcagggcatggcgttctccggcgtgcacaacttcgtggatctgctccagcagaacggcgccgacaagaacctcggcttcggctcccttatgccgcagacatcctccggcgaccagtgcgtcatgggcgagggcgacctcgtggacccccccacgaacaacttcccggacgccggtgaggacgacagcgacgacgatgtggatgacatcgaggagctggagcgccgcatgtggcgcgaccgcatgaagctcaagcgcctcaaggagctgcagcagagccgcggcaaggagcaggccgccggcggcggcggggctggcgacggactgaagccgcggcagtcgcaggagcaggcgcgccgcaagaagatgtcgcgcgcgcaggacggcatcctcaagtacatgctcaagatgatggaggtgtgccgcgcccaggggttcgtctacggcatcattccggagaagggcaagcccgtgagcggcgcctctgacaacctccgtgcctggtggaaggagaaggtccgcttcgaccggaacggcccggccgccatcgccaagtaccangccgacaacgccgtgccgggctccgagagcgagctggcttccggcaccgncagcccgcactcgctgcaggagctgcaggacaccacgctgggctcgctgctctcggcgctcatgcagcactgcgatccaccgcagcgaaggtccccgctcgagaagggcatctctcctccatggtggccgtccggcaacaaggagtggtggcccgaccttggcattcccaagggacagggcccgcccccgtacagaaagccccatacctgaaaaaggcctggaaggccacgttccccccgctgtcatcaaccca

SEQ ID NO: 9650 - DNA, 861 bp, Triticum aestivum
  misc_feature (7)..(7): n is a, c, g, or t
  misc_feature (17)..(17): n is a, c, g, or t
  misc_feature (500)..(500): n is a, c, g, or t
  misc_feature (526)..(526): n is a, c, g, or t
  misc_feature (529)..(529): n is a, c, g, or t
  misc_feature (536)..(538): n is a, c, g, or t
  misc_feature (543)..(547): n is a, c, g, or t
  misc_feature (551)..(551): n is a, c, g, or t
  misc_feature (553)..(553): n is a, c, g, or t
  misc_feature (561)..(562): n is a, c, g, or t
  misc_feature (566)..(569): n is a, c, g, or t
  misc_feature (576)..(580): n is a, c, g, or t
  misc_feature (592)..(600): n is a, c, g, or t
  misc_feature (610)..(613): n is a, c, g, or t
  misc_feature (615)..(615): n is a, c, g, or t
  misc_feature (617)..(617): n is a, c, g, or t
  misc_feature (621)..(629): n is a, c, g, or t
  misc_feature (632)..(633): n is a, c, g, or t
  misc_feature (639)..(647): n is a, c, g, or t
  misc_feature (649)..(649): n is a, c, g, or t
  misc_feature (655)..(655): n is a, c, g, or t
  misc_feature (659)..(668): n is a, c, g, or t
  misc_feature (671)..(673): n is a, c, g, or t
  misc_feature (680)..(683): n is a, c, g, or t
  misc_feature (688)..(700): n is a, c, g, or t
  misc_feature (702)..(705): n is a, c, g, or t
  misc_feature (707)..(708): n is a, c, g, or t
  misc_feature (710)..(714): n is a, c, g, or t
  misc_feature (717)..(721): n is a, c, g, or t
  misc_feature (724)..(724): n is a, c, g, or t
  misc_feature (729)..(742): n is a, c, g, or t
  misc_feature (744)..(746): n is a, c, g, or t
  misc_feature (749)..(756): n is a, c, g, or t
  misc_feature (761)..(791): n is a, c, g, or t
  misc_feature (793)..(793): n is a, c, g, or t
  misc_feature (796)..(800): n is a, c, g, or t
  misc_feature (810)..(812): n is a, c, g, or t
  misc_feature (821)..(838): n is a, c, g, or t
  misc_feature (840)..(840): n is a, c, g, or t
  misc_feature (842)..(844): n is a, c, g, or t
  misc_feature (846)..(851): n is a, c, g, or t
  misc_feature (853)..(853): n is a, c, g, or t
  misc_feature (855)..(856): n is a, c, g, or t
  misc_feature (858)..(861): n is a, c, g, or t
  Predicted polypeptide sequence is orthologous to G956
ggtacangagtgttagntggtaggttatcatacgacttactatagggaccactttgtacaagaaagctgggtacgcgtaagcttgggcccctcgagggatactctagagcggccgccctttttttttttttttttttaagaaaaattggttcattttattgagccccttgcattgtacaagtcctcctgatcaactcctcaaagtcaggatcaaagctcattttcagtgagactacacaccatgaatcaatccatcacatcaaccaatccaatgcaaccatataatatatctctaatcacgagtaatgcttagacctacgtacgcatccttttgccttcggcttcacttctgccgctccagtcagctctggtcagttcatgtcgagcattccttggtggaaggcggcgacacggtcgggcgtcacgcactgggtgatgagccgcgcccctggcttgtgccgtccaacctgattcgttagaatcggccttgactctagcancccccatgaatagttctttatctttntcntttctcnnnttccnnnnnacananttccttcnntccnnnntatcccnnnnnatttctgtatcnnnnnnnnnttagattccnnnnantncccnnnnnnnnntanntatccnnnnnnnnnanttatanttcnnnnnnnnnntgnnntcttccnnnnttccnnnnnnnnnnnnnannnnannannnnntannnnntanttccnnnnnnnnnnnnnnannntannnnnnnnttcannnnnnnnnnnnnnnnnnnnnnnnnnnnnnnantannnnntcattttccnnnttgattccnnnnnnnnnnnnnnnnnnanannnannnnnnanannannnn

SEQ ID NO: 9651 - DNA, 300 bp, Triticum aestivum
  misc_feature (283)..(283): n is a, c, g, or t
  misc_feature (286)..(286): n is a, c, g, or t
  Predicted polypeptide sequence is orthologous to G957
gctcggagcaactgggcgctgcaatttggcctggaatgatagatagtcccttcctcctctgctcggtgcaactcgccctagtggatcaaagcggaaccgtgctagtatcgggtcgtcgtggttcgttctgagtcgtagggttatattttgtcactgtcagagtgcgtgtggtaaaaaaaattacacccttgtgatcgagcataatgcaagttgtgaaactcaaaatgtacacctctttgatcaatgtatactacttctccaagaagtagcctaaccgaaacanaanagaaaaaaaaaaaa

SEQ ID NO: 9652 - DNA, 796 bp, Triticum aestivum
  Predicted polypeptide sequence is orthologous to G958
gagccacaacctagaagccgcggccgcagctctctctccgcgcgccgcctgtggccgccggcggcaaccaagagaaacaggatatttatgcctttttcttgacacggaaagccaatggcgagaggactggattcagattatattggttctatttcgctcatggatggatttgatatgggtatcacgtttgatgggtttggagaaaatatgaagaagttcatggagttaccgatcaaatatcttgattctgctcacgataaagctgttgagctagttgaggatatccatgcgctgatttacgctcactctcctgatgataaatttccggacaaagaccatgggacattaactgatccatctagtaacggtaccataaccgagtctccctccacatgtgttaaaatgcagcaagttaaccctaacgaagaattctctggttatccttcatctctcgttaccgcggaagaccattctctcggctcaactgctactgatgttcatgaaacagagtcggtttcatctacaagtccagccatgtgtgcttctgaagaccccatttcacttgagagaactgctgacaccaaggaggaagttactttttgcaattcagaggatctctcagataactgcactcctgaaaatcacaattcactagggggttctgatagcagtgacgaggaaattatattatggaatcaatggaattctgtaacatcacgacaatatcctgaacaagccaccgtagtccaagattatatatctgaagaagcaaacggaaataaatcatcgagcaagt

SEQ ID NO: 9653 - DNA, 743 bp, Triticum aestivum
  Predicted polypeptide sequence is orthologous to G971
ccacgcgtccgctcttcctcttacaaatttaccatttgatttcttaattctagatagctgttattggttgatttaggaaaagtataccttggaatcatagttcagtttaattctagatagttgctattggttgatttatttacatcaccttgatcactacaatctcgcatgaatcatagttcagtttaattctagatagttgctattgggaatacaacactgtttaacattcagttttgttttctcagtgctttggagaagatggacatgaggccccaacctgcactggcatagctaggcaggggagtatccttccacttgacatttccttctcagttttgtatgtttaatttttagagccgtggttactatgaaaaccgagatgtggatattgcagtattgatcttagttcaattcattctattacgtagcctcactttgttatccatgatttccctcatttgattgatttgacacatgttcattcactagattatagtctacttcattttttgtgtatttagttctaggttgttttgatttaagtggtacttgatttcttggcattgttcattgtctcgagccatgtctgaaactgaaggaaagaaggccctgaccactctcatcatttactcaagtaataacaccatcggcgacaggaacgacaagctgacgcagatcgtatcttggtggctgctaatgaatcatgtaatgatggcgcagaactcacaaagaaaaagacg

SEQ ID NO: 9654 - DNA, 1129 bp, Triticum aestivum
  misc_feature (31)..(31): n is a, c, g, or t
  misc_feature (1039)..(1039): n is a, c, g, or t
  Predicted polypeptide sequence is orthologous to G975, G1387, G2583
caatgctccaacgcgtccggagcgtacccanatggtcgacctgcaggcggccgcactagtgattagcgtggtcgcggccgaggtttctaacacaaaaccacattctatttatttcctttatatatactacataacggacattgatgtgtaataaagtatcttgacggtgactgtgtatgtaataacaaatataagtacatatagctgcacacagttgcaaacttatgctttttgtaacttggattgagtaatagacatatatctatcttcctgaaacaacctgaactgcttgcgtaccaaccagtgtacgggatcctgatctcggatggcgacgttgccatgctgtttcgtccatgctttttcagacgacgaagctaccttcttctccatgcgatggcgaagctggaccgctactgctcagcagctcctcaatcatctgcagcgtgagcctctcctcgtcatccattgtactcgccggtgaagaagccgtggttgctgacactgtggactgcgctgccaccgcatcgccggatggcccggcccctttgttgagctccacggtcatgacccagttggagtcggcgcgggcccctgcgcgcttctgccagacgccaatgtgggacttctcggtgtcgaggcgaaggcaggtcagggacggagacggcgctttgcagcacttgcgaagcttggcactgagaacctgggacaggttgctcgtcgaggaggaggagctgccgccacggacgtcccgggttgcagctggggcaggatcgccggtgctgctcctctgcacggggaaagtggtcttggcattgcggccgctcatcagaacggcggcctcgtcgtaggcccgtgcagcttcttcggcgggttcaaaggtaccaagccacaccctccttttaagggaggggtgtctgatctcagagacccaggagccccagtggcgctgcctgactccagggaacttcttctggggttgcaccatttgggtctgtctgtctggccttcacagacgagggaacgagccctctgagtccgnacctcggccgggaacacgcttatcccggggccatggcgggccgggaacatgcaacgtcgggcccaatccgcccaataagtggtccaatta

SEQ ID NO: 9655 - DNA, 600 bp, Triticum aestivum
  misc_feature (554)..(554): n is a, c, g, or t
  Predicted polypeptide sequence is orthologous to G979, G2106, G2131
ttttagattaaattgcaatgtttgtaaccgcagttgtatggttctatctagctccgagcttcatctatgatgcgccaagaaaaacaaacagagaaaagattacataaaaacagagaaaacatggagctacccagcatccacgactagagctagtagtaggaacacatggtacagtagtagagccgcaggacaactagtggtcttgtctgtcaaccgacaaggcatgcgttgtgctacctactcatggttcagagagccatctcgctgaacctgaatggtcttgacaatccttgactgaacctaaactatcagatgcgcatgattgggactagtggcaagtacaccaggatgttgagcggtaggcccctgtcggcaaagttgttgttgttggtactcctcccgtgtcacccgctgcatcctctcatgctcctgcatgtacgtgtccacctgcacttattgggaagttgaggagcccgaagtgtgagccccagcacttgagtgtcgcctgagccccagcacttgagcgccacgagatcatgggtgcgagctacttnctcctctgtcttgtaagatcacaaataaacaggtggtgaagaactt

SEQ ID NO: 9656 - DNA, 510 bp, Triticum aestivum
  Predicted polypeptide sequence is orthologous to G987
ttctctgtgcctgctctgctgcctccacacccgcactatcccagctcgtgtgccggctcgaggagaagctcaggccgccaccacacaaagggagaggaacccaagaagaatctatcccgccttactgtccatgacccgacgacagagacagctacttcgagcctaggtcctgctccggagaccgttccagagtacctgtctgtgaagcagtgcctcctctgttgatctaccagcggagacttcggtcttactagtgttctcatggacttcgacaagtagcttgtacctcagctacgatcttgatcggacgttgtagatagtcaggctttcagcctttttcatttatagatgtctgtactcaaacatgtaatgcttccgtttgttgcttgattgctctgaatgttgggtcatgtgacccctgtttgtaataaatgctatgatggctcttctgagcctttatctatatgagttgttgagttaaaaaaaaaaaaaaaaaaaaaaaaaaaaaaa

SEQ ID NO: 9657 - DNA, 362 bp, Triticum aestivum
  Predicted polypeptide sequence is orthologous to G989
gcacgaggctcgtcgtgaaaccggagaacggcgtgctccggctcggatggaagcagcgcgtggtggccgtcgcctccgcctggcgctaatctggtgaggtcgcgccatcattgccggcaccagacaattgtttaattaattcgcacccgtcctctatttttatcgtttcttatttgttcgattggcaaggtgtgatgagttggttcttgatctagtagtaaagcttagctgtagcgactcataatcctcgtagctaatatatggaaagagtacattattacgctactgattgccgttgttgtttttgtcacctgttgcttggagaagttgtagatagcatcggctgatccaaaaaaaaaaaa

SEQ ID NO: 9658 - DNA, 721 bp, Triticum aestivum
  Predicted polypeptide sequence is orthologous to G989
tttttttttttttttttttttttgaatatgatatcagctgtatataacctctttttacttgtacgagtatacatgtatatatcactcaagaaatcaagagaaaagaaataagaatcaagctctctctctctctgccaataaggaaccaatgaagaagaaaccaagaagaatcggatgagcacacggtctatcacaatatctatgtactgaatgaatgaatgggcgcgtgtttcagggctcgttcttgccgaccgattgccggcacggccgccacgcgctggccgtgatgagggccctgtctcgccaccccagcgccatggccttgccgtcgccggcctccatgacgcggaacccgccgccgccgcacccgccgctcttcatcttgagcagcagcttcgcctggctcaccgtcctcgagctcagcctcgcgtcttcgaaccccgcgctctccagcctctccttccaaccgcgactcaccttgtccgccgcgcgatcgccgtcgtggcgccgacggtccagagaggccattgcgtcgctgatctccacgccgaggtggtccctctcgatggcgatcctctcagcgctgtcggccgggaggcactcgtgcagcgactcgaacacggccgcgtagtaccggaggttggccgcgaaccgcgggagcaggctcgcgcttccgcatcttccggcgcctttaacgccgccgttgccttcgtcgaccttg

SEQ ID NO: 9659 - DNA, 613 bp, Triticum aestivum
  misc_feature (28)..(28): n is a, c, g, or t
  Predicted polypeptide sequence is orthologous to G1017, G2567
gaggaattcggacgagggacgctgacgngtccgacgccacaacggcggcggcttctcggtgccgcgctactgcgccgagaccatcttccccaagcttgactacagggctgacccgccggtgcagacggtgctcgccaaggacgtgcacggggaggtgtggaagttccgccacatctacaggggcacgccgcgccggcatttgctcaccacgggctggagcaccttcgtgaaccagaagaagctcgtcgcgggggactccatcgtgttcctgcgcaccgagcacggggagctctgcgtcggaatacgccgggccaagcgggtcacctgcgggggcatggagtgcatatccggctggaacgcgccagggtatggggggttctcggccttcctcaaggacgaggagaacaagatgatgaatggtggccccgccggttacgtcaagggcagggggaaggtgaagatcgaccatgtggtcgaggcggccacccttgcggccaacagccagccatttgaggtggtgtactacccgagagctagcacgccggagtttgttgtcaaggccgcggcgatgcaggctgccatgaggatccactggtgccctggcatgaggttc

SEQ ID NO: 9660 - DNA, 684 bp, Triticum aestivum
  Predicted polypeptide sequence is orthologous to G1017, G2567
aaatccgtccaagagttcgttgataagcacttccaactcagccgccaggatgaccagcccttaacttgggcgatcaacagcgctgaacaaacagctaacagacaaatacagtgagtacatattaaaaagcaatccacaagattgtattgtagtactaacgacgacgcagttccgcttgacagcacgggttaacaaacgctaataaaacgcatgcatatagagagtagtccttcactctaggtttaatatttctcaatgaaactcatgctggagctcatcaagatatcacacccgctgaaccatgcattcgatgaggtttcgccaagatatcacacccgctgaaccatgcattcgatgagaggtttcgccagccctcccttttcgccacttattatcgtcagcctccgtgccactttcatgaagtcgctgaatggtaatcccccagtgtgcatgacggcaccagctgtgtcacggtaacgaagatggcttatgatttcttccttctcgatcccaaacatgtcagccagacggccatacaactcgtcgtatgacccaaagacagacaagtcgatggtgcgaccaacatcctccgattccataaatacctttgcagtgcccagcttccaatccaaggtcagaagcctcatgaccctgggatgagaatccaatgcagattgatgaacc

SEQ ID NO: 9661 - DNA, 620 bp, Triticum aestivum
  Predicted polypeptide sequence is orthologous to G1017, G2567
gaggttgtgctgcaggtgacctgggatgaaccggacctgctgcagaatgtgaagagggtgagcccatggctggttgagctggtctcaaacatgccggccattcacctcgctccgttctcgccgccccggaagaagctctgcgttccgttctaccccgacctcccggccgacggccagtttccagccccgatgttccacggaaacccactcggacgccgcggcggcgtcggtccgatgtgctatttcccggacggcactcctgcaggcatacagggagccaggcatgctcaatttggtatacctttatcagatctccaccttaacaaactgcagtcgagtctgtcaccgcacgggcttcaccaggtcgatcacggcgggcagccgccgaggatcgccgctgggctcatcattggtcacccggctgcgcgagacgacatctcgtgcatgctcaccattggcagtcaccagaacaacaacaacaacaagtcagatgtcaagaaggcttcaccccagctgatgctctttgggaaacccatactcactgagcagcagatcactttaggtaagctctgggggtttctctccatctgctgctaggaagagctcctctgaaatgagcg

SEQ ID NO: 9662 - DNA, 387 bp, Triticum aestivum
  misc_feature (281)..(281): n is a, c, g, or t
  misc_feature (367)..(367): n is a, c, g, or t
  misc_feature (375)..(375): n is a, c, g, or t
  Predicted polypeptide sequence is orthologous to G1017, G2567
cggcgatgagcctttcagcgcgttcgtgaaatcggcccggaggctgacgatcctgaccgacgccggcagcgacaacatagggggctgagaatgaagcagcagaatcatcatcagccgaataacttaggtggccggccattccaagtcgtcattagcgagcaataagccggaccaagtgccccctgcgtgtacagctgaacggcaagctgtggttggtttcttcccgagttagctcatttccctttcatttcctcgtcaccgtagccaggccgtagccgtangagctgcaaaacaaaccaaatcaatgtggcagcagcaccactccactctggacacctttcatgatcatcatcgaatgtaacgtacntgccgatnaaaaaggggggg

SEQ ID NO: 9663 - DNA, 519 bp, Triticum aestivum
  misc_feature (324)..(324): n is a, c, g, or t
  misc_feature (327)..(327): n is a, c, g, or t
  misc_feature (473)..(473): n is a, c, g, or t
  misc_feature (491)..(491): n is a, c, g, or t
  misc_feature (499)..(499): n is a, c, g, or t
  misc_feature (518)..(518): n is a, c, g, or t
  Predicted polypeptide sequence is orthologous to G1017, G2567
gcgcacgcttgatctctctgctgttggctcgtacgaagagttatatcgccggctttccgacatgttcggtatggaaaaagcagagctgatgagccatgttttctaccgtgatgcagccggggcgctcaaacacactggagatgagcctttcagtgacttcacgaagacggcgcgtaggctgaccatactaacggacacgagcggcgacagcagcgtagtgagctaggaggaatgaggaaggaagctctttcgccacttgtacgtacagctgggttgacggcggcgcggcgcagcacggtggcgattctcaagagagcatagatngcngtggctgcggaattttccgcaacctggatgcaagtcaaagaagcaacaacggtgcaagcaagcttcaagtttttctccgattaatagagagctccaagaatgggactgggtgattgtttgtgttggtgatcatgaacaagtttccngttttttttttccgttgngttgactnacaaccaattatgatgatnt

SEQ ID NO: 9664 - DNA, 836 bp, Triticum aestivum
  misc_feature (765)..(765): n is a, c, g, or t
  Predicted polypeptide sequence is orthologous to G1017, G2567
acgcttgacattaggcctatttaggtgacactctagaacaagtttgtacaaaaaagcaggctggtaccggtccggaattcccgggatatcgtcgacccacgcgtccggcatgctcaatttggtttaccattaacagaccatcagcttaataagctgcaccttggtctgttccacggcggcggttttaaccggcttgacgctctaaccccgtcttcccggatatctaagggctttgtgctcagcagcgcaccagcccatgacagcgtctcttgcttgttgacaatcggtacaccacagagcacagaaaaatctgttgacagaaagacaccacatataatgttgtttggaaaggccattcttaccgagcagcagatgacttcaagtggatcaagagagacactctcctctggggctactggaaatagttcacctatcagtactgcgctcaaggcaggaaatgcatccgatggttccggttcatcaatctgcatcggattctcatcccagggtcatgaggcttctgatcttggactggaagctgggcactgcaaggtatttatggaatcggaggatgttggtcgcaccatcgacttgtctgtcttcgggtcatatgacgagttgtatggccgtctggctgacatgtttggcatcgagaaagaagacatcataagccatctccgttaccgtgacacggctggtgctgtcatgcacactggtggattaccgttcagcgacttcatgaaagtggcacggaggctgacgatnataagtggcgaaaagggatgactggcgaaactctcatcgaatgcatggatcagcgcgtgtgatatcttgat

SEQ ID NO: 9665 - DNA, 817 bp, Triticum aestivum
  Predicted polypeptide sequence is orthologous to G1020
cccaccccacccccccaccccgcatcaccaaaacgcccgcataaccaaaaagatacgcgcacgccacttatacacctgctgcacccatggcgcctagagcggcggagaaggcgcctgtctccccgcccaccgggctcggcctcggcctcggcggcggggtcggggtcgtcgccgggggcgcgcactacaggggcgtccgcaagcgcccgtggggacgttacgccgcggagatccgtgacccggccaagaagagcagggtgtggctcggcacgtacgacacggcggaggaggccgcgcgcgcctacgacaccgccgcgcgtgagttccgcggcgccaaggcgaaaaccaacttcccgttcccttcgtcgtcgtcgtcgtcccctgtcgccggcgccggcggcggcggcagcccgagcagcgacagcaccttggactcgagcggcggagggagcggcggctgcgcccaggcgcccatgcaggccatcccgctgccgcccgccctcgacctggacctcttccaccgcgcggcggccgtcacggcggtcgccggcggcggcatgcgcttcccattcaacggttacccggtggcgccgcgccagcccatgcacccgtacttcttctacgaacaggccgcagcggcggcggcggcggcgtcggggtaccgcgcgctgaaggtggcgcagccggtcaccgtggcggccgttgctcggagcgactccgactcctcgtcggtcgttgatctgtccccgtcgccccccgcggtgacagcgcataaggcggtcgcgtttgatctggatctgaaccggccgccgccttc

SEQ ID NO: 9666 - DNA, 1150 bp, Triticum aestivum
  Predicted polypeptide sequence is orthologous to G1020
ctgccgcaccaaccaaccaacgccgcaccccgcccagccaccgccaccacaaccgccgtgtcgaacacttgccatggctcccaagaacgcggcccccgccgccgccgccgcggacgccggcatggagccgaggttccgcggcgtgcggaagcggccgtggggcaggtacgcggcggagatccgcgacccggccaggaaggcgcgcgtctggctcggcaccttcgacaccgccgaggccgccgcgcgcgcctacgacgccgccgcgctccactaccgcgggcccaagggcaagaccaacttccccgtcggcaccgtcgccgccttcgcgcacgtcccgctcccgccgcccaaggcgctggccgtcagccccagcagcagcaccgtcgagtcctcgtcccgggacacgccggccgcgccgcccgccgcccccgcgcccccgccggcgctcgacctgagcctggcgatgccggccatggtggcggcgcagccgttcctgttcctggacccgagggtcgcggtgaccgtggccgtggccgcgccggcgccggcgccgtgccggtcggcggcgatcagcggcatgaacaaggcggcgtcccgcgaggaggagcagagcgacacggggtcgtcgtcatccgtggtggacgcctcgccggccgtgggcgtggggtttgacctgaacctgccgccgccggtggagatggcgtaggagatggaccgatctcggtcgcccgatgacgacgcggcccggaagccaaacgaacctctctcttgggtagaacttaaagtttagaagaatggggtgtacttactagtaagaggttaaccggccgtttaattgccaggatcgacccatcgatgggtaagggtaagtaggggtacttagatccggtgcgtgcgttgcgtttttggctgggggagggaggttacctggataagaacatccatctatctgcccccgaggttcttacaatttccttaaaaccaggggaaaacaaagccaaaatgggaagaaccaggagtaagccttgggtctcaagggcaaaatttggacccgcccctctgttaggggaaattcagattccactcctctcccaaaaacaaaaaaacgccggccgccaaaaaccctcgggggcccaatctcgcgcacatt

SEQ ID NO: 9667 - DNA, 1163 bp, Triticum aestivum
  misc_feature (26)..(26): n is a, c, g, or t
  misc_feature (37)..(37): n is a, c, g, or t
  Predicted polypeptide sequence is orthologous to G1020
acgcccgccctttttttttttttttntagaagtaatncaatataatccggtccatgttgacgccggcaggaggtggcttgggcgacaatacatccatccatctctgcctctccggcgaaaaaagaaaccgtatttacagatctgcccctgccgttgttgtgcaaggcggccggcctcttctaaaaacatcatggaggtacatgcaaatttttcttcgttctactaggggcaaaaaaagaaggcgacgaaagaaactagcagtcatatcagctacgtggactggggggcccgatcagagctccgccggcggcgggcagttcaggtcgaggtcgaaagggacgggcttccttgagggcggcgacggcgccagatccaccaccgacgaggagtcggagtcgctcggggacacggacgccacggtcaccttcggggcctggctgtacatgtggcagccgccggcggcggcggccgccgcctgtccgaagaagtagtacgggtgcgacacggggtagccgctgaaggggaagcgcatgccggcgccggcgccggccccggcggtgctggtggccgcccggtggaacacgtcgagctccagggacggagggagcggcatggcctgcatgggcgccctgcacgtcgccgtccaaggactcgacggtgctgctgttgctgctcccgctgccctcgcccttgagggccgcgcggccggccggcgcctaggccgaagcaagcggaacttgggctcagcctcgttgcccgcgtactcccggctcggccgctgttacgcccggcgcgccccctcggccgtctcgtaacttccgacctccacccgcgctccttttggccgattagcgcatctcggcggtcgtacgctccccaacgggtccctcctccagccggccagcctcggggactggaacccccacccacctccctccacctcacacccattctatccaatcccccacctcttcactcacctccactatacgcctccccccccaccctcgacatctcaacctcaagagatccgctctcttgcaaacgtgcgctccaacgatctgcggggtctctgcgccccgtccccgcgccgccactctccacctctcgtctcacctgtcctctctatggtgcgaccaagcgtcgctatcccaccgcgagaa

SEQ ID NO: 9668 - DNA, 1086 bp, Triticum aestivum
  misc_feature (17)..(21): n is a, c, g, or t
  misc_feature (25)..(25): n is a, c, g, or t
  misc_feature (31)..(31): n is a, c, g, or t
  misc_feature (33)..(36): n is a, c, g, or t
  misc_feature (38)..(38): n is a, c, g, or t
  misc_feature (40)..(44): n is a, c, g, or t
  misc_feature (47)..(48): n is a, c, g, or t
  misc_feature (51)..(51): n is a, c, g, or t
  misc_feature (64)..(64): n is a, c, g, or t
  Predicted polypeptide sequence is orthologous to G1020
ttttttttttttttttnnnnntttntttttntnnnntntnnnnnttnnttntttttttttttcnttcttccctctcctcaagctctgaacataaggcctattcaaggtgttttccaaaaaaaagtttgtacaaaaaagttttcccctaccggtccggaattcccgggatatcgtcgacccacgcgtacgagaccattccccccacgccgaaccgcaacaacaaccgtcgcgcacgcgccgagcacggtcgaacacttgccatggctcccaagaacgcgctccccgtcgccgtcgccgccgccgcggacgccggcatggagcccaggatccgcggcgtgcgcaagcggccgtggggcaggtacgcggcggagatccgcgacccggacaggaaggcccgcgtctggctcggcaccttcgacaccgtcgaggacgcggtccgggcctacgacgccgccgcgctccactaccgcggggtccaaggacaagaccaacttccccgtccggaaccgttcgcggctttcggccaacgtcccgttccccgccgacccaagggagatgggccgtaaagcacccaacaataagcacccgtatcaagtagttacgatacccggacaacaccgacggtacccgttgagtccccgactggttcacggactgaatggattgacccccccaagtgcacccccgtcagaccgaggctcgagacctcggaaggacttggtcggcaagtacggaggctcattgggatgagtcgacctgctcacgacccgccaccccgagattacctcgaggatgaaacgaagaagtgcggagagagagaaaaccgaaagaaccacgggtgacactttagcacaaacactaatcactctcacaatcatacctaagacttgaaaacaacggcacgcctaacgagaaagaaacccaaaagtcgagaccggcagctgcatcgcaggctagcgaaactcggagcacgcgacgggacacgcggggtgtagccacctcatatgcagaatctaaacagaaccgccgattctagtcgaaccgaagcgggacatgatcaagcaatacgggtacggactatctaca

SEQ ID NO: 9669 - DNA, 1166 bp, Triticum aestivum
  misc_feature (15)..(15): n is a, c, g, or t
  Predicted polypeptide sequence is orthologous to G1020
tgcgacccacgcgtnccgcgactggagcacgaggacactgacatggactgaaggagtagaaacaccccagatcctgcacgccatccatcagcttgatacgcacacacccatccgtcaacaagaaaaagaaagccagccatggcgcccaggacgtccgacaagacggcgacgccgcccgctgccggggccgccgcgaccgggctcgcgctcggcgtcggcggcggcggcaacggcgggggcgtcgggccgcactaccgcggcgtcaggaagcggccgtggggccggtacgcggcggagatccgcgacccggccaagaagagccgggtgtggctcggcacgtacgacaccgccgaggaggccgcccgcgcctacgacgccgccgcccgcgagtaccgcggcaacaaggccaagaccaacttccccttcgcctccgcctccgcgccgcccgccgccgcggccctcaccggcgacggcagccggagcagcaacagcagcaccgtcgagtccttcgacggcgacgtgcaggcgcccatgcaggccatgccgctccctccgtccctcgagctcgacctgttccaccgcgcggccaccagcaccgccggggccggcgccggcgccggcatgcgcttccccttcagcggctaccccgtgtcgcacccgtactacttcttcggacaggcggcggccgccgccgccggcggctgccacatgtacaggcaggccccgaaggtgaccgtggcgtccgtgtccccgagcgactccgactcctcgtcgggggtggatctggcgccgtcgcccgccttcaaggaaagccgtcccttttcgacctcgaactgaactgcccgccggcgggcggagctctgatcgggcgccggaggttatgtagcctgatatgactgctagtttcctccggcggcctccttttttggcccctagtaaaacgaaaaaaaattgcgttgttaaaaaaaaaaaaagggcggcggccttaaagttcccccgaggggccaggctttacgcgtaccaggttttttgacaaagggggccccaataggggggcgtattaaaagcagggccgggcccgggttataaagctcggggatgggaaaagggaaccttgggatttgggggaaggaccttcactcgtggggtgggcaattttgggcaat

SEQ ID NO: 9670 - DNA, 630 bp, Triticum aestivum
  Predicted polypeptide sequence is orthologous to G1033
tgagttcaggccgcagtacatgggagaagcacccaaacaccaagggcgtcgcagcggtgaccaaggctgccggggagaagtggcgcgctatgtcggacgaggagaaagcgcaatatgggggcaagaagccagatggcgagagcaagcccgcggccgctagcaagaagaaggagagcactagctctaagaaggctaaaactgatggtgcggaacaggagggagaaggttctgacaagtcgaagtctgatgttgaggatgatgagaatgatggcagtggcgaggacgagtagtagtaaatagcttagagagctgcagctatgcaaatcggtgttcactgcttagggctttagctttgctatgttactgttatccttgttatgtcctgttgtaaggaaaacgtgcgaatgaaggtactcctgggccgtggcatgctggaggtgtctctgtttaactagtagcgaagaaaatgccgaatactgttgactgcttttcttttgcgaacctccgcagcatgtgtaaactattttgcttattcactgatctgatgactagtccgcgattggctttctgttaatcgcgtctgctgtattcatattctgttgtgtaaaaaaaaaaaaaaaaaaaaaaaaa

SEQ ID NO: 9671 - DNA, 441 bp, Triticum aestivum
  misc_feature (215)..(215): n is a, c, g, or t
  misc_feature (236)..(236): n is a, c, g, or t
  misc_feature (239)..(239): n is a, c, g, or t
  misc_feature (300)..(300): n is a, c, g, or t
  misc_feature (311)..(311): n is a, c, g, or t
  misc_feature (322)..(323): n is a, c, g, or t
  misc_feature (328)..(328): n is a, c, g, or t
  misc_feature (333)..(333): n is a, c, g, or t
  misc_feature (359)..(359): n is a, c, g, or t
  misc_feature (378)..(378): n is a, c, g, or t
  misc_feature (401)..(401): n is a, c, g, or t
  misc_feature (404)..(404): n is a, c, g, or t
  misc_feature (414)..(414): n is a, c, g, or t
  Predicted polypeptide sequence is orthologous to G1033
cgcattatcagtaccatgagaacaatatggcagactctgcagctgccagcgacggtgagcagagcgatgaggaggaggaggaagaggacgatgacaatgaagaagagagccagtaatgagagactgaataacaggtccaggcattggtgattcaaacagtttctattgggtatgtgttagggttacattgcaacaacttaacttatatttgaatncaagcaggaactatatgtccnagnaattattttattggaatccttttatcaaagtaatttcccaagggtttaatttattacttanttatgataagnccccgcccttnntcaanttgcnaccacatatttcatgccccttaaccnaatttcaagacacatctgncccgattcctttgtgccaagatntgnctgttttgcnaaccctgttgcccctaaaaaaaaaaaa

SEQ ID NO: 9672 - DNA, 609 bp, Triticum aestivum
  Predicted polypeptide sequence is orthologous to G1033
ccacgcgtccgcgacggcgaggcgctgaagctattttgcaggctgcatagtcaagggggagggggtcgctactacaatcgctctcgcaagaccacgggttgccgcgtggggagggcaggaaaaggccagacacgacgggcggggagcggaggctgccggacctgctagcccgccggaccaactccctgcaacactaattagtcagatcctttgttcgccaagcgatttgaaaagatgaagcctatggtgaggtccaacagtggcggcggcagcgaccgaaggggttggctagcgtggaggaagacaaagtgtggcaagaactccaacatgcccaagcagcctcccagtgccttctttttgtttctagaggattttagtctggagtacaagttggaacacccgaacgtcaaggtgtcctcagtgatcaacaaagcaggtggtgatcgatggcgagctatgtctgatgcagataaggcgtcgtattgcgtcatggctgagcaccgtagagcagagtacgccaaggcgatggaagcgtacaataacccaggggaacccggccagcatgaggtggcccacaaggtggagccggctgatgtgatgtacaaccaa

SEQ ID NO: 9673 - DNA, 1032 bp, Triticum aestivum
  Predicted polypeptide sequence is orthologous to G1033
gagacgccagaccggccgccctttttttttttttttatcaagatgattttctccctttcaacatcatatatattgagatcgggggcaggattcttaaaacagccacgggcacgacactaggtacatacgacagagactgaattaaaacataaagcacgaagcaacagagggcggtccgagcagaggaccctgcagaaaggaaactaggctagcaatttcaccactccgatccaggacaacgactacatgggactagagctaccatttctatcatcgccatcagcagcagcaacctgaaagagagggagggactaccaaggggctaaactaacagcgaacatccatcatcgatcggtgacaccagcaatgagcggcagcggccacgttccagagaccccctccccctgctgcagctgcttggcgtgccgcttcactcgtcgccctcgctgtcctcgtcgttcacctcggacttggacttgtcagagtcgccggacgcctctcctgcctgtgggttgttgtaggcgttgatcttcttggtgtactcggccttgagcttctcggccttggcagtgtagggagccttctcagcatcgctcagggacttccacttctcaccaccggccttgccaaccacggacacctgcttaacgtcggggtgcttctccttgtactccttcctgaaggtgtccatgaagacgaagaaggcgctcggggggcgcttgggcttgttggggtccttctcggccctgctcttcttcaccgtgagcctggagtcgccggcgcgggagcccgccttgggccttatcctgccgccggcggccaactttggatccgaccaagggggtggtggggtggggaggggggcgggccctcttctgcttggggcttgcgtggggtgggtccgccgggtgggagggagattttctaccccttcagtccaatgtaaggggtcccgtggcccaaatcgcgggacccctggggtcgaaaaatatcccgggaaattcgggaccggttccaagccgggttttatga

SEQ ID NO: 9674 - DNA, 855 bp, Triticum aestivum
  Predicted polypeptide sequence is orthologous to G1033
tgaccttaggcctatttaggtgacactatagaacaagtttgtacaaaaaagcaggctggtaccggtccggaattcccgggatatcgtcgacccacgcgtccgccggaacccctcaactcgggcgctcgattcctggcttcccctggcgccgatctcatctgttgctcagacatgactgcttgcaagcagaccgcatccacgggcgccgccgccacgtacgaggccgacagcaagtcggcagcgaagagcgatggagcggaggagcggaagccctcgaccaagtgcaggaaggggaagaaggccaagggcaagttggcggtgaagagcaatgttgcggagaagcccaagacccatgacctttccgatgttacacgcgggttggcggtaatgagcattgcaacagagaagccgttggatgaacagctcgcccagcacgccctgttcacctaccagaactacttctggatggacaacttcaaaggcgtctatgacaagccgtccgtagatgctattaaaaggaaagctgctgaaaactggaaatcctttagcgattcggacaaagccccttatgtggccattgcacgtgtgaacagaatactcattgccgaggcatatgagttcaagaggacactgaagttgaccctcctgatgacggacaagatgatgaatctgaaaatgtgaacagcccagatctctaaaaatgtgtttgaatagaaatgtctttgtaaaatggcggaaatactggcaccaactccaaaaaaccgattctgtctgggcggcatttggaggtttgaaattcaggtgccattccagcctgccctatggacaatttccttagttcaaaaatagtttggg

SEQ ID NO: 9675 - DNA, 523 bp, Triticum aestivum
  misc_feature (501)..(502): n is a, c, g, or t
  Predicted polypeptide sequence is orthologous to G1037
aggaattcggcacgaggctcccctcccccctgcctgctttgaccctgctggctggctgcctggcttcatctgcccgccacgcctttccccgccgccgctcgccgcttggattcgtaggatccagcgaagcccgtccccgcgccgttcgccggggcattaggtgacccggccgtgccgtgtaggacacgcggaggaagatgaccgtggaggggagggtcagcggcgggggggacggcggcggcaaggacaagttcccggtcggcatgcgcgtgctcgccgtcgacgacgaccccacctgcctcaaggtcctcgagaacctcctgcgccgctgcgactaccatgttacaaccactgggcaggcagccaccgccctcaggatgctcagggagaacaaggaccagtttgacctcgtgatcagcgatgtccacatgccggacatggatggtttcaagctcctcgagcttgtcggtctggagatggacctcccagtcattatgttgnntgcaaatggggagacacagac

SEQ ID NO: 9676 - DNA, 661 bp, Triticum aestivum
  Predicted polypeptide sequence is orthologous to G1037
gggaaaatgttgcgagcctctgcagaagtacaggctatacctcagacggctaagtgccgtggcatcacagcaagccagcattgctgctgcttttggaggcagagaccccttcttgcacatgggagcatttgaaggacttcatagttatcatcaaccctttgcccctcctgctgctcttccatctctcaatccacatggactgctgagtggtgctggtgcagcagcatttgggcttcaggaccttgcttctcccaaggcaaaccagtgttctagcagcaacggcgcagtaagtcattgcgccggcgatacggagaagttccacattgtgagcttacaagacaaccaacaggcagatttatcgcaaggcttgacctcgtcgcttgggcagccccagctccatcagaagtggattcatcaagaaaccagtgacttgtgctctgtcttttccgggggtgctctggctaacactatgtctggcacacttcaaagagttacaagcagttcactgccaccagaagatcttttggagtgcactgcacacatcaaagttggagcccatccatcaataggaataccaactgggagttcagggctgcttgaaaggtctgtcggagtttccgccgatttgcgggattcttgtatatctcagcagtgtgctctt

SEQ ID NO: 9677 - DNA, 740 bp, Triticum aestivum
  Predicted polypeptide sequence is orthologous to G1037
aaaacatgcagtgagcacccaattattaagaataaactatgtagtatgatgcatttattaacaacaaaacagctaagcatggaaaaagaaaaggtggtccacatgtaggtatcctgtatttgaccatgcatgcatttcgtatgtatctcacgcacctcctgttgtctttagctgggtgaccgcattgacgaacaattcatgcatctctggggtccactcgacctttttcttctttgtggtccccagctgcaggccgccctcggagccccccttgcccttgttgggatcgttcactccttgccctatcttccttggggtgtcatccatatggacgccctgggtgtggcgagggttagggttctccgtggctgcgccggcggctttgcgcctccaccgcacgacttgctccagatgaagtatatctgcacgtcacgtaggggcttgtccatcaagtagcaagcgccttcctgcattgccctttccctcgtctccatggtctcgttgcccgagaacatgaggatgacagggtaacgtttcccgacgcgcttgacaaggccgacgccgtccatccctcgcccccgggtctgtgcgacggtcatgatgaagtcgatcccatgcgggttcttctccacctctttcaacgcatctgcgggcgaggcgctggccgtcactttgtagccgccgcgccgaagcatctgcgtcaagtctggaggcagacgggatcatcgtccacagcaagg

SEQ ID NO: 9678 - DNA, 816 bp, Triticum aestivum
  Predicted polypeptide sequence is orthologous to G1038
gccacagcacgctccgcgctgacgagcacgagtttgacgcgcacgcggcggcaatggcgaacggcgaccaggacatggccaccgacgaattgatggagacggaggggttgaaggtccttgccgtggacgacgaccccatctacctccattccttgacgcagatgcttcggcgctgcggctacgaagtgacggccaagccgtcaccagcagatgcggtgagggaggtggagaagaacccgaacaggaccgacttcatcatgacggtcgtgcagacccgggggcgagggatggacggcttgggcctcctcaagcgtctcgggaaacgttacccagtcgtactcatgttctcgggcgaagagagcatggagacgagaataaggggaaatcaggggggcgcttgctacttgctggagaagcccctacacgacacgcagatatacttcctctggcagcatgttgtgcgatggaggctcaatgccgccgccgctgccacggcaaacgctaaccctcaccacagccaaggcgtccatctggatgacacgcagaggaagagaaggcaaggaatgaacgattccaacaaggggcaggggggcttttcgagggcggcctggcactggggaccaccaagaaggaaaaagcttgagtgggactgcagaaatgcatgaattgttcgtcaatggcggggacccacttaagacaacaggaggggcgtgaaaatcataccaaaaggcatgcatggcacaatacatgaatccttcccttgggacccttttttaatttttccatgcttaagctggtttggtttttaaataaatg

SEQ ID NO: 9679 - DNA, 706 bp, Triticum aestivum
  Predicted polypeptide sequence is orthologous to G1038
ccacgcgtccgaccagcagtaccttctgaagagcgcaaggtgtgtgcgtgctatggagaacgacaacgccttcccttctggtgtcagcagggacactttgccccaggatttccccgtcgggatgagggtcctcgtggtggaggacgacccgaacgacctcgagcacttgatgcaaatcctcgagaggtgcggctacaaagcgacagcaaaagcgtcaccgagagaagcgctgaaagaggtggaggagaacggagagggcttccacttcgacatcatcatgaccgtcgtgcacggcggcgaagaaggagatggattcgacggcttcgacctcctcgagcgtgttcgggatcgttacccggtcatcattttctctgccgactattctaaggagatggtgatgaggacaatcaatgaaggcgcctgcgacttcatgccaaagcctatgtgctaccaggaggtgcgcaatatatggttccatgtcaacatgcagaggggattagaagtggacgaccctgacgagggggtagaaggacctagcaacaatgagaatccccctgagatcaaatagctcgggggacatctatgacttcctctcgatgaataaaggtggcaccattgtttgctccgcaacagctctggcgactctggcgtgagtcttaggcactcgggcaagcttctattctatagtagctacaaaattacttca

SEQ ID NO: 9680 - DNA, 823 bp, Triticum aestivum
  misc_feature (518)..(522): n is a, c, g, or t
  misc_feature (546)..(547): n is a, c, g, or t
  Predicted polypeptide sequence is orthologous to G1038
aagctatgaccttaggcctatttaggtgacactatagaacaagtttgtacaaaaaagcaggctggtaccggtccggaattcccgggatatcgtcgacccacgcgtccgtggatgtagtggtactcattacagcgattcaggagttgggaaatactgagtacattattacaagttgagttaatgaggttagcggaggaatttttgtaatctgtaaaagcaagttcagggtgtgttgggaaatacgtacattaatggtcgtccttgagtcgagttgtagttatcgttcacacaatctcattttgcgcccataagagggatgcagatatggtggttcattttcagagtagatattcaagtccgacgaaactgaacaagcttcaaccactgcaatcccttctggagacgtccttcatcacctcgttcatgcccttttttctttcagttagacacatcgacagtcaagctttgcgcactactgtagatgttgttgcagttttggctgtatacaaattccaacnnnnnaaaaaaaaaaaaaaaaaaaaaaannggggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatga

SEQ ID NO: 9681 - DNA, 718 bp, Triticum aestivum
  Predicted polypeptide sequence is orthologous to G1043
gagccttgctgctccagaatccagatcactggcagtagacggtagtgctgtgcgcgcgcgcgagtagctagccggagcaggagagtgttcgagttcacgagatgtccatggcgccgtacgagcaggtgatggatgacctggccagggggcagcagttcgcgacgcagctgcagggcctcctccgggactcccccaaggccggccacatcatggaccagatcctccacaccttctcccgcgccatccacaccgccaaggccgcggccgcggccgctgccagcgccagcgccagcgagagcgaggtcaccgatggcgcaagcagcggcgggaagaggaagcccgccgcccgcggaggaccgcgcaaggcctgtcggacaaggacccaggattcgtccgtcgtgaccaagaacatgaggagcttggaggacgggcagacatggcgcaagtacgggcagaaggagatacagaactccaagcactcaaaggcctactttcggtgcacgcacaagtacgaccagcagtgcatggcgcggcggcaggcccagcgctgcgacgacgacccggacacgttcagggtcacctacatcggcgcgcacacctgccgggacctcgccgcccgccgtgggcggcgcatgctcccggcaccgcagccggctaccacctcatcagcttcgcgccggccgctgctcatggcaccaccaccagcaccaccacaacg

SEQ ID NO: 9682 - DNA, 1031 bp, Triticum aestivum
  Predicted polypeptide sequence is orthologous to G1043
cgtacgacccacgcgtccgggactggagcacgaggacactgacatggactgaaggagtagaaaaaccctgccctcgcctcgctgccccatatcactggctggctactctggcggcgtcgtgctagaccggaagagtgttccggtgtaccacgtgctcgtgcttggaacgccgtacgtgtccatggagatggagaccccgttggcgcatgtgatggatggcctgatcaaggggcgggagtttgcgacgcatctgcggggcctcctccgggactcccccaaggccggcctcatcatggaccagatcctccatgccttctcccgggccatgcacgccgccaaggctgcggccgctgccacggctgctaccagcggtagtgagaggtcctcggacgtgcatagcgaggtcaccgatggtgcgagcggaggccggaagaggaagtccgccgccgccggaggaaaccgcaaggcctgtcggacaaggacccagcagtcgtccgtcgtcacgaaaagtgtgaagagcttggacgacgggcaggcatggcgcaagtacgggcagaaggagatacacaactccaagcactcgagggcctacttccggtgcacgcacaagtacgaccagctgtgcgcggcgcagtggcaggtccagtgctgtgacgacgacgagggcatgttcagggtcacctacatcggagtgcacacttgccgggaccccgccggcgccgctgtggcgtcgcacatgctccacctcaccgggtgcgccgaatgccttgtcgccggctgccagctcatgagcttcgcgcgccgggaggtcaaccgccgtcgttcccataatgaccacgagaacaatgacgtttaccgcaacgctggtccatgaagaaccctccagggggttcggccttcaggctttgaagcctgaaaccggcaaccgggaggaggtgtttacaggcggaacccgggtaatttgcccaggaaagaaccgcggggcggccagggcacgggtcctgtttttccccacagggaacgttgactcc

SEQ ID NO: 9683 - DNA, 535 bp, Triticum aestivum
  misc_feature (487)..(487): n is a, c, g, or t
  misc_feature (498)..(498): n is a, c, g, or t
  misc_feature (505)..(505): n is a, c, g, or t
  misc_feature (516)..(516): n is a, c, g, or t
  Predicted polypeptide sequence is orthologous to G1051, G1052
caaggacgctcatcaagaggcgctgaaggaggagatcgagaggctgcggcaggtgtaccagcagcagaacctcaggatgtcgtccggtgcgggcgcggcctccgaccacggcgggccgcccccggtgcgcgcggagaaggagctcatgagctgagcgatcatcgcatgtcccttccgcgcagcccgccgctgcatcattgacctggaagggaaacatggcatcatgaaatgcatgaatgaaaccgtccatgccttttttttttctcttgttcttcttttttcttgtccattgacctgtgtatcattctttgcatatcgatttcagttttggggttttttactgtgaagaaaaaatgaagtgtgcctccgttgtaaattccgtgtgtagcatgcatcttgtgtacgtagatccgtttcaagtttaagtttggagcatcatcttttaggaaagtttttgggaaacactaagcacactcttgctttgtanctcgtactganttagcanaactgttgtantatctccgaatccttgttc

SEQ ID NO: 9684 - DNA, 638 bp, Triticum aestivum
  Predicted polypeptide sequence is orthologous to G1051, G1052
tttttttttttttttttttttggacggagaaaaattgcatttgattgaccagaagatagaacaaagccagccaagcaatggaaccactcgacctcaaccaatccgagttacaaatccttagctacaaccttcgccctaaatgccgggggaaaaatacagatcaggggaagtggagaagagtgatcaggagcagacagacagaggacgcaagaatgaacaaataagcaaccacccagccggaatgaacaaactgagttacagacaccatcacaccccgaagaatatatgcaaaccaagccaatgcagtgcaccaaatcttaacagcagcagtagcagcagcaagaagaacagcgacaacacttggttgtcctgaggccgatgtgccggatctcgatcacgagggcgcggcggtcccctcgctggcgatcaagccgttgctgttgtcgccgcggaccagggggccgtcgtcgtgtgccgggggttccgcgttcctgaggctctgctgctggtagacttgcctcagcctctctatctccttcttcagtgcatccatctttgaagatcttgtcctgcgcgagcgccgcgatgcgctgcttgaggtggctgttccccagcgtcagcagcgagcgttggtggtc

SEQ ID NO: 9685 - DNA, 623 bp, Triticum aestivum
  misc_feature (46)..(46): n is a, c, g, or t
  Predicted polypeptide sequence is orthologous to G1051, G1052
aatgaaaatatctttaccaacacaaatgtaaggatggttcaaacanatatatctacgacaatttcccatcccaacacaattatcggtagggatgagtgaacatcaaaaaacaaaaacaatgaacatgtcaaactgcacaaataatctagtaacattggtgtgtttccacacgatgaatcgacaagagtgaaaggaaaaagtcaccacaaaaaggctggttgcgccatgttgtgttatcgcatcgcggctccctcacacataaggagctcttgcttggcttgcattgaggcggccgtggccatgtctgtgccgcctgtggccttgatcttctggtggtggaacagctgccgtagtcgctcaatctcctctttgagtgcctcttgatgagcatctttgaagatcttgtcttgtgcaagggcggcaattctttgcctgagatggctgttgccgacggtcaataatgaccgctgatgatctagaaaggccacgcggggagagagtgctgacacctccatctggagaccggtgacgctgcgttcaagctctgagatgtactgcaacttccgaactcttgacctctgcgctgactgcctgttggccaatatccttttaacccgcttggg

SEQ ID NO: 9686 - DNA, 1087 bp, Triticum aestivum
  misc_feature (23)..(23): n is a, c, g, or t
  misc_feature (29)..(29): n is a, c, g, or t
  misc_feature (816)..(816): n is a, c, g, or t
  misc_feature (851)..(851): n is a, c, g, or t
  misc_feature (948)..(948): n is a, c, g, or t
  misc_feature (1014)..(1014): n is a, c, g, or t
  Predicted polypeptide sequence is orthologous to G1051, G1052
gacccacgcttccgaattccctncaagcnccatcccccatctcacccaagcaacgaggcgcaagcaagtgtagcagcgaagaaggctactctctatgccagcctcggccagtataaaacaaggctctacgcgcgccggcacaccgcattacgcaactcgctggttcagcagctagctagctttggcgtggctaggagaggtagcggctagctagctgttgcgcattgccgggttcgccctcgagcgtaatggcgcagctcccgcccaagatcccgacggcggcgacgggggcgcaccactggcccggcgccggcgtggagcaccacggccacgggcccgtcgcggtgtgggcggacgagttcgccgagttcgcggcggcgcgccggggcgcgcaccgcaggtcactgagcgactcggtggccttcgtggagatggcgccggggggctgcggcggggcaggcgacttcgacaggctggacgacgaccagctcatgtccatgttccccgacgagggcgggtcgacggccccggggtccgagaacggcaccagcgacagcgacggcgacaagcacggcaaggaccggtacgacgacgggcagcacgacgatgctaatccggaggagccggggccggggcaagccacgccgacctcgtccacggagacgatccgcgaccccaagagggtcaagaggatactggctaatcgtcagtcggctcagagatctcgggtgaggaagctgcagtacatctccgagctcgagcggtgcgtcacaacgctgcagaacgaggtgtccgtgctgtctccccgggtggcanttctggatcagcagcggacgatcctcaccgtcggncacagcccacctcagcagcggatcgcagctctggcgccaggacagcttttcaaggacgctcatcaggaggcgctgaaggaggagatcgaaaggctgncgcaggtgtaccagcagcagaacctcagaatgtcgtccggtgcggggcgcgggcctccgacacggnggggcggcccctgtgcgcccggagaaggacccatgacctgaacgaccattggattcccttttgggcagcccga

SEQ ID NO: 9687 - DNA, 703 bp, Triticum aestivum
  Predicted polypeptide sequence is orthologous to G1062
ccacgcgtccgcggacgcgtgggcggccaagaacctgatggcggagcggcggcgcaggaagaagctcaacgaccgcctctacatgctgcgctccgtggtgcccaagatcagcaagatggacagggcttcaatccttggtgacgcaattgactacctgaaggagctcctgcagaggatcagtgatctccactccgagctcgagtctgctcccagctctgctgcactgggtggaccatcgacagctaatagcttcctcccgtcgacgcccaccctgcagccgttccccggccgcatcaaggaggagcggtgcccgccggccccgttccctagccccagcggccagcaggcgacggttgaggtgaggatgagggaagggcaggcggtgaacatccacatgttctgcgcgcgcaggccgggcatcctgctgtccaccatgagggcgctggacagcctcggcctcgacatcgagcaggccgtcatcagctgcttcgacggcttcgccatggacgtcttccgcgccgagcaatgcagggacggccctgggctcctgccggaggaaattaaggccgtgctcctgcactgcgccggtctccagaacgcgatgtaggcgagtgaacccgggagacagaccgtcaggacggtgatgatgatgatcgtggccgttggatggtctctatctcctctctgcctcgccaggatgatg

SEQ ID NO: 9688 - DNA, 503 bp, Triticum aestivum
  Predicted polypeptide sequence is orthologous to G1063, G2143
cttcacatcgcggcgctgcagccggtggaggtcgacccggaggcggtgcgcccgccgaagcgccgcaacgtgcggacctccaagggacccgcagagcgtggcggcgaggctgcggcgggagcgcatcagcgagcgcatccgcgtcctgcagcgcctcgtccccggcggcaccaagatggacaccgcctccatgctcgacgaggccatccactacgtcaagttcctcaagtcccaggtgcagtcgctcgagctcgccgccgccgccaccggcgcggccgcccaccgcgccgctgccttcgcctaccccgccatgcagcacgcgccgtggtagcccgtcctcatcagcacggctcgtcgacgcttcagctaccatgatagcagtgattcaataatccttccttccgtttctgtcgccggcccgcgccgcgcgcaccagctcgtcgtcctcgatccgcttttggagttcctcggatgatttctgtagctctgtgcggctgtgtgca

SEQ ID NO: 9689 - DNA, 566 bp, Triticum aestivum
  Predicted polypeptide sequence is orthologous to G1064
tttttttttttttttttttcagaaaacaagtacgggcaggcaaaccctcatggaagtagacatggtaataaccttcgaaaaagaactagaaattagaacaacaggtagggactagaacgttatatctcaatcgctaatacaacatcatctgacataacgagataatttaaggcgatttttacacgagttacatcgaccatgcccttgctcgcagctccttaagcgccactctgctaccagcgggaagccagagacatcgaatcaaaatcagcctgaaagagcaagttcttgcgctggtacagttcccatgatttccgcagccaagttttgtttcaaatttccctaaaaatatgtgttttaaatccatccagccacttgttatgtgccatcactaacctgacagctgcaaactcgtcaattggaaattatacaaagacatgaacttctatacgtccccacaaaatgcacggttcatgaactattcatgatctaagttctttggctccaaatcacaaacagtacatcatcaactgacatataaccatagagtacttaattacttcttt

SEQ ID NO: 9690 - DNA, 921 bp, Triticum aestivum
  misc_feature (627)..(627): n is a, c, g, or t
  misc_feature (897)..(897): n is a, c, g, or t
  Predicted polypeptide sequence is orthologous to G1068
accagccagtagcttgattacgccacgctatttatagtgacactatagaatactcaagctatgcatccaacgcgttgggagctctcccatatggtcgacctgcaggcggccgcactagtgattagcgtggtcgcggccgaggtttttagcacaaatgacaaccacagcatgtcattccatactagtcaataacactgggttgcactgctatccaaaccaactcactctctcacatagctgaaggttcatcaatctatgatcaccagagactgttccaggcagcgaacacgatctcgaaaaaagaagaaaaacttttaataatctaccgcgatatcaccatcgaacaaagctctcagagtagcgagactttagttgacaatgatgtcagatgttccacgagaagccaccgtcccccggctgctcccccatgaacagaccgctctccacaagttcgtgggagatgagatgttccaggtcgtccatgtcatgcacagactccacctttggggtcgccgcattgccaccagaagcggccgggttgctgctcactgacttgaaactgatgcttcgctggaccatgccagctccactgttgatcagattactaggccccgtcatacccatcanagcagcgccctttgctgtgccattattcatgtgctgtgcctgctctccgctagcagcggtgttggcgaccgcggctcccagatgcagacaccatttgcattgggagtgctaggagactgctgttgctgttgatgttgctgctgctgctgctgctgctgttgatggtgctgctgctgttgttgctgatgagcaagagccggctattggtgtcttggcttctgcagcactgatgatcacatgctgctgaaatgtgactagcgcccagctggnaattgtatgctgtgctggactact

SEQ ID NO: 9691 - DNA, 425 bp, Triticum aestivum
  misc_feature (413)..(413): n is a, c, g, or t
  Predicted polypeptide sequence is orthologous to G1075, G1076
ggccggcggtggcatgccgttcggtgttgatccgtcggggggctcgacaggagctgggctccagttcttcaacctgccgatgggcatgccgccaatgcccgtggacgggcacaacggctggccgggcgctgccggtggcgtcgagaggccgccgttctcgtgacggatcttggccggcggtgaggacagcaggtgcgtccgaggacacggacatgtacaacaacagttagcctctacttcttatcacggtcgatcgattatctctttttcattgtgatgaaggaaatctcctgatattttttgcgttaacctggataaatttgggttggtgttagtttgctgggtccctgtttgtttaattggaatatatgttgcgagaacgtgcactcataaattcaccaatttaaattaanaaaaaaaaaaaa

SEQ ID NO: 9692 - DNA, 1127 bp, Triticum aestivum
  Predicted polypeptide sequence is orthologous to G1079
gtcttccgagaaagagggagaagagagatggtgatctcgacggggaccattccaaagtttaagacgacgacacggacagctgctcgacgcctctgcccccgccgccgccgcccggtatggagtgggagtacacggacccaatcactatgcgtcccttggattttcttccatcttcgttggctgatcgggacgataaagaagtggcctcacaagtcagcatggatgacgattgggtggaaacgaacatagaatttgatggacaggatgaaagcgtctctggcaatgctgatggcatacttaggcgtgtggaattgcatccagcaaagagtagggttatgggtgatgaaaactcatcaatgatgagcagctgggtaacaaaggactcgaactcttcggtgatggcctgggcgactgacaagtcactggtagaaatagccaaggagattgatgagtacttcttgaaagcagccgcaagtgggactgatgttgttatactcttggattctgctaccggccggctagatccctcagaggtgcaagtaaagaaaggaaaaaattcgaagtctgccaaggttttctctacactttcctggagctggtcattcaagtctgtacatgctaacagggaatcctcaagtgatgcttgtggatacggttatcatggcaaaacactagataagctttatgacgaggagcaaaaactctatcagttagttaaggtgcactatgggagtcttaagtattattttgatttagtctatgttcaccgaaatgcattgcacaatacactcaaggattgagataacagcttatagcttgtatcttagattttgatgaatcgtttattgtttaggaatttttgttacctctatccataggggaaatgatgcatcatgaataaatgttgacttgttaccttatgctgccagaagtcgacacatggtgactatcctatttggaggatgaagatttggcaaggttgaatacagaaagtaagttcattgctaaggagctaaatcagggaacatgataggtggaggcagaaaagtcgggaaatatctaaaactgaaactcgataatgtcctaagagaagtgtagctgaagtgttgaccatttaagccagggat

SEQ ID NO: 9693 - DNA, 720 bp, Triticum aestivum
  Predicted polypeptide sequence is orthologous to G1084
atttaaaacagaggggggaagcagaactgagtatatacacataaaagtgttgttatagccctggtattaacaggcgcatgcaagcctgatgagtggcagtcttagagattacatgcaacagggtaacttgtaggtgctcaaaagcaagcgatggcagcattcatcatgtcataaagcacagctagacgcttgtagagtcggtcgccggcgttgacggaggcaagggagatgttgaacttggtccagatgtccctgatggcagccctggtcctctcaatggcgaacagctccgcactgttggcgtcctgaatcctcagttgcgcgaccttcttctcgtaggagcgcaaatgtgttccattttcatatctttggcttgactcattctttggacttctaatgattatacaaattcttggagaagcaagtgtactcgattgaacgtaccctgactttaggctctccttgtgcctctggaagagctggaatggctctgatgaagcttcgcaaatgccgacttgctcgttgccattgttatcctcaacaaattcttggagaatcaagtgtcctcgattgaacgtaccctgactttaggctctccttgtgcctctggaagagctggaatggctcaggcgaagcttcacaaacaccgacttgctcgtcattgtcgttatcctcaacatcccctctcggagcagctggtttaaccttaatttgaggcca

SEQ ID NO: 9694 - DNA, 700 bp, Triticum aestivum
  Predicted polypeptide sequence is orthologous to G1084
cgaaattcttgataaacttattatatttatacatcacgtgagaaagaaaataatattccatcacagacaacacacaacaattataataccatcgacagaagcatcttgctgcatggcaactaataagatacaacaatagaaattgcgcatgtgtaggccccaacggcggtggtgtgcctctgatgcctccgaccgtgtggtgactatgggagaagctcgctcacctcatccactatgcgcttcatcacccggtgcacgtcgccaatgactcgccacatccttgccagcatttggaggagtcgcagatgacaactaccctccgggacacgtctttgacaaaggcgacggtgatgttgagcttggtccggagattcctgatggtagccctggtcctctcgatggtgaacggctctgcaccgttggcatcctaggtcctcagttgcgtgcactttttctcatacagcagcggaacgcactccccttccttcgtcgggaggctcctgtagtgcaagcagtcatcgcagagcatatagagcactcccaactcctacaacaattactcagggtaaaccaaactccaaaaagttgtcctcacaataatccaaactcctcaacatgaaccaaagactaaatccaatttctaaatgtgagaacgatcattgtagcacatgcaaggaggcacaaaaattgatcttcctcc

SEQ ID NO: 9695 - DNA, 574 bp, Triticum aestivum
  Predicted polypeptide sequence is orthologous to G1084
cggcacgaggcctagtatgatttgtcagagcgacatctaccctccctgccacaaatgattgatccttttaaccagattcagaatccgaactttcgtttcattaaaaaagaaaaccgaggttggtcatccatgatgcatttatagatccatttgatgatgaatcccatcccatcttgaatacccctcccttcatttcaaagccaagttatgaactggaatgcatttgcaagcagaggagcgtgtccggctgttgtcgtacgagaagaagctagtgtgtgcagctgaggacccaggatgctaacggtgtagagtcgttcaccatcgagaggaccagggcttccatcatggtcctccggaccaagctcaacatatctgccgccttcatcgacaacttgtcctggaggatcattgccgtctgcaacgactcacctgaatgtacgcctgtgatggcattttagtttcttccccacgtgatgcatcaatacaataagtttatcaagaattgcatgaatgtgctatccagatccaaaaagaaaatgaaggtgtcgttccccaaaaaaaaaaaaaaaaaaaa

SEQ ID NO: 9696 - DNA, 666 bp, Triticum aestivum
  misc_feature (11)..(11): n is a, c, g, or t
  Predicted polypeptide sequence is orthologous to G1089
atgcagtttcnaatttgcaaaggtgctataacaacaaaatagaagggaaaatgacatcaaagggaagtacactatatacgccctagtttagaaaatagagctagtctggggtactgggttgttaaactaatctggcacggggcagaactttagtttccacttttatctataccaaaagaacatcgattgtttcataaatgttaattgctttcttgtttccaaaactaacgatctgtggcacggtgattgtctggcacaaagggtgcggactgattgctcaggattcaaaaccaaggattactgtggggacctcccctacagtttccattcaaaagaaacaagacacacttgcctcgactgtcagcatggttggagtggtaatgcatccgtgtggcctcaagcttttttgacacatcatgtgcactctccgaagacctgagaaagttatcatcaagctgagcaataatctgcagtaggctggcagacaccatcataatcttccctttccgggtctcaactgagcccatggacgaggcatgctggtggtgtacttctggttgcaggccaggtgccttgggtggcttcctaacaatcggcttcgacgggggaaggtttgccccaagctcatcgatggccttcgccttctccagtgctgtcttgtggtgg

SEQ ID NO: 9697 - DNA, 509 bp, Triticum aestivum
  misc_feature (250)..(250): n is a, c, g, or t
  misc_feature (445)..(445): n is a, c, g, or t
  Predicted polypeptide sequence is orthologous to G1095
gttcagcgctgcaaccgattctgatcaggaaaccaataagagctgctgttctgtatgccttcaggacttgagaccgcagcaatttgtgagagccttgcctcagtgccagcacattttccacgtgcgatgcatcgatgactggcttcagaggaacgcctcctgcccactgtgcagggctgggtgttcacatagaccacctgtgcttataatttgaatacccgtgctccgcgttctatgatccgtgaaatancttgtatacatagaggtttctttcctttctttccttttgccagtcctgtggagtgggggcaacgtttccggctgcacgttttcttgtcatagcaataacgtgatatgtgcattatctaaatggaaatgactaacaagctacagaattatgggcatgtttttctctgctgataactactggtactgactttgtaangtgaatcgcttgcaacctgtcaagtgctgcaagtaatgatccttatcagcgcaaaaaaaaaaaa

SEQ ID NO: 9698 - DNA, 829 bp, Triticum aestivum
  misc_feature (530)..(530): n is a, c, g, or t
  Predicted polypeptide sequence is orthologous to G1095
acgcatgaccttaggcctatttaggtgacactatagaacaagtttgtacaaaaaagcaggctggtaccggtccggaattcccgggatatcgtcgacccacgcgtccgctaacaacaccgccaccacagcgcagcatttactcccgagcatcaccggggcgggctgcgactgcgagcgatcgatctcgcttaaccaaccaccatgggcgcaccaggcgcagctcccctagcaggcaacagcttcgtcatcctctccgtcgccgtcgtcggcatcctcgccaccagcctcctcctcctcgcctactacctcttcctcacccggtgcggcctcgcctcctggcgccgcgaccacgacgacgtcgtcacgaccacgcagcatcaccaccgtatcgtctactccacagcaccagagccgagccgcggcctggaggaggcggcgatacgccggatacccacgctccggtaccgggagtccaagcagctgcaggcaccgcaggcccaggcggcgagcgagtgcgcggtgtgcctcancgagttccaggagggggagaggctccggctgctgccgccctgcctccacctcttccacatcgactgcatcgacgcctggctccacgccaccgccaactgcccgctctgcaggaccgccatctccggctccgcctgccagccccagccccacgttatacttaaccaatcgacatcgtcaacgtcctccaagccgaccacgtagtcatcgacattccctccgcggcccgggggagaaaacgagcaaactcgctgggcgtacctggcgacaatagggagcatgggagaacgaacgcattgac

SEQ ID NO: 9699 - DNA, 670 bp, Triticum aestivum
  misc_feature (26)..(26): n is a, c, g, or t
  misc_feature (35)..(35): n is a, c, g, or t
  misc_feature (49)..(49): n is a, c, g, or t
  misc_feature (55)..(55): n is a, c, g, or t
  Predicted polypeptide sequence is orthologous to G1108, G2394
catttgcattgtcaaggagtgtgtgncagcgagangagctgtaacttcnccaagnttaaaaaaaaggacaaaaaaaaccttgggacaccatcgctacaatccatagatcaaaagcatcaactttatacatgcagaccggcaccgcgagcaaactatatgcttatgtatcacctcggaagatggaaggcagaccaatctaatgcatttcgatctcctgcgtcggtactgtatggtcgatgtggcgagtatcagatgtgccagatgagcttgctatctcggctttgcacagagggcatagtgcatttatcttgagccatttgtcgacacattccttgtggaagcagtgtgtgcagggaagttcacgaagctcttcgttgtgtgcatacttggcaaggcagatgcagcaaacagcatcttcagcagaaagcgatcgctccttgtcagtccctgcagccactatacctccctcttggccttcggcttcattacctgaaccatggcggcgtttcttggttttgaatttataagttggcaaagtattgatggattcccgaagtggcccctcttgtattgtttgtgtcttctctgaagcccatgacggatataatgcaggggagacaacagcatatcattgcacagaggatgaaaggcatggcatacccaatacagc

SEQ ID NO: 9700 - DNA, 731 bp, Triticum aestivum
  Predicted polypeptide sequence is orthologous to G1108, G2394
catgctccaaccctgtttctggtgaatgccacatttgacaaatactgagtataatcactagctaagcaggtgtgagtatttacaatatatacgagacaattccgccagaatgggagaaatggacttgcgtcctacttatagcgtgttccatccatcctcatgcccatgctcatgggacgaagcagaagaacagctaccgctgtgactcgacgtcgcctctttccctgttttcattctgttggtgttggccctcggggccagcctcggaagacgccgccgttgagccgcccagctcggacttgcaaagagggcacagcgcgttgatcttgagccacttgtcgatgcactccatgtggaagacgtgcccgcagggaagctctcgcagatcttcgttgtttgagaaccttgataaacagatgcagcaaacggcgtcttccgcggagatagtccgctccttgtcggtcccagatgccagaaccccgccattgtcttcccccacttctcctccatcgcggatcctcatcgacttgtacttgtacgccaccagcgtgttgattacttccgcggtagcgcctttgttcatatccagatcctcgtggaagcctaccatggagattatgcagggcaggcaacagcatatcatcgtgcacaggatgaatggcagtgcatagccgatgaagccgaatgcaaggaacactatacacagcctgtacaagttaggagcgtcatgg

SEQ ID NO: 9701 - DNA, 1101 bp, Triticum aestivum
  Predicted polypeptide sequence is orthologous to G1108, G2394
acgcgtcccgaggaggaggaggactgaggaggaagacgaattcgactccgagttttgaatttggccatttggcccaatcttgccgtccggcgatttttctttggatttctttggtgaaaccctcggcggatggtcgcttgggagccaggcatttgattcgatcttaagtggtccaggcgattggaggagcagctggctgctgctgttcccggggagtggattttcttgaggtgcagtgaatctctcctgctgtcataggttaaaaaaaacaattcaaattgcctggccttggatcaagtccattttcctatagagattgtctgtcttaagtcaaagcagctatatttctggcaaacacaacgagctagtttcatatgcagcgttcagttgatggctgctcatcctgttgaatcagaagcaagcagtgaaacagacaatcaccctttactgatagaccacatggaaaatactgctcatctcgagattgcaattgagagcccaagggatgatgttgcttcatcgtcaaccgctcgtcgggaggataatgatggcttggatcgattgcctcacatctcagaaagttcttcggagacaactactgcatctaactctcaaagtgctccctctagcagaagagatgctaatcgtgctcgtcgtcggcaaagtccgttgaattctagttgctggatctccattgagcttgttgtaacagttagccagattatagcggccatttgtgttctgtcattgtcaaggaagggacgtccgcattctccattatttgagtgggtcattggttatacggtaggttgtgttgctactcttcctcttctctactggcgctatctccatcgcaaccgcccaaacactgggcaagacccagcagtcagaactccctccgaacagcatacctgagtccatttctcacacacaaattcggccctggcatgtctgagctgttttgtaactgaccaaatggagttcccaaaacacgtgttaccaaaatttagggcccagcttttgcgatcactcaggatgcccctgactttttttccccgttgttgttttggggaagtttggatttgggggcattccctgccc

SEQ ID NO: 9702 - DNA, 938 bp, Triticum aestivum
  Predicted polypeptide sequence is orthologous to G1108, G2394
ggtgccccaccgcaggctggaccggtcctgacttcccgggatatcgtcgacccacgcgtccgtgtgtgcagcgatatgctgctgtttcccatgcttaatttccgttttgcgcctccaagaggatttgggtcaaagtagaggagcggctcaagagctaattgatgcattgccaacctacaaatttaaaccaaaacgaagcaaaaactgggtgcttgatcatgcttcgagctccgagaatcttagtgagggtggcatcctgggcccaggaactaaaaaggaaagggctgtttcttcttaagatgctgtttgctgcctctgcctaactacatactgatatgccccccacctccgcgagggggcgtggcaacaatatgcaatcatgcgcaatgatgcccgacaaaagcctcaacacaaatgcacccatgcgccacccctgccgctaccgcacactaacacgcgcggcgactcatccaacccactagcacaaaccccgcaaagccaacccgcccacacaccaaacgccccgccaacacaaccaacaccacccatcaataccaaccaaacccaagcaatacaccaccccccatgcccttatcgcccccgaatccacccaccacacccacttctcgaccaccggaccgaccaccccccagccaatccacctatcgaacgataattgctctcacacacaaccaaatccaaacgatcccccgactcgccctcccctccctcccactactaacacaggatcgcactcaacctaaccatccgaccacgccagctaagactcctagacgaacactcaccaccaccccccatcgcagaccccgacccccgcatgtcgatgagggcaacgtcaaccacgaagcacgcagtatacgtccatcacaacacgagagacgcacgatcaactctactgaacgcctgcgctcacgccc

SEQ ID NO: 9703 - DNA, 612 bp, Triticum aestivum
  Predicted polypeptide sequence is orthologous to G1129
cttaccatggaggtgtcggtttgctatgcagagaactctggaaggccaaccgtcacagcgtttagctaattctgattcacctgtacaacatttggtctgaccagggcaaaatttgccatccatgctttaagagtacgaaaggaacaagcaatcctatcccgcaagcattgtttttctaacctgcagctatatctctgcatacaagagatatgtgtggtgatggttctgctctaacattctggctgagcttattgacactgccagactgccttggcatgggcatgcaccaaccggtgatatatctggctgaaaggaaatctgatgagttcgtacacagcaatacttcaatcaacaatatattttacttatttacttgcctggcagtatccttcattgatcgatggcgcggcggccatatacccttgctagtacctgattgttctcattcattattgtgcagcagttgctgcttgttcatatccattttttttttcaattcatgccaacatgtacatatttacacagcagagatagttagatttaccgactaacaagtgacaataaaaatatgattgtttaacctagagactactaaaaaaaaaaaaaaaaaaa

SEQ ID NO: 9704 - DNA, 799 bp, Triticum aestivum
  misc_feature (678)..(678): n is a, c, g, or t
  misc_feature (757)..(757): n is a, c, g, or t
  misc_feature (790)..(791): n is a, c, g, or t
  Predicted polypeptide sequence is orthologous to G1142
gccgtctctctcttctcccttccttcgattgcagtccatgtccgaggaacagtagttagttcacagcacaacaccaccgcgccaattagtttgttaagttaggagcttgtgatcaaggcagcaaggcgagaagctgaagctctagctagctctggcgggcatgtttccggcggaggcgtcgttcgccggcgcggaagcggccatgctgccgcccttcttcgtgggctccatgtggcagtcggcgccaggcggcggcgcggctgccttgtccgaggaggacgaggtagccgccgctgcggctgccgaggcagcgcacgaccgcgcggtggcggcgacgcggaaccaccgcgaggccgagaagcgccgccgcgagcggatcaagtcgcacctcgaccgcctccgcgccgtcctcgcctgcgaccccaagatagacaaggcaacgctgctggccaaggcggtggagagggtgcgggagctgaagcagcgcatggacggcgtcgttggcgaggcggcggcgccggcgagccacctgttccccacggagcacgacgagatcgtggtgctcgcgtcgggaggcggcgccggcggcgcggcggccgtgtttgaggcctccgtctgctgcgacgaccgctccgacctcctcccgggcctcatcgacacgctgcgcgcgctccgccntccgcacgctccgcgccgagatggccaccctcggcggccgcgtccgccaacgtgctcgtcctcgcgcgcgacgccggangacacgccgacgacgactactccacatcctccnnaggacggg

SEQ ID NO: 9705 - DNA, 901 bp, Triticum aestivum
  misc_feature (679)..(679): n is a, c, g, or t
  Predicted polypeptide sequence is orthologous to G1145
tgcggccgcgtccccgacctccttcttctcctctgccgcggcctccttcccccgcatcgcgcccgtcgacgccggccccgcgcgccgcgcgctggagcgcgagatgtgctacggccacggcgccgccgcctggcccggggcccccggcgctggcgggggcgccgccgcgcccgtggaccggcgcaagaagcgcatgatcaagaaccgcgagtcggcgtcccgctcgcgcgcgcgcaagcaggcccacgtcacccagatcgagtcggaggtgcaccagctgcgcgaggagaacgagcagctccgcctcaagtacgaccagctcaaggcttcggtggaggtgtcggtgccggtgaggaagacgctgcagagggtgctctcggcgcccttctgatccttcttccttcccgaggggccgagatcgaagcaagcagctgctccagccaccaccgtcactactactactcacatagctagagtgttgcagtagctagcacttactagtaactattaccagctactactacggtgatcatccatcatcgtccctgtaaatccatatggatgttattgtgttcctacttttccttctatcactaggccggccggggttgtctcaatcttattggtcactcaactaaactagaagtggcaatgcgcgaggaaagggaaaaagactcancagcttaatttgtacagcggcagctgctaccagtagtagaactcctaataataatacccggtgtggattagccaggcagcacctggttcttgttttggtgacttggattaatgaattatggggcacttaattacggtaggtctatggctatttggtatacggtggagtacccggaaaaaaaggggggccgtccaatctcccttaagagtggtaaaattatga

SEQ ID NO: 9706 - DNA, 650 bp, Triticum aestivum
  Predicted polypeptide sequence is orthologous to G1145
aattcggcacgaggtgagcctcagcggcttcagctccctcccctccatctccagcactgcccatccgcctgcccgcctgccctccctctccctcagcatcggcaacggtagtgccgacggagaggatcagcagctgggcgtcagcagcgacgacggccacaagagcattcgggcgatgaagaacagggagtcggcgctgcggtccagggccaggaagagggcctacacgcaggagctcgagaaggaggtccgccggctcgtcgaggacaacctcaaactcaagagacagtgcaaactgcttcagtcggagattgctgcactcaccgcccagcaggcaagcaacaagcagagcagcccacacaggagaacctcgtccactcagttctagcaaccgctacatcagggctgcattttcctctagcaagcaattcattagtattagcagtgcacttgtagttggttcttggcctcaatcaactcagctgcccgatcgatatgccagcgcgtggtccgtttatctcatgtgcatttatctgcatgtattgctgtgtgcactagtcagactggatgcctggaccagagcacatgcaacctgcctgcgattaattgtgttgcagagcacctttattaataatgctgaatcgtaatcc

SEQ ID NO: 9707 - DNA, 774 bp, Triticum aestivum
  Predicted polypeptide sequence is orthologous to G1145
gcagaaaagatccaacgcatatataggtttagatcgatcttgtacataggtatacatatgaactgtagacgaaatgtgcacaggtttgattaattttctcctaaatttgtactgccaaaatacgcctgtgctcagcgtcttgggccgtctgatcccctttcagaactgagtggatgaggttcgccggagagagctcttggtaggcaggatgagggcggccacttcccgcttcagctctttgcactgcttcttcagcttgaggttgtcatccaccaggcgccgaacctccttctccagttcctccacatatgccctcttcctggcccttgagcgcagcgcggactccctgttccgcatcatccggatggtcctcgggtcctcgccgctgctgccaccgccctgccgcagctccatgtcgacctcatagccgccaggaaacccgccaaacgagaccggcgtggacggcagcgagcgcgcgccggcgaggaggtggaggtcggtgtcgtcgtcccgcaggccggagatggagaagagggagctgcacccactcatgaggctcagctgcgggctctccggctccctccatgccgcagccgctgctgccgccatctcgtagtgcccgttgccaccgccgccgagccggtagttcgccatgggagccggaactcaagacacctcgattgatcgagctgatcgagcaatcgatctaccagtggtgctgcttttttgtgctgcgtgggtgctgggttaagctaaactaagatgctttggtcg

SEQ ID NO: 9708 - DNA, 554 bp, Triticum aestivum
  Predicted polypeptide sequence is orthologous to G1145
ccacgcgtccgcccgtctactgtctacaccacaccacagtgcgcacaccacacgggggaagcggggcgtagatagggatgtcgtgggaggagcccggcatcccgcagctgagcctgagcggcttcagctccctcgcctccatctccagcaccgccgctccgcccgcccgcctgccctccctctccctcagcatcggcaccggcggggaggaccagcagccgggcgtcagcagcgacgacggccacaagagcgtccgggcgatgaagaaccgggagtcggcgctgcggtccagggccaggaagagagcctacacgcaggagctcgagaaggaggtccgccggctcgtcgaggacaacctcaagctcaagcgacagtgcaaacaggcacgccttcttctccccttcttcttcttcctccagctccatctctctttcttgcttgcttgcttgcttgcttgtgcatgggtaattagttaactcatcaatcccccgcttctttctccatctcctcagcttcagtcggagatgccgcgctcacgcccagcaggcaagcag

SEQ ID NO: 9709 - DNA, 1197 bp, Triticum aestivum
  misc_feature (849)..(849): n is a, c, g, or t
  misc_feature (891)..(891): n is a, c, g, or t
  misc_feature (893)..(893): n is a, c, g, or t
  misc_feature (924)..(925): n is a, c, g, or t
  Predicted polypeptide sequence is orthologous to G1145
aaggcatgcatccaacgcgttgggagctctcccatatggtcgacctgcaggcggccgcactagtgattcgagcggccgcccgggcaggtgttttttttttttttgaaagcagatacagggttcattgaatttaccatgcggctacagaggttacagcagcgaaaacttacagcaagtattagcaagaaacttcgcagtacgatccatacactgggatccgtgccgcaagaatatttgcaacaaccagatttacaaaacctgaaacctaagggccgggaggacatttcacaagattgttgggtgtcctaggcctttacaaattacaagcaaagcaaactgcacacactccatagatacatgcgaggagaaagcaaaagagcgatcaaaatctaccagaagcctgtactctacacacaatcagaatgaggtcgatctcgttctccgaagatgccttttcggttctggagggggcgcggacttcaataacatgtccaactccttctctctcttcagcctcttgttctcctcttccagacaagacagtttgcattcgagctcgtttgtgtaggcctgtttcctagctcttgaacgtgcagccgattctcggttcttgatcatcctcttctgcctccgatcagcaaccttgtataccacatcctgggaagacattctcttacgactaggactttgaagatcagaaagttctagagatgacgaaatactcatttgacgatctgggtagatggaatccattgtcgaagggattgcaacactcaacggttgcgcaaccgactgacgtacaatatacgcatcaattgcacttgttccctgtgggaaatcctgcactcntggtcatcaatgagcactttctcccagtccctacagatcaantnactcctcagcatccttctgatactgcccagnntacatgcagcccttgcagaaactctcagtgtatctccccaacgactctgtgatcacaactgaaactctttccatcatcctactctctcttcctgctgatgtcttccaaattcatcactgtcttctgctcatggcggggcacagtatgctgtgccctgagttcaaaccaaagctgacgtgcttgactgctgattccaggcccattgggtatggagggtctttcaattggaggaggtccttaattgggaaaggttccttaaaagatttaggtca

SEQ ID NO: 9710 - DNA, 1071 bp, Triticum aestivum
  Predicted polypeptide sequence is orthologous to G1145
ctggcttttttttttttttttttttttttttttcttttgcgactttcaaattctcaccgggatctcagcaaaaacagaggtatcggcggacatacgctctgtctggcaaaaacagcaacgaaaagacactttctttgggcatggccacatacatgaccaccatatgatgagatagagacagacataacttaccatgtacaaaggagctctgataaaattaaaacataacctggcagatttacacacattgacaaactctgaaccaccggggtgggacatgctaagggctgctactcatctacaaactctgaaccaccgggctgggacaagctaccaactgcccctcaggctactatcgacgtcaaacaggggcagaacttgttctccggagttgatacttgggttctgggggaggcgcggaggttatcatcatgtccaactccttctgcttcttcaacctctcgttctcctcttctagacgagacaccttgttttcaagctcattagtgtaagcctgcttcctcgctctggagcgtgcagctgattccctgttttttatcattctcttctgccttctttctacaactttatcagttacaccatctgatgcaccacgcttgcgcctaggtgtctgaggatcaaaaagtgcatcgagcatgggtgacgtaatctggccatccgggtaaattggttccatgatagcacctgtagcaacagaaactggctgaagacccaaatgacttgccatgaaagggcctgccatgcttggattctggggcctccaggtactgctgtaaccaatgcgcccccgggtttaaaacggggcgcaggggccgttaccttgctcccaaccgcacccatgttagcgggcaagtcaatcggatcctttcaaatgccctttagacaaaaccccacgcttcccccagaaatccccaagtgtctattcccccaagggtgggtggcttcccggccttcccggaatacctccctaacaatttttttcggggaaatttggtgcccttcacaccctggccaaccgtttttggtaaaatcaggagcctttgtgagtcc

SEQ ID NO: 9711 - DNA, 1083 bp, Triticum aestivum
  misc_feature (23)..(23): n is a, c, g, or t
  Predicted polypeptide sequence is orthologous to G1145
acccagtcgtctcggtggtgctnccgccgtcgcctcctcctcccttccccaatggtaggcgccagactgagccagctctgaccgccgcgcggggccttgatccggcgccaggcggtcgggaatcgcgcgggtgccccgttcaattcgacgcggactccagctgggaggtcggagcggcggagatccggtcgccggacttgcctccaatccgctggtcgccgtcgttcccggaagaaaaatcgaggaggttcgttcgccggcgcgtgctgtgcgcggtctcgtggatctgcggctcggcgacttgtgaccgggtctttgccggtggaaagggggctgctttgggcatcgttgttcccgaggtgtttgtccccataggggcgaccagttcaagagagcgccggttcatgattcaggcaatggcgtcgcaatcgcaggcaggaggcggcggtggcggcggctatgctggcccggggcagcgcgggcaggcgcagggcctggcgaggcaaggttccctgtacagccttaccctcgatgaggtgcagagccagctgacagagcctttgcttagtatgaacctcgacgagctgctcaagagcgtgtttccggacggcgtggatcctgtcggtggcgtcgctggccagtctgagccggccccgggcctgcatcgccaggggagcatcacaatgcctcctgagctgagcaagaagacggtggacgaggtgtggaagggcatccaagattcgccgaagagaagtggtgaggagggtattcggtggaggcgggagaggcagccgacctttggggagatgacacttgaggatttcctggtgaaagctggagtggtcgctgaagggcatttgaaggatccgattgacttgccagctaacatgggtgcggttgggagcagtgtaacggccgctgcgcccagtttgaaccccggagcgcattggttacgcagtccctgaagccccgcattcagcatggaaggcctttcagggaaagtcttgggtcctcaccatgtctgtgcaaaggtgctacatgggacaaattcccggatgccgattactcccaaggtcggtgcca

SEQ ID NO: 9712 - DNA, 539 bp, Triticum aestivum
  Predicted polypeptide sequence is orthologous to G1146
gtacattcatgagccacatcacaagttcccagcaaatgtaccaccaaatcagcaaatgtaccgcctaattaagcagcaagccaacaaaacacacgactcccatgaacttgtcaatgggccgattcaacaatagaacatcacgtccttgacgttatccctgatcctggggaggcgacggtatgtcccaggaggaccagcagctcctgcgccggtggcagctgactcccgggtgccaccgctgacgatcgaggcgctgtccgagccctccgatggctcgtcgtaataccgtgcgcggaacgcagccaggtgagcgtagtaggcaggaggaacaacagagacagagcgagtacatcgagcgtatgtgtagcacaggttgttggtgagcagctgcagcccatcggcagtgaaacggttttcatcgaagaggacatggtagtgagttggtctgcttgtgccctgaatcccggcatggctacacaggtagaaatcaaactcggtgggatggcatatgttggtgtcgaccacggttccaggaagga

SEQ ID NO: 9713 - DNA, 614 bp, Triticum aestivum
  misc_feature (7)..(7): n is a, c, g, or t
  misc_feature (48)..(48): n is a, c, g, or t
  Predicted polypeptide sequence is orthologous to G1146
tgcaggnaattcggcacgaggcacattatcatgttctgtgggacgagnaacaatttcacggcggacgaaatgcagacattgacaaacaacctttgctacacgtatgcgcgttgcacacggtctgtttctgtcggtaatttcttcttccttctcgcgcccctgctgaatacattttcctctttcgacgtaacaatggtgacaaatctgaagtttggcctttggtctgttgtgttgtttgagcagtgccgcctgtttactatgctcatctagccgcattccgggcacgtttctacatggaccaagatagcctctcggtgaagaatgccaaccggacgaatggaagtgccatgaagactatgccagcggtgaaagagagggtgaagagggtgatgttctactgctgacaggcactcggacatgctatatagctaacactaggaattagaggtttatattagattttagatatgtaggacgggaagagtgaagaactaggtatcttgtcctatataaacttggactatgttttgttaagattgggcacaacatcctccgtaatatagctaatagattggcaatgtcagtccggaaaatgtgcacacataaaaaaaaaa

SEQ ID NO: 9714 - DNA, 711 bp, Triticum aestivum
  misc_feature (17)..(18): n is a, c, g, or t
  misc_feature (684)..(684): n is a, c, g, or t
  Predicted polypeptide sequence is orthologous to G1146
tgtactctctctgatcnntattgattatcgcagattaatgtagtacaatggataggagggagtaattaggatctactcagaaacatgattagtattaaactaaagctcaagctcaatgtaaattgttctgggctcctattcacccatatcaacactttcaaaactgctttagcagaaaaacataacacctttcacattttcactgagaacgggaaaggatccctcatgccctcgtttgatataaagtcgtccccgcgaagccaaaagatgtgcatagtagacaggaggcacaactgaaacagaagaggtgcatctcgcatacgtgtagcataggtggtttgtgagcgtttgcaaagcgttagccgtaaacttgttttcatcccacagaacatgataacgcacaggtcggctcactcccttagtgacagcatggctacacaaataaaaatcaaagtcagtgggatggcatacttctttatcaatcactgtaccaggcagtacatttccacttccataaattgtactcacaacatcatagttatcagaaaacagacgggtatgatgacgtttctgaacgacaacaaaggtaactcgtgggcttttttatggcagaaagttcaacatccaaaacctgattaagctgtccattgctgacaccatccctgtaaaatatgattcttccangtatgcattcagttgcccttctgaaag

SEQ ID NO: 9715 - DNA, 334 bp, Triticum aestivum
  Predicted polypeptide sequence is orthologous to G1146
ttttttttttaaacgcaaggcgtggcttgaatgctctggttttcaagctccaaacctcaaaagtactcgaggttcaacgtttacagcatgacaaagtacacacatagatggtacttaagcaagcatagaccagcatagtagggcgcactgcgacagccgctggcaaattattactactttcttcacataattacaatgacaaggggcgacatgctgacttaaggagcattttaatctccgccttcacgggcttcaacagtaaaacatgacgttcttcacattgtccttgagggctggaaggggcttaacagctgcaccgccgggggcccgggta

SEQ ID NO: 9716 - DNA, 630 bp, Triticum aestivum
  Predicted polypeptide sequence is orthologous to G1146
caattattgaagggcagaggytcaccaggaagcttaacgagaaacaagtgactggcatacygagagcyacgtgcgaacgyccccgtgatagggagaagagcayacttaagayggtggagcacaacaacyattcagctgataagctggcacaggagtttggaatcgatgttacggataaaatggtcaatgtgcaggctcgcgtgctacctccccccatgctcaaatatcatgaatctggaaaggacaaagcttgtgcaccaagtgttggccagtggaacatgattggcaagaaaatgataaatggagggaatgttcagagatggacttgcttgaacttyycacgtttgcayattgatggagtcaaaaggttttgtggcgacttagtcaaaatgtgcacgccatcggcatggttttcaatcctatgccagtggtagaaattctctcagcgtctgccaataacatagaaggtgctttgaagcatgctcaccagagtgcccataacctccagttgcttattgtgattctcccggatgttactggccattacgggaaagttaagaaggtgtgcgagactgaccttggtatagtatctcaatgtctcaagccagacaaggtcgaaagagcacacaa

SEQ ID NO: 9717 - DNA, 584 bp, Triticum aestivum
  Predicted polypeptide sequence is orthologous to G1146
ccacgcgtccgcgctgccgacaaatttccttatcccgtctgccgttccttcacctcgatccccttctctggtccttttctcatctgatccgcttcgcctctactgcttcgcctctcctcgtctccgtgtgattcgccatcaccacctcgccgcttccctactggttgtgacggcggcgctcgctggatggcatggtggaggtggtagagggtggcggaggcggagcagtcgaggtcctcggcgtcgcgcgtgtggtggggcagaaagtggaaggggaagaatgacgccatccagagaaggaggcataggatctaaaagatcgagcctgcccctcacgcaagctcaagaaggagttttccgggtgtgtggatgatagtttgttcagcagcatggaccatgccatgaaattggtgacggcaagactcccagactcatatgacaaaaaggaaggagttacaggagatggaaccactggtggggcggtagaatttttttctgttgagggcgatagtgtgtaagagcaacctttcctttttaagataatgtgtggacatgtatttacttttttggggtgtgtgctccag

SEQ ID NO: 9718 - DNA, 635 bp, Triticum aestivum
  misc_feature (389)..(389): n is a, c, g, or t
  misc_feature (405)..(405): n is a, c, g, or t
  misc_feature (410)..(410): n is a, c, g, or t
  misc_feature (435)..(435): n is a, c, g, or t
  misc_feature (467)..(467): n is a, c, g, or t
  misc_feature (469)..(469): n is a, c, g, or t
  misc_feature (487)..(487): n is a, c, g, or t
  misc_feature (537)..(537): n is a, c, g, or t
  misc_feature (567)..(568): n is a, c, g, or t
  misc_feature (571)..(571): n is a, c, g, or t
  misc_feature (580)..(580): n is a, c, g, or t
  misc_feature (589)..(589): n is a, c, g, or t
  misc_feature (621)..(621): n is a, c, g, or t
  misc_feature (635)..(635): n is a, c, g, or t
  Predicted polypeptide sequence is orthologous to G1146
ttttttttttttttttttgacccttaaaagtactcaaaattcaatgtttatacagcatataaagtacacacatagatggtacttaagcaagcatagaccagcatagtacggcgcacgagacagcggctggcggattattactaccctcttcacataattacaatgacaagaggcgacacgccgacttaaggacatattaagctcggccttcatgggcttcagcagtagaacatgacgttcttcacattgtccttcagggctggaagaggcttaacagctgcaccgccgggggcccgagtaccacgtgacgccgacgagccggacgtcggtccacgcccaccgggcccacttgccatagagccgctgtcggagctctctggctccatgtngaaacgggcgcggaangcggncagatgagcatagtatgcaggtggnacaatcgacactgaccgagtgcactcgcgtangngtacagaggttgttggtnagactctgcaaccatcactgtgactttttcgtccacaagactgataagancggacggtggtcctgatcagatatgacaanngantcaataccngatacagtntctgtcaaacgtctggatatttcacccgtcanggtctacatggatn

SEQ ID NO: 9719 - DNA, 629 bp, Triticum aestivum
  misc_feature (315)..(315): n is a, c, g, or t
  misc_feature (319)..(319): n is a, c, g, or t
  misc_feature (333)..(333): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (382)..(383): n is a, c, g, or t
  misc_feature (393)..(393): n is a, c, g, or t
  misc_feature (411)..(411): n is a, c, g, or t
  misc_feature (425)..(425): n is a, c, g, or t
  misc_feature (457)..(457): n is a, c, g, or t
  misc_feature (463)..(463): n is a, c, g, or t
  misc_feature (467)..(467): n is a, c, g, or t
  misc_feature (484)..(484): n is a, c, g, or t
  misc_feature (515)..(515): n is a, c, g, or t
  misc_feature (518)..(518): n is a, c, g, or t
  misc_feature (521)..(521): n is a, c, g, or t
  misc_feature (526)..(526): n is a, c, g, or t
  misc_feature (542)..(542): n is a, c, g, or t
  misc_feature (557)..(557): n is a, c, g, or t
  misc_feature (563)..(563): n is a, c, g, or t
  misc_feature (572)..(572): n is a, c, g, or t
  misc_feature (580)..(580): n is a, c, g, or t
  misc_feature (583)..(583): n is a, c, g, or t
  misc_feature (586)..(586): n is a, c, g, or t
  misc_feature (596)..(596): n is a, c, g, or t
  misc_feature (600)..(600): n is a, c, g, or t
  misc_feature (615)..(615): n is a, c, g, or t
  misc_feature (618)..(619): n is a, c, g, or t
  Predicted polypeptide sequence is orthologous to G1146
ccgtcttcctctctccctcctcctggtccactctttcccgagatacgtacgagcccaggacagccatgaagttcttcggttcctccacgtccaagaaggagaacaaggggaagaagagatccaaaaggagcggcaacggcggctccttcgcctcgaccgcgtcgtccgtcggcatcagatgaccagtctgttacaacgctgagatccgtcctgccgtcgtcttcgggggccggcggtaccgtccggtcccgggacgaccaaagaaaccggcctgggcgccgtgacgcggctggactggaggttggcgctgcgtanatcntgtcgaccgaggangactggccgcgatgtcnccnaggggangccgctccccctttagggattnntggcgccgangcgcggacaaggcaactnaaggacaatttccngtgtttgaccttacgggacgaagtttccgccnaaggancctncctgttggctcctggcnacaacggtgtcgttgagaatgcgcccatatnggnggngtcanacgacgggacggttcncgcttacagttaccnatatangcttccctnatattatnaantgnctacaattanaaanccacactttctatanagnnaatagttttt

SEQ ID NO: 9720 - DNA, 2511 bp, Triticum aestivum
  Predicted polypeptide sequence is orthologous to G1146
gcacgaggctagacatccggatgagttaaaacgagaccctaacaagtggatgattgacatcgagtactatttgtcacagcagattcatcctgtcgtttctcgtctgtgtgcttcaattgagggtactagccctgcccgactggctgaatgtcttggacttgactcatcaaagttccaatcaagatcaattgggtctagcaatgaggatacgtctaccatgctcttatctgtaattgatgatgaagatgagagatatcgtggctgtgagccactgcgtttatcatgcccaagctgtaccaataccttcgagtgcccccctgtgtccagtctgattgctagtttatcagatccaaatgaaggaaaagatgctactgtgaatttctggcgtcggatgcggtgcccaagatgtccagatgatactgatgagtgcagagtttctcctgctgtgcttgccaaccagataaaaagacaggctgataatttcatcaatcggtattacaaaggtttactgatgtgcgatgacgagggttgcaaatattcaactcacattgtgaaccttagagtgatgggggattctgagagaggaaccatctgcccgaactatccacaatgcaacggccgtctagtaagacagtacacagaggcagatctatacaggcaattgtcctacttttgctatgtacttgatgcaacccggtgtcttgataagttggaccagaagatgcggcttccttttgagaaagagtttgcagtattaaaccaaacaataagctccgcatttctggagattcagaaaatccgagacagatgtgctttcggatgggttcaattgacagatctagcagtgtcaatctgatgagctactgtttgccgtaatctcaagcagtgctgatctgagcatgggccgtgggatattgtgttgttgaaactagatctgttgttgaaggtgaaaggaactggaaaccagatgatggccttggccactagctgctgacgggtttcctggcctgcaaaggatggagttgcccacatcatgttgcatttaaatacaaatgttctaaccagttgtttcagagaccctccttggtgccatccctaattttcgaagtgtatattgtactactgttgtaaatatgttgcatccatcagtcccatggttttgtagtgacatactttgaatactaaatttgtcatcagtcagtttttatcatcttaaaattatcacaatccagatgcttaaaaaaaaaaaaaaagaaatactgtacttgttgatgctttgtcaaggagaattccccttgttagtgacagaccaaccattatatttggtgctgatgttacccatcctcatcctggagaagattctagcccttccatcgcagctgttgttgcttctcaagattggcctgaggtcaccaaatatgctggattggtgagtgcacaaacccgtcgtcaggagttgatacaagatctttttaaagtatggcaagatcctcagagagggactgtaaatggtggaatggttagagaacttctcctttcctttcatagatcaactggacagaaaccccaaaggatcatattctatagggatggtgttagcgaaggacagttctatcaggttctgttgtatgagcttgatgcgattagaaaggcgtgcgcatccttggagtccaattatcagccacccgttacctttgtggtggtccagaagcgccatcatacacggctatttgctaataaccacaacgatcagcgaagtgttgatccaaaaagtggaaacatactgcctggtaccgtggttgattcaaagatatgccatcctaccgagtttgatttctacctttgtagccatgctggtattcagggaacaagccgccctgcgcattaccatgtcctttgggatgagaacaattttaccgcggatggtttgcagactctcacgaacaacttgtgctacacctacgcaaggtgcacccgttctgtatcgattgtgcctccggcatactatgctcacctcgccgcttttcgagctcggttctacatggaaccggatacctccgacggtggctcggtcgcgagcggtgccacgacaagccgtgcccctgctggtgcacgctgcggtagagctgcagggaatgctgctgttaagcctctgcctgacctcaaggaaaacgtgaaacgtgtcatgttttactgctgagtttaggatcccaactgaattacatgttgatttgccaatcctttctttgcggcagaaaagcaatcctcattcatcacatgagtgtatcagtgctgccatgtttcctgtgcaacctgaacatctcaattcctcttcgccccctacagattttcaaatgacattgccctgtttgtcttgaccacattattggcctgcacattcaaacatccgtccagatttgtaactttggaggttccatgtaatgctacgacgaagaccctatataatatttccccacctttttttttaaaaaaaaaaaaaaaaaaaaccac

SEQ ID NO: 9721 - DNA, 791 bp, Triticum aestivum
  Predicted polypeptide sequence is orthologous to G1146
ctcgtgccgaattcggcacgagaacttcctcaaatacgcaacgcatgccgcctgaaatatcctgcaaccgacaccaaacgagggctccccaggatcacaattgttgtctgtggtaaacgccaccacactcgattctaccctaaaaacagcggtgacgctgataaatcatcgaatttgatggctggaactgttgtcgatcgtggcgttacagagactcgaaactgggacttttacctacaagcccatgcatgtcttcagggaacagcccgtgcctgtcattactatgtgataatagacgaaattttccggtccaataaggttaagggtggtcacaaaaatcacgctgatgcccttgaggaattgacaaacaatatgagtcatctgtttggacgagcaacaaaagccgtcagtctttgtcctcctgcttactatgctgatttactctgcacaagggtacgctgctacttatctgaagttttcgacccaagtgaggcccagagtgtgatgagtggcggcaccaaccaaacgatcgaggacattgttattccgccgagtatgagggattccatgtactacatctaagctcattgcatgagaatgagaatcattaaaccataaccttcggtgttagttacagaattagctgtgtcaagtcattatagacgaaataccatttctgtattgtagactttgcgttccgaaatattttatgcacacgcaaatgtatagccaaaaaaaaaaaaaaaaaaaaaaaaaaaaaaaaaaaaaaaaaaaaaaaaaaaaaaaaaaaa

SEQ ID NO: 9722 - DNA, 690 bp, Triticum aestivum
  Predicted polypeptide sequence is orthologous to G1146
ccacgcgtccggtaacgttcctccaggtccaccaagaacagttcccgagctgcaccaagccccgtatgtccaatatcaagccccggtggtttcaccatccgcatcaggagctggctcatcctctcagcctgtgtcagaggtgagcagtggacaagtccagcaacagtttcagaaacttgcgattgttgatcaaagttcaacaagccaatccagtcaactggcaccagcatcaagcaaatcagttagatttccattgcgccctggaaagggtacacatggagataggtgtgtcgtgaaggcaaaccatttctttgctgagctccctgataaagaccttcaccaatatgatgtctccataactccagagattacatcacgtggtgtcaatcgtgctgtgatggcagaacttgttaggctctatagacattctcaattggatggacgcctacctgcgtatgatggaaggaagagcctatatacagctgggccattgccatttccttcaaagacatttgaaattactctgcatgacgaaaaagaaagccttgttggtggtcaagtcgcaccaaggcgtgagagacaattcaggttggtgatcaaatttgctgctcgtgctgatctccaccatttggatatgttcctaaatggaaggcaaactgatgaaactcaagaaactcttcaggtgcttga

SEQ ID NO: 9723 - DNA, 706 bp, Triticum aestivum
  Predicted polypeptide sequence is orthologous to G1146
agatcccaacatgatcatatagactttcaaactaacaggtagaagtccttcccaaaccagaaatgatttcaggggtagttcaaatacgaccacagataggtagatggttacacagagtttcacacggtacaacaatgaaagtttgcatggcggtgttctcccagcgccaccaatgcagtgcaaatacttttaacacacccaaactcagtcgaatatcttcaggtttgcatattagggtgaacaataaccaccacgaccttaacagtaaaacatgacccgcttcacgttttccttcagggcggggaggggcctgacagcaacattcccaaacggcctggtattgcgtccaccctgtggagggccacgggcaccgcttgccatggacccactgtcagaggtatccggctccatgtaaaacctagcccggaaggctgccaaatgtgcataatatgctggaggcacaattgatacagagcgggtgcacctagcatacgtgtaccacaagttgtttgttagagtttgcaactcatcagcagtgaatttgttctcgtcccatagaacgtgataatgagcaggacggttagttccctgaatgccagcgtggctacacaagtagaaatcgaactcagtcggatggtaaatctttgaatcaacaaccgtgccaggcattatgtttccacttctatcaacagtacgctgatcattg

SEQ ID NO: 9724 - DNA, 1152 bp, Triticum aestivum
  misc_feature (859)..(859): n is a, c, g, or t
  misc_feature (882)..(882): n is a, c, g, or t
  Predicted polypeptide sequence is orthologous to G1146
agctccaacgcttcccgagctctagcaatggtcgacctgcaggcggccgcactagtgattaagcgtggtcgcggccgaggttttcctttttttttttttttttttttttaatttattcaagcataacaaaaaaaactaatatccagcacatttcagaaacacgttgaaaaaatggcacatgataattgttgtggctaattcaaaacagaaatggatacatttgaaatggaacttcaattttcaaatgtaaatacaatttttcaaattaaaacaagtacgtttagacaaagctcggcaataatttttcatttcttcaactccaccacaaccacttgaaggccctgcgctttagcagaagaacatgccacgttttttcacattgtccttgatatcaggtagaggattgatgaatggtttacaggatatatcgatatttaatgaaattcccatctgtgtgttttgtattgtctgataaaaaccacagcagtttttcaagccctcgtcaggttgagatttataaaatgaccggccaactaggcaataccttccaaggaacaattcatgtagaatagtattaaatgcttgatagaattcttcaccatcaattcgtccgaacaaaactttatccaatgttatctggaccctaaaatgtctcttaccccttgggaggccacaaagaatattttcctggtcaggtagtgttactttaaaagcctcacaagtaaatggaaatggacgagatgtatataagcttttctttccatcatatgcaggaagacgaccacccaaacgtgattgcccatacagctttgcaagttgtatcatgacatcaccagctgaagtaggcttaggatctatnaatacatgatatcggcaaagagnttcattataagttagtttaaaatggttggccttcacatatagctttcaccagcagaaacgaatccagggcgcttttagcttcggcggggacaaattttggagttaaggattgaccatggactgtactgatggcccaaaactatctgcctcgggaccacattgaatgaacggttattcttctcacatgggacaaacctcgccacaacacacggtgatcgccccttccaccgctaccttccggaggaaaatcaaaacggtcgccaatttaca

SEQ ID NO: 9725 - DNA, 917 bp, Triticum aestivum
  misc_feature (14)..(14): n is a, c, g, or t
  Predicted polypeptide sequence is orthologous to G1146
aaccgccacttgantgatgacgccacgctattcggtggactactatagaatactcaagctatgcatccaacgcgttgggagctctcccatatggtcgacctgcaggcggccggactagtgattagcgtggtcgcggccgaggttgcggggcgtcaaagtcgaagttactcaccgggaaaatgtaaggcggaagtaccgcatttcgggggtgacagcacaaccaactcatgaactcatcttcccaatcgacgatcaaatgaatatgaagtctgtcgtagagtatttcaaggaaatgtatgggtttactattcagcaatcacatcttccttgccttatggttggcaaccaaaagaaggcaaactatctaccaatggaggtctgcaagattgttgagggtcagagatacacaaagaggttgaacgaaaagcagatcacatcactgctaaaggttacatgccaaaggcctagagaaaaggaaatggatattctacagacagttcatcaaaacggatatgaccaagatccttacgcaaaggaatttgggatcaacataagtgtgaagctaacatccgttggagcgcgcgtccttcctgcaccttggctgaaatatcatgatgctggaaaggaaaaggagtgcctgccacaggttggtcaatggaacatggtgaacaagaaagtgatcaacgggggcaaggtaagccactgggctttgtataacttctcgaggagtgttcaagaaacaactgcacgcggattctgcccagagttggcacaaatgtgtcaaatttcgggcatgggatttcacagtgaacctgtgctccaaatatattcagctagaccagatcaagtagcgaaggcactaaagcatgtgtataatgtagcactacacaaactcaggggtaaggacttgagcttct

SEQ ID NO: 9726 - DNA, 1049 bp, Triticum aestivum
  misc_feature (13)..(13): n is a, c, g, or t
  misc_feature (849)..(849): n is a, c, g, or t
  Predicted polypeptide sequence is orthologous to G1146
cgacccacgcttnccgctgggcctgtgtgatttttcacgcatgcgtcctgaggcggtacacaggttctgttgtgatctgattcagatgtgcaatatgactggaatgtctgtcaattcaaggccacttgtagacaaccgatcagcgagccccaaccacattgagaatgctttgagagatgtctacaggaggacaacggaaatgctttccaagcagggacacgaaaaacagctacaactgttaattgtaatcctacctgaaatcagtggttcttatgggaaaatcaagaaggtttgcgagactgaccttgggattgtgtctcagtgttacctgccaagatatgctgccagaccgaacaagcaatatctggagaatgttgcactcaaaatcaatgtgaaggtcggactgccaccttccattgagaaggcctttgctcgatttggtgttcctgctgttacaaaagtcccaacaatcatctttggtgctgatgttacacaccccccacctggagaggactccacatcatctattgctgtggtggtggcatcaatggactggccagagatcaccaagtacagaggtcttgtctctgctcaaccacacaggcaggagataatcgaagacctcttcagtgtcagcaaagatccgcagaggggcaatgtcaatggtggcatgatcagggagttactgattgccttccgctggaagacaggccggaggcctgagaggatactcttctacagggatagtgtgagtgaaggccagttgagcactgtacgttttcatgaaatgaatgcaatcaggaaggcctgtgctgctttggaggaggggtatatgcccaaattatatantatggctctgataaatgacactatactcatgctcggttgcaccggtggggtctctgttgtcccaccgggggtacaacgcggattttgcggaattccgtccgggctattagttggaaggggacagctcggacggcgggtaacccccaggaacagcaggaagaaggcgaacctgggagagggccctgtgaaggtgcaattaa

SEQ ID NO: 9727 - DNA, 709 bp, Triticum aestivum
  Predicted polypeptide sequence is orthologous to G1146
gatggagtgagtgaaggccagttctaccaagttctactgcatgagcttgatgccatcagaaaggcatgcgcatcgctggaagcaaactaccagccgctggttacgtttgtcgtggtccagaagcgccaccacacgaggctgtttgcgcacaaccacaatgaccagagcaccgtcgacaagagcggcaacatccttcccggcactgtgattgactccaagatctgccaccctacagagtttgatttcttcctgtgcagccatgccggcatcaagggcacgagccgccccgcgcattaccatgtcctgtgggatgagaacaacttcactgctgatggactgcagaccctcaccaacaacctttgctatacttacgctaggtgcacgcgctcggtgtctatcgtccctccagcatactacgctcacctggccgccttccgcgcccgcttctacatggagccggacagctccgacagcggctccatcttgagcgcgcgcaagtccggctcgtcgacgtcccgcagcacccgcgccgccggcgccggggtcgtcaggcccctccctgcgctcaaggacagcgtgaagaaggtcatgttctactgctgatgatgctccacaatctactgctgccctaataaaaaggctccacgcctgctcacctgcaccttaagtgatgaattcactgaaggtgttgttgcaccgatacttaagt

SEQ ID NO: 9728 - DNA, 881 bp, Triticum aestivum
  Predicted polypeptide sequence is orthologous to G1146
acgcttgaccttaggcctatttaggtgacactatagaacaagtttgtacaaaaaagcaggctggtaccggtccggaattcccgggatatcgtcgacccacgcgtccgctgggcatgtattaacttctctcggaatgttcaagataatgctgccaaggttttctgtcatgagttggctataatgtgccaaatatctggaatgaactttgcacctgaacctgtgctgcccgtacttagtgcgaggcctgaacacgtggaaagagcactgaaggcacgttatcatgatgccatgaacgcaagcaaacccccgggcaaagaacttgacctgctaattgttatactgccagataataatggttctctttatggcgaccttaaaagaatttgtgagactgaacttggattggtatcccagtgttgtcttacaaaacatgtttttaagatgagcaagcagtatcttgcaaatgtagctctcaaaatcaatgttaaggtggggggaaggaatactgttcttgtggatgctttggcaggaggattcgccttgttaccgacagaccgaccataatatttggtgctgatgttacacatcccccaccctgaaagaagattctagccccttccaattgccagctgtggttgctttctcaagaactggccctgagataacccagtaccgcaggattagtgagttgcccaaaccccttaaggcaaagagctgaatacgggatcctttttaaaagtattggcaaagatcccccaaagaagggaacctgtttactgggttggcaatgaatccaagggaagcttcctcattattcttttcaaagaagggccaacttggaacaaaaaccctcccgaaagtattctttatttttaacgggg

SEQ ID NO: 9729 - DNA, 851 bp, Triticum aestivum
  misc_feature (757)..(757): n is a, c, g, or t
  Predicted polypeptide sequence is orthologous to G1146
acgcatgacattaggcctatttaggtgactctatagaacaagtttgtacaaaaaagcaggctggtaccggtccggaattcccgggatatcctcgacccacgcgtccgcagatcttgggctagtctctcaatgttgtcttgcaaagcatgttttaaagatgaaaccacaatatcttacaaatattgcccttaaaatcaacatgaaggtggggggaagaaatactgtacttcttgatgctgtggtagggaatctcccacgtgttagtaacacaccaactattatatttggtgccgatgtcagtcatcctcatcatggagaaggacgttctagtccttctattgcagctgttgtagcttctcaagactggccggaggttaccaactatgctggattagtccggcggcaagcccgtcatgaagagattatacaaggcctttttaacgaaaatgattgtggaagtggacgtatatctggtggaatgatcaaagagcacctcatttctttcatgaggtcgactggacatataccccggaggatcatattttacagggatgttgtcagcaaaggacggctcaatatggttattgagcatgaactttctgccattaaaaaggcatgtgcgtcgctggatcctatttataatccacaagttaccattattatggttcagaaacagcaccacacacgtttgttcgctggtaactatggtggtgggagcacatttttgaaatggaaatgtattgccaggtactgtggntgataaaagaatatgccatcccactgactttgatttttacttgtgtaaccatgcctgcactaaggaagtcgcccggcctgttcgtatcatgttc

SEQ ID NO: 9730 - DNA, 1062 bp, Triticum aestivum
  misc_feature (792)..(792): n is a, c, g, or t
  Predicted polypeptide sequence is orthologous to G1146
gcgacccacgcttccgcgaccgggagcgtgatataacccagatggtcaaacacaatgcttatcaagaggatccttatgcgaaagagttcggcattaagattagcgattgtctggcatcggtagatgcacggattttaccggccccacggcttaagtacaacgagactggtagagaaaaggattgtatacctagagttggtcagtggaatatgatgaacaagaaaatggtaaatggtggcaaagtcagaagctggatgtgcgtcaattttgcccgcaatgtgccggacaagcttgctcgtgatttctgccatcaacttgctcagatgtgccaagactcgggaatggacttcgctctggagcctgttctcccacctatgagtgcacgtccggatcaagtggagcgagctctcaaagctcggtaccatgaggcaatgaacattcttggaccccagcgccgggagctcgatctgcttattggaatccttcctgataacaacggctcgctttatggtgatttgaagcgcgtgtgcgaaatagatcttggaatagtttcacaatgctgttgcacaaagcaggtgttcaaattgaacaagcaaatttatgcaaatattgcactgaagataaatgtcaaggtggggggcaggaacactgtgctggtggatgcattgtcgaggcgtattcccctggtcaccgatagacctacaatcatatttggtgctgatgtgacccatccacatcctggcgaggacagcagtccctcaattgctgctgttgtagcctcccaagattggnccgaggttacgaggtacgcggggttagtttctgctcaggcgcaccggcaagagctgatagaggatttgtacaaggtccgggcagatccacagaaaggaccagtcagtagtggcatgatttaggagctacttatatccttttagaaatcaactggtgagagccctcagcggatattattttaccagggatggcgttagcgagggcccattttaccaagttctgtggtttggaaccaaggcgaaccgaaaagccgtgtgttcccttggggga

SEQ ID NO: 9731 - DNA, 533 bp, Triticum aestivum
  misc_feature (374)..(374): n is a, c, g, or t
  Predicted polypeptide sequence is orthologous to G1150
gtgcaacatagggaaaaaaagagtgaagaagttgcagcatagttttagtttcagcagcccccccttttttaccttctttcccttcacctctcctcaagctgatggcaccgcaccagctgattcagaccacaagaggcgaaggacaaaaaatactaccactactagcaaccccaaggcttcaaaaacagtgtcagatacttagggcccctcctattattaccattaccatatgcattagttactgttagtcgattactcctgctgctactactagtagtaccaccaccaacaaccaccaatactaccaccgccaccaaccccccattgatgtgccaccaagctcctggcaaggccaccgccaatataatagccanctactagtagtagtagttctcatgtaatagtagcacattagggtgcgatgtttagccaaaaagtacagaggaatactaccacaatgtatgacatacactagtggctctgctcgctgtgttgcaagacagtgcaacaagatacggatgcatagctagcta

SEQ ID NO: 9732 - DNA, 380 bp, Triticum aestivum
  Predicted polypeptide sequence is orthologous to G1150
ttttttttttttttttttttaacataaaacaccacaaatccataataataacaataatcctctcagagccggtgagcagtaggtacaggaacgcacacaataaataatactataatagtaataataaactcacaccaatcacactagatcaaatccaccatcaaaaaacctctccaaaccctcagatccatccatccatccgccacgcggaccaaaacaaatgcctcctcttcataaaactatcaccaccgctaacgacacactgctactaccactactactagactgcaggactcccactaccactgtaccactagatctgaagacgcgcgcgcacgcagacgggggcggcgagcccaccaccaccaccacatctcctc

SEQ ID NO: 9733 - DNA, 683 bp, Triticum aestivum
  Predicted polypeptide sequence is orthologous to G1181
ggggaagcttccccggcagaacagctctgccggagccctagattggttccgccaaggttccgcctcgtggcggcggagtttcttcccgaatgcttgcttatgattttttctcggacgaaagatttcatatagaagaagatggggaccggaggcttgccagggggcccacgaggcagggggcgcgccccccagcctcgtggccagggtgtgggccccctctggtattttcttcgcttagtattttttattatttccaaaaatgacttccgtggagtttcaggacatttggagttgtgcagaataggtctctaatatttgctccttgtccagcccagaattccagctgccggcattctccctcctcatgtaaaccttgcaaaataagagagaacaggcataagtattgtgacataatttgtaataacagcccataatgcagtaaatgtcgatataaaagcatgatgcaaaatggacgtgtcactaagcggagaacaatatgtgaaaagctcgtaggcattggatcgctgatggagaattatgccggatgcgattattcatgcaacagttataacatagggtgacacagaactagctccaattcatcaatgtaatgcaggcatgtattccgaatatagtcatacgtgcttatggaaaagaacttgcatgacatcttttgtcctacc

SEQ ID NO: 9734 - DNA, 658 bp, Triticum aestivum
  Predicted polypeptide sequence is orthologous to G1181, G1850
gagggcggttgacccgcgagctggggcagatgaaaaagctgtgcaacaacatcgtgagcctcatgtccaagttcgcctcgagccagcagccggacggcggccccgggtcgctgtcgtccgtagtaaactgctcgggtgagtcggcgctggcgcctccgccgccgctccccgcggggatactggacctgatgccatcctgctcggcgctggccacggccgccggcctcgccgtcgacggcgggccggatacggacgcgaggctgttcggcgtctccatcgggctgaagcgagcgcgagacgaggaagaaggcggcgacgggggggagcttcctaacagcaacgacgacggcgcggacgtgaagccggaggaggcagcggagcggcggcccgagggcggcggcagcgaggagcggcagtcgtggccgatataccggcccaagcccgtgtaccgggcctgcacgggcaggacggggccggctccgggtcagaccaggacagatccaactcgaggtgagtggacgatgttgtagaagcttcgagcacctactaattattaatcaccaccaaataataatactgtaagcatcactagagtcgtgataggatcttgcattactttgctaggctggtggggagctcggctgccccctctacccct

SEQ ID NO: 9735 - DNA, 504 bp, Triticum aestivum
  misc_feature (271)..(271): n is a, c, g, or t
  misc_feature (274)..(275): n is a, c, g, or t
  misc_feature (492)..(492): n is a, c, g, or t
  Predicted polypeptide sequence is orthologous to G1181, G1850
gccggacggcggccccgggtcgctgtcgtccgtggtgaactgctcgggcgagtcggccctggcccctccgccgccgctccccgcggggatactggacctgatgccatcgtgctcggcgctggccacggccgccggcctcgccgtcgacggcgggccagagacggacgcgaggctgttcggcgtctccatcgggctcaagcgagcgcgagacgaggaagaagacggcgacggcgaggagcttcctaacagcaacggcgaaggcgccgacgtntanncacagtgctttgatgtttgatctggcctgggaaggcatctacacggttgtgccattcttaatgtagcatattactgagagtcttgatactgttgtactacgatacatctggtatgttctagtagatgtgattttaagcttgtaaattttctcttctctttgctgcaacattcgttgatgcaaatgctgtcttaagatcgtgaattttgcacgtcaanaaaaaaaaaaaa

SEQ ID NO: 9736 - DNA, 707 bp, Triticum aestivum
  Predicted polypeptide sequence is orthologous to G1181, G1850
agaggagagccgtcgcggcaaccacagacaaacccagctgaaagccgccacaccaccgtgccggttacatgggaggaggccgcggcctggtcaccgggttctacgtctggggctgggagttcctcaccgcgctcctcctcttctccgccgccgtctcctgctagccgcctctgcttctcgatcgatccttgactgatcatatatacatagatacatacaccagcttattattaggtagaggaatctgttaggtgattaagccggcgacgatggccggggcggcggcgcagcagcagcagcagaagggtggtggtgcggtgagggtcggcggcggagggccggcgccgttcctgaccaagacgcaccagatggtggaggagcgcgggacggacgaggtgatctcgtggggcgagcaagggcggtcgttcgtggtgtggaagccggtggagctcgcccgcgacctcctgccgctccacttcaagcactgcaacttctcctccttcgtccgccagctcaacacctacggttttcggaaggtggtgccggaccggtgggagttcgcaaacgagaacttccggcgaggcgagcaaggcctcctctccggcatccgtcgccgcaaggccacggcgacgacgacgactccccagtcctctaaaaccagcggaaccggcgtaacggtcgcgttccctccgccgctgcctgctctg

SEQ ID NO: 9737 - DNA, 887 bp, Triticum aestivum
  Predicted polypeptide sequence is orthologous to G1181, G1850
acgcttgaccttaggcctatttaggtgacttctcaccgggtttgtacaaaaaagcagtctcgtaccgggccggaattcccgggatatcgtcgacccacgcgtccgtttgcttgctgccccgtatagggatttaggaagatcgtgccggaccggtgggagttcgccaacgactgcttccggcgaggctagaagcgcctgctctgcgacatacaccgccggaaggtggtccagtcggccgggcttgctgctgcggctgccgccgccgcggctggggcggtcacggttgccactgcggcgatccctatggcgctgccggttacgcgctccggctcgccggagccgcagctctcctccgaggagcaggttctgtcgtccaactcgggatcccgcggagagctcccgctggccgctccgtccggctcaggctccggcctgggcggcgccgctgccggctcctcgtccggcgatatgggcgaggagaacgaccggctgcggtgggataacgcgcggttgacccgcgagctggggcagattgaaaaagctgtgcaaccacatcgtggagcctcatgtccaatttcgcctcgagcccacagccggacgggggccccggggtcgctgtcctcccggggtgaaactgctcgggccaatgcggagcctggacccctcccgcgaccgctcccccgggggggatactgggaccttggagcgcactcctggctccaacgccgggctcacgggccgcacgcgcctcacccttctcaccgccggtgccgacagacggaccctccaaggccgtttccagtatcctcaactccgggcttacagcgagggcgccgaaaacgcagggacaaacaacggcccaccagggcaagcgaacatttcctcac

SEQ ID NO: 9738 - DNA, 1108 bp, Triticum aestivum
  Predicted polypeptide sequence is orthologous to G1190
tcagagcggccgcccttgtttttttttgtttaggactgcatcactatcacttcgtgctccataaatatttgagataaataataattatagccaccccgcttgattgctcgatgtacaatcgcagtgccgactagctatagacatgcatacagtattcggataacaacttacaggtgactcatcaaactttacctccccttatctttccccaaagaaaaagaatcaactgttgtgtgatcaatagctaactattggatcctcctatatgaatatgacaagataaactatatatattgcttgtttaatttattttgatgactatgaacccctccttgttctatcaaagtgtcgactatgaatcaccctcgcctttccactgggatcatggtcaattcctgtcactggggctgctggttcgtgactatgccttctttgccgaccagagctgcttgtggcagatgaggagcttctccttctcattctccttgttctcggtgtcatgcctgtcgcaggtccatctcatgcccttcgcgatggaggccacggagtcgaggaagtaggggttgtcccggatgatggcgtagccggtcggacgaaggatgcggtccatctcaacaagcacaaacttcatctcgcatctgtgtgattctgcggcgaagaggccgtcggcgtgcagcagatcgtacgtccgtgggtacgtggagaaggcctcgcaccagtcgtggttggtgccgatgagtcctctgtcgtagacgacgccgagggagttgggcccgtaggaggagacgacgttcatgacccacaagggtccttgacgaggctcgcccggaaccttccgaacaaggtgctcatgtccatgaacgttcccgacttgttcgtcccccagcgcgggcaacaccgcccttgtgtggttttaccgccgccttccacttggcccgcgtcgggcttcaagggtgcttgccgcttcgcgccggggaagaattgaaaagccccctcggcccaagcccaaacctttgggggccattgggccagcgctttcccgggggaattgggggttgggcgccggcacaccaagaacccctggggcacttcccaccccggtctaggt

SEQ ID NO: 9739 - DNA, 484 bp, Triticum aestivum
  misc_feature (272)..(272): n is a, c, g, or t
  misc_feature (277)..(277): n is a, c, g, or t
  misc_feature (309)..(309): n is a, c, g, or t
  misc_feature (332)..(332): n is a, c, g, or t
  misc_feature (342)..(342): n is a, c, g, or t
  misc_feature (355)..(355): n is a, c, g, or t
  misc_feature (365)..(365): n is a, c, g, or t
  misc_feature (382)..(382): n is a, c, g, or t
  misc_feature (388)..(388): n is a, c, g, or t
  misc_feature (398)..(398): n is a, c, g, or t
  misc_feature (408)..(408): n is a, c, g, or t
  misc_feature (417)..(417): n is a, c, g, or t
  misc_feature (421)..(421): n is a, c, g, or t
  misc_feature (427)..(427): n is a, c, g, or t
  misc_feature (429)..(429): n is a, c, g, or t
  misc_feature (442)..(442): n is a, c, g, or t
  misc_feature (451)..(451): n is a, c, g, or t
  misc_feature (482)..(484): n is a, c, g, or t
  Predicted polypeptide sequence is orthologous to G1206
ccaagttgaaaagaagatcttgcatatggactgacatattctaaacacagtattacaatctccatcacaacggttcagagatgaatggcaggcatagaaaagtaaactgaaaattgttgcaactcacgtctgacaaaactcgaaagtcaaaacttttcaccaacagaggtatatataggggagccaatatatacatggatcagtgtgcagtgcatgtagtaattaaacacagggcaaaatgtcaatctaacctgtgcagcgcatgcgagatnaaagngcccgcacgacaacgtgattcaatggtcaagncaacgggctcctccgtcctgtancctttgtggngtccgtaaaaatnctgtgggcancgacaccaccattcgcntaaaanggcacccttntcaaaggggnttaaaactnttgnccttangnggggacacccacnttttattcnaaaaaagtctaccctccataaggaaataatnnn

SEQ ID NO: 9740 - DNA, 834 bp, Triticum aestivum
  misc_feature (17)..(17): n is a, c, g, or t
  misc_feature (621)..(621): n is a, c, g, or t
  misc_feature (770)..(770): n is a, c, g, or t
  misc_feature (772)..(772): n is a, c, g, or t
  misc_feature (774)..(775): n is a, c, g, or t
  misc_feature (778)..(782): n is a, c, g, or t
  misc_feature (785)..(785): n is a, c, g, or t
  Predicted polypeptide sequence is orthologous to G1206
tgtacacgacgttaggntgctagctttcatacgacttactatagggaccactttgtacaagaaagctgggtacgcgtaagcttgggcccctcgagggatactctagagcggccgcccttttttttttttttttgcagcgaaatgtactgtcatcatattatttcacaattcatactcactgaatacgagtaaaagagagcacttcaaacaaaaattacaaacacttgaattaaaaactttccatgacctctcttcatgtttttatccatgtttttggtagaaaggaaattaaagattgttcagcaggcttcttcctaacccacaagacaaaataaaacagagtgatgttctcttgtaaaggaaagcttttatttcaagaccacatcgaagaagcaggcatgagggaaccttcagcggcgcaaccactgcactctggtgttgatttggatccaaaaggcagttagatgtcaaagggttgcctcagaatgctccattgttcgcctattctatcgattgtaaacacttttgccaataaataccatccacccataccggtgattctttgttgtcaaaagacaagtggatgttttgtctgtacaagatatccgcaggtctctttanttcttctcctcctctcaggaagtggacaacatcctgacacaacttccactccccctttgtgcatggtcaatcaacaatcttcagcatgcgttcacatattcagtcttcattggatgccatgaacagaatcttcttggggtcactaatangnannaannnnntgncagtatagcctcacctggttttttggcctgattttccttatgatttaaa

SEQ ID NO: 9741 - DNA, 962 bp, Triticum aestivum
  misc_feature (15)..(15): n is a, c, g, or t
  misc_feature (17)..(20): n is a, c, g, or t
  misc_feature (22)..(28): n is a, c, g, or t
  misc_feature (41)..(41): n is a, c, g, or t
  Predicted polypeptide sequence is orthologous to G1206
ttttttttttttttntnnnntnnnnnnnttgtgtaatacgnaccacagctctcagcttaagcctatttaggtgtttctatacaaaagtttgtacaaaaaagtaggctggtaccggtccggaattcccgggatatcgtcgacccacgcgtccgcaggaatgatataaagatccaatgcccggtttgccgtggctgctgtgattgcaaaaaatgcacccttggtcagaccaagggaggtatgcagaaggaatcaccagctggtcaagggaaactaatcaggatcaaaatctgcaatcaccaattttacaagcttttaccattgaaacttgaccaggaacagcttgatgaattggaaatagaagctaaaatacaaggaacaaaattatccaatatccgcgtccaggtagctgaagacgaccagagcgggtcactttactgtaataactgtaagctgtccgtacaccaagtcttgagaagctgcccaagaatgccctttcaagctttgtctaaattgcttgtgagaatatacgcggaagggaatatgtcagtgcagccccccttgaatataaatttacccccccgacttttacaccaacaagtcccttcattaaggatggcagccaacaagttccgcctttcctttgacccggacagccctcctgacctaccccccacctccgcccccctccctgctagcctctaccccgctccgacgctcactccccacactttcctactcctatctgcacttatacctaccctcccgctctctcgagcaccatcccttcgtaaaccatctcccatccgagaccacaaacatccagaggccaacatgaactcgcaaggaagagagcatcatcccacccactgccgccccacacccatccccccccccagcccatctgtcacaagccacgtcccgatgcccagccacacagcatagcctatactctaccctatgta

SEQ ID NO: 9742 - DNA, 793 bp, Triticum aestivum
  Predicted polypeptide sequence is orthologous to G1229
caaccaggctcgtgatggtaccacgtcagtgaaccgccacctgtcgatgttgacgcagtgacggactcgtcaaatcagccccgttagtttgaccagacagcgacgatttccgtcaggtaagtccgcaaggaggaaccttggcaaccaaggcggcagcagcagcggcgaaccaagtcagccaagtaactgacatgtgcttaatctccacgcatcaaggaccacacgaagcttcccagccttcgtcccggggcaacacgcgccatgccttctcggcttctcctccctataaatgcagagccaccaccagagcatcacagcaacacaagctgagcctacgcaaagatcgagcgagaaactaaaaaaaagcgagggaaatatggtgctgggcatgaactgcttcggcgcccctgaagccgcaagcaaggtgtcgccggcgggcaggcggctcggcggagagggagcagaggccaaggagcagaaagcggcggcgaaagaggaggccgcagtgaaccgtgccgtcggcgaggcgaatgagatgggagccgatcaggtgaaggctgcggggaaggaggtgcacaagaagaagaggagcggggctccaatagtgatgcaccactttcccttccattctcgtcccgggctgctctgatctcaaactcctactactagcatggccactgcaattttggtgaagcttctgtcggcattctgccggagagttcgcatgttttgtgagggctagattatttgacgagcattgtagtagttctatcttagaattgtactctcttcg

SEQ ID NO: 9743 - DNA, 851 bp, Triticum aestivum
  misc_feature (23)..(23): n is a, c, g, or t
  Predicted polypeptide sequence is orthologous to G1242
ttaacccacccttgtttagtggncttacatacgacgttagattgggaccactttgtacaagaaagctgggtacgcgtaagcttgggcccttcgagggatactctagagcggccgccctttttttttttttttttcatactatttgtgaacttttaaattcatcattaacaacacttacacatgcaaggtgtacatgacattcacgtgtaaacatcacactcacgttattgggcacaaaccacacaagattttaaatgcatattagtatataagctaataataagttgtagaaggataattaccacgtacgattgcaagcgaagtgacgtatgggtgatgaccacacatgcacacgttcattcgttccctcgcggtgatcgatcaaaaagccacttcggccttggcaaactcctctctcttctggttcacgtcggccaccatcttgccgaacctgcacggcgggctgaccaccggcaccgtgccagcgcatatgccacacggacccttgcaatatgctatgtttcatgtctcgatttttggaaattacggttccacttttctcgggtgcaccgccaccctaaccgtctggcgattctggttccacatcggtatagaccggtgccgtcgcctgccacaaagggccccgttgcatgtcgtgcagtgccatcacttgcttttctcgcggcatgcacgacgcgcggagacactctattgcagttgcgggagtcggaatcggcgtgtgacaatggggcccattcgttccgcgacatttttgccctcttggcgccgacagtcgtattcaaatgtttcgcattgccccgaagacaagactacggacggcggaccttagg

SEQ ID NO: 9744 - DNA, 1081 bp, Triticum aestivum
  misc_feature (820)..(820): n is a, c, g, or t
  Predicted polypeptide sequence is orthologous to G1242
tactacgacccacccgtccgggaggcttaaatctgatgtcgaaaagggtttacccccaaagaaagaattatccttaaagttgggatgtctcagatgcaaaagcagtactatcgaggtctgcttcagaaagatttggaggttattaatgctggtggtgagcgtaaaaggttgcttaacatagctatgcagttacgaaagtgctgcaaccatccatatttattccaaggggcagaaccgggcccaccttacacaactggtgaccatcttattgagaccgcagggaaaatggttctgttagataaattgctgcccaaattaaaggaccgtgactccagagtgcttattttctcacacatgaccaggcttttggatatcttggaagattatcttatgtacagagggtatcaatattgccgaatagatggaagtacaggtggagaagatcgtgatgcatccattgatgcatttaacaaaccaggaagtgagaagtttgttttcttgctttcaaccagggctggtggacttggtatcaaccttgccactgctgatgttgtgattctttatgatagtgattggaatccacaagctgatcttcaagctcaagaccgcgcgcataggataggtcaaaagaaagaagttcaagttttccgattttgcaccgagtataccattgaggaaaaagtgattgagagagcgtacaagaagcttgcattggatgctttggttattcaacaaggacgattgtcagggcagaaaactgtcaataaggatgacttattgcaaatggttagatatggtgcggaaatggtgtccagttccnaggatagcacaataacagatgaggatgttgacagaattatagctaaaggagaagaggacaaagcagcgctggatgcaaagatgaaaaaatcacagaggatgccattagtttaaaatggatgacactgctgaattgtatgattttgttggtgaccaggaggaaacgagggttatttaagaaaaattgtgctgagaatttgggtgttcacctacttgggaagaagggataggatttcaatgggtttgatcctcacccacccca

SEQ ID NO: 9745 - DNA, 579 bp, Triticum aestivum
  Predicted polypeptide sequence is orthologous to G1246
atcgctgcttatctactcgataacagagagagagagaagaaaaagaagatggtggcgattgttttatcaactgttacagctgtcttttttgacatttggaaagaccgccacttgtggcgtcccccgcttcccctccctcccttgttcttatccagaacgacgtattgaaaaatccggccaccgacccaccgaccaccggcacctcgccgccctcaccgacgcggcggagctcgctagggggacaggtggacacgattgagttggttgtgctgaatctgattgatcatacgccggctggccgctctccggagactagctgcatggtcgacgggttgtggatgactggaagcagccgctgcttcttctcgctgcttggctgcttcactcggcgtcggaggtgtccgggctcggcgcctggttgagatccgggttcttggcgcgcccgttccacgccgtccgctgctgcttcacgtggcggtgcagctcctcagcgtgcggctccgcgtggtggtggtgttggtggagccgctgccgctcccggtggtgcgcgggcgcggcgaccatggtggtcatgccggc

SEQ ID NO: 9746 - DNA, 612 bp, Triticum aestivum
  misc_feature (421)..(421): n is a, c, g, or t
  misc_feature (535)..(535): n is a, c, g, or t
  misc_feature (561)..(561): n is a, c, g, or t
  misc_feature (566)..(566): n is a, c, g, or t
  misc_feature (569)..(569): n is a, c, g, or t
  misc_feature (591)..(591): n is a, c, g, or t
  Predicted polypeptide sequence is orthologous to G1255
tttttttttttttttgaatgcaccatataccgtaataactgaaaaaggaaagtaactaaattacgagcagtttcgacgagttgttttgtgtgtgtgcgcgcgcgccatgcagcctgcagagccatgcatgcacaccgacagcattgcacgatcggcagctacgcgacgcacgccgtggcgatggcgacgggcacgccgcctccggcgccgttggcccgcttgacgaagcggcccttcatccgcggccgcttctcggcgttgagcttgcgcacctcgtaccggatcttctttgagaagagccgcgtccgccgcttctcccggtaccgcgacacccgcgcctccctgccgccgtccatcctcagcctcggcgtccccaacccctccccgccatggccaaccactcctcccatcatccaagcgncctcctgcagcgagtagtaatcgtgtggcagcatcatcgagcttgacgtgcggctctcgccgtcggccacggcgagtcccaagtctcatgatggctcgtagttaaatgaggcangtcccgggggacgggcgtccgacggnacgcnctncacgtctctccgggtccaacgngatccaaccaatcatgtcaaa

SEQ ID NO: 9747 - DNA, 621 bp, Triticum aestivum
  Predicted polypeptide sequence is orthologous to G1255
ccacgcgtccgacggagtagctagctggtgctggtttggtgcggcgcgcggggcgccagcggcttgggttttcatttgatgagctgctcggggaaggcggcggacggcgcgatggggagcaaggcggcgcgggcgtgcgacggctgcctgcggcggcgggcgaggtggtactgcgcggcggatgacgcgttcctgtgccaggggtgcgacacgtcggtgcactcggcgaaccctctcgcgcggaggcacgagcgggtgcgcctgcggcccacgtcgccgctgctccctggtgcggccccgcgggagaggcgccgcggcgacgaggtcgtgccggcgtggttcaagcgcaaggcgcggaccccgcgctcgcaggccaagagcgtcgggcgtctcctctcgaggcggctcgtcgtgccggaggcgtctggcggggactcgccggaggagcagaagtgtgacgtggagaccgacgaggaggagctgctgtaccgcgtgcccatcttcgaccccgccctcgcggagctctgctcgccgctgactctcgaggaagcgacgaaggccgtcgcgtcatgctgcaatgaggatggtgccatcgtcaaggaaccgaaaaagccagctgcg

SEQ ID NO: 9748 - DNA, 679 bp, Triticum aestivum
  Predicted polypeptide sequence is orthologous to G1255
cgcttctcggcgttgagcttgcgcacctcgtaccggatcttctttgagaagagccgcgtccgccgcttctcccggtaccgcgacacccgcgcctccctgccgccgtccatcctcagcctcggcgtccccaacccctccccgccatggccaaccactcctcccatcatccaagcgccctcctgcagcgagtagtagtcgtgtggccagcagtcatcgagcttgacgtgcggcctctcgccgtcggcccacggcgagctcccccagttctccatgatggcctcgtagtttagattgagcgcgaagctcctcggggtgaactgggcgtccgcactggcaccgctgcttgcagcgttctcgtccggtgtccccagcggcgagtcgtagtcgaagtcgatgtcgaacatatcgccggacacctccggcttctgctcgaggccgcacgctcgcatggggtcgatctccagcttgactcgcccgccgtctacgtccatcggctcgatgaggcccaatgcctccatgcagaacggttcctcctcgtcgccgtcgtccatgcccggccggccaagaagggcctccatgtccgcggcgaactccatgagctcggcgtccgtcgggcccaagtttacgaggctgtcggagaagaactgaaccggcgccggagtcggcgtcgcagctggct

SEQ ID NO: 9749 - DNA, 1057 bp, Triticum aestivum
  Predicted polypeptide sequence is orthologous to G1255
attccagagcggccgccctttttttttttttttcgcaacctttacaccagcagaaaatacctgatttctagacttacaaataagcacattgtgattgtgattcagagattgtgccctgctggttcgaggctacccaacacatcaggaatgaaaggctggaaggcatgcattgacatacaccaactaggcttgatctccctctaccattctcagttacaagtccttacccaccctaactctattgtaccatgaatgtatctcctacgttttgagatcaacatctacagtacaacctttgtaatcagtacaacttccttacaaaaacgacgaaagtaacaacaacaacaacaataaccctaaaccatggaacgtatatacagatgcttgcagtacatagctactacttactttgcacatgaaattctacgagtgtatattcagtcgtacgtacgtggtgagggcgtcctatttcacagaggtttctgctcaaaactagcaagaaagaacgagctacgtaggtgaagtgtattttattagcggattatcgttcgagcggcggcgaggacggtgcatgcacaggcgtgcatgcatgcggctgcatccacggacgaacgatcgagcgcttgctttcaaaaacggaagcgcccgtgcgcgccgccgtggccgtggcccgcgagcaccatcggcggccgcggcggcagaggtggcagcgcggtgcgcttgacgaacccggccttcatcccggggcgcttctcggggttgagccttgccacctcgtaccggatctcggacgcgtgggtcgacgatatcccgggaattccggaccggtaccacccctgttttttgtacaaacctgttcctaaagggtcacttaaaaagccctaatggtcattaccggttcccggggtaaaattgttatccgtcccggggcctagggtaaattccgaaggctcgcctcgtccccggggtttttctatggagggccaaaacagcggggatggggtttcccaggggcaatttgacggttcactaaaaccaagcctctgtttttttaaac

SEQ ID NO: 9750 - DNA, 869 bp, Triticum aestivum
  misc_feature (847)..(847): n is a, c, g, or t
  Predicted polypeptide sequence is orthologous to G1255
ccgcttgaccttaggcctatttaggtgacactacagaacaagtttgtacaaaaaagcaggctgccaccggtccggaattcccgggatatcgtcgacccacgcgtccggttaagcgctcgcttaactctactgagctagtgtcagcggggcaggcgccagggtgcctagctcggtcgcttgagtccgacgagatggcgagcgccggcgcggcgatcggggcgcgcgcggcccgcgcctgcgacggctgcatgcggcggcgggcgcggtggcactgcgccgcggacgacgcgtacctgtgccaggcgtgcgacgcctccgtccactcggccaacccgctcgcgcggcgccaccaccgggtgcgcctcccctcctcgtcctcgccggccgccacctcctcccttcagcacgccgacccggacgagcccgcgtggctgcacggcctcaagcgccggccgcgcacgccgcggtccaagcccgggatggtgggcaagcacggcgcgcccgccgccgcgaaagccgcggctgcctcggcggtccccgatctcgaggcggaggactccggctctgggatcgtcggtgaaaacgaccacggccacggggtggaggccaaaaagaaggatctcctgggcccccttcccgtggttacacccccctgctcgctatattctacacccccatgccggggcgaaccatttcccttagcccccccaaagcgaaaaactttgccgtcgggggggtcttcaccggcctagggcgggtatcccgttcttagctcagttgcattcctagcggcggccggcgagcaggccgaacgagctgaactgcgggacatcatcgccgccgtgcnaccagaccgcactacgcccccg

SEQ ID NO: 9751 - DNA, 849 bp, Triticum aestivum
  misc_feature (14)..(14): n is a, c, g, or t
  misc_feature (792)..(793): n is a, c, g, or t
  misc_feature (799)..(810): n is a, c, g, or t
  misc_feature (812)..(814): n is a, c, g, or t
  misc_feature (817)..(818): n is a, c, g, or t
  misc_feature (821)..(822): n is a, c, g, or t
  Predicted polypeptide sequence is orthologous to G1267
aaccgctagtgcgntaaggcctatccaggtgacatagtataacaagtttgtacaaaaaagcaggctggtaccggtccggaattcccgggatatcgtcgacccacgcgtccgtacgcgtccagaggctagatagctccgtccgtccgtgtccgattccgccggggccgggcgtggatacctaggctaggctaggcgaggcgccgccgatgtcggactgcagcaccggcacggactcgccgcgggccgactccgtcgacgagcagccgcccggcggaggccagagcaagcgcgaccacccctcgccgtcgtccccgctgccgccgcccaagcgcagccggagatccgtggagaagagggtggtgtcggtgccgattgccgagtgcggcgagcgggccaagaccaacggcgagggcccgccgccgccggactcgtgggcgtggcgcaagtacggccagaagccatcaagggatcccctaccccgggggtacaccgctgcgactccaggtgccggagagcgggggccccgagccgcgaccacggtatcgtcactatctagaccacaccgtgcgcgcagacgtgtcccacagtctccggctgtgagccagcgagcgccgcgtgatgcagcggccgacgagcgcgacagacagagagactggcgagcttatcgctgcgaccggggaacacgtacgggggcagagagaactcatttgtcctgcgttcgttccagacgaccggcgctgcgcccctacccttcttgttgtcaaaaagcccccagcgtgtatattatccccnnccgccnnnnnnnnnnnngnnnggnnggnngggggggcgggggggtttgcggggggt

SEQ ID NO: 9752 - DNA, 1016 bp, Triticum aestivum
  Predicted polypeptide sequence is orthologous to G1267
cgtgcgacccacgcttccgcgactggagcacgaggacactgacatggactgaagggagtagaaaattgaaagctgcacccatccatccatccatccgccaccatttccaccatccccccatcactcgacccggccctgtactactacaccccctcctcctccgttcccctcgccctgatagtacactctgttgcggtagccagtgatcatcaccaaagcccagcccacagatatatacgctttcggaaagtgggggttggtttcgctttgagctttttatccggggcagccagtcagccagccagccgccgggccgggacttctgttacgagtccagaggctagatagctccgcccgtatccgattccgccggggccgggcgtggatacctaggctaggctaggcgccgccgatgtcggactgcagcacgggcacggactcgccgcgggccgactccgtcgacgagcagccgcccgccgacgccgagtcgcccggcggaggccagagcaagcgcgaccaaccctcgccctcgtccccgctgccgccgcccaagcggagccggagatctgtggagaagagggtggtgtcggtgccgattgccgagtgcggcgagcgggccaagaccaacggcgagggcccgccgccgccggactcgtgggcgtggcgcaagtacggccagaagcccatcaagggatccccctacccgcgggggtactaccgctgcagcagctccaaggggtgcccggcgaggaagcaggtggagcgcagccgcgccgaccccaccgtgctgctcgtcacctactcctacgatcacaaccacccgtgggccggcgcccaggaacggcttgcacccccaacaggtcctccccgggggctgttggacccccaggcccgagcctggcacgcggggtggagtgccagcccggagcaagggcccttaagcgcccgaagcaaagagccggaaggaggaaattgagccagaagccttgttattggtcttggccgaacccggggga

SEQ ID NO: 9753 - DNA, 531 bp, Triticum aestivum
  misc_feature (310)..(310): n is a, c, g, or t
  misc_feature (325)..(325): n is a, c, g, or t
  misc_feature (338)..(338): n is a, c, g, or t
  misc_feature (375)..(375): n is a, c, g, or t
  misc_feature (403)..(403): n is a, c, g, or t
  misc_feature (433)..(433): n is a, c, g, or t
  misc_feature (445)..(445): n is a, c, g, or t
  misc_feature (477)..(477): n is a, c, g, or t
  misc_feature (486)..(486): n is a, c, g, or t
  misc_feature (512)..(512): n is a, c, g, or t
  misc_feature (517)..(517): n is a, c, g, or t
  Predicted polypeptide sequence is orthologous to G1269
aaggaaggtcagctgtcatggtgctgccacatggttgctgcagaagactgttgaaatgcatattattcttgggatagctcctcagaatgaaggatctcgcggagcgatggaactactagggtacgacgaggataatggtgtattgtttttatatgcggccgcctatgtctacatggttgaactgatgtcaatgcaatccaatgaacttcatctaagcaatctaccaataagtgtcatcctttcacatgtttctatgcaccaaccatcctgggtggacgcaatgggacctgaaatgctgcaagatacgtangatgattgtcctggnaccctggttcaangtgctaaaggtgctgggatgggtcaacaagtgaagtnactatgggggtgctgctgctgttctcanaaatctatcgcgttgcacaatgttggccgnaatgtatataanatgttatccgggaagaacttaatggacaactnttccataangtacaaagagcttttaactaatactnaccanggaaaaaaaaaaaa

SEQ ID NO: 9754 - DNA, 533 bp, Triticum aestivum
  misc_feature (32)..(32): n is a, c, g, or t
  misc_feature (246)..(246): n is a, c, g, or t
  Predicted polypeptide sequence is orthologous to G1272
agtgtaccgtaacgcatctcttgcctcatatnaccggcccctcgtatctccccatacatattttgctttctacaaaaattcgtctggcaaagcaaattccccttcctttgccggctgccatgtttttctactaccttacctgccctgcatatctagctagatggatagatagataaatgttacaagtaaaaaaaaaaggttactgggatgtcgtctgtcttttggcacaaaccacagcaaggcagngccatatgtagtatatcatcttcgttcgcctgtccctcaactggcgaaaccccgcaggaaaccaaaccggctcgaactcgaaacaggtctcttgagggttgctgctgtgcttgaagtgtcctttggcgcctcaggggtaggcactccttccttcatcgaagttgcccggttgatcacagcccttttaggtattgatgtagttccagctagcatactcagtcctgatgctgatatggctgtagacgaacgcaaaaccttaggtggatctgctctaggtgattgagcta

SEQ ID NO: 9755 - DNA, 610 bp, Triticum aestivum
  Predicted polypeptide sequence is orthologous to G1272
agggaggggccacccccgccggagaagaccgccgcgacggaactcgcatcgccggtaggatggacccgcatgatggagagcctgctgctgacgagttgccaccaccaccccctctgcctcccaacgtggtgcccatcatcgcagaagatgctgctgctgctagtgagagcgaaccgcccccaccgccacctccaagcaagccagcaaagcctaggaggcacataatggccaggcctcccaatggcttgggaaagaagggccagcccatccagctgcttgccaaccactacaaagtctctgtcaagccttcagaggagttcttcaaccactactatgttaatctcaagtatgaggatgatacgccagtcgacagcaagggcattggcagaaaggtccttgataagctgcagcacacctaccattctgagctcgcagacaaggactttgcatatgatggcgaaaagagcctctttaccatcggggctcttccacagatcaacaatgaattcattgtggtattggaagacatcggtagtggaaagactgctgctgggagccctggtggtaataacggtagtcctggaggtggtgaccagaagagggtgaggag

SEQ ID NO: 9756 - DNA, 781 bp, Triticum aestivum
  Predicted polypeptide sequence is orthologous to G1272
accggtccggaatttccgggtcgacccacgcgtccgtgtttgtcaatgacgcggtgcaggcagaacagtttgatttgagcatccgcaaagtgttcaccttcagtcaccagattacaggtcttcatattgcagacttgcatttcaatgaagttagctcaatgttgtcccatgccatccctgttcgccttttgaaggtatttggagaagacagttgaaagttgggtggtattagagaacttgtcttctacattcacatcagggagacgtggggtttgaagatagacccattcccattcccattcccattcccatttcttcccaaatcccagcccccgccgtctggcgtcctccgccccgccttcctttttcacctctccccttccatccacctccctaagggcgcggaggcggagagggcggaggcgagagggttccgcatctccgggcgagctctggaaggtacctgattatggcggctaaaacgggtggagctgtacaagtgcataagaatgacactgttaaacgcacagcaatggcacggactggcttgggccgtgaaggaaagcccattaggttgctgtcaaaccactttgctgtgaagcttagtgggattgattcggttttctaccaatacagtgtgtccatcaaatctgatgacgatcaggtggttgaaggcaagggcattggccggaaggtcatcgataaaatgttgcaaacatacagttctgagcttgctggaaaggattttgcatacgatggcgagaaatgcctatttactgtt

SEQ ID NO: 9757 - DNA, 1565 bp, Triticum aestivum
  Predicted polypeptide sequence is orthologous to G1272
actcgaatatgaggaccctcacactgtaattgaagagagcccgtcactgagacgagctccggtggcacgaagagtggaggagatgtttgcccagataaaggccaagctacctggagcacccttgtttcttttgtgcctcctccctgagaggaagaactgcgaagtttacggtccttggaagaagaagtgtcttgctgatttcggcatagtcacccaatgtctagctccgcaaagagtcaatgaccagtacttgagtaatctgctactcaagataaatgctaagctcggtggactcaacacactgcttcaaattgaagcagcccgtgcaatacccattgtggggaaggtgcctactatcatcctgggcatggatgtctcgcatggtcaacctggccaatccgacaggccttccattgctgcggtggtgagttctcgtgagtggcctctcatctctaaatacagagcaacagtgcacactcagtcacccaaacaggaggtgatggcttccctgtttaagccacggggagctgaagatgatggccttattcgggaatctcttattgacttgtacactagctctgggaagcgaaagccagaccaagttattattttcagggatggagttagcgaaagccagtttactcaggtgataaacattgagcttgagcagatcattgaggcatgcaagtgccttgacgacaagtgggagcccaagttcacggtcattgttgctcagaaaaaccatcataccaggtttttccagacaaactcgccagaaaatgttcctcctggcactgtggtggataaacaagtgtgccatcccaagaactttgacttctacatgtgcgcgcatgctgggatgattggcacgtcgaggccaacgcattaccatgttctgcatgatgagatcggcttcagtggggatgagctccaggagtttgtgcactcgctctcctatgtgtaccagaggagcacgacggcgatatcagtagctgctccgatagcgtacgcgcatctggcggcggcgcaggtgggcaccttcatgaagtttgaggacatgtcggacacgtcgtcgagccagggagggggccacacgtctgcgggcagcgccccggtgccggagctgcctcggctgcacgagaaagtgaggagctccatgttcttctgctgatctgatgctgctcttgaacttgatcgatgccgctttctgtcagtggaggttgaaccgtgcgtctgtataaataaaacctactagtacctatctatctatgtactatctagatggcacctggaactttagctgttatccagggtgcccgtaagtcggtccgttgtgtcgggtgccgctgggaacgttcccatggatgttaccgtttgtggtgttggcgttgttgaaccaaccaacctgaccctagcttaaccttgcttggattggatgatgtgctagctagctagagctagagctagagttagaccatgcatggctgatggtatgtattgtgggatcatatctatctatctccatcctgacttggtgataaaaaaaaaaaaaaaaaaaaaaaaaa

SEQ ID NO: 9758 - DNA, 2815 bp, Triticum aestivum
  Predicted polypeptide sequence is orthologous to G1272
aagaggggaaatcctatacagcttgtgacaaatcatttcaaagtctcgttgaagacgacagacgagttcttccatcattactatgtaaatctgaagtatgaagatgacaggcctgttgatggaaaaggtgttggtagaaaagtcattgataagcttgctcagacttatccatcggaactagcccataaagactttgcctatgatggtgaaaagagtctttttaccattggtgccctcccacaaattaacaatgagtttgttgtggttcttgaagatgtttccagtggaaagactcctgcaaatggcagccctggaaacgacagtccagacaagaagagagtgaaaaggccatatcaaactaaaaccttcaaggtggagttgagctttgctgctagaatccccatgagtgctattgcaatggcactcaaaggccaggaatcagagcacacgcaagaagccattcgggttattgatatcatattaagacagcactctgccaaacagggctgcctgttagtccgccagtcattttttcacaacaatccttcaaactttgtggacttgggtgggggtgtgatgggctgccgaggtttccactcaagctttcgagccacacagagcgggctttctcttaatattgatgtttctacaacaatgattgtgaaacctggccctgttgtcgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacaaatgttttccctcaagcaaaggaatggtgggaatggtgaccctgaagcaatagaaatatctgtttatgattactttgtgaagaaccgtggcattgagctgaggtactctggtgatttcccttgtataaatgttgggaaacctaggcggccaacatattttcccattgagctctgccagctggtccctttacaaaggtataccaaatctttgagtaccctacaaagatcatctcttgttgagaagtccaggcagaagcctcaagagaggatgtcagttttgtctgatgtactgaaacgcagcagctatgatacagaacccatgttgaaggcatgtggaatttcgatagctcagggctttacacaggtggctggtagggtactgcaggcccccaagctcaaagctggaaatggtgaagatattttcacaaggaatggacgttggaatttcaacaacaagaggcttgctagagcttgtgtggtggacagatgggcagttgtaaacttttcggctaggtgtaacaccatgaaccttgtcaatgacctcatcaagtgtgggggcatgaagggcattacagtagaaaaacctcatattgtaattgaagagaatggttcaatgagacgtgcacctgctccaaaaagggttgaggatatgtttgagcaagtgaagtctaagcttcctggggctccgaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctgaagatcaatgcaaaacttggtggaatgaactcactactacaaattgaaatgtccccaagtatacctcttgtatcaaaggtcccaactctcatcttgggaatggatgtgtcccatggatcccctggacagtctgatataccgtccattgcagcagttgttggttctcgggaatggcctcttgtctcgaaatatagggcttcagtgcgctcgcagtcaccaaagctcgaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgctgattgttgcccagaaaaatcaccacaccaaattcttcatacctggatctcctgacaatgtccctccaggcactgttgtagataatgcagtctgccatccaaggaattatgacttctacatgtgcgctcatgctggaatgattgggactacaaggccaacacactaccatatcctgcatgatgagatacactttgctgcggatgacctgcaggatcttgtgcactcgctctcatatgtgtaccaaaggagcacgacagccatatcagttgtttctccaatctgctatgcacatcttgcggctgctcaggtggcgcagttcataaagtttgatgagatgtctgagacgtcgtcgagccagggcggtggccacacctctgccggcagcgctccagtgcaggagctgcctcgcctccatgagaaagtccgcagcagcatgttcttctgctgagccagccagccagccgcacttgcgcgttccaacttttggtgatgcgcttggttatctagtactagtagtatgtagtagtggcctgtgatggcctgttggactcctgggatgttgtgttcctaagctggttgctgcacttggtgcctcagaacctttgaatcctgtcagggtgctgcagttgaacctttactatcgaaccatctaatttgttgctttcaaaaaaaaaaaaaaaaaaaaaaaaaaa

SEQ ID NO: 9759 - DNA, 857 bp, Triticum aestivum
  misc_feature (22)..(23): n is a, c, g, or t
  misc_feature (666)..(666): n is a, c, g, or t
  Predicted polypeptide sequence is orthologous to G1272
cactcacccgtgccttagtggnnttaccatacgagttagtatagggaccactttgtacaagaaagctgggtacgcctaagcttgggcccctcgagggatactctagagcggccgccctttttttttttttttttttttgttttttttttaccaaattcacaactgcaagcaaattatcaccaagtcaggatggagatagatagatatgatcccacaatacataccatcagccatgcatggtctaactctagctctagctctagctagctagcacatcatccaatccaagcaaggttaagctagggtcaggttggttggttcaacaacgccaacaccacaaacggtaacatccatgggaacgttcccagcggcacccgacacaacggaccgacttacgggcaccctggataacagctaaagttccaggtgccatctagattgtacatagatagataggtactagtaggttttatttatacagatgcacggttcaacctccactgacagaaagcggcatcgatcaagttagagcagctcagatcgagaaactgactctcttgtctgctcctcactttctcgtgcagccgaggcagctccggacccggggcgctgcccgcagacgtgtggccccctccctggctcgacgacgtgtccgacatgtcctcnaatctcatgaaggtgcccacctgcgccgctcccagatgctcgtacgttatcggaatcacttattgatattgcccgtcgtgctccttttggtcctcattggagaagcatgtgcccaaattcctggaggctcatccccctttgaagccctttttcttcattcaaaaaattgttattggctttgcctcccacct

SEQ ID NO: 9760 - DNA, 644 bp, Triticum aestivum
  misc_feature (483)..(484): n is a, c, g, or t
  misc_feature (531)..(534): n is a, c, g, or t
  misc_feature (609)..(609): n is a, c, g, or t
  misc_feature (613)..(613): n is a, c, g, or t
  misc_feature (616)..(617): n is a, c, g, or t
  misc_feature (623)..(623): n is a, c, g, or t
  Predicted polypeptide sequence is orthologous to G1313
ccacgcgtccgggagcataaggcagagcttccagatgtttctttcagcaatttacctggtctgtactttgagtcaaaaaaccatggcttcatggatcaagtaaaccaagcagaagttctgaaagaatctgagatctcatttccttggttgaacgcggccattaatggtaccttcgatggcggccatgccttttcaaatggcaacttctctacttccaggcccatgactggtccctggaagatggagctcccttcactccaatttgctggatctgatccaaacaactggtccacatactcaaggacctgcgccgcgcagggtgccaactttgctgatccctgcatgcgctcatcagcggcaatggcatcagctaagtttgagcacatgtgcatgataccagggaacagcggtcagttggaagagccgcttccagaagctcatgcagtaagctctgcagagaaccagcagctgtccgtggggagnncgagtgcctctactggctcaccctgcgatgctatggtggaaacatcnnnncttcatttcttggaacgggatcccaacctgtacgcccttgtcaacagctgttcgcccgcctcgcctctttgccangcancgnntgatgngttaccgtgctccgatttttc

SEQ ID NO: 9761 - DNA, 1527 bp, Triticum aestivum
  Predicted polypeptide sequence is orthologous to G1313
ccagggcacgacggagagatgtaccgggtgaagagcgagagcgactgcgagatgatgcatcaggaggaccagatggactcgccggtgggcgacgacggcagcagcggagggtcgccccacaggggcggcgggccgcctctgaagaagggcccctggacgtcggcggaggacgccatcctggtggactacgtgaagaagcacggcgaggggaactggaacgcggtgcagaagaacaccgggttgttccggtgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgacgatgaaataaagaattactggaacactcgaataaagagatgtcagcgagctggcttgccaatatatcctgctagcgtatgcaaccaatcttcaaatgaagatcagcagggctccagcgatttcaactgcggcgagaatctttccagtgaccttctgaatggaaatggtctttatctgccagattttacctgtgacaatttcattgctaattcagaggctctatcttatgcaccacagctttcagctgtttcaataagcagtttgcttggtcagagctttgcatccaaaaactgcggcttcatggatcaagtaaaccaagcagggatgctaaaacagtctgaccctttactccctggattgagcgacaccatcaatggcgcgctctcctcggtcgatcagttctcaaatgactctgagaatctcaagaaggctctgggttttgactatctccatgaagccaactctagcagcaagatgattgcaccatttgggggtacacttactggcagccatgcctttttaaatggcaccttctctacttctaggaccatcaatggccctttgaagatggagctcccttcactccaagataccgaatctgatccgaatagctggctcaagtataccgtggctcctgcgatgcagcctacggagttggttgatccctaccttcagtctccgacagcaactccgtcagtgaagtcggagtgtgtgtcgccaaggaacagcggtctcttggaagagctgcttcatgaagctcagggactaaaatctgggaagaatcagcagctttccgtgagaagttcaagttcctctgtcagtacgccgtgtgatactacggtggttagcccagagtttgatatctgtcaggactattgggaagaacctctgaatgaatatgctcctttcagtggcaattcactcactggatctacggctcctgttagcgctgcgccgcctgatgtttttcagctctccaaaattcctcctgcacaaagcccttcgctgggatctggtgagcaggcaatggagcctgcatatgagcctggggctggggacacttcgtctcatcctgaaaacttcaggccagacgcactcttctccgggaacacaactgac

SEQ ID NO: 9762 - DNA, 638 bp, Triticum aestivum
  misc_feature (21)..(21): n is a, c, g, or t
  misc_feature (38)..(38): n is a, c, g, or t
  Predicted polypeptide sequence is orthologous to G1323
tcggcacgaggggcgagcagnagcaacaccatcaaggnagttggaatttgagatggacaagatcgaaatccccatgctggacctcggcttcgaccttgacatgctgctgaacgccgtccccgacacgcacttcccggccatctcgtcggcgtcgacctcgccgtgctcgtccgcgtccccgccctgcgtggtggacgaccaagtgctgctcgatctgcctgagatcgacatcatgcccgagctgtggagcatcatggacggcgaaggcggcgtcggcgcgtgcgcagaaacggcgcaggcgccgtggagcaatgcggcgctgtgccagggcaacggaacagaggcgagcgccgcaacggccaacgaagacgacgacggaaaggagtggtggttggaagatttggaaaaggacctgggcctgtgggggcccatcgaagactaccagctccaacaaccggacccacaaggttcgcgtggacccgttctcagcccagcgtggacgactccgcgtcatgctacttccccgcacacactgtccggcattttttctcaagagtacgccaagggggtaccatacttttatagaagatagaaagcataattataagagcttgccggagatgcgaacaaaaaaaaaa

SEQ ID NO: 9763 - DNA, 1110 bp, Triticum aestivum
  misc_feature (22)..(22): n is a, c, g, or t
  Predicted polypeptide sequence is orthologous to G1323
tacggcgacccacgcgtccgtncgagccgggccaatcgaactagaacaagcgagcagagtggtctgtgtcgggtggccgatatggggcgaggcagggcaccgtgctgcgccaaggtcgggctgaacaggggctcctggacgccgcaggaggacatgcgccttatcgcctacatccagaagcacgggcacgccaactggcgcgccctcccgaggcaggccggcctgctgcgctgcgggaagagctgccggctccggtggatcaactacctgcgccccgacctcaggcgcgggaacttcaccgccgaggaggaggccaccgtcatcaagctgcacgccttgctcggcaacaaatggtccaagatcgcggcgtgcctgcccgggaggacggacaacgagatcaagaacgtctggaacacgcacctgaagaagaaggcgtcggagcagaagccaggcgttggcgagagcaagggcgaggcggccgacggagaccctgacacgcccgccccttcgttgtcttcggcgtcctcatcgatgacgaccagcgacgggtccaacggcggcgccggggagcagtgcggcacgagcaacgagcccgaaacgataaacgtaccatcgcctctcgagctggagctggagccagtcatggacatcctggacatgctggccgacgagcccacggaggcgttcgcgacggcggcgccaatgccaacgtcttcgtgctcgtcgtcctccctcacgacgtgcgccgggggcggcggcggtgtggaggagctgctcgagctgccggacatcgacatggacgctgacatctggagcatcatcgatgacgatgtcgcgcgcctaacacaaggcgatggcacagtgccatgtacgaccaaggagggaagcgagtgttggttggagaattggagaaggaactcgccctggggggcccggcggaggactccagccccaggggggcccaatcgacaagatgggtacccgggccactctacgaaacggagggggaactggggatggatcctcctgcccgccggtcaaatccaatagtgagcgtccattttgaatgaaagggtggaatccacgggggccccatggaaggcacaaaaa

SEQ ID NO: 9764 - DNA, 541 bp, Triticum aestivum
  misc_feature (31)..(32): n is a, c, g, or t
  Predicted polypeptide sequence is orthologous to G1327
ggttgtgcagtactttttgaaattttcaganngtttatttgttgtagatgtgcggttcacttcttcagccacctctctcttgctgttcacttgtcaggatagagaaggacggtggtgtgaactacttcgatgggagcagcaggggagtcgcggtggtgtttctgcctctggatgtcacagttgtgtcgttcggctgtgccccattacggcttggtattttccctttcttgttgatacatgcttcggtgcagtcggcttgatcgaagatgaggttcggctggtttgtgtatgctggtcagggtgtcttgtgtgtacatgcagctcatggcgtgatgttggttcagttcgttggcaagcggttctgtatcgcgggcgtgcagctcaccatcgtcaggctcgcagttcgtttggtgctggcagggtcaacacaactggacccaggacatacgactttgatttctttttcattttgttttgagtcggttttatgtaaatttacagggctgtgtttgaagttgaattctcattagtaaaaaaaaaa

SEQ ID NO: 9765 - DNA, 408 bp, Triticum aestivum
  Predicted polypeptide sequence is orthologous to G1327
gattcggacgaggggtcaaggaaagtgaccaagaatgccagggcaggcgcaaagaaccagcctcggttctctcatcgcagaagcccggcccggcgagatgatgacctccatcgttggtggcggtgctgttacccgtcgggtgtttgagtgtcaaaaagatcaaattagccaataggtgaagccagagttctgtacatgtatattaaattagatccgagttgtcacttgacagtgtatgtatgtcatcatgtatgtagagtgataaatctgacgtgtggaagggtaactaaatacagattatccaccatgagcgcatagagatgcgaaagcagagtattgtaagatgtgtacagttagaaaattgttgaaatgtgcaaggcattttactctgaaaaaaaaaaaaaaaaa

SEQ ID NO: 9766 - DNA, 616 bp, Triticum aestivum
  misc_feature (382)..(384): n is a, c, g, or t
  misc_feature (550)..(552): n is a, c, g, or t
  misc_feature (574)..(574): n is a, c, g, or t
  Predicted polypeptide sequence is orthologous to G1330, G2423
gcacgaggactacatcgccgaccacggcgatgaccgctggaactccctcgcccgcgccgccgggcttaagcggacggggaagagctgccggctgcggtggctgaactacctccggccggacgtgaagcgcggcaacttcaccgccgacgagcagcttctcatcctcgacctccactcccgctggggtaacaggtggtccaagatagctcaacaccttcctgggaggaccgacaatgagatcaaaaactactggagaacaagggtgcaaaagcacgccaagcagctcaactgtgatgctaacagcaccaagttcaaggatgccatgaagtatctatggatgcctcgccttgctgaccaccaccttcagcaagcatctacagtnnntgatcatcttgtgcctgggccaccaacggcctacatggagagctccggcatggtgacatcgtcgtccgactcgtttgcatcggagtcatatgatggtgcacgctgtgcaaatgcgagcgtgggagagatgatacatagtggggattgggttcaagagcagaatcannngttttggcctgagacaaaccanaatttccagcttcaagactcggagttgtctggatgggtacaa

SEQ ID NO: 9767 - DNA, 1129 bp, Triticum aestivum
  Predicted polypeptide sequence is orthologous to G1330, G2423
gcacgagcttggatcctccactagctacgtcgtccatggatgtggtgctgcagagtcgtagcagcaacagcatggcggcggagccggaggaggaggcggagccggaggaggaggcggagctccggcgagggccgtggacggtggacgaggaccttacgctgatcaactacatcgcggaccacggcgagggccgctggaacgcgctggcgcgggccgccggcctgaggcgcacggggaagagctgccggctgcggtggctgaactacctccgccccgacgtgaagcgcggcaacttcaccgccgacgagcagctcctcatcctcgacctccactctcgctggggcaaccggtggtcgaagatcgcgcagcacctcccgggtcggacggacaacgagatcaagaactactggaggaccagggtgcagaagcacgcgaagcagctcaactgcgacgtcggcagcgccaccttcaaggataccatgaggtacctctggatgcctcgcctcgtcgagcgcatccacgccgccgccggcgatcccacaatcggcgacacctcgtgcgcgtcaggagtcaggtcgatggctaccaccgccgccacggccaccacatatcccgagaacaactctgccgccatcgcggtcaccaccagcaggtcggcatcgtcgggttccttcacgtcggagctctgcggcgaggagaagaacctgcatgtccatggcagcggcgagaagacaacgagcggaggggactggatgcaggaagcggaccaagagttctgggccatgcatatgcagatccagcctgaggacggtggccttttccacgtcgaccacgagcttagcggatgggtgcagggcttctccgacgtcggcgtttcggctgacaatctctggagcctcgaggacatatggaagatgcaatgagttttctagttatcgaggagcgatttttatacttatacatgtgtatcatacaactaatagatcatatacatcggagtgaggatggcagcaaacttaattagctaattaagtactaatattttgtagagctaactttaaaaagtgtaaggcacttgaatttcttcgttggatcttgttttacctttaaaaaaaaaaaaaaaaaaaaa

SEQ ID NO: 9768 - DNA, 683 bp, Triticum aestivum
  Predicted polypeptide sequence is orthologous to G1341
cacgatacattcacaagatgatctgccgcaacgacacacgcaaacacctacaggttcgacattgagcgtacaaagcaacgtggaatcttgaaaaaacagctactacaggttcctcttatctcacgacacgcaagggttttgctcttaaaccaagttcatagcacgaacgaatacaatggacacaaagaaccacgagagaccacagcgcaggtgcacgtgcacgtgcacgccctgcacctgccgctcacacccgtcaatcgcatcgaggcatcgggatggagatcgagagctgggtcgtcgagaaggaggtgccgttggagcgctcgtcgtccatctccgaccacgagtcccgcctccccggccactcgtcgaagaagggcctcagcggctggttctcctgcttgacatttcccatgagccctccacctccacctccacctcctccacctccaccacccaaagagcggcagtcctgctcctgggagtgggacagcgaggcgatggttacctgcccaagctcctgcgacggctcatagtgggaatacgagaagccgccttgcatgaggccggaatctctaggtttcgacagttggtacgggggcaggctggaccccatcgagtgccacgagctgtccgttggggaatcgatggtgaagcccctgttgttgtttcctgatgctcca

SEQ ID NO: 9769 - DNA, 1143 bp, Triticum aestivum
  misc_feature (21)..(21): n is a, c, g, or t
  misc_feature (24)..(24): n is a, c, g, or t
  misc_feature (766)..(766): n is a, c, g, or t
  misc_feature (823)..(823): n is a, c, g, or t
  misc_feature (980)..(980): n is a, c, g, or t
  Predicted polypeptide sequence is orthologous to G1341
tccgcccagagagatttgttnatncgctgaccggctggcttcccctctccctgttccaatgccttcacaacccactcatgaaagacatccagaactccgacatctatagcctgtgcgaggagtggcagctggccatcgaccggatccccgacaaggtggcctcagaagggatcaaaaccctcctgtcggtgatccacgctgtggtagtccagcaggcggaggagcagaaacagaagaagaggtcagatgctgcattcaaagacttcgagaagaagacagaggaactgcggtctctggagtccaaatacgggccatactctgccgcaggctatggagagatgacgcggaagacaccagtagcagagaagcgggcgaaggtggaggccctgaggagcagggcggacgacgagaagagcaagcacgagaagagcgtcggggtgacgagggcgatgaccctgaacaacctccagacaggcttccccaacgtcttccaggcgatgacaggcttctccagtgtctgcatggaggcgttcgagtcggtgtacaacttcaagcggagcttggaccgggcgctcgacatgaagaggctactgacctgatgagagtggcattgcctgtggtcactgtataaaatgtatacagtttgtaggcttgtagtgtgatggtagtagggctggaagagagtttgattttacagagccaacttcattggtctggtacctggtgactagtctaggcatagaaatgcctggagctcgtttacttngctgtaatgaactcgaggccttgccttcctttctttttgcctggcttctactagctngtaatcattcaaaatctggctgttttgaagagctgcggtttttgaaaaaaaaaaaaaaaaaggcgggcgctctagagtatcctcgaggggcccaggttacgcgtaccagctttctgtacaaagtgtccttataggaatcgtattatagctaggactnccgtcgtttacacgtcgggactggaaactgctactgggatcttgtgaaggacctattctgggggggattattgccaactcctacgagatttaagccaggtaaattaaatttaaggttaagggtaacaaccgatatctgccgttaaatttggttcgaattaata

SEQ ID NO: 9770 - DNA, 722 bp, Triticum aestivum
  misc_feature (234)..(234): n is a, c, g, or t
  misc_feature (665)..(665): n is a, c, g, or t
  Predicted polypeptide sequence is orthologous to G1361
aatttgagagtacgttaagacgtaagttacgtatacatatatgtgtatataatgaacaatgtaacaaagattgatccctacgcttcatcacctgtgcagccactcaacacttttattgtccagtagtactgtttcgaaactgcttcgcgcgcactgccagtgccattttatctgcctgccatcctctcagtacgtgtctcctggcctctaacctagtagtagagtatatatcangtcaacgaatagaactgctttgctttagttggctttgcaattcttggtcagggaccaaagcccgtccctcccgtgtgcacctcgaagttaggcatcaaatgagcagaagcagcagcagccgcggccgccgccctgttgttaggaggagccgcctggctgctgtacccgattagtgctgcagcagttgggctgtagaaatctaccattcctgcagcttccttcagcatattgttgttgtggccatcctcgtggtgatgacggtgatgatcactagttgcacctgcaccgccacccttgatgatattgcccgctgtgatggcggcgtccctgacagcggcagccgtcgagccgccgcactgccgtggctgcgtctgatagaacaccttggagacgacgagctcgccatccttctcctcctcatcggagcctangtggtattgatgcatcacccagttggtcttctctggcttgcgctgcttgccgtagtt

SEQ ID NO: 9771 - DNA, 1130 bp, Triticum aestivum
  misc_feature (630)..(630): n is a, c, g, or t
  misc_feature (762)..(762): n is a, c, g, or t
  Predicted polypeptide sequence is orthologous to G1361
ccacgcgtccgatgcatcaatccacctctacttggtagtacaactagctccctcgtggcgtatcgatctccttggcaagcaacaacccaaaagttggtgagaattctattcctctgtaccagatagagagagaaacccagcacccagcagcagcaacaagcgcaggcaatggtagctagcttgtaacagggacaagcttcctctctaacctctttttctctttgttctcttcgcaggccgctttgttccctcgcccgccctctttagccagccaccagccccgatctccctcgatctcctctcctctttttaccctgtcactcattccctcccagccggcagggccggccttgatcctgccacatatggggacgggctagcaaagcggaactgcggacaccgagaggctttccatatcttcatccatccatcatcattaagtacgtggtggtggggcgcgggagtgccgtgtcggccggccatgacatggtgcaatagcttcaacgacgtgcgcgccgtggagaacaacctggcctccgccgcggccgtcgcggcggcggccgccaagaagcagcagcaccaccagcagcaggcctcctcccacgtcagcctcgttaggacgtgccccgnctgcggccaccacgcgcagtatgaacagttgcaggcggcgtcgacgatacaggatctgcctgggctgccggccggcgtcaagttcgaccccacggaccaggagctgctggagcacctggaggggaatggcangccggacacgcgcaagctccacccgctcatcgacgagttcataccggcgattgagggagagaacggcatttgctacacccatccggagaggcttccaggagttggcaggacgggcttgatccgcatttttccaccgtccatcaaagggctttacgaaggggactagtcagcggggcaggtggacaccgaaaaacagggcggcgaaacaaaatgcacaaacggggcaaaccccccccgttttctggaggggaagctcagggggtaaaaaaatctggtctcttatcaactacggaaagcggcaaccccaaaaaaccaaggggtttgttcaaaacccctaagcccctaaggagaaaagggggtgcccctca

SEQ ID NO: 9772 - DNA, 651 bp, Triticum aestivum
  misc_feature (581)..(581): n is a, c, g, or t
  Predicted polypeptide sequence is orthologous to G1361
cggcacgagggtcgagccatatcgctgttctcagtcagtactcggtagagacagatcggcaagtccttgcaagcgcttcgctgaacctcctctagtcctcttcctcccagaactgccgcattaggtttcgatccactggtcgcgatggtcgttgatccagttctcaagggatttgacctcaacatcgcggcagtagatgagtcaagccctttggaaggaatcggccttggcctgtatgcgactgagttcatccacaagtacctcagattcaatcccacggaccaggagctgatggagtggctcgaggccaaggtgagggatggaggcgcgagatctgaccctctgattgataaattcatacccaccatagaggtcgagtacggctacccccatcctcagcaacttccaggtgtgacgatggacggcacgatcaagcattttttctgccgtccgagggcgttcgagagtggacggaggaaacatcggaagataaaggcggagcgcaacgatcgtaccgcatggcacaagaccggcaaaagcatggcattgaaggccaacggccggctgacgggctggagaancatcctggtgctctacaccaacaccaggaagaccaactgggtgatgcacgagtatcgcctcagcgacgtc

SEQ ID NO: 9773 - DNA, 1260 bp, Triticum aestivum
  Predicted polypeptide sequence is orthologous to G1363, G1782
gcacgagaagattatctctgtaaactataagttctgacaggtcttttgctttattagtggctcttctctctgatgatgttcacatcgccgaagccccatttacagtgaggtgaattgatgcgattatatcttcatgctaacagtaacaccctttttgtttcagacaatgacaatgatcatgggaagcccgatcagcacatggtaaagccgcttttatctttggggaacccagagactgttgctcccccaccaatgcttgattgtagccaatcatttgcatatattccttatactgctgatgcttatgctgggatctttccaggatatgcctcgcacgctattgttcatccccaattgaatgctgcaacaaactctcgtgtgccgctccctgttgagcctgcagcagaagagccaatgtttgttaatgcaaagcagtaccatgcaattcttaggaggaggcagatacgtgctaaattggaggcccaaaataagctggtgaaagcccggaagccataccttcatgaatctcggcaccgccatgccatgaagcgagctcgtggaacaggagggcggttcctcaacacaaagcaactcgaggagcagaagcagaagcaggcttcaggtggtgcaagctgtacaaaggtccttggcaagaatacactccttcagagtagccccgccttcgcaccttcggcatcagctccctccaacatgtcaagcttttcaacaaccggcatgttggctaatcaagagcgcacctgcttcccctcggttggcttccgtcccacggttagcttcagtgcactgaatggcaacgggaagctggccccaaacggcatgcaccagcgcgcttccatgatgaggtaaagcaaagcaccctctggtgcgctgccggtggcaattcatccttggcttatgaagatgttccggaaatgtggttgcaatatcagctggaccaagacattgttatgagtccttttgagtttcatctagttgaaagcactggtgtgctgatgcagactgaaatcttcatcacatttcttttgtgtgtacttattcaaataaggcacaccttgattatcccagagaccggagttgggcatggttgcgaaaccataggcctatacttccttacctgttgtgaatgtatctggtaatgtacttaagagatggttgagcctcgagctttgatgaatgctgttgcagttcatcaactttgcaacctggtttgcctgatttcaaaaaaaaaaaaaaaaaaaa

SEQ ID NO: 9774 - DNA, 1022 bp, Triticum aestivum
  Predicted polypeptide sequence is orthologous to G1363, G1782
gcacgagccccaaaggtgactcctttgggaaatcggttgacgatcatatgaggtcaactttgacttttggtgataagcattctgtatatgcaggtcaaaacactgactatggccacccaatggcttgcatttcatacccgttcaacgattctggttctggagtttgggcggcctatgggtcacgggctatgttccagcccctcatggcgggcggaggggcatctgcaacggcaagagttccattgcccgtcgaactagcagcggatgagcccatatttgtcaatcccaaacaatataatgggattctccggcgaaggcagctgcgcgctaagttagaggcccagaataaactcaccaaaaacagaaagccctacctccacgagtcgcgccatcttcacgcgatgaagcgggcaagaggttccgggggacgtttcctcaattccaaacagctgaagcagcagcagcagtctggcagtgcctgcaccaaggccattgcggatggcgcgaattccctgggttcgacccatctacggctaggcagcggcgcagccggagaccgaaccaactcggtgtccaaggcgatgtcctcccaagagaacagcaagagagtcgccgccccggctcccgccttcaccatgattcaagcggcgcgcaaagacgacgacttcttccaccatcacgcccaccatctcagcttctccggtcattttggccagtcaagcgaccgatatacgtaataaggggtcctccgcgccccggtgtggtcaggcaactcatccttggctttatttctggcgtgttaggacttcagagatagtttatctcacagtgctttgcagcccatagttctcggcttgatgttcggtatgcaaatgttggtgtactggtgcgttggaacaaaagtttgatgtgttcacatgacgattggtcgcggaactcatcttgtgttctgctcgaccctaaaaaaaaaaaaaaaaaaaaaaaaaaaaaaaaaaaaaaaaaaaaaaaaaaaaaaaaaaaac

SEQ ID NO: 9775 - DNA, 1192 bp, Triticum aestivum
  Predicted polypeptide sequence is orthologous to G1363, G1782
gcacgagggagtgacgcggtcgaggaggggcgtgcggggggcagacagagagggagcgcaaagggacggcggaggcaagctagcttcccgggggcggacgcaccgagagagggcggcgggagggaggaggcgcgtgggagccatgcttctcccctcttcttcgtcttcctcctacgatcccaaaggtgactcctttgggaaatcggttgacgatcatatgaggtcaactttgacttttggtgataagcattctgtatttgcaagtcaaaacactgactatggccacccaatggcttgcatttcatacccattcaatgattctggttctgtttgggcggcctatgggtcacgggctatgttccagcccctcatggcggaaggaggggcatctgcgaccgcaagagttccattgcctgtcgaattagcagcggatgagcccatatttgtcaatcccaaacaatataatgggattctccggcgaaggcagctgcgcgccaagttagaggcccagaataaactcacaaaaaacagaaagccctacctccacgagtctcgccatcttcacgcgatgaagcgggcaagaggttccgggggacgtttcctcaattccaaacagctgaagcagcagcagcagcagtctggcagtgcatgcacgaaggccattgcggatggcgcgaattccttgggttcaacccatctacggctaggcagcggcgcagccggagaccgaagcaactcggcgtccaaggcgatgtcctcccaagagaacagcaagagagtcgccgccccggctcccgccttcaccatgattcaagcggcgcgcaaagacgacgacttcttccaccatcacggccaccatctcagcttctccgaccacttcggccagtcgagcgaccggtatacgtaacaaggggtcctctgtgccccggtgtggtctggcaactcatccttggctttatttctggcgtgttagggtttcagagatagtgtatctcatagtactactgttgtactgctttgcacccacatagttctctgcttgatgttcggcatgcaaatgttggtgtactggtgcgttgggacaaaagtttgatgtgtttacatgacaattggtcgcggaactcatcttgtgttctgctcgactctaatgtgtgtgctcacatgtgaattccgtaaaaaaaaaaaaaaaaaa

SEQ ID NO: 9776 - DNA, 548 bp, Triticum aestivum
  misc_feature (121)..(122): n is a, c, g, or t
  misc_feature (260)..(260): n is a, c, g, or t
  misc_feature (411)..(411): n is a, c, g, or t
  misc_feature (466)..(466): n is a, c, g, or t
  misc_feature (502)..(502): n is a, c, g, or t
  misc_feature (519)..(519): n is a, c, g, or t
  misc_feature (526)..(526): n is a, c, g, or t
  misc_feature (528)..(528): n is a, c, g, or t
  Predicted polypeptide sequence is orthologous to G1380
gcgccgcggcacagggctccctccgcctccgccgcagctcccacggcgccggcggccgcggccacgtccagccacagcagcaccgtcgagtcgtggagcggcggcgcaccccgcgccgccnncctgccgcggaggccgtgcccatggaggaggacgatgacgaggactgccacagctactgcggatcctcgtcgtccgtcctctgcgacgacgcatgcggcgacgacgcggtggcgtcccgcgcgcccctgccgttcganctgaacctgccgccgcctcttgacgcggccgctgagacccatcagatgggtgcccgctacgacacactactccgcctctagctcccgagaacggccaggaatcagaggaaggatcgacattcgacaccgcttgttttttcggctgctgaancggtggtgcctctcgctaatgggataattttgcttttccctttcttttttttttnttacacacgacgatgtaaattcaatatgtaataatnagtacgtcatgaattgnaggaagnantgagctttaaaaaaaaaaaa

SEQ ID NO: 9777 - DNA, 1052 bp, Triticum aestivum
  Predicted polypeptide sequence is orthologous to G1380
accagagcggccgcctttttttttttttttacaaatcaaccgcaattccaatcgcatattgaatagtagtggtggtggtacaatcgctcttgcacacagcatcatctgtctaatctaataatcaggaggaaaaagaatagaagaaaaataaaaaatcgctagctttggtgcgcagctcgtccggcgacccgggtccggtgtatcctagaagagccgtagctcggtgcacagctcgtccgacggcggcgggaggttgaggtcgaacacgaagggcgcgcgaggccggacggcggccgaggcggcctcgtcgccgccgtcgtccacgacggaggccgacgaggcgcagtcgctctggcatcctgcgtcgccgccggagcgctccgccagcaaaggtgccggcgctgacacgcgcgggacggcccgaggcgcgttcgcggctctgggcccgctgtaggactcgacggtggagctggcgctgcaggctgggccgggggaagccggtcgagacggatgcgggagcgtggggagcgtggggaaggagacggggtcctggggaaagttggtggtggcgagcgggccgcggagggtgcgcgcggcgacgtcgtaggcccgcgcggcggcctcggcggagtcgtaggtgccgagccagaccccggcccgcttggccgggtcccggatctccgacgcgaacctgccccacgggctgtttcgcacccccctgtaccgcggggccacgccccagccccaaagcgccgccgggttgcacacggtggctgcggtcctcatagtagtaaatcgcccggccgctgaggtttaagtccttccgtaccttccgccggtgaatggttcggcctggttaccaccacagagggggcctaagaaaccggcggtgatcccgagctcaaacaagcttcgatcttgggcccgggttaagggagcctaccgcggcctggacctgaaatcgcgggcaaaaacgctgtgattccaacacttgcgcccagtgagggcctcctgctcaatcgcggccgctagggccacaaatgccgggaatt

SEQ ID NO: 9778 - DNA, 861 bp, Triticum aestivum
  misc_feature (817)..(817): n is a, c, g, or t
  Predicted polypeptide sequence is orthologous to G1380
acgcttgaccttaggcctatttaggtgacatccagacaagtttgtacaaaaaagcaggttcgtaccggtccggaattcccgggatatcgtcgacccacgcgtccgcagctccagcaccgcggctcggctccctctacccagagccaaagaatcaaggctgtttgaagctcgagatcacgcgcgtttcattcagcccctctggtggtggtagccaggccgagacagtcaccgggcggaaggagcggaaggactgaagcctcagcgggccggcgatctactactatgaggaacggcagcaccgtgtgcgacgcggcggcggctgtggggctgggcgtggcgccgcggtacaggggggtgcggaagcggccgtggggcaggttcgcggcggagatccgggacccggccaagcgggcgcgggtctggctcggcacctacgactccgccgaggccgccgcgcgggcctacgacgtcgccgcgcgcaccctccgcggcccgctcgcccaccaccaactttccccaggaccccgtctcccttccccacgcttccccagctcccgcatccgtctcaaccgggcttcccccgggcccagcctgcagccgccagctcccaccgtcaagtcctacaggcgggcccaaagccgggaaagccccctcggggccggccccccccggtggtacacgcccgggcacccttttggttgggcggagacgcttccggggggcgacgcacgggatgccagaacccacttgcgctctccttcgggcctctccgtccgggaaagaagtgcggagcgacaaaggcgctttactggcgccngcggcggagcctctacgccgcccttcttggggcgctattccttc

SEQ ID NO: 9779 - DNA, 1092 bp, Triticum aestivum
  misc_feature (711)..(711): n is a, c, g, or t
  misc_feature (870)..(870): n is a, c, g, or t
  misc_feature (1060)..(1060): n is a, c, g, or t
  Predicted polypeptide sequence is orthologous to G1380
tacgacgacccacgcgtccgccggcgccgccttctcccagctccgacacagcggcagccccctctgtcgcagagtcaacaagtcaagcctttctcaagcccagagcagggtagacgcccggcctgaccagctcggggcagcaccctcggcctctggtgatagtcactagcgaggaaacagcagccggcgcgaggaagcgagagccggccggcgttctactactatgaggaacggcagcaccgtgtgcgacgcggcggcggctgtgggactgggcgtggcgccgcggtacaggggcgtgcggaagcggccgtggggccggttcgcggcggagatccgggacccggccaagcgggcgcgggtctggctcggcacctacgactccgccgaggccgccgcccgcgcctacgacgtcgccgcgcgcaccctccgcggcccgctcgccaccaccaacttcccccacgacctcgtctccttccccacgctccccgcgctgccgcgtccgtctccaccggcttcccccggccccgcctgcagcgccagctccaccgtcgagtcctacagcgggcccagggcggcgaacgcgcctcgggccgtgccgcgcgcgccagggccgacgcccttgctggcgaagctcccaggcggcgacgcaggatgccagagcgactgcgcctcctcggcctccgtcgtggacgacgccggcgacgaggccgnctcggccgtcgtccggccgcgcgcgcccttcgtgttcaactcaacctcccgccgccgtcggacgagctgtgcacggagctgcggctcttctaggacggatccaccggacccgggatcgccggacgagctgtgcgccaaagctagcgattttaaattttnctcctattcttttcccctcctgattagattagacagatgatgtgtccaagagaagacccgatgtcccaccggcattactactatcctttaccccgataggaatggcgggtgatggattgatgcccaaaaaaaaaaaaaaggggggccccctagaattcccctggggggcccaagcttaccgttccccggntttctggtacaaaggggccctaaagggggcca

SEQ ID NO: 9780 - DNA, 371 bp, Triticum aestivum
  Predicted polypeptide sequence is orthologous to G1382
tggacgcctgcggtaccggtccggaatttccgggtcgacccacgcgtccgggggcaggccggcctcaacgggctcgccgtcggcggcggcgggagcgcgttcgcgtccaacacctccgtgccgatgcccatggcctaccacggagccggcgggtactactactagctcctcctcctcctcctcctcgagccgagcagcctctgctcgttcctgattgatcgttgagcttttatctgtgaataataatactctgatcgtgatttgccaccagaaaaactgtaatccgaattgatttgatcctgctcggacgctgaggtaaccatggcgattgagaatttgagattaatggtaaaaaaaaaaaaaaaaaaaaa

SEQ ID NO: 9781 - DNA, 2158 bp, Triticum aestivum
  Predicted polypeptide sequence is orthologous to G1382
gcacgagccgcaccgcgccgatggccgattcgccaaaccctagctccggggacctcccctcagccgccgggagctcgcccgagaagccgtaccccgcggatcgacgcgtcgcggcgctcgccggcgcgggcgcgaggtacaaggccatgtccccggcgcggctgccgatctcgcgcgagccctgcctcaccatccccgccggcttcagcccctccgccctcctcgactcccccgtgctcctcaccaacttcaaggttgaaccttcaccaacaactggtagtctgagcatggctgcaattatgcacaagagtgctcatccagacatactgccttcgccacgggataagtctattcgagcccatgaagatgggggttctagggattttgaattcaagcctcatctgaattcgtcttctcaatcactggctcctgctatgagtgatctaaaaaaacacgagcattctatgcaaaatcagagtatgaatcccagctcatcatctagcaatatggtgaatgaaaacagacctccctgttcacgcgagtcaagtcttacagtgaatgtaagtgctccgaaccaacctgttggaatggttggtttgactgacaacatgcctgctgaagttggtacatctgagccgcagcagatgaatagttctgacaatgccatgcaagagccgcagtctgaaaatgttgctgacaagtcagcagatgatggctacaactggcgcaaatatgggcagaagcatgtcaagggaagtgaaaaccctagaagttattacaagtgcacacatcctaattgtgaagtaaaaaagctattggagcgtgcggttgatggtctgatcacggaagttgtctataaggggcgccataatcatcctaagccccagcctaataggaggttagctggtggtgcagttccttcgaaccagggtgaagaacgatatgatggtgcggcagctgctgatgataaatcttccaatgctcttagcaaccttgctaatccggtaaattcgcctggcatggttgagcctgttccagtttcagttagtgatgatgacatagatgctggaggtggaagaccctaccctggggatgatgctacagaggaggatttagagtcgaaacgcaggaaaatggagtctgcaggtattgatgctgctctgatgggtaaacctaaccgtgagccccgtgttgtcgttcagactgtaagtgaggttgacatcttggatgatgggtatcgttggcggaaatatggacagaaagttgtcaaaggaaaccccaatccacggagttactacaaatgcacaagcacaggatgccctgtgaggaagcatgttgagagagcatcgcacgatcctaaatcagtgataacaacgtatgaaggaaaacataaccatgaagtccctgctgcgaggaatgcaacccatgagatgtccgcgcctcccatgaagaatgtcgtgcatcagattaacagcagtatgcccagcagcattggcggcatgatgagagcatgtgaagccaggaacttcagcaaccaatattctcaagccgctgaaaccgacaatgtcagtcttgaccttggtgttgggatcagcccgaaccacagcgatgccacaaaccaaatgcagtcttcaggtcctgatcagatgcagtaccagatgcaatccatggcttcgatgtacggcaacatgagacatccatcatcaatggcagtgccaacggtacaaggaaactctgctggccgcatgtatggttccagagaagagaaaggtaacgaagggtttactttcagagccacaccgatggaccattcagctaacctatgctatagcggtgctgggaacttggtcatgggtccatgagaggaatgatgagagtgtcagcaaatgcttatagctccatgaatcatatattacaaacaatgcttttgtaacgacaatctcttcagcaagattcttaattgtgtatcggttacaagtcagttcagccagaggcaagtaagctataagctatacctggaggactgcagcaaatgcgcatgtgtctttttaggcgcggaaaaggcccctgctgtatgtagcgctgcagacctacattcgttgtacagcgaacctaatatgattaattaattagattatgagaatttggtttaaaaaaa

SEQ ID NO: 9782 - DNA, 323 bp, Triticum aestivum
  Predicted polypeptide sequence is orthologous to G1387, G2583
tttttttttttttttttttttttttgcaaacgtgtacagatcagaacatatacaactgtccacaaatgtaatacatgataacttgggaggaacatatacaactttcggttactctatacatgacaggcagagccaactattacaatcatcctttggttaattaccgaaccggtccacaacaataagtgcaatggttgtagtcaaaaacaatgggcgaactgggccaagcatctaaaggtcctttggttaaagcaggtctaccctttcacccacagcaagtacttggatattcattacttctccatattcacccaaaaggatac

SEQ ID NO: 9783 - DNA, 638 bp, Triticum aestivum
  Predicted polypeptide sequence is orthologous to G1420
ttttttttttttttttttttagctagaaagaatttgatttcaacatccagaacaaattcagcacaacaaacatttgtacctgttaccctgtgtctgtcagttcgaataaaaaaaacgtgtgtgcccatcggtcagctccatgcctcgctaaattaaggccaaactgaagctatgggcatattatgtacatactcatagtgattgagttaacgatacccatgctggtagcccatcgcgtcatcgggaagaagatcggcgtggaactgcatgccaccgtactccgacaatcggtgtgccaccgacggggcggcggccgtagtgggctgcatgcacatgcgcccgtagacgtcggcaccagccggcaaaaggtcatgttggtgatgttggagcgcggcaagcgaataggcagtgtccgcaccggtggccattagcatccgtgcgccgcggtgggcggccatggggcttgggtgcccgtggcggccctcgtaggtggtgacgaccgtggacgggtcctgctgcgaccgctccaccagcttcttcaccccacaccgtgccgctgtgcaccggtagtagctccttgggaaggagctgttcttgacggccttctggccatacttgcgccagcggtagccatcgtc

SEQ ID NO: 9784 - DNA, 868 bp, Triticum aestivum
  misc_feature (5)..(5): n is a, c, g, or t
  misc_feature (30)..(30): n is a, c, g, or t
  misc_feature (663)..(663): n is a, c, g, or t
  misc_feature (671)..(671): n is a, c, g, or t
  misc_feature (685)..(685): n is a, c, g, or t
  misc_feature (693)..(693): n is a, c, g, or t
  misc_feature (737)..(737): n is a, c, g, or t
  misc_feature (749)..(749): n is a, c, g, or t
  misc_feature (769)..(769): n is a, c, g, or t
  misc_feature (783)..(783): n is a, c, g, or t
  Predicted polypeptide sequence is orthologous to G1435, G2741
cacangctatttcgatataggcctatccangtgactatgtagaacaagtttgtacaaaaaagcaggctggtaccggtccggaattcccgggatatcgtcgacccacgcgtccgatcccatgttatcccctcgcgtcgtccggccccagcctcacgacggcacggcctccgccggctcatcctcgtcgcggcgccacatggtggaccgcgtgtccgagtgggagctcggcctcccctcggccgccgagctgacgcccgtctcgcagccgctcatcccgccggcgctcgccgcggccttcgggatcggccccgcggacgcgctctcctcccccgtcgacaccggcttcctccacgactcgcccacctcccatctcacatccaggttcgacgagtacgacgaggaggacgaggaggagggggagggcgagaccgacgacgccgccgccggggcgcggaggggcggcggcggcgggaagaaggcgaggatggtgtggacgccggagctgcaccaccggttcgtcgaggccgtggagcacctcggcgagaagggcgccgtgcccaaggccatcgtgcgcctcatgaacgtcgacggcctcacgcgggagaactcgccagccactccagaagtacgactctatctaactcgaggcgctccagccccggngctggcgngccctcgccaccgncaccgccnttcttttcccgcttcgacgtccaacgaccgcatcaagactccgncaccggagcggntactgcgcgtacccgtatgnttctaccagaagcntcgatgcgataagcgcatagtcacatgttgtcgcgttccgactgatcgtgattgtctaaacatgcaccacggtagtcatgtcctt

SEQ ID NO: 9785 - DNA, 555 bp, Triticum aestivum
  misc_feature (470)..(470): n is a, c, g, or t
  misc_feature (482)..(482): n is a, c, g, or t
  Predicted polypeptide sequence is orthologous to G1449
gctgatccggcgcaccagtagaggaggaggcggcggcggccatgggcagcggtcgctgtttgtgaaggtgtacatggagggcgtccccatcggccggaagctggatctgctgctgctggacggctacgacagactcctcgccgtcctaggccgcatgttcaaggcctccatcatacatccggatactgtcggccgtgatcaccgagtggttcttggggagaagcaggctcgccatgttgtcacttatcaagaccaggagggggactggttgatggccggggacgtaccgtgggagctattcctggcgggtgtgaagaaattgaagattgcaagggtggacagtagcacctctgattgattcaacgagggcgactcatgtggcctccattcctgggtgtgcttggatttcattaattcatttatgggggattaagatgagatggttatttcttggtgaagtcggctgcttnatagtgtacagnctgcaaaagtgtgggacatattcctgaaaaaaaaggagcaacacatatataatacctttttctaaaaaaaaaa

SEQ ID NO: 9786 - DNA, 533 bp, Triticum aestivum
  Predicted polypeptide sequence is orthologous to G1451
agccaaggtgtcactttgggagattgaacccctgacaactttcccgatgtaccctactccttttccactcagactgaagcgaccatggccaacaggcttgccttctctgcatggtggtaaggatgatgacttgacttcctcgctcatgtggcttcgagatagtgcaagccctggtttccagtcgctgaatttcggtggtgctggtatgaatccctggatgcagccaaggctggatgcatcgttacttggtctacagcctgacatttaccaaacgatggctgcggctgcgttccaggacccaacaaagatgtcacccacgatgttgcagttccagcagccacaaaacatggttggtagagctacgccgcttctgcaaagtcagattttacagcaaatgcaacctcagtttcagcagcagtcataccttcaaaacatcaatggggccacgatccagggccaggctcagtctgagttccttcaacagcagctccaacggtgccagtccttcaatgagcagaagccacagcttctcc

SEQ ID NO: 9787 - DNA, 684 bp, Triticum aestivum
  misc_feature (26)..(26): n is a, c, g, or t
  Predicted polypeptide sequence is orthologous to G1451
aatctttgactccaacacggcggatnacccacacttaattcacagcgaaaagtctaggctccagccgggataatcagttttaggtccccagtcggaatactcggttttaggtcattcatattgctacataataaggtggtcacttccacggtaccatactgcctcacattcataagagcggttcttgtctgccattccgagactaggctatcatagagccgaagcagcgatcacacaacatatccatgatcggaatgatgttggtagatcgtctaactatattattgactaaagttcatggcgaggagagggctagctaggttggtgaaccgaacacgtcgcaataccgtgatgatgatgcgatcctggagtgctggtttagttctggactccgatctccgtttcagtagtccagtggcggtacggaggccatgttgccggtgagattctgcaggtcgtggcccccagaataaccgtcgcagacattgccctgcgccatcctcgctccaggtgcagaagacagaaggccctcgccgccgccgcggaccatctgctgcacctcctgctgcgagagtatcttgatgcaccctacgctattcacaaactcctgccatgggtcgtcgccgacgagaagaatatcattttctcggtcgacgaatacaagctgccagcctgatcttacgg

SEQ ID NO: 9788 - DNA, 702 bp, Triticum aestivum
  Predicted polypeptide sequence is orthologous to G1451
ttttttttttttttttttgatgactagagagcctacattcacaggattagtatgtaggagtattccacagaagagagttttggcaggcttaccaaaaggggggggtttacggatcacggtacaggttcctactacttcttaacatgagatcacatggcatgattattagacggtagtacatgacttaaaagagctagtaggaatggtctgtgtgcttgctttccagttccgggtctcgaaaactagggagagagaaaaaaaggctgcagaaacatacgcggcgagctagcttaagccgaggccttcgcctcagaacgccctctcttcagaactctacttcgaccgagccgaccgacgcgatcccggtgctcaggctcctcgactcctgcctgctcgcgtagtcgtcgcagctgctaccgccgccgccgccgcctagcctcttcccgggggccgagctcaggagctccaggccctgcttgcccatctgctgcacctcctgcggggacaggatctttatgcaggacacgctgttcacgaattcctgccaagggtcgtcaccgaccagaaggacgtcctcctcccggtcgacgaatacaagctgccagcctgatctcatagggtcttccaactggccctcaaggccgaataggcgcccagttccctacgtagttcatggtagttgctaaacttggtgatatcaag

SEQ ID NO: 9789 - DNA, 671 bp, Triticum aestivum
  Predicted polypeptide sequence is orthologous to G1451
tttttttttttttttttttttggacggggtacaactgagtaaattacatcccgagtacaagatatgcaggcacatgtgccgggcacatgttgtataataccagatgatggaatgaacggatgtgggtgatggtcgtgtataataccaagataaggaagtggcgtctgcctcacgccatccctctcgacatccacaaaaaaccgtccatttcttagggagaggcatatatataccatgtcgccaggccgcactacatacgcatcaataaacatacgccagccaacagcgtgaatcctggtcttcttagctccatgatcaagcttgacttcgtactccagtagttctctggttacaaagattgtcttacacatgggcttattctctctggcggcaatggactgcagatgctcaatacatgcaccaaacactcgcctgttgcagcatgggataatcttttcttccagccaggcacgactataacgcttccagaatcatcggcaggtacatctgggttgacatctgggccgtaggcacaggtatttgcgcccctcaatgtggccggaggcgttactagtcccatatgttcattggattgtgtcgtctcgcctgggacatgtacaaattcctgtatgcttggctgccgcgataaatcggccgccgcccccctccgt

SEQ ID NO: 9790 - DNA, 724 bp, Triticum aestivum
  misc_feature (651)..(651): n is a, c, g, or t
  Predicted polypeptide sequence is orthologous to G1451
gcacgagggggaatacgtcgagcaaatagatcgcaaacggttatgccatcatcagtattgtctagtgacagcatgcatattggtcttcttgctgcagctgctcatgctgcatcaacaaatagccggttcactattttctataatccaagagcaagcccttcagagtttgtcataccgttggctaagtatgtaaaggctgtgtaccatacccgtatatctgtgggcatgcgtttccggatgcttttcgagacagaagaatccagtgtcaggcgatacatgggaacaattacaggaataagtgaccttgatcctgctcgttggccgaactcacactggcgttctgttaaggttggatgggatgagtcaactgctggagagaggcaaccaagggtgtctctctgggagattgagcctctgacgacttacccaatgtattcatctcctttccctatgcgactgaagcggccttggccaacaggattgccctccttatatggtggaaaggaggatgacttgacctcttctctcatgtggcttcgagatggagcaaacccaggtttccagtcattcaattttggtggacttggtatgagtccttggatgcagccaaggatggatagttccctacttggtctgcaacctgacatgtanccaagcatgtcagcagcagcttttcagaacacgacgaagcaagtatcgcctacactgctgcagttccagcagc

SEQ ID NO: 9791 - DNA, 1034 bp, Triticum aestivum
  misc_feature (613)..(613): n is a, c, g, or t
  Predicted polypeptide sequence is orthologous to G1451
tgcgacccacgcgtcccgatattcacgacgtggagtggaagttcaggcacatcttcccaggccagacctaacgacacttgctagctactggctggagtgtgttcgttagcgccaaaagacgagttgctggagactcggtgctcttcatatggaacgagaaaaaccagctttggctaggaatcaggcgtgccaaccggacacagactgtgatgccttcctctgttctttcgagtgacagcatgcacatagggctccttgcagctgcggctcatgctgcttctacaaacagccgcttcacaattttctacaatccgagggcatgtccatcagaatttgtcataccactctcaaagtacatcaaggctgtttttcacacccggatatcggtcggcatgcggttcaggatgctctttgagaccgaggaatctagtgttcgcaggtacatggggacaataacagaagtaagtgatgctgatccagtgcgttgggctagttcctactggagatcggttaaggttggttgggatgaatcaactgctggggaaagaccgcctagagtttctttatgggagattgaaccattgacaaccttccctatgtatccgtcattgtntccgctgagggttaagcatccctggtattctggtgtagcaggccttcaagatgacagcaatgctttgatgtggctgagaggagttgctggagatggaggttatcagtctatgaactttcagtcacctggtattggctcctggggacaacagaggctccatccttctttgatgagtacggagcatgatcagtacccagcagtagttgctgctgctgccgccggcttccagtctggtgggtatatgaaacaacaatccctaaaccttcagcagcctatgcagccgcctcaagaacactgcaactccaaccggtgttgcagcaacagattttggagcaagcaagccaacagcaacttgtagggctgatatccagaatattcgaccatggttgaaccaggtgcaatcagcaccaatttcaaaggt

SEQ ID NO: 9792 - DNA, 1127 bp, Triticum aestivum
  misc_feature (17)..(17): n is a, c, g, or t
  Predicted polypeptide sequence is orthologous to G1451
ggtttgcgtggttacgncgacccacgcgtccgcttgaggcgactgcataggctgctgaaggtttaggacttgttgtttcaagaacactgcaacctcaacccgctcttgcagcaacagatcttgcagcaagcaagccaacaacaaaccgttagtgctgatagtcagaatattcaggcaatgctgaactcaagtgctatgcagcaccaacttcaacagctccagcaactgcagcaggtgcaccaggtgcagcaggcgcagcaggctcacattgatcagaagcagaagattcaatcagatcaaacatatcatgttcctactagtgcgtctctcccaagtccaacatcactaccaagccatctgcgtgaaaaatttggcttctctgatcctaatgctaattcgtcaagcttcaccacttctagcagcagcgacaacatgctggaatcgaacttccttcaggggaattcgaaagctgtagacttgtctagattcaatcagccagtagctagcgatcagcagcagcagcagcaacaacagcaacagcaggcttggaagcaaaagtttatgggttcacaatcactgtcttttgggggctcgggtttgcttagctcacccacaagtaaagacggttctcttgagagcaaaattggttctgatgtgcaaaatcagtccctttttagtcctcaagttgattcttcctccctactgtacaacatggtgcctaacatgacttcaaatgttgcggataacaacatgtctacgattccttctggatcaacatatcctgcaagtcccatgtatggttgtttggacgactcttctggtatatttcagaatacaggagagaatgacccaaacagcagaccattcgtgaagggttataagtcaggatcagtggggaggtccctggacatcacccggttctccaattatgctgaacttcgggaagaactgggtcagatgtccggcattgggggtcagttggaattactccgaatagaataaggttggcaccttgtaattcgtcgaaaggggaaaatgatgtgcttcccccttggagacgacccctggggagtcatttggccaaaagggttatgggacatcaaggaactttcaccgagaggagtgta

SEQ ID NO: 9793 - DNA, 411 bp, Triticum aestivum
  misc_feature (28)..(28): n is a, c, g, or t
  misc_feature (403)..(404): n is a, c, g, or t
  Predicted polypeptide sequence is orthologous to G1468
ggtgacgcctcgttgtcgggcgtgagcngatgcgtgcggacgcatcgttttgtcgataggatcaatgcagtagatagcgtcgggccgtagaaaaaccaaccttcctccaaaccccaaaccagttctgtttgatccttttgtacatgtgatatttcttcctccttaccttgttcagagtcttgtctggggatgatggctgatgcctcccgggtggttaactgtgttgttggcagagatggttgttgatagggcaggtagctgttgttgcatgatttgcattctcattgttgttgtaaaggttgcttcttccatccaagggaaacggctatggcttgtgctgccagccgctaccctgcccaaagaaaatgaaatatgaagagaatagttgaggacaaaaaaaaannaaggaga

SEQ ID NO: 9794 - DNA, 1016 bp, Triticum aestivum
  misc_feature (937)..(937): n is a, c, g, or t
  Predicted polypeptide sequence is orthologous to G1471
ctacgacccacgctaccgccaaatcagacgcggagaggtcaatattgggcgtgcctcttgtactgaaagtaactggttggacggtgcttgtctaatggttgtgcttatgagctggtacgtgaaagttcttctgaaaggcagttgatgcaaatgggctgacacgatcctgagtttgaactagatcttccaagcacaaggatcctttctaggcgaagtcatacatgaaacaggtggtccttgaagtatattgatacatatggtttgggtgcgatggaagctggcttgagaagagagacaccatttagcgtctgttctatttcgccattgtagctgtgtaaatgttttcttgccttggggaatcgagagactcctttgtacatgatttgtaacttgccgctggtaggtcttgtggtgcatagaaagctcatgttttggtgtggggtttgttgaaccaaaaacttgaaagcaaatgtgacaatcatctatagttcaactgacaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaagggtaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctggtcatgatcatantcagccataccacatttgtagagggtttacttgctttaaaaaaacctccacacctcccccttgaacctgaaacataaaa

SEQ ID NO: 9795 - DNA, 701 bp, Triticum aestivum
  Predicted polypeptide sequence is orthologous to G1480
gccacagcactgtctcctcggtggatgttgggtcggtgccggagcggagcgacagccccatcgcggcggcgacgccggcgacgggggaggggagggaggcgcgtctgatgcggtaccgcgagaagcgcaagaaccggcggttcgagaagaccatccggtacgcgtcccggaaggcctacgccgagagccggccgcgcgtcaagggccgcttcgccaagcgcgccgacgacgccgacgcggactccaacgccgtcgcggtgggcacgatcaccacgccccggccatgcgtgctcgacttcggcagctacggcgtcgtgcccaccttctgaggcggcgcctaatttcgtgtccatttcctctggcgagcgtgccggctgggtgcctaattaaatccggcacggcatggccggcacgcacgagcgcgccgacgtgcatgcgtcgcacgtcgtgttccctcttgtatgattgcatgtaatgtttctcgagctggctgatcgctggctcgagtgtagtatactactctactcgacagacacgcacgcacgcacgcatgttttgctagaactagaataatacagatagttctagttgactagtctactacctgtacccttttctgggctagcttgatggcaaattaggctagggcaatgtaacgtgttttgctggaacagcttaattctagtttcggatcccaggat

SEQ ID NO: 9796 - DNA, 601 bp, Triticum aestivum
  Predicted polypeptide sequence is orthologous to G1480
cgcgtctcggcgtacgcctgcgggacgcgtagcggatggtcttctgaaaccgccggttcttgcgcttctcccggtaccgcatcagccgggcctgccgctccttccccttgctcgccaccaccgccaccgacggcgccggcgccagggccccgccgactgacagcgcgtccggcaccactgcgacctcagacgttgacatgctctggttcatggagtgttcggggtagaagagagcgccgccggcgaggtcgagctcggaaggggcgacgggcaccccgatggccttgatcccgtccatggaccggacgaagtccagatcgaggtacgcgtccgaatcggcgaagaacgtggcggcgctgtcctcggggctgtcgccaggctcgggaagaagccacgaggccgcctcggcctcgttgctcccgtcgtcgtctgcgtcctcctgcatcgcggcggcggaggacggggaggggttgggctggggcggatcggcgagcgcgccgaagaaaggcgtgaccgggagccgatcgtgccggctggcgagcgggttggcggagtggatgtcgggagtcgcacgttgcgcaggagcgggaggtgtcggacg

SEQ ID NO: 9797 - DNA, 1061 bp, Triticum aestivum
  misc_feature (34)..(34): n is a, c, g, or t
  misc_feature (300)..(300): n is a, c, g, or t
  Predicted polypeptide sequence is orthologous to G1480
gtcacccagaccggtcgccctttttttttttttntagatgataataatgattgccgatccaaatttgtttgggctacgggtggcggccatccaaaaataaacgagcatattggccaaagtactactactgttacagtttacagtattactagtacatcactagcgcgatcgaactagctcaggaggagtacatggatggattgctagtcccctactactgtacatgcatcaatggtacaagtacaagcggccggccggggcgccgggccggcgggtcggaaggacgggacgactccgtanccaaagtcgagcaagtaggaggtggaagacggcacggcatgggcctccgcgtccaagtcctcgccgtcggcgtcctggtcggtgcgcttggcgaagcggcccttgacgcgcggccgcgactcggcgtaggccttcctggacgcgtaccggatggtcttctcgaaccggcggttcttcctcttctcccggtaccgcatcagcctcgccaccctgccctccccggtcaccgccaccggacgctccggcacagtcaagtaccccatgtccaccggcgaagcctgctgcatagtcacgccgtggctcggcggcgccgcggtgtacgcgggcatgtacgcctgcggcttgggccgggtgaagtcgatctcgaagctgcccgcgccgccgaagatggcctccgggcccaccccgacctccgattaagagccgctgtgcgcgccggaggcgttggccgtgtattaggagctgtaggtctgcggcggcttggcgccgatccccgcaggcgaagtccaggtccacgaagggggggttacggccacggtccggaggcccgttgggcacgcaggctttccagcgtgggccgaagcgccgtcaagccgacgggcgaggttaggggctcacacagggccggaaaaacagggtgctcctctcttcccggccctctcttggccgcggtctcccccgtgtgagagggtccggcttccccccccagcctgggtgccagctcgtgccgggccacctatcgccttagtctcgcgcccctc

SEQ ID NO: 9798 - DNA, 1177 bp, Triticum aestivum
  misc_feature (12)..(12): n is a, c, g, or t
  Predicted polypeptide sequence is orthologous to G1480
aagcaggctggnaccggcccggaatgctcgggatatcgtcgacccacgcgtccgccaccgcgtgcacccgccattgcctgtcggagctaagaggacgtgcaggggtgctagctagttatgatggagctgcgcaagtaccggggtgtggggggcaggcggtgcggggcgtgcgaaggggcggcgccggcggcggtacactgccgggactgcgccgggtacctgtgcacggggtgcgacgcgcgcccggcgcacgcgcgggcgggacacgagcgcgtctgggtgtgcgaggtctgcgaggtcagccccgcggccgtcacgtgcaaggccgacgccgccgtgctctgcgccgcgtgcgacgccgacatccaccacgccaacccgctcgccgagcgccacgtgcgcgtgcccatcgcgcccatcggctcccccgaggccgccgcggtggcggccgaggccatgatgttctgcggcgccggtgacggggaggccagggcggatcaggacgaggtgcccgagcagctgcgccagcacgggggcatgctgaacctcaacgtgcaggccggcaaggagggcgggaagatggactacctcttctccgacctcgtcgacccctacctcgccgtcgactttacgcgcttcgcccacgctgacagcgtcgtgcccagcggggtcgccaccgccgcggtacccgccgtcgtggacctggacttcgcgtgcgggatccccgccaagccgccgccgacctacagctcctcgtacacgggcaacgcctccggcgcgcacagcggctcttcatcggaggtcggcgtggtgccggagggcatctgcgggggcgtcgggaccttagagatcgacttcaccagggccaagccggaaggcgtacatgcccggcgtaaccgcggggccgccggaacacggggtgggcatgcagaaggcgtccccggtggacatgggatacttgacggtcccggaccgtccggtggcggtaacccgggagggcccggtggcaaagctaatccggtaccgcgaaaaaaagaaaaaccccccggtccaagaaaaccatcccgtacccgtccagggaacggcctacccaattccggggccggccgtaaagggccgttccccatcgccacccgaccaggaagccgaacggaaagaattggaccccggaggccaa

SEQ ID NO: 9799 - DNA, 1070 bp, Triticum aestivum
  misc_feature (12)..(12): n is a, c, g, or t
  misc_feature (788)..(788): n is a, c, g, or t
  misc_feature (1049)..(1049): n is a, c, g, or t
  Predicted polypeptide sequence is orthologous to G1480
ttttttatttangtgtcttcctaaaacaagtttgtacaaaaaagcattttcctaccggtccggaattcccgggatatcgtcgacccacgcgtccgggtggtggcgctggtgctagctgggctcgtcggactgtgagcgagcagtgagcgcgtacgtgccatggagggggaggagaagccggtggtgggcggggcctactggggcgtgggcgcgagggcctgcgactcgtgcgccaccgaggcggacaggctcttctgccgcgccgacgccgcgttcctctgcgccggatgcgacgcgcgcgcgcacttctccggttctcgccacgtccggttctgggtcttctaggtttgttagcacgcgaccgcggacggttcgtgtaaggtccaatcccctcatgctcatgcataccctgcttctcttatcatccacaccgttaaagcctttcagtgtcctcccacccatatcgtgatccccgcggtattaccttttctgtctaaccctgcgcgcgtccttctgagtctttgttacctttgtcgcgcctctgcgtcgatgctatggctgccgcgtcggctgcagagacacgcagagagggacgcttcgccagcgcgcttgttcgcggcaatggaacaccgatctttatttcggccttgtggttatctcttgttgtctctctctatttgattggtccgataacaagtattcacgctcattcttctttagatttcttcccgttagtatcgcgccatcgcgtctcactaagctatcggctcgcctgcgcgatctacacnaccactctgctccacccacttctgtcgcaccaatcacccccgccgcgacgtcccgtccctacatatgtctgctccgacagtcaactcgcgtcgctacgtcctcctctgccttttatgttttgcttgcgcaaatatgatacaaatcctgtgtatagagctagatcagtcgcacctatgaattataccacgcgtcctacttaaagtctgctgatgtcgcacctctcctccacttgtgcgtccgtaccacatcacccacacttntattcatattcctctgcatag

SEQ ID NO: 9800 - DNA, 851 bp, Triticum aestivum
  misc_feature (814)..(814): n is a, c, g, or t
  Predicted polypeptide sequence is orthologous to G1482, G1888
acgctatgaccttaggcctatttaggtgacactatagaacaagtttgtacaaaaaagcaggctggtaccggtccggaattcccgggatatcgtcgacccacgcgtccggagagagagcccgagataactctattggcctggccccgtgacctaccttgcctatctctcaccgccccctccatctctctctcgcgtggcggggtcgaagctgcgtgcccagatcgtgccatgaaggtgcagtgcgacgtgtgcgaggccgaggcggcctccgtcttctgctgcgccgacgaggccgcgctgtgcgacgcctgcgaccgccgcgtccaccgcgccaacaagctcgccggcaagcaccgccgcctgtccctcctccacccatcgccggcctcctcctcgtcgccttcgccgaagccgcctctctgcgacatctgccaggagaagagggggctcctgttctgcaaggaggacagggcgatcctgtgccgggagtgcgacgtccaggtgcacacggccagcgagctgacgaggcggcacggccggttcctgctcaccggcgtgcgcgtctcgtcggcgccggcggagtcccccgcgccgtcgggtcaggaggaggaggggaacagcaccagcccctgcatcgccgactcctgcagcggcgacgccagtggcacggcgagcgccagcgcgagcgcgagcgacggcagcagcatctccgagtacctgacgaaacgctgcccgggtggcacgtcgaggacttccctctggacgacgccgccgtcgccgtctcctcgaacagccgtaatcaggggaggagggnctggctaggatccgtgggccccaagaaggtgaaggta

SEQ ID NO: 9801 - DNA, 898 bp, Triticum aestivum
  misc_feature (599)..(599): n is a, c, g, or t
  misc_feature (646)..(649): n is a, c, g, or t
  misc_feature (853)..(853): n is a, c, g, or t
  misc_feature (856)..(857): n is a, c, g, or t
  misc_feature (874)..(877): n is a, c, g, or t
  misc_feature (879)..(881): n is a, c, g, or t
  misc_feature (895)..(895): n is a, c, g, or t
  Predicted polypeptide sequence is orthologous to G1483
caccagctattgagatataggcctatccaggtgagatgatataacaagtttgtacaaaaaagcaggctggtaccggtccggaattcccgggatatcgtcgacccacgcgtccgccgtatcctcccttcccctcccctcccctcccccccctttcccgaggcagcgggcgagagagaacagagcggagcagcaaagagaggccgtatctggcgcgggcgatgaagatccagtgccgcgccgcccaagtgcgacatctgccaggaggcttctggatacttcttctgcctggaagaccgtgctctactttgtagagattgtgatgttgctatacacacagtgaattcctttgtttcagcacatcaaaggttcctgctgacaggagttcaagttggcctcgatcctgctgatcctgttccacctgttgctgacaagcacgtaaacacttcaggtggatcagtggattcactaccgaaacacttgccaaagaaaaatcctacagtcctattttcaggtgaaaactgtgcatctattcccagccagaatgcaatcagtggagattattcgaggcagttctgtcaatacacacagaggacactgtngttatgacacatggcttagatggggagcgcccctaccactgcagaannnnggatgtaatcaaattttgtctctatcagacacacagcttatccaccaatgacagaatgtgccgggcttacattacattctaggcggaatggtcagacgtttactgatgggcggggatgaatctcaagaactagatatgtggcaattgggttactggcatggttctcagggttgacatgctactgggaagtgcactcgggaaggnaanngtggaaacgagggcgtnnnngnnngggcggcgcactcnggg

SEQ ID NO: 9802 - DNA, 849 bp, Triticum aestivum
  Predicted polypeptide sequence is orthologous to G1483
acgcttgaccttaggcctatttaggtgacttctagaacaagtttgtacaaaaaagcagtctcgtaccggtccggaattcccgggatatcgtcgacccacgcgtccgatcaatcgatcgccgaaggtcctctgctccgcgtgcgaggcggccgaggcgcgcgtggtctgctgcgccgacgaggccgccctctgcgcgcgctgcgaccgcgacgtgcacgccgccaaccgcctcgccggcaagcaccaccgcctacccctcctctccgccgcatccaacccgcccgccgtgtccgcgccgaactgcgacatatgccaggagggccacgcctacttcttctgcgtggaggaccgcgcgctgctctgccggagctgcgacgtcgccgtgcacaccgccaacgccttcgtctccgcgcaccggaggttcctcctcacaggcgtccaggtcggcctcgagcccgacgaacaagaagaatcagttccggagccggagccggagccgcaaccgcccaacaacgcctcgtcggctcccctgccaccgccgatgtgccaccggaagaggagcccaacgccgctctacagcgacggagacatcgactgggcgggcggctcggacgtcggcatccacgggaaacttgcccgactggtctgtcctcgatgaacagttcggcagcgctaccccggcgatgaggcccgcggagccgggaggtaatccaagccccctcccaaaaaaaaagcccccgggtgggccgtcccgggcgggcaaacccaccacttttttttggccgggagcattgcccggaacgtggccgcctgggaaccaattctcttcgggggttccccccaagttcc

SEQ ID NO: 9803 - DNA, 1027 bp, Triticum aestivum
  Predicted polypeptide sequence is orthologous to G1483
acccacgcttccgcgactggagcacgaggacactgacatggactgaaggagtagaaaagcggtcctgcacgcggatgatcgtgtagtgatcggatcaatcaatcgatgaaggtgctctgctctgcgtgcgaggcggccgaggcgcgcgtcgtctgctgcgccgacgaggccgccctatgcgcgcgctgcgaccgcgacgtgcacgacgccaaccgcctcgccggcaagcaccaccgcctgcccctcctctccgccgcctccaacccgcccgccgtgtccgcgccgaactgcgacatatgccaggagggccacgcctacttcttctgcgtggaggaccgcgcgctgctctgccgtagctgtgacgtcgccgtgcacactgccaacgccttcgtctccgcgcaccggaggttcctcctcaccggcgtccaggtcggcctcgagcccgacgaacaagaagaaccggtgccagagcctgagccggagccgcaaccgcccaacaacgcctcgtcggctcccctgcaaccaccgatgtgccccaggaagaggagcccgacgccgctctacagcgatggagacatcgactgggcggccggcccggacgtcggcatcacggggaacttgcccgattggtcggtcatcgatgagcagttcggcagcggtaccccggcgttgaggcccgcggagccggaggtaatcaaagcccctccgaagaagagcccccgggtggccgtcacggcggcgcgcgcggccctttttggcgggagcatgccggactggccgctggacgagttctttggattcaccgagttcgactccggcttcggattcgcgggaaaatgcacgtccaaggccgacagcgggaagctcagctcgccgaaacgccgttcgatgtcgtcgtcctcctcggaaacgcggccagaacgcgcaggattcttcggcaggtgcggaggtcactggtcgagtcgtcatgcggagcccctcccgcgacggcctaggctcactggagggagacggatacggtctgcct

SEQ ID NO: 9804 - DNA, 929 bp, Triticum aestivum
  misc_feature (619)..(619): n is a, c, g, or t
  misc_feature (690)..(690): n is a, c, g, or t
  misc_feature (692)..(692): n is a, c, g, or t
  misc_feature (715)..(715): n is a, c, g, or t
  misc_feature (748)..(748): n is a, c, g, or t
  misc_feature (764)..(764): n is a, c, g, or t
  misc_feature (766)..(766): n is a, c, g, or t
  misc_feature (773)..(773): n is a, c, g, or t
  misc_feature (796)..(796): n is a, c, g, or t
  misc_feature (803)..(803): n is a, c, g, or t
  misc_feature (812)..(812): n is a, c, g, or t
  misc_feature (819)..(819): n is a, c, g, or t
  misc_feature (821)..(821): n is a, c, g, or t
  misc_feature (879)..(879): n is a, c, g, or t
  misc_feature (887)..(887): n is a, c, g, or t
  misc_feature (918)..(918): n is a, c, g, or t
  Predicted polypeptide sequence is orthologous to G1488
ccggagtaccggccggcggcgagcccgacgttcgtgccgtccaagcattccaactcgcaccgcaaggtggtggagctgcggcgccagaaggacaccccgcagcagcagctcctgcaccattctcagcacaagccgccgcagcagcagctcctgcaccattctcagcaccagccgccgcagcagcagcaccagctggggccgggcctggggttccaggtgccgagcccgctgctgttcgacgggccgcacctgggcggcggcgcggacgagttcctcatccgcaaccgcataggccccgaccaccggcagctcatctagcctagcttagctagccagcgccgcccagctcgcctaggaggaggatcgttccgttagccccagcagcaataattcagcaagaagaacagccagcccagcccagctaaaacttttttcctaggagttgttgtttctccggattttaatttacctttttccagagacctgtatgcttgcttgcttgctacactctccgtgtttctcagtcagctctcgagttccttagaaactaatcctagggtgcatttgtcgttttccttccttctcttcttttttcatagactttttctttgcttttccnctagatttttccttcattttcttgtaatgccaggcccacgctgccaggggtatccaaagcccctagaaatncntatgaaccaacgaagggaacacnaccaacacggaagggcaaacaggcaacggagcnagcagggggtttgccntnggacaanacacagacacaccagcacaccanaacacantacaacgancacgcanangcaggaataaaaaaccccgctcgcgaatatgagagagagaagtgacagccaccaccanacaacagnaacacagacgagcaacgagacaccgcactangcgacacgaag

SEQ ID NO: 9805 - DNA, 458 bp, Triticum aestivum
  misc_feature (28)..(28): n is a, c, g, or t
  Predicted polypeptide sequence is orthologous to G1488
ggcaaggtgctcgagctccgccgccagnaggagatgcaccaccaccaccagccgtcgcagctccagcagcacgcggtcgccggcggcgtcgggaggataatgcacatggagagccacctgctgttcgatgggccggcggcgccgcccatcctcggcggcggcgacgacttcttgatccaccaccgcctagggacggcagactaccggcagcagctcatctagacgagtcgtcagtctgttagaactgatcagtttagcccagaaataataattaaaagcagctaaaaccccaagagccggaaatatcggaagaactgcaaatgtttgcttattaggagttatattttcccagttttctctctgcttccgtttggttagcccgtgtgctttttgttgagctcgaaattttcgtgtccatttagttcatgatcctccccagtttcccgctaaaaaaaaaa

SEQ ID NO: 9806 - DNA, 634 bp, Triticum aestivum
  Predicted polypeptide sequence is orthologous to G1488
ggtcgacccacgcgtccgcggtcgataagcgaagccccttcggcgccatggccggcaaataaggggaagaggtgccagcactgtgggtcgtcagagacgccgcagtggagggaggggccaaaggggcgagccacgctgtgcaacgcgtgcggcgtgcggtacaggcaggggaggctactgccggagtaccggcccatggcgagccctacatttgtgccaacaaagcatgccaattcccaccgcaaggtgctccagttgcatcggaccaggcaaagcaacgacgagcatccatcaccgctgcctgccgacagcgtcaccaacctgcccccaatccgcgacgagctcccgaccaccagcacggcaggtcttgccagtgaggatccgaccgacgcaccgggctacaccgacaacccaatcaacgtgccgagctcactggactcgctgctgctcgacgggccgtcggcaccactcatcgtagagagtgaagattttgcgattagctagcctatgaagaataattcagctgagatgagatactgatcctttttacttcgtttgttcagatactgatgcttggaaattttaaactttcaatcactgaaggccactgcacaggccctagcagtgatcaaac

SEQ ID NO: 9807 - DNA, 863 bp, Triticum aestivum
  Predicted polypeptide sequence is orthologous to G1488
acgcttgaccttaggcctatttaggtgacactatagaacaagtttgtacaaaaaagcaggctggtaccggtccggaattcccgggatatcgtcgacccacgcgtccgcaaaaaagcgccgagtaacgcactgccccgccgcagatagagaattgcggtgcctaccgctctcgcggcggccatggaggcgacggtgcccgactactacggccgcgacaagaagggctccgacctcttcgtcgtcgacgacctcctcgcgctgccgtgcgacgacgacgaggaggaggaggaaggggttggcgaggcgccgttcctgccggccaactccgcctccgccgccgccatcgtcgtcaagcaggaggccgggttcgggaacgcgtcggccgactcgtccacggtcacggccctcgacagctgcagcaactccttctccggcctcgccgatggcgacttctccggcggcctctgcgagccgtacgatcagctggcggagctggaatggctgtccaactacatgggcgagggcgaggagagcttcgccaccgaggacctacacaagctgcagctcatctccggcatcccctccgggggcttcccctcggcgaacggacccactgctccggcgggccacgctgccacggcgcagcccggcatggtcctgcccggagggccccgtccccgccaggcccgtagaaagcgctccccgcttgccccgggcaactggccgtccggcctgttcgtttctccgccggccccggtctcccggcctccccgggggtcctggccctctcgcccggggagtcccggctctcccaccggggtttccttggcaagaacccctccagccggaataaaaataggggt

SEQ ID NO: 9808 - DNA, 550 bp, Triticum aestivum
  Predicted polypeptide sequence is orthologous to G1504
cttccggagtaccgcccggcggccagccccaccttcgtgccagccatccactccaactcccacaagaaggtggtggagatgcgccagaaggttgagcccaagggcgacgacctgctgcagttcatccgccgccgggattgatcgagctccccgtgccggcatcggtcgccggacggttggtctcgtctcatcccccttagctattatatatgtatacatgctagtatgtatgcattgcatgcttgcttccatccatgtagtcagtcagtcatcgtcgtccgtcgtcatgcatccacccaccatcatcgccatgcatcggtttcagtcagcatccacccatcaatcgccgggcatcctggccggcgttagttcaatagggcttttcttttgggtttactccacctcttttgcttcgtctattacttaattggttccccctaagaagatttgatgtctgtatagagcagggtgagtgaggagggcaggagaaatagatggatggatcaatcacagagtcggtggttgttgcattgcagttgcttgcaaatta

SEQ ID NO: 9809 - DNA, 595 bp, Triticum aestivum
  Predicted polypeptide sequence is orthologous to G1506
ctccatttctggcaattgtgactccatctgcattcggtcaagcattatagttcgcacagtatggcctttgttacatgcctggcacgtaatggctgctatcagtctgctgagctcatctgtttccctgaagagttacgatgggagtatcaaatagacatgtatcagcaacgtcatcagtctgttgagctaatctgtttccctgactgaagagttagtatgggagtatcaaataaaagtgtatcggcaacgtcagaatggttaggaaccttcatacaacagttactagaggcagcaccagagcaattcattcttcgaaagcctgaatatcgctgttgatatttttatatattgtccggttgttggctttctcaatatttcccttcctggaagcatgtttctcagtgtacgtttgtaagctctgttgagatgtatcgcatgatgctagtgcccttgatagactttctgctttgctctggttcttgggcaatgggagtacgcaccctctttggcatgcatcgtccgggaaagacgccggttctgctctgctccctccacaagagcaactgcgtccgcatgttgggcctgccatcgttcg

SEQ ID NO: 9810 - DNA, 662 bp, Triticum aestivum
  Predicted polypeptide sequence is orthologous to G1506
gcagatatacaggttacaatttctccgccatatatatatgctacaccaaacaaaagaaaacaagcgcagacaaattcagcatatgcatgtctggacgatcatcggtgagcggtatcgtatgatgatgatccaggaaccaaaatgtaaacaaaactaccactgatgcctgttcctgagctgatcgctagcggaaccgggactatggttgctcgggggagaggctgcggttacggtcacagagctgagctgagatggtggggggcagcagagaagaagctctgcttcagggtgccgcgcgttgcgagggacctccagcagcagcgagtcttggtcagaatccttgtccgaggggttcagcatagatgataatttgtctggggctaacatgaacaggttgagtggtgctgctgctgctccggtggcattgccagatttcggcaaaaatgcgcttcttctcaactgacaagaagccatagccctggatctcgaagaagctaatctcatggttcctcctctcacttctgcatctgtgaagctttgctgctggctttcataaggtcttttgagagacctcatgctggacttggtaaggcctccaacttccttgctgcaattgtcctctaaagctgaatctgcgctctccaggatatgctggttcgaac

SEQ ID NO: 9811 - DNA, 662 bp, Triticum aestivum
  misc_feature (30)..(30): n is a, c, g, or t
  misc_feature (80)..(80): n is a, c, g, or t
  Predicted polypeptide sequence is orthologous to G1506
ttcccccatgaaagagttcttctattttcncggtgatatgagttatactttctccaaaagcccacgtgctatggaaaccnacacaagcctagtccaaaagcaccgctacaaatgttagctgaacgggcaattttgcctccgcggcagacgcacattgtcaatgtaaattggggcgataacgacggcacaagcatgaacaaaccgcagaaagccctaccggtgatcggtaaataaaggtaccgtgatgatccaggaaactaagggaaactaccgctaccgcctgttcctaagttggtctctggtctacggttgcttgaggcgcccctcgccatcagcaaccacgtctgctgaggtggagctgcgggttactgagctaagttgaaatggttggcaaagaagttctgcctctggttcccgcgcattgagaggaacctccagcagcaagtcttgatcagaattatccatgtactgcggaggggccagcatggatattttatctgggggtaacatgagtaagttaaatggtgctcctccagatttgggcaaaaatgaacctttgaactgaggagccatagccacagatttgcaaacttttttggcaatcctcatggttccttctgggcagctttgcaactggctttcatgaggccttttgagaggct

SEQ ID NO: 9812 - DNA, 655 bp, Triticum aestivum
  Predicted polypeptide sequence is orthologous to G1506
ccacgcgtccggattcatacaccacccaagaaccgccccttgattcccccctccccctttttctgctcgcgaattacttggtagtagtatttccacaggagaactgctccttttccgctctgttttccgtgtttctctgcttggaaattcctccggttcttcctcgtttgttcgtggggggcgaggggaggaggaggcatgggaaaggaaggtccttgctgccattgcggcgtcacgagcaccccactttggcgaaatgggccaacacataagccagtgctctgcaatgcatgtggctcgagatggagaacaaagggttcattggagaattacacaccaatgcattctcgtgatgatatcgatgctgatcaacctagagttagcaagctgaagccgccgacattgaggctaaaggaacagaggcagctaaagaaaaggccaagccacagcataagggagaatggagcattttctgatcaaaacttctggaagatgggggatgccgacccaagtcgatctagttctggatcggcactatcatattcagagagttgtgccccatatggttctgctgatgctagtgaaatgactggttcagcgcaatcgcatgcttgggagtcattggtaccatcaaaaaagagaagctgtgtcactc

SEQ ID NO: 9813 - DNA, 882 bp, Triticum aestivum
  misc_feature (14)..(14): n is a, c, g, or t
  misc_feature (832)..(832): n is a, c, g, or t
  Predicted polypeptide sequence is orthologous to G1506
aaccgccactgagntagggcctattcaggtgacacaatataacaagtttgtacaaaaaagcaggctggtaccggtccggaatcccgggatatcgtcgacccacgcgtccgcggaggaagattaatttaccacagtgcaactcctgtggattcctttgagattggttatggaagtatgcttctgagaagttcaaactcaaaatcagcggaggaagattcagaagcaaactctgttcctgcagataataaatcataccttacaagtgaatcctattcagggactgcctcgtttgttgtgcatagtgaaagcaagggggcaagtaattcaaatgcttctcctgagaagccaaagtggtttccggtgcatacacacgaaattgctaaaaggggtaaacttcattactcaaagcagcataccctggaaaatgtaggttcaactttagtttcagtagctttagagggagaaggcactaaggaaacaggaggaaatgaaaataccagtgctttgaaagaccttaccaaatccaccatgaagcctctcaaaaggcctcatgaaagccagttgcaaagctgcccagaaggaaccatgaggattgccaaaaaagtttgcaaatctgtggctatggctcctcagttcaaaggttcatttttgcccaaatctggaggagcaccatttaacttactcatgtaccccaataatatcatgctgcctcgcatcatgatatctgtcagatgtgtgagtcctcagcggaaccagcaattgccgaaaacagagcaacttcttgcaacattcacttactcataccgcactcactcacaacgtgtgctatgcnagggcgctcaacacgtaacagaacacttagacaggggtcggtatcccttt

SEQ ID NO: 9814 - DNA, 641 bp, Triticum aestivum
  Predicted polypeptide sequence is orthologous to G1510, G1779
ctcctcccctccccatctcatcctgatctccaattatctgcgctccctagctcgctagatctcctctagatctcatcatgtctaccatctacatgagccagctctctactgctttccctctaatggaggaagatcatcaccaggatcaccatcaggggcacttccaggccttcaccctgcccaaggatccccccatattgttcccttttgtgatcagcaacagcggccctagcgacaacagcagtactctcagctacggatcagaccagcacttgatgcagcaccatgccatgctagatcagccccaacatatgatcggtgaatcatccagtgtgttctcgacgccgttcccgaccgtcgagagcatccgcgacgacatgatcgagcgatcctactcgtacgatccatatgatatggagaagctgcaggccaccagcggatcgctcaagatcggcaagtggacggcgcctgctcccgcagccaagatgaggatcacgaggaagacgagcgatcctggtgtcaagaagccgaggaagagggcgcaggcatacgaggatcatggccacatgggcggcatgaaccaagctctgggtgttattaggacatgctctgattgcaacaccaccaagacccccttgtgg

SEQ ID NO: 9815 - DNA, 683 bp, Triticum aestivum
  Predicted polypeptide sequence is orthologous to G1510, G1779
attcggacgaggaacccctccctctctccctccattcgaaccaaacccgagggagccgccgcccgcggaatccaaactttttccctccatccccttccccgcgcgatcaatcgatcgcttgatcaagcgcttgatcgagcgatcggagccgatcggggagcagcggcgatcaggaatcgatccgtgctccgcatacaagatgtcgccggcggagatggagtccgacaaggtcgttgaggcggcggcggatcctgaggagcgaggcgctggcgaccccaaggcctgcgacgactgcaacaccaccaagacgccgctctggcgcggcggacccaacggaccaaagtcgctgtgcaacgcgtgcgggatccggtaccggaagaggcggcgggtggccatggggctcgacccggaggccaagaggaagcccaagagggacgacgccatcctatccaaggcggaggcttctagtaccaaggaggaggaggaggaggacaacaaggccagcaccaacaagatcaagaccaagacgactactcacaccgtggagctccacatggttgggttcgccaaggacgcggtgctgaagcagcagcagcggcggcggcggcagatgcgacggaggaagccgtcgtgcctggggcgaggaggagcgcgccgccatcctcctcatgtcactctcctca

SEQ ID NO: 9816 - DNA, 849 bp, Triticum aestivum
  Predicted polypeptide sequence is orthologous to G1512
acgcttgacattaggcctatttaggtgacactcagaaaaggttgtaaaaaaagcaggttgcaccggtccggaattcccgggatatcgtcgacccacgcgtccgatctcatcccacctccacctccttcttaacctccctcatcttcttcctccgcccgctcccccgcacgccgcagcgacgcaatctcaccgatcgggcctcgccccccctcgctcgatcctcggaggccagggaccgagggcggcggcgcgcgtgcggattggattccttccgagtaccgtgagttcttcgaccagaactgtttgcgacagctagcattctgattgctatggaaggtgggggaatggaccaggtttgcatggctgccatgacaaaccaacctccagtgtccgataacaagccgatgaagaacatcagtggggagatgcctgcaaccgcaaccgcaaacgctggaagcggctcctttgactgcaacatctgcctcgatttcgctgcagacccagttgttaccctctgtggccatctctactgctggccttgcatctacgagtggctgcgaccgtcggtggtatcagcctccggtggcaacagcacttcagcaaggcagcagtgccccgtgtgcaaggccgcgctatctgctgacagcctcgtgccgctctatggccgtgggtggtagctcgaagaaatcactggatggcacggccatccctcgacggccacagtgcaccggggagaatgttgcgcaccagcacgcgcaaagcagcatcgatgatgaccggcacacccacatggggagcccagccctccgctccggtaactgcggcatgggccacaccacccttcctggg

SEQ ID NO: 9817 - DNA, 651 bp, Triticum aestivum
  Predicted polypeptide sequence is orthologous to G1519
caggcgtatcatgtttaagaatcattctttagccatataaaaggatgacatatatatgcaagggtaaatccgctaaatcaattcccaaagaattgaatgagcagatcaaatgcaacaattcagagcatatttgtagaggaagtaatggaaagacattgtattgcagttctgtaaccatttcctcaattctatggagatgaaaccagagcgtaaccaataatgaaacacatgaacatcataggtgaactaacctgataattcctaaggagtattccatcgaacaacctgagcaacctaaaaccaatggcacaggacaattcacttgatctggagtgtggccatctttgtgtaggacatgcttcgaccatggtgagggagaggtccatgcggcaagtttgtctgctgggcggtggtcaacaagatggggacattgtcttctccacccggtgccatcagggtttgctggaaaagggatggtgcagaattcacccattggtggcactatcgtgccggcgaccacttgctgccctctttgtcggcggcctaaccttcacccttctcttcatcgcctcccatcacaaaattttccatcgacggcgaacttgatcccctcccctatcagtgtgattgctgctgctatccacaaggtca

SEQ ID NO: 9818 - DNA, 508 bp, Triticum aestivum
  Predicted polypeptide sequence is orthologous to G1526
aggtgcatttgtcatggacccttggtggaatcctgccgtggaagagccagctgtcatgcgcatccatcgaattggtcaaacgaagactgtttctatcagaagattcattgtgaagggcactgtcgaagaacgcatggaggccgtccaggctcgaaagcagcgaatgatttctggagctttgactgaccaagaagtccgcactgcacgtatagaagaactgaagatgcttttctcttgagacgaaaaaaagggctgttgagcatctgatggtcggcatgcttgcacattgcatccatggctaaaacaagatggccggtgtcctttttttctcaaagccagaagttggaaggtaaggcgagggtaggaaatttgcaccgcccaaatatcttccatcttcgggcgtttagctgttgttgtacgcgtggtttgtatatcatgaacaaaatttgagtcagcaatcggcagaagaaaagtttcttttgtaaaaaaaaaaaaaaaaaaaaaaaaa

SEQ ID NO: 9819 - DNA, 413 bp, Triticum aestivum
  Predicted polypeptide sequence is orthologous to G1526
agggccagtcattggttgcctccgccaccgccggggagtgcatctacacctggggtgacacggtcaagcggagcgttggccgcaggccaccgcctgtggctgtacggccgcatcgttgatcttgccgcgaggatgaagcggccgagggccggcgtgtgctctgctctgtaagtcgccccgccttaggacggcctgcctcgtctggagcgcgtcgccgccgccgccactgccgcaagacagaaagcgctactgttgcagcgccgttgctcgtgtggggacctcccgctgttgccggagcgtctaattagactggagggcgacgcttcggaggatcggccatggccatatcctcggcgccgccgatctgcgcggatgtgagcctttaattgttctgaaaaaaaaaaaaaaaaaaa

SEQ ID NO: 9820 - DNA, 740 bp, Triticum aestivum
  Predicted polypeptide sequence is orthologous to G1537
ttttttttttttttttttaatagaattcatcatcacattaaaacaaagtacatacatagttctcatctaacaacatatatatagctctccagagcatctaattaattaaaccatacattgaaactatgtaaaacatttcaatgcgaaaacaaatgcgatcataatcgcaaccaaggtaacaattgatccaacggcataatgataccaagcctcggtatgaatggcataatgataccaaaggcataatctttctaatcttcaagcgcattgcatccatcttgatcttgtgatcatcgacgacatccgcaacatgcaactccaatatcaccttcttctcctcaattttttttattttttccttcaagtaattgttttcttcttcaactaaatttaacctctcgacaatagggtcggttagaatttccggttcaaccacctccacatccgaatcatagacaggacgagggccgacgggggcggataccaaaaccatcgcacttgtagcaagttacttctcgtctggagctcgcggacaaccactactttagaaattaacaaaaagggcatcatatagctcgtttgcgtcgacattgatcccaccgtgcaacctccttcttgtattgctctcccaccgctacggcgccaaattgtcatgaccccctggttgtagaggctcgaggatggatagatagatgtgtcaagtcaggcgctgctaccgattatatggctacgaaaagggc

SEQ ID NO: 9821 - DNA, 1041 bp, Triticum aestivum
  Predicted polypeptide sequence is orthologous to G1538, G1545
aagccaaaccggccgcccttttttttttttttatacttacaaagattaccccttcataatgttcatggcttagcagatagtacgtactactactgagattctccgttagggcatccacccattgaaactaccaccaatactacccagttctgacttgctgctactactgctagtacgtgcatacgattgccccgcaatcccggttgattaattaattaattaacattgattgagcatagtaaactaccactagcactgttctttcaccccctctatccgggtgagctgaactgatcgtacacccctccgaggtagccgccggccgccaggtccatcatgtagttggtgtaggcgtactcgctcatgtaggtcaggtcggtctccacctcctccatcccgaactgctgcccccctaccattgccgtcaccgtcgagaacgacgaagagctcgggctgctgccacccccgccgcccgttgccgccgccgacgccgccatggccttgtttttctcctcctccgtctccgccaacctctccttgagcctcagcagctcggcctcgaggcggcagttgtggacgacgacggcgtcgtgggccgcgcggagcttggagaactcctcctcgatgagtttgctcttgtagcgggcgcggcggttctggaaccacacggcgacctgcttggtgtccagtcccagctccgcggcgagctgcaccttgcgcggcgtctccagcttccgctccttcctgaagttcatctccaggaactgcgcctgctcgtcgctcacccttcgcttctttcgcggggtgtcccctccgccgttgccggccggccttcttctggtctccgccggagacgacgggtgttgggtcctccgcccggaagctgtccggggaagacaaaggagggaacaggaacccttttccctcctcggagcttatttttcccagcaaattaaagttaccggcaccccaaaaatacttccctctttaacctgggcccggatccacaaaaactaagttttttggatcgggtcttgacca

SEQ ID NO: 9822 - DNA, 444 bp, Triticum aestivum
  Predicted polypeptide sequence is orthologous to G1539
ttttttttttttttttttttttttttttcacccaaatcaaattatagatctgcagcaagaagctgctgctgctgctacatgctgctgacgacgatgtacagtaaaaaatccaggcaaatacaggtaaggcaatcaactacaactactactaggtggcaattacagtaagggactgatcgatcgagggatccgtcctgtcaaccaagaagataagtaccagtaggggaagtaaaactgctactgctgctgctcctgctgctgggaaaaatcaggattaaggaggtgaggtgataatggtgggagtatgtgtaacgagcgagtgaaagaaaaagttgttgttgatgaatcggtggttggttggttggttaggctataatgcttcttttcttctttccggagcatctttttcccttggcctttctacacggccggccggccggccgg

SEQ ID NO: 9823 - DNA, 334 bp, Triticum aestivum
  misc_feature (316)..(316): n is a, c, g, or t
  Predicted polypeptide sequence is orthologous to G1554
tcgagtttttttttttttttttttttttatggaaccatttctctaattcaagtaccttttcaaaatacatggtatatagaactgttacaaaataagcaattcttgtccattttataatgtttcactcttgcagggttttgaaacatacgcacttcagtttgctgatgctggtatactggcatgtggcaagcaagcgcgatgtgcaagcaagttcatatacatatctacccctcctgatctaatgtagtaccactatgtatttacctacttttctgggtggtccacaggagtaagttgaacatccaccaagcacaantctgtttgaaaggggggg

SEQ ID NO: 9824 - DNA, 489 bp, Triticum aestivum
  Predicted polypeptide sequence is orthologous to G1554
gcacgagggtgaggttggcttcctggagttcttcttccggaatgcgagggcgctgaagaccgcatctgtttccatggccatccaagcttcacaccgttctcggcggaggaggcgcacgccaaagtgaaatattgctacaggaacaaggcgagtaagtcctgccacatggttgtccgtgggagtaccggcccttcaggaggtgaagtttggaggttcaaagatggggcagatttttctttccatgaccccttttcccaggtgttggtcaggtgagcttagtttctgtggagaagtgggctggctgttttctggtgcaaactatgaagtaagtatggtgtctgtctcttgctagccgtgcccttgtgatggtccgtcgaatttgaggcttgatgagctgatattttgcttgccctgcatgtaacctgtgttacctgttacccggtctatctatgtatgctccacgagccatttcatttgaaaaaaaaaaaa

SEQ ID NO: 9825 - DNA, 557 bp, Triticum aestivum
  Predicted polypeptide sequence is orthologous to G1554
tttttttttttttttttttttttttttccgcaaaactgtaactagtataacctcttcccgatgtacttacataataacagcaagagtttcatctcaaagcactcaaggcttgatctccctgcatacaacaaaaatcgactacactacaatcatgtctcaggaatctctcaagataccactgtcatcgcgcgacccggaaactccgaacaaactctaatataacttgttgatcatttccagccatagctctcggatctgccatcttcctcctcgccgctgaccgtcaccgatgaggcagctacgcctgagcttgaaaagtgaaggggccccggaggtgaccctcctgactgggagctgctttggtcctgagttatccagagccctcccatgagcacgatcggccggttggctgccggagatcctggcgcccttcggttgtgtagacggtatttctggagatggctcttcacttcatcattggtcaggccatccaccttcatcagctccctgatttgctttggagtagcaacttggggaccaccgatttggtgcagggc

SEQ ID NO: 9826 - DNA, 1110 bp, Triticum aestivum
  misc_feature (836)..(836): n is a, c, g, or t
  misc_feature (865)..(865): n is a, c, g, or t
  Predicted polypeptide sequence is orthologous to G1554
gatacccgaggcggtcgcctgcagctcatatgtcccttgcagtcacgttagtgtagattccgtagggatagcgatcataacagctcccggggtcaattggtatctccgtcccgtaggagagatcggcatgggcgcagatttgagcctggatttgaagatgttcgcggccaagagcctggggcgggtcagggaagcgccggcggccgccatggacgactgtatccggaggctggaggaggagaagagcaagatcgaggtgttccggcgcgagctccccctctgcgcgcgcctcctcgccgacgtgattgatgtgatgaagaaggaggtggaggagaagaagagaggcggcgatcgaggagaggacagggaggacgccggcgcaggcgacaagagcaactggatgagcaccgcgcagctctggaccggcgattccgtccggggggacgatgcttccgagaagcaggatgagaggaggaggtcgtcggagccggaatctcgcgacggcgctggcttgccgtccaaggccgtgggctccggcgcgccggcgttcgcgccgccgagtttgaggaaggatgacaaggctgtgcggatgccggatctgccgtttctgtcgccggcaccgatcaagacctctccggctgctgctaccggcggcgctgaagaaagccgccgccagcttgtgggattcgcgcaagaagcggcgagggctgcagccgccctggcaccggctgccccttccctaagcctccaggcgcagtcgcagcagacagcacagcagcagcagcagcaagcgaggaaggcgcggcggtgctggtcgccggagctgcacctccagntcgtcacggccctgcacccactcggtggntccccagtggctactccaaagcaaatcagggagctgatgaaggtggatggccctgaccatgatgaagtgaagaggcatctccagaaatacggctggaccaccgaagggggccgggatttccggagccaacgggcgatcgggctatgggaaggctcgggatactcaggagcgagcagtctcagtcagggggatcccccggggcccctaaattttcagcccggggctacttcctatggggaagggaa

SEQ ID NO: 9827 - DNA, 685 bp, Triticum aestivum
  Predicted polypeptide sequence is orthologous to G1560
ggattgaccggctgaaaagggacaagcaactgttgatggcagaagtggtgaagctaaggcaggaacagcagaacacgaaggcgcgtctgaaagccatggaggataggctacgtggtaccgagcagaagcagcagcagatgacttcattcatggcacgtatcttgcggaaccctgaattcttgaagcaactgattgccaagaatgggatgaggaaggagctccatgacgctatctcgaagaaaaggaggcgccgcattgacggtggacctgaagcttatgccgtgggtgctagtagcagcagcctggagcaagagttgcctgttgtgtttgattctcatgggtcagtggaacttcttgccgaggggtcggtgccggtggaactccttgctgacgggatcccacccgatctggaaggctcagtggaactccttgctgacgagatcccacctggcctggaaggttcagtggcactccttgctgacggcctggaaggttccgtggaactccttgttgatgggattccatctgatctcgacggctcaggtatcgactctaacggcgtaacagagccacaggattatggtctcggtacctgtgaagcgcagcagaacagagccctggggctgttccatgataatttctgggaggagctgctgaacaaaggacttcagcgttgagaacgacg

SEQ ID NO: 9828 - DNA, 703 bp, Triticum aestivum
  Predicted polypeptide sequence is orthologous to G1560
atcaggcccttggctcctgcctcgaggttggccagttcggattggacgaagaaatcgaagtgctaaagcgcgacaagaacgccttactcgaagaggtggtgaaactgaggcaggagcagcagagcagcagagctgacatgcgagccatggaagagaggctgcaccgcgtcgagcagaagcagctccagatgatgggtttcctggcaagagcaatacagaaccctgacttctttcttcagttgatccagcaacaagataaactgaaggatcttgaggacgcttattcgaacaagaggaggaggtccatcgacgtaatgccgttccttggccctgagggggccagtcagagtgagccactcgagtccacattcatatttgaggacagggaattttcagagctggagaatttagccatgaacattcaggggatcaggaagggcatggagggtgacagaggtggtcgggatcaaggctgcggtgaggccgaactgactgacgacttctgggaggagctgctgagtgaaggaatgagggatgaagctgagatggtagagctggaaaggaggagatctagatatgtcgacgcgtagcgcaaagtatgggtcatttaagtacagcgatccaaaatctaccagaattcataaccatttaatctatataccattgtattgatagctgtattgtatattgtagtgctaattca

SEQ ID NO: 9829 - DNA, 1100 bp, Triticum aestivum
  Predicted polypeptide sequence is orthologous to G1560
ccgcccttttttttttttttttttttttttttttttcccacggggtactcttctatttatttctcatacggatactgacaatgccaatacacacgagctagcagaaacactgcagttcgttagaccgacagtagctagcagaaataactgataccaaatagaatcctcccgaaagctgaactaaacacggcaatgacgaaaataagaccgacaccaagataatatggtagcatcatcaccaaaggcggcagtgatctactcgactgactgatcatggccgacatggacatatatatacacatatataacaacaggcttgctggtaaggattctcggggctgctcggcgatggattactgtccagactttgtgttcttcaagtggagctagtccatcttctgagccaacaagttcatgtcatctggaaccacaaggttgctggcctcctcgccgagccccccttcatgcagcaggtcctcccagaaatcatcatttagctctccactgggcctgcctctcagttgctccgaacggctggaagcgacactctgctgcacctcagctccctttgtgtcgacggacgagctttcaagatcggatatgacaccgttcacgagcgagtccactggctcctgcttctcaaacattacctgtgacccttgttccagggtagagccagtgcccatgccatcgacagcttcaggtccttggtcgatgcggcgccgtcttttatttgagatggcatcttcaagctccttcctcatctcactctgggagatcagctggcgtatgaacatggggatctgcatgactcgcgccaagaatgacatcatctgctgtggcttctgctcggttcctggcagcccttttttcatgggttggaagatctgacttgtggttctgttgcccctgtctgagcttcaccatttcagccaataagaggtggttggtcccttttcaaagtgactatcccccaggtcatgttcaaaagtctcccaccctcagggtaagaacccaaaaaaatgggtgattttgaaacccatgtggtaggggtcccggggcgttaatatttctggggggggggccctttgcccctccca

SEQ ID NO: 9830 - DNA, 1999 bp, Triticum aestivum
  Predicted polypeptide sequence is orthologous to G1635
ctcgtgccgaattcggcacgagctcgtgccgcgcctcttcgcctctcttctcttctcctgcctgcccctccctcctcgcgctccatcgacaacgagcacctcgtcttgttcttggtcttggcttttggtgtggcgacgttgggtagtgtgattatcttgttctcgctggcaggagatggcctgtacgcaggagaacgccatggcaaccgacgaaagcacggcggatcatcgcgggagtcgtccgagttcccacgacatggatttatcaggggatgaccacgtgccaaaggcacgcaagccgtacaccatcacgaagcagcgggagaagtggaccgaggaagagcacaagcgcttcctggaggccctgcagctgcacggccgcgcctggcgccgcatacaagagcacataggcaccaagacggcagtgcaaatccggagccacgcgcagaagttcttctctaaggtcaccagagagtcgtccgggagctgcagcggctcgggcgccgcggccgcgacggcgacggcggcgatccagatccccccgccgcggcccaagaggaaaccgacgcacccgtacccgcgcaaagcggacgacggcgcggcggccggcggtaagcacgccccggggctcacgcatctggagaggcctcccgtgcggatgggcgagcaggaggaagggtcgccgacgtcggtgctgaccgcgtcgcgggtcgaggcctccggtggccgcttctcctacaactccagcggcagcaggtcgccggttccgtcggccgccggctccctctacggctcgtcggtggacagaggggacggctgcctctcgcctaatacgactaaggcttcagagttcactgcaaatggtgatgtcaaagaggggtcatgtacaggatcagcgacatcagtccttaagctattcggcaagaaagtcgtggtgaatgattcattccagaagccgaataccagcaccggcaacccgcagaatggtggcgacgtcggaactgaagcttcagacgatacaaccacacaaggaagcagaaacctaccttctggcggtgccacagaaggaagctcatggaatccatggccgagcagcatgcagcagtttgtgtattttgttcctcaaccggatggtttcgccacacaatctgcggtgccatggtttggcaccctgcctggtgcaatgttctaccagcaagccatggctccaaatcagcaccagcgccatcgctcagagaccgcagaccacaagttcatgcagagggaaggatcctggacaggatcaaacactggccctggatcagctgcgcataattcagatgctgccgactcccgagggagaggaaacagcagtgagagcgacaaaacgcctgtgccgcggttaacaaagtgcgagagctctgtttcggtcagtctgcaaagaggtttcatgccatacaagagatgcgcggccgagagcgaatcgctgcggtcggaggcgcccagagaggagaccgacggtgagttgacgaggctgtgcttgtgacagccgaagattcgacacgctcttcacagtttagatgtttgctagttttgctctagactcttgagctggtggtgtgatctgcagtgggaagaagcgaccactcatcctgctggttttgcctgtcggtatgtcgcacttctccgaagcagctcgaagccgcattagattgagcatttctggttcttgctcgtgaatatatatagttggaatatgtagtatccatgtttttgttctctacagagtgtctctgcagtttttaccccaaatcgggaggctcagagttcagtgttgttgcctgtatcaacctgggcctgagagagggttgtcgtagtcttaactgcatgttgtaagctaggcaggcttgtatcactctgtagtctgcattctgtaaaacatatgataggcagaagacgaacaaaaacgtcgaatgctctgtatatctaaagtataacataatataaaaaaaaaaaaaaa

SEQ ID NO: 9831 - DNA, 819 bp, Triticum aestivum
  Predicted polypeptide sequence is orthologous to G1635
gcttgacattaggcctatttaggtgaactatagaacaagtttgtacaaaaaagcaggctggtaccggtccggaattcccgggatatcgtcgacccacgcgtccgctttgaagagagaaacaacaacaaagattaggagctgctgattttgcctctgttcttcgtcgcccgcctctcagcccgatttggcttcgccggtgctccgattttgaaggatccagagagagatatggctcgttttcaggaaaccaagccggatctgctgaattccggcagcgatacgcggatgatggccgaagcccgcctccccaaggcgcgaaagccgtacatgataaccaagcagcgggagaaatggaccgaggaggagcacaagctcttcctggaagccatgcagctccatggccgcgcctggcgccgaattcaagagcacataggcaccaagacggccgtgcagatcaggagccacgcacaaaaattcttctccaaggtcacccgggactcgtccggggacagcggcggcagcagctccggcgccgggccgccgatccagatcccgccgccgcggcccaagaggaagtcggtgcacccgtacccgtgcaacctgaggagcgcgcagccggggaagcgcgcccccgcgctcctgcgggtcgacaagcctcagctgtccatgtgtgagcaggggaatggctcgccgacatccgtggtgaccacctcgcagataggcttggggcggctccgagagcttcgacagcgacacctcgaccatcgacgttgaagagcgatgccccacgccgagcacgggggaccgccgaggtcgctg

SEQ ID NO: 9832 - DNA, 687 bp, Triticum aestivum
  misc_feature (522)..(522): n is a, c, g, or t
  Predicted polypeptide sequence is orthologous to G1638
tcggcacgagggtgaagaagtacggcaaaggggactggaggaacatttcgcgcaacttcgtgcagacgaggacgccgacgcaggtggccagccacgcgcagaagtacttcatcaggctcagctccggcggcggcaaggacaagaggcggtcgagcatccacgacatcaccacggtgcacctggacgaccagcccccctcgccgtcccagtcatccatgatcacccagtccagcgcaccggctccgagctcggcaacggggcagttctcgctgccggccgacaccaagcagcacggcggagcaaatgcgccatacaattcgccgccgagctacggcatgggtttgcaagatcaaggcatccagtgtggccctctgcatgatcagctggcggcaaaccggagcatgttgtattagaagatgcaacctttcgatccatttcgacgacaccgatcagatgtctagtgtaatatggcccttgctgtagcctcactgcctgtattattattgaagtaagtaattgatntatggggatttttcagaacatagcagagagagagagagagaggtatgatgctggtgatgctttggtagtagtccataatttctggtgtggatactgaagaatgtaaggggagaagaatggcaagaacttgatgctgtagtatcttgagacagacagggaatacta

SEQ ID NO: 9833 - DNA, 1085 bp, Triticum aestivum
  misc_feature (914)..(914): n is a, c, g, or t
  misc_feature (950)..(950): n is a, c, g, or t
  Predicted polypeptide sequence is orthologous to G1638
ggccgcccttttttttttttttttttttttttttttggaccgagaaacgtttgaaccaattttcaggccggcgctagctagctcctgaccggagcacaccggagcacaagcttcatcgaaggcttattacagattcttttttcagtacagtggaggttcttgggtgtggcggaattatgtacactggacggcacgccgatgggttcttgaggtttctccatggacgcagacctgcacgtacgctcaacaccgccgtgtcgctctcagatattttcgcttgcgttccatcatctgagtgtcggtcgagagagacacaagcacagcgactctgcaaccaaactgctctcgaggcaagcgcgcccgcctgcctgcctcgtccctggtgtggtagcgcccgtggatgcgatgatggtgagaggtggccgccgctgttttgtcctccgtgcgggcttcgccgcggcgagaaagctccgtcacagctggccgcattgcatctgcaggaggagcgagtcgtcgaggtcgaggcccgcgccggacatgaacgagctctggtgctcgagcttcacgttgccgtacgggtggccgccgccgagcgtccccgctggcagcgtcgacggcacgaaggcatgccgttgccccccgtaggacggcgagggcttcgtgtcgacggtggtgaccacggacggcggtgaccctgaggggctgtcgcggtcgtcgtcgtcgggcacgttgacggtggtgatgtcgtggatgctggaccggcgcttgttgtccttgccgccggaggtgagccggatgaagtacttctgcgcgtggctggccacctgcgtcggggtgcggctcgtcacgtagttgggggagatgttcctccagtcccctcgcccgtactctttagcccccttcagaggaccggntgttcttcttccgtcaaggggagcccctttttccgntcctggtcgggcgcccccgcttaaggaaataaccgcccggaacccgccgtgcccggggggcccccgtcccattcaaaattaacctcgaaaaagggaacaacttttctatttagggacgggacccccccggcctta

SEQ ID NO: 9834 - DNA, 396 bp, Triticum aestivum
  Predicted polypeptide sequence is orthologous to G1638
aggcgagttttttttttttttttttgaaaaatccccataatcaattacttacttgaataataatacaggcagtgaagctacagcaagggccatattacactagacatctgatgcgcttgcatcttctaatacagcgtactccggttcgcggccagctgatcatgtagaggaccacactgcaggccttgatcttgcaaaccctgccatagttcggcatcccgagcgaccggctcggcgaactgaagggtgtgctcgccccgccgtgctgccccgttgccgcgctgagccggtgcgctggactggttgatcatcaatcactgggacggcgcgggaggctggtcgtcggtcaggtgaactgtggtgatgtcgtggatgctcgacctccttgccacccct

SEQ ID NO: 9835 - DNA, 824 bp, Triticum aestivum
  misc_feature (752)..(752): n is a, c, g, or t
  Predicted polypeptide sequence is orthologous to G1640
acccgctagtgcgatataggcctatctaggtgactagattgaacaagtttgtacaaaaaagcaggctggtaccggtccggaattcccgggatatcgtcgacccacgcgtccgatgctcatgatacaagaaagatgtatggttcgtcgaatgtatttagttccaacaagggaatggtgctgtataaagttttaccgaaaactgaagcgggttctattgtacgtaaaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctcccccctgaacctgaaacatacaatgaatgcaantgttgttgttaccttgcttattgcagcttataatggttacaataaagcatagcatctcaaatttcacaaata

SEQ ID NO: 9836 - DNA, 1019 bp, Triticum aestivum
  misc_feature (22)..(22): n is a, c, g, or t
  misc_feature (28)..(28): n is a, c, g, or t
  misc_feature (662)..(662): n is a, c, g, or t
  misc_feature (827)..(827): n is a, c, g, or t
  misc_feature (873)..(873): n is a, c, g, or t
  Predicted polypeptide sequence is orthologous to G1640
cgacgacccacgcttccgtccncaaatnacacaagaagaacaagaatcatacgtcggcagcaccatgcttgtccaagttgatatcctaacaccgaccgctgtcaatgcgaggggtacatgctcacgaattaagggccacagagacaatgaaaagaaggcagggtcaaataagaagaaattaggggttactctacgggtaccgcgcacttgcagaacatgcaaggaagttgtgttacatgacagtcgtatctgtccgaagaaaaaataaaaatggttgtctaagtatgaacgctactaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtntgtgtattttagattcacagtcccaaggctcatttcaggcccctcagtcctcacagtctgttcatgatcataatcagccataccacatttgtagaggttttacttgctttaaaaaacctcccacacctccccctgaaactgaaacataaaatgaatgcaattgtngttggtaacttgtttattgcagcttataatggttacaaataagcantagcatcacaaatttcaccaataaagcattttttcactgcattctagttgtggttgtccaaactcatcaatgtatctatcatgtcgggatcgatcctgcattaatgaatccggcaacgcccggggaaaggggtttgggtatgggtt

SEQ ID NO: 9837 - DNA, 853 bp, Triticum aestivum
  Predicted polypeptide sequence is orthologous to G1640
aagctatgacattaggcctatttaggtgacactatagaacaagtttgtacaaaaaagcaggctggtaccggtccggaattcccgggatatcgtcgacccacgcgtccgaacactctccttgccctggcgtcctggctcatgctgcttctgcttgcgctcttcatcacaaccaccactgcttcactgccgtgccagtgctgctggatcgtggagcatccgacgaggacctgcggccacgcctgctgcggcgacaactgctgcccgcccgctccaccgccgtcggcacgctgaaaaaggatgcccaggcttgttcatcggaagtaaaaataaaaataaaaataatccagagggaatgatgttgtactcatacttacctgctcttctgtgagcatgtaatggtctctataactttccagcaataaacatcccttggctccttcaaaaaaaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggaaatataaaatttttaagtgtataatgtgtttaaactagctgcatatgcttgctgcttgagagttttgcttactgagtatgaatttatgaaatattatacacaggagctagggattcaattggttggggattttaaaatccaggcccaagctcatttcaagcccct

SEQ ID NO: 9838 - DNA, 696 bp, Triticum aestivum
  misc_feature (437)..(437): n is a, c, g, or t
  Predicted polypeptide sequence is orthologous to G1641
attcggcacgagggccaccggtgccgcccagccagccaccccgtccacgagcacacgcaacgccacccccgacccgcgcgctagttaattggcgcagcgccgcgcacctggcacctgggtgtcgtgtcgtcgccgcagggaggagagccagagagaccagaggccagccatggacttgtactaccagcaggccgcgccggcggcgaggaggccgtgggccaaggaggaggacaaggcgttcgaggcggcgctggtgacgctcccggaccaggcgcccgaccggtgggagcgcgtcgcggcgcggctcccggggcgcaccccgcaggaggcctgggagcactaccaggcgctcgtcgccgacgtcgacctcatcgagcgcggcgcggtggacacgcccggctgctgggacgacgacgacggctgcacagccgccgccncacccggccgccgcgccggcaagccccgcggcgaggagcgccggcgcggcataccctggtccgaggaggagcacaagctgttccttgacgggctggagaagtacgggcggggggactggaggaacatctcgcggttcgcggtgcggagccggacgccgacgcaggtggccagccacgcgcagaagtacttcatccgccaggccaacgccgccacgcgcgactccaagcgcaagagcatccacgacatcaccaccccttg

SEQ ID NO: 9839 - DNA, 1038 bp, Triticum aestivum
  misc_feature (23)..(23): n is a, c, g, or t
  misc_feature (791)..(791): n is a, c, g, or t
  misc_feature (800)..(800): n is a, c, g, or t
  Predicted polypeptide sequence is orthologous to G1641
cgacccacgctgccgcacaaatnccaccaaggcccaatcacaagcatccactttctttttgctcatcttctcaaggcctccaacggtggaggcggaataaactccggccgctttttgtagccgcccggaatttgatactcccccggtcctcccctatataggcacgcctccttccacctccccccttcgccactttcctgccttcctccattgctcgccaggccgtccttaagccaactcaggtagcagcaactagagccgacatgatggcggaggcgtggatggacgtgctgccgccgccggcgccctacttcgccgggcagccgtgttgggccgtgcagcaggagcgtcgcggaggcggcgcctggacgctggaggagaacaaggtgttcgaggaggcgctcgcggcgatcgacctggacgcgccggaccggtgggagatggtcgcgctgatgttgcccaggaagacggtcgccgacgtggtgaaccactaccgggccctcgagaacgacgtcgggttcatcgaggccgggctggtcccgttccctcactacgacagctcgtccccttcgtccgggttcactctggactgggacgggggcgccgccggcgccggcgggttccggcgcggctactgcctcaagcgcgggcgcgccgaccaggagcggaagaagggcgtcccgtggacggaggaggagcaccggctcttcttgaaggggctgaagaagtacgggcgaggggactggaggaacatctcccgcaactacgtgacgagccgcacgccgacgcangtggccagncacgcgcagaagtacttcatccggctcactccggcggcaaggacacaagcgccgctcagcatcacgacatcaccacggtcacgtgccgacgacgacgacgcgacagccctcaggtcacgccgtccgttgtcacacgtcgaacgaagcctccccgtctacgggggcacggcatgcctcgtgcgtcaacctccaggggaacgtcgggggggcaccgtagggaagtaaactgagcccaagt

SEQ ID NO: 9840 - DNA, 631 bp, Triticum aestivum
  Predicted polypeptide sequence is orthologous to G1650
ttttttttttttttttttttttttgaacatgatatttaatgtttcatatatactcgtgccacccatccacccactcgtcgggctttagatccaagtcccgagccacgagttcaatatgtaattacattgattgcatgtatgcactaagcaaagctaaaaatgaaaaattacataggcgacattggattggtacgatagcatctcgaccgcgcgatctccctactatgcccgttgcttgtatgagacggaagcctgacgaaactcgataataatggtgagatcctgacaatcttgaacagcttgcagtcgatgacaacaatgccatctcgatcagcattcttcacgcctgtagcgttcagtctgatgaagaacagcacagcacttctacggtacatgatcctccatctagcaacgtccgtccatgaggtgtgttcgctttggtcttcggagttcacatacagtacttaccacgcattcagctgctaatcttgcagaactgggcgcgacgcgccaattcaaaataccagtagtagcccatgcgctgtaacatgactacatgtgactcaccaatgagcagcagaccgattgctgcactcaatgcttcaaagcatctcaaaagaatggtggcaat

SEQ ID NO: 9841 - DNA, 644 bp, Triticum aestivum
  Predicted polypeptide sequence is orthologous to G1652, G2776
gaggaattcggcacgaggcagggatggagccgaccgtgcacgaacacgtcatggcggagcggaagcgccgggagaagatcaaccgacgcttcatagagctctccaccgtcatccccggcctcaagaggatggacaaggcgaccatactgtccgacgcactgaggtgcgtcaaggagcagcaggagaagctcaaggcattcgagggccgtgaggtgaggagcatcgactcggtggtgctagtgaagaggccgtgcatctccaatggcgatgatggctacccgtcaccggcgtcgtcagcagcagctggaggaggtccaccgatgacaaggatcccgttgccggagatcgaggcaaggatctcggagagcaatgtgatgatgaggatccactgccaggacggcaaaggggtccttgtcacgttgctcgccgaggtcgaggggctccaccttagcatcacacataccaatgtcgtgtctttcccggcttccactctgatcataaacctcatggccaagctagacgagggcttcaccgtcacagcagacgacattgtatggaagcttgactgtgctttgcgccgacatcatagcagcaaatgatagttctaggcttttagctaggagagggccaataaacatgaagac

SEQ ID NO: 9842 - DNA, 674 bp, Triticum aestivum
  misc_feature (19)..(19): n is a, c, g, or t
  Predicted polypeptide sequence is orthologous to G1652, G2776
aacatgaaaattcttactncgacttttattaatatgtagtagcatttgtcgtgcagagatatttgctagtatcatttaccttactctcccacaaaataaaataaaaacatttaccttgctgtttcttttacgaaaggaggattacccccgcctctacatcatttcttactgtgaatcacaaaaatcaatattggaccgaattgtggaatgaaggaaggaaaacttgccttggccgtgatggttatgatgacagtgcaggccgtgaacggcatgacattggcgtgggtgacggtgaggtggagcccctcctccacctccgacagcaccctcaccaccacccccttgacgtcgtggcagaggatcctcaccatgatgccggtctccgagaaccgcacctcgatctccggcagaggtttctccgctgccggcgcccccgacgacgcggacgagggtgagccgttttcgtctgcaacggcggcgtagcacggcttcttgacgagtaccacggtctcgttgctcctgctgctgcgtccggcggctgcctccagggccttgatcttctcctgcagctccttgacgtgcctcgtcgtgtcggaaaggatcgtcgccttgtccatcttcttgaggccggggatgacggtggagagctcgatgaagcgctggttaatcttctc

SEQ ID NO: 9843 - DNA, 764 bp, Triticum aestivum
  Predicted polypeptide sequence is orthologous to G1660
ttttttttttttttttttttttttttttttttttttagcattacctcatgttatcaatggtaacgtgctactgtagctcaggtcatagccattcagattgtacagactacacagcaaaccaaaatctgcagcacaccgattcaaataattgcatgtgcatcttgtcccacggcttgcatcgagacattcaagcttcttcagtgagattgcatttcagacgcaatctgaaatttgtttggttttcagcacaggaaccagttgcaacactggaaccgggacggcacgtgtccggtcttccagatgcgctccacctgtcgcgccaaccagactgcctgctggtcccgtctcacctcgaccctcacttgcttcccctccaccttgtgcctcaatgtgggaagcctcttggtgaagttgttcttcacccccgccttctcggcctgcacctgaaataaaatttgcacaattacaaccagctgagatttgtttcagtcttatctggacggtgcaacaagttcatggatgctgagctctgcattcatcttggcttcgaatttggatttctggcagttctcccactcctgtatcgtcacctccttcctttgatatctgatccatcatgaccaaaacaacacaagattcagaagaaaatacgtggagattttgttcgtgacttgatgcaagtttacacttcttggactctgctcatgccgcaactcgagcttcaaactcctccttcgcctcgtattctttgccggcgctcttct

SEQ ID NO: 9844 - DNA, 397 bp, Triticum aestivum
  Predicted polypeptide sequence is orthologous to G1660
cagaacgacagttggcggttacagacctgtacaaacatttcctccaacttcaggactacaatgatagggtcaaaacagctgaacagaggctgcagtctctcgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaactgcattgtaactagaaacaggaaaaatgttgtgtaagggtcggagaatctgctgtcgtggtccctgagcccggatttctctttcgaagttggattcattaaccggcctgattattcctgataccgtaaaaaaaaaaaa

SEQ ID NO: 9845 - DNA, 345 bp, Triticum aestivum
  Predicted polypeptide sequence is orthologous to G1666
tagcgtggtcgcggccgaggtacaacaaaactacagcagaacagctagcaggaggtagcagcaactcaaagaagccttcaggtgtttcttcatgcatttgcaggcactttctcttgagctcgctcatgtcctctctttttataccagcagtgctgccctgaacttcagacttttcagaatgaggcccatgcagacgactctgcaccagcagcaacataagcgaacggcgacgacagccctggaggagcaggagcagccgagccgccctgctcaatgattccatagtgcaccaggagccgcgtgatcagcacgccggcgacgtacctgcccgggcggccgctcgaa

SEQ ID NO: 9846 - DNA, 695 bp, Triticum aestivum
  Predicted polypeptide sequence is orthologous to G1672, G2802
tttttttttttttttttgaaaaatcagcatcaatttggaaagcaaaagaaattaaaagggttaatgtacacgcaaacaataccactactctttacaattagaaaataggtagtacgaataaaaaaactatgataaacggtgaactgattatagttgtacttgattaagtggtctctaatacatctagcggcccacacatgatcccttcagtgtcagcacaaacaatacctttcctcccatcgatctttcatcttctcttttcgttggccattttgtcttttctgtcttggagagctcacatagttccttttttttattgagggagatctacagagatcaatttttctctgttcttccccccactatagtaggtgtacattctccaagaaaagcatcgctgcatgttcaagcagacaaaaaccattccagtgaaagtggttgtggttagtgttccttttagcattcatcgccagtcgccactattttaccagtccttgctactatccatgatgatcttggttgtcaggtggccagtacgggtaaggccattctgtctcttgggggtgagcaattgaagtttcccctttcgtgcttgtggacgacgtgcatcccattatcagttcttccaagccggcagacctgaaatttgtcatggcgatggagaaggattgctggcacatggaactgatcatgat

SEQ ID NO: 9847 - DNA, 577 bp, Triticum aestivum
  misc_feature (473)..(473): n is a, c, g, or t
  misc_feature (566)..(566): n is a, c, g, or t
  misc_feature (577)..(577): n is a, c, g, or t
  Predicted polypeptide sequence is orthologous to G1718
tcgagtttttttttttttttttttgagtttacacataataatttaataaagaagagtaggtacagaacacatcaataagatgctgtttaatcattgtaacaccaacacaacaaagcttcaaagatgcaactaaaccttctgtacaattcattctcacagccacaaataaaagtgacagattatatcaaaagcatgatgacatattgttgttttccctaatttggatcctttacgggtttgaacctaaggcgagctagaaatggctttcccaaaactgaagccagaaaccgtgtcgatatgcggtgcatgttgacagtgacaatcttggcatgcttcgaggagaccaacatttgtttacaaccattcctccttataacagtttgacggcctcaattttgtggtgatgcttgtcagaattactacgggatcatttatacttcacgggttgcacgtaactgcgggttctgatccancctggcttgtataatcggtcctaagcgcgcttgatgggtcaaagccgctctttaagcctcacgtcctctaggagtgccgcaactggtacgcantcgccgcttcn

SEQ ID NO: 9848 - DNA, 1012 bp, Triticum aestivum
  misc_feature (5)..(6): n is a, c, g, or t
  misc_feature (14)..(14): n is a, c, g, or t
  misc_feature (16)..(16): n is a, c, g, or t
  misc_feature (19)..(29): n is a, c, g, or t
  misc_feature (31)..(33): n is a, c, g, or t
  misc_feature (38)..(38): n is a, c, g, or t
  misc_feature (55)..(55): n is a, c, g, or t
  misc_feature (60)..(60): n is a, c, g, or t
  misc_feature (67)..(68): n is a, c, g, or t
  Predicted polypeptide sequence is orthologous to G1718
ccccnntttttttntnttnnnnnnnnnnntnnnttttnttttttttttttttttnttttnttttttnnaccggccgaccgaccaccccacctccgctcccggcgtcggcgctagtttaggtgtctccctagaacaagtttgtacaaaaaagcaggctggtaccggtccggaattcccgggatatcgtcgacccacgcgtccgcagaactcgccggcaaaaagacagaggctcctccacctcctctcccctctcgctctcggctccttccctcccatggactcggcgaacggcgacaacatggcggccggcatcatgcggctgctcatgctgatggcgaggggcccctcggccgccgacgcaatgccgggggcgggcggcgggcgggtgacggtgcatcacttcatcctcagcggcgacggcggcgacctcttctccggcgaggtcggcggcggcgtcccgccggcgtccaaggcggcgatcgcctcgctgaaggaggtccaggccgctggggacggcgagggctcgcttggcgactgcgcgatctgcctcgacgcgttcggggccggcaaggagatgccgtgcgggcaccgcttccacggggagtgcctggagcggtggctgggcgtgcacgggagctgccccgtctgccgccacgaactccccaaggcggagccggcggccgaggagcatcacaagaagagcgaccacggcgaaaggcgccgaccccaggggcgcggtgactgtccagccatctaggaagcctgcgggggcaaccaacgaaggggaaacataaggatgcaaagacaaaacactgaaacgaacaccgacacgaaccattcacgaactacaactgatcctgagcacattaaaggccataccaaggaatagtatctataatactccctgctattctgacccgctcagctcgctcgcctcctctctatctgcacgcatctgttactcactcttgtaatgctcatgccactacaccgctaacgacttcacaccaca

SEQ ID NO: 9849 - DNA, 1193 bp, Triticum aestivum
  Predicted polypeptide sequence is orthologous to G1718
tgcgacccacgcgtcccggagaaaaacagagaactcgccggcaaaaggacagaggctcctcctcctctcctcccctctcgctctcggctccttccctccctcccatggactcggcgaacggcgacaacatggcggccggcatcatgcggctgctcatgctgatggcgagggggccctcggccgccgacgcaatgcccgtggcgggcggcggccgggtggaggtgcgccacttcatcttcagcggcgacggcggcgacctcttctccggcgaggtcggcggcggcgtcccgccggttttcaaggcggcgatcgcctcgctgaaggaggtccaggccgccggggagggcgagggcgagggctcgctgggcgactgcgcgatttgcctcgacgcgttcggggccggcaaggaaatgccgtgcgggcaccgcttccacggggagtgcctggagcggtggctgggcgtgcccgggagctggcccgtctgccgccacgagctccccaaggcggagccggcggccgaggagcagccgaaaggcgacggcgcaaaggccccggcccagaggcccggtgctgggtcagcatcgtgacgctccgaagcagccgaaaggccgccccaagaggaggagcaaaggtcggagccgtccaacatccggatcgaaggacgtgcttaggggtagggtagggcctcccaaacggtccgatgggtccggccccattggcgggcgcatgacggccagacagccttcacgatcaaccctcgtggtacatgacccacactagtaggtgtttgcccaaacacagacggaggggcaattgcgcggcccaaactcgcgcacctctaccccagatccgggaaatgccgtggcttccccccgggcgcccggcccccccccccggcaccaaacgcgccaaagggcgccgcggctctaagagtcccctcgcgggcccccagatggcgggcgtaccggcggccgtctggaccggaggcccccgtatcgccgcccgacggcctacaaccccgagccgggcgccgcatgagatagccgcccggtacttggacactcgtcagccagtggtcccgtctaccacgggccctcgagctgggccgcgggcccactcggccgaacccggctcacagcagtatccccgcctacgcgccgagctgcgacgcgccggggccggtgccgcacaca

SEQ ID NO: 9850 - DNA, 1150 bp, Triticum aestivum
  misc_feature (1066)..(1066): n is a, c, g, or t
  Predicted polypeptide sequence is orthologous to G1730
ttatgctccaacgcgttgcgagcctctcatatggtcgacctgcaggcggccgcactagtgatttcgagcggccgcccgggcaggttgaaactattaccaactatttttatttttttgcaaacatattccagaaacttttactgactatagtaagcctttggagttaaattccagtaaaacattgtctcaacaaacaagatggagagattccaggatatataaatgttctaaaaaaaaaaaggccaccacagcatcaaacgttatgatgaaagagagaagtggaaccaacatcacccatcatctaactggattttgtgtagacattgcaagtaaaaatgatgattcaatttgttccaaacttataggaaactaaaccacaccgggcagaaaatcaaatcacagaaagtgatcaagcctaacatcgcagcatacatgcgagaattgtggacaggtgcatgattcagatgaatatatcaatgcgtaatctgaaatgccagtgcccccagcccagtttaatctcaagcattgccacagaagaaaaagggtcagcttctactcaaacacaacttactgctacgcaaaagcacaagggcaagaattccagggtaacaagtaacggcacaggatgccacttagcatttcaaaagtctggaggcttagattgacatcttctaacagaacagaaacaatcttcgacatagctcgcagaggaagcaggttacgctgtagggacttgcactgcacgagcttccaaagcagggaacaataaagctcagcgccctcggccgcgaacacgctaatcccgcggccatggcggccgggagcatgcgacgtcggccccaattcgccctatagtgagtcgtattacaattcactggcccgtcgtttacaacgtcgtgactgggaaaaccctggcgttacccaacttaatcgccttgcagcacatcccccttcggcagctggcgtaatagcgaagagcccgcaccgatcgcccttcccacagttgcgcagctgaatggcgaatggacgcgcctgtagcggcgcattagcgcggcgggtgtgttgntacccgcacgtgacggtaaatttgcaggccttacggccgctccttcgtttcttccctccttctcgccaggttgcggggtcccga

SEQ ID NO: 9851 - DNA, 563 bp, Triticum aestivum
  misc_feature (463)..(463): n is a, c, g, or t
  misc_feature (472)..(472): n is a, c, g, or t
  misc_feature (481)..(481): n is a, c, g, or t
  misc_feature (496)..(496): n is a, c, g, or t
  misc_feature (505)..(506): n is a, c, g, or t
  misc_feature (509)..(509): n is a, c, g, or t
  misc_feature (536)..(536): n is a, c, g, or t
  misc_feature (541)..(541): n is a, c, g, or t
  misc_feature (557)..(557): n is a, c, g, or t
  Predicted polypeptide sequence is orthologous to G1749, G1840
gagactagtctcgagtttttttttttttttttagccacagttgaaaaactttactgaacaagttgaaggctagtgtcttctcagttaactaagcaaagcaaaaacagatagatacatagatagctcacagacacacaggtagatgccaatcacgacttgtacatttgttcagagcaaccaaaatccatgcccttgctgccctgtttactcctgcatgggctgccggagtttcttggcttctcgaactagccttgccatctccttccatgtcttcctgtttactcctgcatggcggattgctggcgctccctggcttctcgagcagctcctccgctcacggacaaccttggtactcctccatgtcttcggttaagtgcatcacttatgctggcatcgagtcttgacctcggccgcgacagctatcaattcccgcggcgcatgggggccggagatgcacttgggncaatccccnaaaggagtntataaaatcacggcngctttaaanntcngacgggaaacctgggtaccaactaacncttgngaaaccctttgcagcngggtag

SEQ ID NO: 9852 - DNA, 1079 bp, Triticum aestivum
  misc_feature (815)..(815): n is a, c, g, or t
  misc_feature (883)..(883): n is a, c, g, or t
  Predicted polypeptide sequence is orthologous to G1758
ggttacttcgacccacgcgtccgcgactggagcacgaggacactgacatggactgaaggagtagaaaaccaaccctccctttcccttcacgagcctccccaagcaccaaaccgacaggagtggtcgtccgcttcaactccgactgtttcggccgccgccaacctccggtcgattctgacgcaactagggactcctccctctctttatctctaccattagaatctttgtggtccctctaacccaccccactcgtcattttttctcgggaagtgtcgtaggcaaaatccccgatttggctccgccggaacatctcgggagagctcgccgctggcggctacgtccctcccagagactgttgcgcacctccacctgaccgctacgagtccctaagaatgatggtgcggtcttcttccgtcgccatgcccccaatcaccggcgagggtcgtcaagagcccctcctccgctcggccagaggagggagaaggccggtttgaccagggccaaacccgaccgaaggtccccgcgcgtcagtgactagggcgtgcctgagccatcctaagtgatggcatatttcggaaagaaaatggagggaagattatttttacaaacttttggagtgcacccaactcttctacatcaccaagatttacgattcagagaggagtactacgaagacaccccgcaacctagaaaatggagatagcagccacgtgagatagaagttagccaggccagttgttcctgtgggaatggagttccatcaacgttggagatcgacgagtcgctttcgtcatccaccactagagatcattgtnatactcgatgggcctttatatggtcttgtacccaaattcttctaaactgtttgaaatctgtatcaggnaaatgttcaccagcaaaaaaaaaaaaaaaaagggcgccgctctagagtatcctcgaggggcccagcttagcggtaccagctttcttgtcaagtgttcctatattgattcgatatagctaggccggccgctgttaaacgtcggactggaaaatgtaacttggattttgtaaggaccctattctggggggactaatga

SEQ ID NO: 9853 - DNA, 616 bp, Triticum aestivum
  misc_feature (266)..(266): n is a, c, g, or t
  misc_feature (424)..(424): n is a, c, g, or t
  misc_feature (527)..(527): n is a, c, g, or t
  Predicted polypeptide sequence is orthologous to G1767
ctagcccacagtgcaccatcctcccagtagcagcaagccgtccaccgcggcaggagcagcagcggcaccgaggagaagcagcgccgtcaaccaccaccggatagatgcagcagcaccttccaccagtgaggagaagcagtaccgtcagccacggaggatccaccgtggtttcctgctgatcttctttcctccgcccagcctacaaaattaaagaggggagatcgggatgctgcgcgccgcgccctgcttggatctgatggagcggnggagatagtggtcggggcatgggatggcgccttcgtcgtcagaccattgggattcagcatatttctgcagtcttctttagagatcaggagggttcgattcaacacaattccgggcttgggttcctgtcgaacaaaatcatctcgacagcattcctctntcttgcttcttattagtcaaactctgaaatcaatttctatattttagtgggtacttaattgatttgataggctatatctacgtgtgatgcatcaactaggctntgtaaatggatacatagggttttctggttattttcttcaataattatgtgttcccatttctcccaaaaaaaaaaaaaaaaaaaattcct

SEQ ID NO: 9854 - DNA, 651 bp, Triticum aestivum
  misc_feature (635)..(635): n is a, c, g, or t
  Predicted polypeptide sequence is orthologous to G1777
gttgaagcagttacttctacaataaattgcaatttgcagcacaaatatagtagaacatctctacagttctctcccaaaaagtcatcttcttgctcaacaggtagatttagcattataggaactatgcacaacggcatcatgtcatgtcatgatatacaagaggataagttgaaagtttgcttgctctattggtcgggatcacagccccagggcgaggttgcagcgcaagcaagcgccccaaggcaacaaaagagaacacagattcctttatgtagctgaagaaacacaggtcagctgtacagttgcagcggaatgttccgtcagatactggagcttcagatcttgtccgccacttcggctggcacgttgagatcaaaaagagcaccgccgccatgagcatctcttctttctctcttgtgagacgggcgtccactgttgtcagaacttgatccgtgcatctgaataataggtcgctttcccgtgagggacgagcctgattcgctacataaaccaagctgactcttgtgttcatcctgactacacttcatagatggcgaactttgttcagcagagtccacacaaatgtggagctctgaggctctatcaagacccttggatttgtatggggccatatnatgaggcgtgcggaga

SEQ ID NO: 9855 - DNA, 712 bp, Triticum aestivum
  misc_feature (18)..(18): n is a, c, g, or t
  misc_feature (711)..(711): n is a, c, g, or t
  Predicted polypeptide sequence is orthologous to G1779
agaatagataaggatacngttttaaacaacgataatgtccacataaacgccttaatagacaccatacaatacaattagtacgatacagttaaaaaccatagaataagtaccaagtcattttaaaccacaatcatgtcccacacatacgaatcatatcgtcaacacttcagacttcagatacaggcatactgtgcagagctgactggtatcatcactgatgggggctgcaggagctgcggtacagatggctgcccttcaagtcctgcctgtagaagttgctgccgctgcttcttcgacctgttggtgtttggtgcaggggcatgacaagcatttcgcttacctacctgagctttatctgatttctcaaccagatattccgtcagcacatacggaatgtaggtcggatcgtaaagatacaacccctcagaagaacatggcataagctctcccactaacttcctcttagtgtcaacagcgacaatccatgcagtttcaccctgctcatgcagttcggtcgcgaggtaaacaacatcgccgtcgccacgcagagtaggagcagctgttttcaggtccttgagtggcacttttagagcacacgcaccaccacctccaatctgaggcaaggagacagtgccgagctcatcggaatggactgtgttccccttgcgccaacagttccaagtcaatgtcctataccatgtgatgagcctnc

SEQ ID NO: 9856 - DNA, 1174 bp, Triticum aestivum
  misc_feature (3)..(4): n is a, c, g, or t
  misc_feature (8)..(8): n is a, c, g, or t
  misc_feature (17)..(17): n is a, c, g, or t
  misc_feature (25)..(25): n is a, c, g, or t
  misc_feature (141)..(141): n is a, c, g, or t
  misc_feature (708)..(708): n is a, c, g, or t
  misc_feature (716)..(716): n is a, c, g, or t
  misc_feature (733)..(733): n is a, c, g, or t
  misc_feature (739)..(739): n is a, c, g, or t
  misc_feature (750)..(750): n is a, c, g, or t
  misc_feature (756)..(756): n is a, c, g, or t
  misc_feature (776)..(776): n is a, c, g, or t
  misc_feature (824)..(824): n is a, c, g, or t
  misc_feature (838)..(838): n is a, c, g, or t
  misc_feature (848)..(848): n is a, c, g, or t
  misc_feature (860)..(860): n is a, c, g, or t
  misc_feature (862)..(864): n is a, c, g, or t
  misc_feature (867)..(867): n is a, c, g, or t
  misc_feature (881)..(883): n is a, c, g, or t
  misc_feature (891)..(891): n is a, c, g, or t
  misc_feature (893)..(895): n is a, c, g, or t
  misc_feature (903)..(903): n is a, c, g, or t
  misc_feature (916)..(916): n is a, c, g, or t
  misc_feature (922)..(922): n is a, c, g, or t
  misc_feature (927)..(930): n is a, c, g, or t
  misc_feature (936)..(938): n is a, c, g, or t
  misc_feature (940)..(940): n is a, c, g, or t
  misc_feature (943)..(943): n is a, c, g, or t
  misc_feature (947)..(947): n is a, c, g, or t
  misc_feature (952)..(953): n is a, c, g, or t
  misc_feature (956)..(957): n is a, c, g, or t
  misc_feature (962)..(962): n is a, c, g, or t
  misc_feature (964)..(964): n is a, c, g, or t
  misc_feature (969)..(969): n is a, c, g, or t
  misc_feature (977)..(977): n is a, c, g, or t
  misc_feature (981)..(983): n is a, c, g, or t
  misc_feature (985)..(986): n is a, c, g, or t
  misc_feature (990)..(990): n is a, c, g, or t
  misc_feature (992)..(992): n is a, c, g, or t
  misc_feature (995)..(995): n is a, c, g, or t
  misc_feature (1001)..(1001): n is a, c, g, or t
  misc_feature (1005)..(1005): n is a, c, g, or t
  misc_feature (1007)..(1007): n is a, c, g, or t
  misc_feature (1009)..(1009): n is a, c, g, or t
  misc_feature (1011)..(1011): n is a, c, g, or t
  misc_feature (1013)..(1013): n is a, c, g, or t
  misc_feature (1016)..(1016): n is a, c, g, or t
  misc_feature (1018)..(1019): n is a, c, g, or t
  misc_feature (1022)..(1022): n is a, c, g, or t
  misc_feature (1025)..(1026): n is a, c, g, or t
  misc_feature (1029)..(1029): n is a, c, g, or t
  misc_feature (1031)..(1031): n is a, c, g, or t
  misc_feature (1035)..(1037): n is a, c, g, or t
  misc_feature (1042)..(1042): n is a, c, g, or t
  misc_feature (1046)..(1046): n is a, c, g, or t
  misc_feature (1049)..(1049): n is a, c, g, or t
  misc_feature (1054)..(1055): n is a, c, g, or t
  misc_feature (1057)..(1060): n is a, c, g, or t
  misc_feature (1068)..(1070): n is a, c, g, or t
  misc_feature (1075)..(1082): n is a, c, g, or t
  misc_feature (1094)..(1095): n is a, c, g, or t
  misc_feature (1100)..(1100): n is a, c, g, or t
  misc_feature (1104)..(1105): n is a, c, g, or t
  misc_feature (1108)..(1108): n is a, c, g, or t
  misc_feature (1113)..(1113): n is a, c, g, or t
  misc_feature (1120)..(1120): n is a, c, g, or t
  misc_feature (1123)..(1126): n is a, c, g, or t
  misc_feature (1128)..(1129): n is a, c, g, or t
  misc_feature (1132)..(1134): n is a, c, g, or t
  misc_feature (1139)..(1143): n is a, c, g, or t
  misc_feature (1146)..(1152): n is a, c, g, or t
  misc_feature (1154)..(1157): n is a, c, g, or t
  misc_feature (1160)..(1161): n is a, c, g, or t
  misc_feature (1164)..(1165): n is a, c, g, or t
  misc_feature (1173)..(1174): n is a, c, g, or t
  Predicted polypeptide sequence is orthologous to G1789, G1911
tgnnatgntgttttganccctattnaaccctcactaaagggaacaaaagctggagctccaccgcggtggcggccgctctagaactagtggatcccccgggctgcaggaattcggcaccagatcagggcttctgaagtgcanaaacttcagcgctaactgagctcggtttccgagaaacatactaccaattccgatccaggttgagatgtcagggagctcatcccgcggcggcgacgacgcggcgtggagcgccaaggagaacaagctgttcgaggaggcactcgcctaccacggcgagggcacgcccgaccgctggctcaaggtgtctcgcgccatgggcgggaccaagacggccgacgaggtgcgccgccactacgagatcctcgtggacgacatcaacctcatcgagtctggcagggtcccgttccccaagtacaaggacaactgattcctcatggagcgaagcatctgaattctgaagatccggcaatcaggagaacctgtttataatctagtccttagttgggaccatgttactgaagcaataaaaagaagaaaacatgtgtgtgtgtgtgtttgtttgtgtgtgtgtgtgtgtgtgtgtgtgtgtaattttaggtttgtaagcaaatcaagtgcgcctagtcttgcatacagtaccatgtaatttccgtgcctatacttagcttttactccttcagtcctctncaatatgntttggagtaaacatcantggtgnaaatccccggnacttgnttgcaatggttatgaacccntgcttgtacaatatacatgctttgctaaaaaaaaaaaaaaaaaacttnagggggggcccggncccaaattgncctatagggagncnnnttncaattaatggccgnnntttacaangnnngaattggnaaaacctggggtncccaanttaannnnctttgnnnanatncccnttttnncannttggngnaatancaaaaggncccnnncnnatgncnttncaaaanttgncnancntnaangnnaanggnnaantntaannntaaantttngtnaaaanncnnnnaaaatttnnnaaaannnnnnnntttttaaccaannggccnaaannggnaaaanccctttnaannnnannaannnccccnnnnnggnnnnnnntnnnnccnnttnnaaaaaaann

SEQ ID NO: 9857 - DNA, 690 bp, Triticum aestivum
  Predicted polypeptide sequence is orthologous to G1789, G1911
ccacgcgtccgccaaagcttctccaagagcaaaggacttcctcaattccacaggagcaccccaggcacaagaaagtagtgttattagttcgagtagaacatcacatctcacctgaaagatgtcttccgggtcgtcgtctcggagcacctccccgagctcagactcggagtggagcaaaaaggagaacaagatgttcgaggaggcgctcgcctactacggcgtgagtgcccccaacctctgggagaaggtggccagcgccatggggggcaccaagtccgccgacgaggtgcgccgccacttccagatccttgtcgatgacgtcaacagcatcgagcatggccgcatcccattccccaagtacaagacccagggcttctggaccaaataaaaggatcgatgaagcagtgtaagctccagtggacagtgaacaaagttctagaaaatagatctcttaagaatgggctgatgttctaggaggaagcaagggtatccagcattggttagaataacaggaaggaatagagtattgtctattgtgtggacaaagtattgttaggccctgtccaaggttaagtcttttagattctcgtctacattcatgaaccggatgttgttcattatctcctcgaaccaagtcgtcaaataaaatgtcatgtaaactcatgtgtttgtgttatttgtagaagttta

SEQ ID NO: 9858 - DNA, 1068 bp, Triticum aestivum
  Predicted polypeptide sequence is orthologous to G1789, G1911
gagccaaagcggccgcccttttttttttttttttttttttttttttttcctttttttatttttttttttttttgtttgttggcatcatcatcaatttcttttctctttggatgggtagggacatattgttacatgtgcagacaatataaatattgtacattaaaatacatacgaaataagttaaacccatgcagcaaggaaacaggacgatcccgccataaaccacttgctactgaagtattatgaacatgcatgcatctgcatagccttgcatgggtacgttgacttggacaccatgcacgaaacttatctcatgcacatgcacatgcttccagttccatcgatctatgtggggtgtatcattcattgtccattgccgcctaaatcttcaagtgcttcaacctgtcggcctcgtaaccggcgttgtggcccgggcctgggcagggggaacggtaggcggggaaggccaccttgccggcctcaatgcgggcgatgtcgtggacaaacagctcgtaatagcgtttgacatcgtcggccgatttgccgccaccaacggcacgagcgacgttgtgccagcggtcgggcgtgtcccggtcatgcactggcagtgcctgctcaaacagcttgttctgttggggggtccatccagccctcccggccgggctcattgacagcgacgccattgctcgatctacctagctgggattgggcttatgatgttggtaccgtgaacccgttggttgcacagggctgcttctgaaatggattttcaactccttcagtccatggtagtgtccccgggtcccaatgccccaaccttccggggagcgtgggttaacaaattcccgggaaatcccgaacgggacccacctggttttttggtaaaaaccgtgtcctaaaaggccccccaaaaatggccaaagggccaaaccggtccccggggtgaaaattggaaacccccccccggcccaaggctaaaaatcccggggggtggactcggcccgggttttttttatggggggcaaacaacgcgggggatgggttcctcaggggaattgggacggttcc

SEQ ID NO: 9859 - DNA, 1141 bp, Triticum aestivum
  Predicted polypeptide sequence is orthologous to G1789, G1911
tgcgacccacgcttccgcccacgcgtccggactggagcacgaggacactgacacggactgaaggtagtagaaaaccaaaccaaaccaccagcgcttctacaagagcaaaggactacctcacttccaggagagcaccccaggcacaagaaagtagtgttcttagttcgagtggaacatcacatctcacctgaagatgtcttccgggtcgtcgtctcggagcacctccccgagctccgactcggggtggagcaagaaggagaacaagatgttcgaggaggcgctcgcctacgacggcgtgagcgcccccaacctctgggagaaggtggccagcgccatggggggcaccaagtccgccgaggaggtgcgccgccacttccagatccttgtcgatgacgtcaacagcatcgagcatggccgcgtcccattccccaagtacaagacccagggcttctggacctaataaaaggatcgatgaagcagtgtaagctccagtggacagtcaacaaagttgtacaaactagatctcttaagaatgggccgatgttctaggaggaagcaagggtatccagcattggttagaataacaggaaggattggagtattgtctattgtgtggacaaagtattgttaggccctgtccaaggttaagtctgttagattctcgtctacattcatgaactgcatgttgttaattatcccgtggaaccaagtcgtcaaataaaatgtcatgtaaactcatgtgtttgtgttatttgtaagaagttgtacctgtagcaaaaaaaaaaaaaaagggcggccgctctagagtatccctcgaggggcccaagcttacgcgtacccagctttcttgtacaaagtggtccctatagtgagtcgtattataagctaggcactggccggtcgtttacaacgtcgtgactgggaaaactggtaccttgggatctttgtgaaggaaccttattcggtgtgggacataattggccaactacctacggaaattaaggcctaagggaaatttaaattttaagtgtttatgtggtaactagctgcattgcttgcggttgaaagtttgcctccgggtttattttgaaatttttacccggagcgggggcctattggtggggtttaaattcaagcccag

SEQ ID NO: 9860 - DNA, 832 bp, Triticum aestivum
  Predicted polypeptide sequence is orthologous to G1789, G1911
acgctatgacattaggcctatttaggtgaactatagaacaagtttgtacaaaaaagcaggctggtaccggtccggaattcccgggatatcgtcgacccacgcgtccggcctgagccgatgcccaaaccaggtccaagcatccaagcatagttcaggtcataacttaaggtatataatagcagctgattgatcaaggaaccaatagtcgagtgacatccatggcttctctgtcgatgagcgcggggtggacgccgaagcagaacaagctgttcgagcaggcgttggcggtgcacgacagggacacacccgaccgctggcacaacatcgcccgtgctgtcggggggcggcaagtcggcggacgatgtcaggcgctactacgagctgctcgtccacgacatcgcccggatcgaggccggcaaggtgtctttccccgcctaccgtccaccatgccccggccccggccacaacgccagctacgaggccgacaggttgaagcacttgaagatctagctaggcggtaatctggtaatggccaagggatgatacacaatacacagatggactgaacgaagaagcatgtgcgtgcatgggggtaccttgtaatactcataagcgtgtgcatggtgtccatgactccatgtcaatgtatacatgcactactagccggcagaaaagttggccgattatgcagatgcatgcatgttcataatactctagtggctagtggtctataagtatgtacgtgagatttactcacatgggtttaacttatatcctatgtatctaatgtacaatattaataatatcctttatattataaaaaaaaaaaaaa

SEQ ID NO: 9861 - DNA, 833 bp, Triticum aestivum
  Predicted polypeptide sequence is orthologous to G1789, G1911
aaagctatgacattaggcctatttaggtgaactatagaacaagtttgtacaaaaaagcaggctggtaccggtccggaattcccgggatatcgtcgacccacgcgtccgcggagcttcggaagtgcaaaaaccatcagaaaaagcatcagcgctagctcggtttccgatccagttggagatgtcttctgggtcaaggagcgcatcccgcggcggcgccaacccggagtggagcaagaaggagaataagctgttcgaggaggcactcgcctactacggcgagggcacgcccgaccgctggctcaaggtgtcccgcgccatgggcgggaccaagaatgccgacgaggtgcgccgccactatgagatccttgatagcgacatcaagctgatcgactccggcaggctccctttccccaagtacaacacccagggccagggggcttggaactgattcatcaatcaaggagaaaagcttctgaattctgaagatcctgcaaacacgataatctgttcataatcaagtccttagctgggaccatgttattgaagcaagcataattatgtaccgtaaaacaaagattatgagcacttggttaggaataaaagaaaaaacatatgtgtgtgtacataatattaggtttgtaagcaaatcaagttcgcttggttttgcagacggaagcatttatttttcattgtggaacagaatactcctccccaataagttttggggtaaacatcattggagtaaatccccagtactctccgtactccctttaagaaattggggctcaaaaaaaattcatgtttggtcaaaaaaaaaaaaaaaaaaaaaaaaa

SEQ ID NO: 9862 - DNA, 805 bp, Triticum aestivum
  Predicted polypeptide sequence is orthologous to G1789, G1911
gcaggtcggtaccggtcccgaattccctagatatcgtcgacccacgcgtccgcggacgcgtgggcgactggagcacgaggacactgacatggactgaaggagtagaaaatccatctcagaagcagccctgtgcaaccaacgagttcacggtaccaacatcataagcccaatcgcagctaggtagatcgagcaatggcgtcgctgtcaatgagcgcggccgggagggctggatggacgccgcagcagaacaagctgttcgagcaggcactggcagtgcatgaccgggacacgcccgaccgctggcacaacgtcgctcgtgccgttggtggcggcaagtcggccgacgatgtcaaacgctactacgagctgctcgtccacgacatcgcccgcatcgaggccggcaaggtggccttccccgcctaccgttccccctgcccaggccccggccacaacgccggctacgaggccgacaggttgaagcacttgaagatctaggcggcaatggacaatgaatgatacacaccacatagatcgatggaactggaagcatgtgcatgtgcatgagataagtctcgtgcatggtgtccatgtcaacgtacgcatgcaaggctatgcagatgcatgcatgttcataatacttcagtagcaagtggtctatggcgggatcgtcctgtctccttgctgcatgggtttaacttatctcgtatgtattctaatgtacaatatttatatcgtctgcacatgtaacaatatgtccataccaatcaaaagagaaaagaaattgatgatgatgcaaaaaaaaaaa

SEQ ID NO: 9863 - DNA, 579 bp, Triticum aestivum
  Predicted polypeptide sequence is orthologous to G1793
gctatatattttgtatctgatatgcaaggttacctgaatctcctcgcatattttttttgtgttcgtttatttatatggaaaatagcctacttagtcaattttggtttagccctgtatgtggtttgcttactcaatattgacctcagtgtcactatgcctgcttccgaaactctagcactgaaatatatgctctgttactcttaatcaagatgcttttgtaccaactttatgccatgctgcacttactcgggctaaatccttgtgctttatcatgaggacaacaatagtggttacttctcatctgagcttgagctgtggtgaatgcgaccgatgtttcgaccgcatacgaagatgtagttcttttggtttatcagccaatatgatcgtatatagacgggatgcctgtacagaggcgttttgaattagtatggtagcagactatcctatccttattgtaaattatgtgtgatcatcgctatgagacactcctttggatggatttaccattccatggttattgtaaattatgaatgaattattctgtagttttagtattggttctctaatctaaaaaaaaaa

SEQ ID NO: 9864 - DNA, 1494 bp, Triticum aestivum
  Predicted polypeptide sequence is orthologous to G1793
caacgacgcagtcacgcaccggctctttcctccacccctcgtagggctagctagggtttctccgcccaaatcgtgtaataataacccacttgaagattcgcgcgaaagctgcggcgatggccaccaccgtccaaccccactccccggacccaacagccatcaccaccacccctgcccctccccctcctccttctccacctcgccaggagaacccgaccgccgcgggggaaggcgtagagatcgcggcgctcgatgagcagcctgccgccgtcgccgtcgccgacaaggggaagacggcccccggcggcgggaagctggtggcggaggccatgcgcaagtgcgcggcgccccggtcgtcgcgctaccacggcgtgacgaggctcaagtggagcggcaagtacgaggcacacctctgggacaacaccagccaggttgaggggcgcaagcgcaagggcaagcatgtgtacttgggaagctatgttactgaagagaatgctgcaagggcacatgaccttgcagccctgaaatattggggcataactcaacccaccaaactaaacttcaatatttctgattatgcaaaagaaattgagatcatgaagagcatgaatcaagatgaatttgtggcctacataaggaggcagagtagttgtttctcaagaggaacatcgtcatacaggggtgtaacaagacgaaaggatggtaaatggcaagcacgtattggtaggattggtgagagtagagacactaaagacatctatcttgggacctttgaaactgaagtggaggcagctgaagcgtatgacctagcagcaattcagctccgtggtgttcatgctgtgaccaactttgatatcagcaactactccgaagaaggtttgaagaaactagaaggctcatctgaggtagtgaacctggaggaccaatcagaagtcactaagttagctgtgaccaacttggatattagcaaacactgcgaagatggtttgaagaaactagatggcgcatcccaggtagtgaacctggagggccaatcagaagtcaccaagttatctgtgactaactttgatattagcaactgctgtgaagatggtttgaagaaactagaaggctcatccgaggtagcgaacctggaggaccaatcagaagtcacaaagttagctggacaatagatattagaatagcaacatgtaaattatttatttcttcctttttatcttttctctgatcgtcaatctctccacctttctcttttcttgattgatgatgagagtgtcttttcttcgtctgcctttcctgaaacttttttttcccaaggaatttcccttcgctggttgccaactctattatttaccagctccagagtaggatcgtgtgatgctgtactctgtattctcatgtacactgattacaaaccattgatagtatttgtagacattacaacacaaaggaagttcattcttctaaaaaaaaaaaaaaaaaaaaaaaaaaaaa

SEQ ID NO: 9865 - DNA, 1111 bp, Triticum aestivum
  Predicted polypeptide sequence is orthologous to G1794
gcacgaggcggcttctgccgtcgctgcctgcaccaccagcagcgccgagggccaccgtggggtgcgcctccgcaagtggggcaaatgggcggccgagatccgcaacccgttctccggcaagagggagtggcttggcaccttcgacactgccgacctggcctccgccgcctaccaggccgcctcccggagctttatcgaggagaagcgtcgccgccgtggccagtctgtggctgcggcctcacctgctcggtcggctgcgtcaacaacaccgacgtcgtcttctactacaccaacggcatcttcgtcgtcctccacctcggctgctccattcgcacacccgtcgccgtcctctgtcctggaggccaccaagccagcagccgagtccctgtcgcctgagccgaccccagttcccgtcatgttgtccaccacggctgagactgcgcagcttcctgacgacccagagttctaccaggacctcctgcgtggtctccagctgccggacatcgacccgatggacttccgcgccgggcttgatgccttggacgtctccgaggcgtcggcttacttggacggcgaacaggatctgctgctcggtgacctggccgacgaggacctcgagctggacatggacctcgacatcggcgacgacttcctggagatgcctggctgcgactttggccggggcatggatgatttcctgcaaaccgtcgatttctgcgtgtgaattaagagaggtttaaggtttatctttaagtaatgctggtgtgatgggcctcctgtgagtgtaatccgtgtgcattgggagggaggatatcctcttgggtttttccccgggcagctcaatcagctcgtgcccaagatggtgtctgttttccctagtctcccaagcacattagcgttatggtggtgagagtgagagagtatttttgatagtaggttacattgtgataagttatagtagctgctggttatgttatgttcctcttttatgttacctgtcaatgttggtccagacattgtagctggctcaagacaagtcttgtggctgttgctcctagtagtatgaatgaaaaagaaaaataagttcgcattaaaaaaaaaaaaaaaaaaa

SEQ ID NO: 9866 - DNA, 425 bp, Triticum aestivum
  Predicted polypeptide sequence is orthologous to G1796
ctcgtgccgaattcggcacgagcgccactgttccccactcctaaccctatccgatccagagggaggcactgaagcgatgggaagctccaccgctgccactcatgcacttcaccgtcgacctctacaccgaccgtcgctgcccgtgcgcagtccttcatcgacgaaccagcaatggccggaacgctaagagtagaaggagaagaaatatagcgcgtctgctggagcggctcgcgcgcgctacattttgcaacgaccgctgaaaccgacgcttcgcagcatgtaaaaactggctacgaaggcgctgtaaacgtttttttagcgcgccgcgtgttgcgcgcttgttggagattctctcagtacgtgagagacatgataaataattaaatcgtacagtacatttttctagcaaaaaaaaaaaaaaaaaa

SEQ ID NO: 9867 - DNA, 860 bp, Triticum aestivum
  misc_feature (406)..(406): n is a, c, g, or t
  Predicted polypeptide sequence is orthologous to G1796
acgcttgaccttaggcctatttaggtgacactccagaacaagtttgtacaaaaaagcaggctggtaccggtccggaattcccgggatatcgtcgacccacgcgtccgccaaattggaagaggctttcttggatgagatttgtggtggaatctcagtagcgctggtggggatggggatgtctcctgcggactccctcgccgccggccggacccgccgcgctgggtccctcgctccccggcccaagcgcgtgtgcgtcttcttcgtggacgccgacgccaccgagtccgagtcctcgggggacgaggaggtcaggcgcggcgagcggcgcgtgcggaaggtcatcgacatcagcgtctctcagccgtcctccggcgtcgtccatcccacggagacgggctctgctgcngcggcggcgggcggcaaaggccggcgaccgcggctaccgtccgcggttccgtggcgtgcggcaccggccgtggggcaagtacgccgcggagatccccgacccgagccctgcaaagcggctgtggctcggcacctttcgacccgccaaggagcttcccgccgtgtaccaacaacccggccgtgcgcttcagggggccccatgccctcaccaaacttcccggccaagtccagcttccaaatccgaactacgccacggtccacccagcccccccttcccggccggggggggaactttccgtccctaccggggcagcccgggcgttggaggcccccccttaactattccccccttttcgagagccatgcgcgcgcctccgcagtcccggagccccaagagagggacaacccccccaattccgttacacccccattcgcctaatgcccccttccccccc

SEQ ID NO: 9868 - DNA, 645 bp, Triticum aestivum
  misc_feature (49)..(49): n is a, c, g, or t
  Predicted polypeptide sequence is orthologous to G1804
tattaaagtgctattacacataaacatattgctaactttcttttgttcnttttcctgaagtttctgacaaacctatatacctataaacagtaacaacaacataagttcacttgcttgaccagaaaaacactgacatttgggtccttatgggttttaggtactactagtaaattacgataccaccccgctctagaaaggaaaggtaaccattattcattctcatcctcctgccagcatgactatggaagctgaatggtgggtcacctatcaccagatgcagctagcgcagcgccgcgacagggtgccacccttcttggtgttcacattttccttggactgctccatcatcttctccactagcatttgtttcttggtcagcaaaatcgtcttctcctcagctttcagacgagcgttctcctccttgaggtggtttagtttggcttcaagctccttggtataagcctgcttcctgccacacgattgtgcggctgactcatggttcttgatcatgtggtggtggcggcgctcgatgctcccctcacaggactgatcctccggagcgccgcgcttccgcgcgccgctgttatccatcatcgttttgtcgcccatacagttcatcatgtcaacctccatcatggtgctcct

SEQ ID NO: 9869 - DNA, 667 bp, Triticum aestivum
  Predicted polypeptide sequence is orthologous to G1804
gaggaattcggacgaggggagtcgttctccttgcctcccccgctgtgccggaagacggtggaggaggtgtgggctgagataacagggagccccgcccggtgcatgcccagcctcaggccgcgcgaccctcacagcagcctcctgtccagccaccggttgtggccaacgaccggcaggggaccctaggcgagatgacgctggagcagttccttgtcaaggccggcgtggtccgtggatctggcaccggcgtccaggcgcctatgccggtcggcatggtccatggacagatgaaccccgtgcagcaggggcagcagcctggcccaatgatgtacccgatggcaccagccaacggtatattccaggtgatgggcgacgacatggggttcatccccaacgggtacgcggggatggccgtggtgccgccgccaccacctcctcaaggtggggtcggtatcgtgagccccgggtcgtcggacgggaggagcgccatgacgcaggctgacatgatgaactgcatgggcgacgtagtgatgatggagaatggtggcgcccgaaaacgtggcgccccgaaggatcagtctcgcgagaggagcatcgagcgccgccaccgccgcatgatcaagaaccgtgagtcagccgcacgatcgcgtgccaggaagcaggctta

SEQ ID NO: 9870 - DNA, 1582 bp, Triticum aestivum
  Predicted polypeptide sequence is orthologous to G1804
aaaagaaggaagattctcatgtccagagcccatcaccaaaggctataaatagagagcgtggcgcacaagactgaaccacacacaccacaaccaccaagcaagagcgtacgtagatagtggtgaggagagataggatggcgtcggagatgagcaaggatgtgaagttctccgaggaggaagtcacctcacacccgcgcgttctcgaaggtgaggagcaggcggttgcgccggcgcggcagtcttccatcttcgcgctgacgctggacgagctgcaatactcggtgtgcgaggcagggcgcaattttgggtccatgaacatggacgagttcatgagcaacatatggaatgccgatgagttccaagcagcgaccggcggtggcttggtgggcatggaggtggctcctgtggtaggtgctggtgggggcggaggtggccttgatgcaggaggaagcaacctagcccggcaggagtcgttctccttgcctcccccgctgtgccggaagacggtggatgaggtgtgggctgagatcaacagggagccccgcccggtgcatgcccagcctcaggccgcgcgaccctcacagcagcctcctgtccagccatcggttccggccaacgaccggcaggggaccctaggcgagttgacattggagcagttccttgtcaaggccggcgtggtccggggatctggcgccggcggccaggcgcctgtgccggtcggcatggtccatggacagatgaaccccgcacaacaggggcagcagcctggcccaatgatgtacccaattgcaccagccaatggcatgttcccggcgatgggcgacggcatggggttcatccccaatgggtatgcagggatggttgtggtgccgccgccaccacctcctcaaggtggggtggtgggtatcgtgagccccgggtcgtcggacgggaggagcgccatgacgcaggctgacatgatgaactgcatgggcgaaggagcgatgatggagaatggcggcacccggaaacgcggtgccccagaggatcagtcttgcgagagaagcatcgagcgccgccaccgccgcatgatcaagaaccgtgagtcagcggcacgatcgcgtgctaggaagcaggcttataccgtggagcttgaagctgaactgaaccacctcaaggaggagaacgctcgtctgaaagccgaggagaagacaattctgctgaccaagaaacaaatgctggtggagaaaatgatagaacagtccaaagagaacgtgaacgccaagaagggtgcccccctctcgcggcactgcggcagctgcatctggtgaaaggtgacccgccatccagcttccatagccgtgctcgcaggaggatgaggaggaattgtggtgtttaagcggggtcgtatagtaatttactagtagtacctaaaaccataaggacccgaatgtcagtgtttatctggtcaagcaagtgaactttgttgttgttactgttcataggtatatgggtttgtcagaccttcagacaaatggaacaaaagatgattagcattaaaaaaaaaaaaaaaaaaaaaaaaaaaaaaaaaaaaaaaaaaaaa

SEQ ID NO: 9871 - DNA, 1332 bp, Triticum aestivum
  Predicted polypeptide sequence is orthologous to G1804
cgcgctgacgctggacgagctgcaatactcggtgtgcgaggcagggcgcaactttgggtccatgaacatggacgagttcatgagcaacatatggaatgccgaggagttccaagcggccaccggcggtggcttggtgggcatggaggtggctcctgtggtgggtgctggtgcaggcggaggtggcgcagatgcaggaggaagcaacctagcccggcaggagtcgttctccttgcctcccccgctgtgccggaagacggtggaggaggtgtgggctgagatcaacagggagccccgccaggtgcatgctcagcctcagggcgcgcgagcctcacagcagcctcctgtccagccaccggttgcggccaacgaccggcaggggaccctaggcgagatgacgctggagcagtttcttgtcaaggccggcgtggtccgtggatctggcgccggcggccaggcgcctgtgccggtcggcatggtccatgcacagatgaaccccgtgcagcaggggcagcagcctggcccaatgatgtacccgatggcaccagccaacggcatgttccaggtgatgggcgacggcatggggttcgtccccaacgggtacgcagggatggccgtggtgccgccaccacctcctcctcaaggtgggatgggtatcgtgagccccgggtcctcggacgggaggagcgccatgacgcaggctgacatgatgaactgcatgggcgacggagcgatgatggagaacggcggcgcccggaaacgcggcgccccggaggatcagtcctgcgagaggagcatcgagcgccgccaccgccgcatgatcaagaaccgtgagtcagccgcacgatcgcgtgccaggaagcaggcttacaccgtggagcttgaagctgaactgaaccacctcaaggaggagaacgctcgtctgaaagctgaggagaagacaattctgctgaccaagaaacaaatgctagtggagaagatgatagaacagtccaaggagaacgtgaacgtcaagaagggtggcaccctctcgcggcgctgcggcagctgcatctggtgaaaggtgacccgccatccagcttccatagccgtgctcgcaggaggatgaggaggaattgtggtgtttatagcagtaacattatctttccggagcggggtcgtataataatttactagtagtacctaaaaccataaggacccaaatgtcagtgtttatctggtcaagcaagtgaacatttgttgttgttactgtttataggtatatgggtttgtcagaacttcagacagatggaacaaaagaaaattagaaatatgttgatgtgaaaaaaaaaaaaa

SEQ ID NO: 9872 - DNA, 582 bp, Triticum aestivum
  Predicted polypeptide sequence is orthologous to G1804
ccacgcgtccgggatgaactgcatgggcgagggaacgatgatggagagtggcggcacctggaaacgcggggccccagaggatcagtctgcgagagaagcatcgagcgccgccaccgccgcatgatcaagaaccgtgagtcagccgcacgatcgcgtgctaggaagcaggcttataccgtggagcttgaagctgaactgaaccacctcaaggaggagaacgctcgtctgaaagctgaggagaagacaattctgctgaccaagaaacaaatgttggttgagaagatgatagaacagtccaaggagaacgtgaacgccaagaagggtggcaccctctcgcggcgctgtggcagctgcatctggtgaaaggtgacctgccatccatccatagccgtgctcgcaggaggatgaggaggaattgtggtgtttatagcagtaacattttctttcccgagcggggtcgtatagtaatttactagtagtacctaaaaccataaggacccgaatgtcagtgtttatctggtcaagcaagtgaacttctgttgttgttactgtttataggtatatggatttgtcagaaagaaa

SEQ ID NO: 9873 - DNA, 820 bp, Triticum aestivum
  misc_feature (24)..(24): n is a, c, g, or t
  misc_feature (41)..(41): n is a, c, g, or t
  misc_feature (611)..(611): n is a, c, g, or t
  misc_feature (619)..(619): n is a, c, g, or t
  misc_feature (647)..(654): n is a, c, g, or t
  misc_feature (657)..(658): n is a, c, g, or t
  misc_feature (660)..(662): n is a, c, g, or t
  misc_feature (665)..(674): n is a, c, g, or t
  misc_feature (677)..(691): n is a, c, g, or t
  misc_feature (695)..(699): n is a, c, g, or t
  misc_feature (704)..(705): n is a, c, g, or t
  misc_feature (707)..(717): n is a, c, g, or t
  misc_feature (723)..(725): n is a, c, g, or t
  misc_feature (728)..(732): n is a, c, g, or t
  misc_feature (738)..(738): n is a, c, g, or t
  misc_feature (743)..(743): n is a, c, g, or t
  misc_feature (747)..(752): n is a, c, g, or t
  misc_feature (756)..(761): n is a, c, g, or t
  misc_feature (764)..(766): n is a, c, g, or t
  misc_feature (771)..(785): n is a, c, g, or t
  misc_feature (789)..(791): n is a, c, g, or t
  misc_feature (795)..(799): n is a, c, g, or t
  misc_feature (801)..(807): n is a, c, g, or t
  misc_feature (812)..(818): n is a, c, g, or t
  Predicted polypeptide sequence is orthologous to G1823
ttcccccaccctgcgttgctgagnttaccataccagttcgnataggggacactttgtacaagaaagctgggtacgcctaagcttgggcctctcgagggatactctagagcggccgccctttttttttttttttttcgaacatctgtcggttttatagttgctgcattggagaagtgataccagtactacatactgtacatctcccacacattcctgttctgtacattctgaatctaccttcagattcttgtgctgtactgtacatatacatacacatacagtgatgtgatctgctatatctaacaacaatggaggccagtctataacaaaccagagaggccgagtctacgctcgccgacatgatccatggacggacgacggctaccgcagccggagatgctcctctgtcatggggaagaagaggcagacagcgtgagcagacgcaggacagcagcatgccgtacataggcgcagacgtgccgcgactctttactgtccactcttggtcatagtctcctctgtgaccagtgtgattacccactaccctcgggtgtaccgcgtgttataccgctacttgagtatcgcaaccatattgcttctgctcaaaaagngtaatggngccccgagttttgcgtttattacattgnnnnnnnntanntnnntcnnnnnnnnnntcnnnnnnnnnnnnnnntggnnnnnggtcnntnnnnnnnnnnnttgggnnntcnnnnntctggngggcnttgnnnnnnttcnnnnnntcnnnttccnnnnnnnnnnnnnnnttcnnncccnnnnncnnnnnnnttcannnnnnntt

SEQ ID NO: 9874 - DNA, 779 bp, Triticum aestivum
  Predicted polypeptide sequence is orthologous to G1832
cagccacaacccacaacatgcacaacggatcgagctcgcaagtgttcatcatgcccgctgccggccatgtccactaccttgtcgcgggaggctccggaggaggcgacgagcccaggtacccctggaccttcaagtccctgcacgaggtggacgccgtcgaccctgctatcgcccgtggcagcaagaggccggccgccgtccccggtggagcacaggtagagccctacgggtgccccatctgcttccgcgtgtttgccactgccaaggccgtccatggccacatgcgcagccacacggaccgcacctggcgcggcatggagccgtcccggtcgtcgcccctgggcgagatccgttacccgtacgtgtgcgaccgctgcaagatgccgttccagacgcggcaggcgctcggcggccaccgcgccagccacaatggtaagaaaggctgctcctggctcgaaagagaggagctcgccgacgacgaagaagctcggaagcccgtcgtgttcagcgttgatctgaaccttccggctcccgaagcagatcaggaacagggggaggagtagtaggagtcatcaacagatcgatcgagcagcttgctagtgttctcagttgacagttgctggagctgtgcttgcgtgtgctatatttggcgtttagccttctccgatattatattctgccttccttcactttgactttgtgtttcgagaacttggttgccaaataactcttgaacgaacgacccccgtttaattggaacataaattgaagagtgcact

SEQ ID NO: 9875 - DNA, 624 bp, Triticum aestivum
  Predicted polypeptide sequence is orthologous to G1835
ccgctcttcccggagtaccgcccggcggccagccccaccttcgtgccagccatccattccaactcccacaagaaggtggtggagatgcgccagaaggttgaacccaagggcgacgacctgctgcagttcatccgccgccgggattgagcctgctcccgcgccgccggcatcgctcgccggacggtcggtcggtctcgtcccccttagctattatatatgtatacatgctagtatgtatgcattgcatgcttgcttccagctagtcagtcagtcatcgtcgtccgtcgtcatgcatccacccaccaccatcatcgccatgcatcggtttcagtcagcatccatccatccatgaaatcgccgggcatcctggccggcgttagttgaatagggcttttctttcgggtttactccacctctttttctttgtctattacttaattggttccccctaagaagattcccggtatgtatagaggagggtgagtgaggagggcaggagaaatagatccatggatcaatcacagagtcagtggttgttgcattgcagttgcttgcaaattaggaggtactaggtgagaaggagagctaaaccagcagagcagcagcagcagaggcagaggcagc

SEQ ID NO: 9876 - DNA, 670 bp, Triticum aestivum
  Predicted polypeptide sequence is orthologous to G1835
caagaggccgacccctccggtcacctctgatgctgagggcgacgccgactacgaggaaggcagcggcactgcgctcgcgcctggcgaggtgaggaggtgcacgcattgccagatcgacaagacgccgcagtggcgtgcggggccgctggggcccaagactctctgcaatgcctgcggcgtgcgctacaagtccggtcgcctcttcccggaataccgcccggcggccagccccaccttcgtgccagccatccattccaactcccacaagaaggtggtggagatgcgccagaaggttgaacccaagggcgatgacctcctgcagttcatccgccgccgggattgagctccccgcaccggcatcggtcgccggacggtcggtctcgtcccccttagctattatatatgtatacatgctagtatgtatgcattgcatgcttgcttccaactagtcagtcagtcatcatcgtcgtcatggcagtgcttagcattgccttcatgcatccacccaccatcatcgccatgcatcggtttcagtcagcatccatccatccatcaaatcgccgggtatcctggcgttagttcaatagggcttttcttttgggtttactccacctctttttctttgtctattacttaattggttccccctaagaagattttttgtttgtat

SEQ ID NO: 9877 - DNA, 496 bp, Triticum aestivum
  misc_feature (146)..(146): n is a, c, g, or t
  misc_feature (206)..(206): n is a, c, g, or t
  misc_feature (300)..(300): n is a, c, g, or t
  misc_feature (313)..(313): n is a, c, g, or t
  misc_feature (353)..(353): n is a, c, g, or t
  misc_feature (362)..(362): n is a, c, g, or t
  misc_feature (369)..(370): n is a, c, g, or t
  misc_feature (389)..(389): n is a, c, g, or t
  misc_feature (409)..(409): n is a, c, g, or t
  misc_feature (436)..(436): n is a, c, g, or t
  misc_feature (438)..(438): n is a, c, g, or t
  misc_feature (442)..(442): n is a, c, g, or t
  misc_feature (464)..(464): n is a, c, g, or t
  misc_feature (471)..(472): n is a, c, g, or t
  misc_feature (475)..(475): n is a, c, g, or t
  misc_feature (496)..(496): n is a, c, g, or t
  Predicted polypeptide sequence is orthologous to G1837
cgagtttttttttttttttttttttttttttttttttttttttttaaccaaaagggcatcatatctatttatctttcactgaaatcaaagcaaatagtttagtggactacaccacgcaggaagagtttaacacataacttcaatcncaaaaggataatcaccaaagtacaatacatagctgcatcctccaaaggatatcaaatganaggcatccagaaaagaaagctttatctgtacccttagttcataaaaactatacttggttttcagttgtaactaatccttcatacgaaattccanaacacaagattantgcaatcatacctaaaatatcattatcttcccccaaaaancctgttaangtcgtcnncacaagatggggatgacangatagccgcccaaatcttanccctgctagtaaggtccaaaaaacatngntggnaacccggggttacaatccttanaaggacnnatnacaaggccagcatggctacan

SEQ ID NO: 9878 - DNA, 696 bp, Triticum aestivum
  Predicted polypeptide sequence is orthologous to G1850
cacgcgtccgtctcgccctcgcggttcttgcatcgcgcagccaggggccaccccctggcggtcctgccctgctccctccaccccaagcaatcggcgacgactgcccgcgcggccgtgccgttgtgttgccggccgactatcctgcgtctcctctccccaatgctccagcactccttcgctgaccaccctgcctgccgggttgccggacagaattttattgaggccagccacatcacacacagcacgcaggagctggccctatgtcatggcaaaaggtattcagccttgtcaaggtccagtggtgatacatatgcttcttatggatgagctggccctatgtcatggcaaaatgtattcagccttgtcgtggtgatgcatatgcttctgcatgcacaagagccggccctatgccatggcaaaaggtgaaggacttctcttctcatgttactattcagagcatggtaagcatggcatcaaactcttcctagaggtctgccaactgtatgcaggtggtggcgaaggggatcactttgtttcttgtggtagtgaccactcatcaccttcgtctcatgtttacgaagagacagtcgtcaaagcttatttgagatgggccctaggctgtcgcacttcttgcctgctgcttggttcgcccatgctctggtgcactgcaaatgtatatgcccttttatgccatat

SEQ ID NO: 9879 - DNA, 708 bp, Triticum aestivum
  misc_feature (644)..(644): n is a, c, g, or t
  Predicted polypeptide sequence is orthologous to G1855
gagggaattcctcttttgtaacggttgactgaatacctcgtgtagcatcgtgtcatactcacagctcacgagtcagagaccgcaaaattgaaccgatgatgatacagcgaattcccacctactatatacagatatatcctgaagctaagagaacagtcgatgaagactcaacagaaaggttttctgtttgaactttcgcagcagacgacatagaacaacactgaggaaggcgatagctattgctgcttttgggcaggctccgcggtccagtaagttttgacggccacaaggatcttctcagggttgaacggcccggattcatgatccatgatctggctcttccatctcatgccattggtgatggcttgtatcttcactaacatctccacggtgtccctgaagatcaccgtcccttcaggccgcagaatccggtccatctccaggaggatgtatgttatgtcacacctgtcatgataaaagctgaacactttgttagcgtggatgaggtcatacgtcctgggatacgtcgagaaagcctcgcaccagtcatggaatgtcccgataaacccccgctcgtagataacaccgagggcatcaggagcagaacctgaaggcaccacattcatcacccagagcggatactncatcagcgcagcagcaaaaccccccatccctgcatccatgtccatcacgttcctgtatcgcccc

SEQ ID NO: 9880 - DNA, 520 bp, Triticum aestivum
  Predicted polypeptide sequence is orthologous to G1855
taaggcctgaagggactgtgatcatcagggacaacgtggaggtgttggtgaaggtacaagctatcactggaggcatgaggtggaagagccaaatcatggatcacgagtccggtccgttcaaccctgacaagatcctagtggctgtcaagacttactggaccgggaagcccatggaaaagcaataatcaccgcctttggtactgttttatctgcgaaaatctagacatgacttgcttttgagttctgtcttcattgccattttttatctagcttcaggatatctgtatataggaggcatgtggaccatgtagctggaattggtatcaaacatcttcattagccatatagtatgtatgtgacacattgcaatggtgtataagatgttcactcatattttgatgtgctattgcaatctaataagctgatgcctgatgtgacaaaaggatattgtaactgataatatgttcctgtcaaaaatacgatgacaaggttgtggtacagaaaaaaaaaaaaaaaaaaa

SEQ ID NO: 9881 - DNA, 801 bp, Triticum aestivum
  Predicted polypeptide sequence is orthologous to G1855
acgcttgaccttaggcctatttaggtgaactacagaacaagtttgtacaaaaaagcaggctggtaccggtccggaattcccgggatatcgtcgacccacgcgtccgcgctgcctcatcccctggcacctctacgatggattgtacctgatcgaggtcgaccgtgtcctgcgccccggcggctactggatcctgtccggcccgcccatcaactggaagaagtactggaaggggtgggagaggagcaaggaggacctcaacgccgagcaggaggcgatcgaggcggtcgcccggagcctctgctggaagaagatcaaggaggccggcgacatcgccgtctggcagaaacccgccaaccacgccggctgcaaggcctcccgcaaggccgccaagtccccgcccttctgctccaagaagaatgccgacgcagcatggtacgacaagatggaggcctgcgtgacgccgctgccggaggtctcggacgcgagcgaggtggccggcggcgcggtgaagaaatggccgcagaggctcacggccgtgccgcccagggtctcccggggcacggtcaagggcgtgacggccaaggcgttccagcaggacacggagctgtggaagaagcgggtccgccactacaaggcggtgatcaaccagttcgagcagaaaggacggtaccggaacgtgctcgacatgaacgcccgcctcggcggcttcgcggcggcgctggcgagttacccgcagtgggtcatgaacatgggcccgaccgtgggcaactcccgcgcactccggggtggtctacaagcgcc

SEQ ID NO: 9882 - DNA, 1075 bp, Triticum aestivum
  Predicted polypeptide sequence is orthologous to G1855
gaagcgtaagataccccatatctgcaagagtgacaacctgatgctgcctgtacaagaagatgaatcctgtcttactccattgcctgaagtaagcaaccagggatcaatcgccggcggagaggttgcgagatggccaaagagggcattcacggtgcccccaagggttaagaggggcacgattccggggatagatgaaaagaagtttgaggatgacatgaagctgtgggagaagaggttggcgtactacaaacgcaccacgcccatagcacaggggaggtacaggaatgtgatggacatgaatgcgaacttgggcggttttgccgcttccctggttaagtaccctgtgtgggtgatgaacgtcgttccagttaattcggataaagacacccttggagcaatttacgagcgagggttcatcggcacttaccaggactggtgtgaagccttctcgacgtatccgaggacctacgaccttttgcacgccgacaatttgttcagcatctaccaggacaggtgcgacataacggacatcctcctggagatggacaggatactgaggcccgagggcacggcgatcatccgcgacacggtcgacgtgctcaccaaggtccaggccatagcccagcggatgcggtgggacagccgcatcctggaccacgaggacgggcccttcaaccaggagaaggtcctcgtggcggtcaagacgtactggacggccgacccatcggagcacagctgagctgcagctctctgagctccgaaatggcttgtccggtaactaggtgtgacgcgatgatggtgtcggttttcgccatctcggtgtgtgtgtgtgtgtgtgtgtgtgtgtgtgtgtgtgtgtgtgtagtaagcagtgtgtgaccacgtgcgcagtcgcttgttcctctcgccttttttgtctaattctttgtagttcgggtcgaaatggaaaccaaaaaaatacgtcgagcagatcataggttctttttagcttgtacgaccagagattgttactatgtagtactaagattgacttactggaaaaataggccttttactgaaaaaaaaaaaaaaaaaa

SEQ ID NO: 9883 - DNA, 586 bp, Triticum aestivum
  misc_feature (16)..(16): n is a, c, g, or t
  Predicted polypeptide sequence is orthologous to G1863
caatataacttacatnaataaaccccataaataacaaacattatctgtacagagacagcacatgccactctcacatctgtgaataaatatgcaaagtgggatgaaataattaggacagaaaaacccttgtgactgacctcgcccacggcacgttcgcaaccccgtgtgcataacttgttatcatgacataacttaattgccaccgcaaacctcggttgaaaccgaaagtcactctcataacttagggagaaaaagccttctcctcctcctcctggactcggatttcagcatgatgcattaaggcacaaggatctagcactgaagcaggtactgacggaggaagaagaagcggatgctgcagctagcacacggcgatgttgagcgccgatagcttgtgtgcatggttcttgccctgctttttggatgagcttgctgcaggatgttgttgctgctgctgctgctgccgtggcttgctgctgctgtggtatttgcagtggctgtcgtgtctgtcgcggcttgcgcggcagcagggcctcgtgctctcgctctcctccgatgagtgtgaggtgttcatggcggccttctt

SEQ ID NO: 9884 - DNA, 420 bp, Triticum aestivum
  Predicted polypeptide sequence is orthologous to G1868
tttttttttttttttttttttacgacagcacaagtatgactatcttgattctatcataaaatcgtcatggatgtacatgcatgacaaaaaatgcgacctactgtgacaaacacgtatcatcacggaagtttatttttttgtagtgtgaagtctttttcttcaaagggtgactggtcatctttgaattctggacacccggtggctatctcctccgggtcaagctccgattgccaggctttagcccagccaagagcgatgatagctccagctcgggtagctgatagtctttgctcttcaatctggcttgggaaaagtggataagtgatccagcacatacttgatctgacttggcggttttctattgccccccaaggccacaagactacggagggtgccgctgtaaagttgatcagttaaaga

SEQ ID NO: 9885 - DNA, 693 bp, Triticum aestivum
  Predicted polypeptide sequence is orthologous to G1868
gattcggcaccaggaggtctctcatggccggacgccgaggacatgcaagcacatcagaggacccagctctcggtgtccgccgctccaatggcgtcccccgacctgtcgtcggcctccacgtccccgatccacgagaagctcatgctgtcgcccctcaagctgagccgcgagtacagccccatcggcctcagcatcgcggcgacggcggcggcggcgaaggacgagggggaggcgaactggatgcccatgttccgcgactcgtccatgggcgggccgctgggggaggccctgaacaagaacaatggcggcaacatggaggccaagaactacctgtcggcgtcgctgaacctcatgacggacgcctgggactcgagcccgctggagcgccccggtgggggtcctgcagaggaccgccttcgggtcggtgtcgagcagcaccggcagcagccccaggcaggagtaccacggcgtgtatgatggtaacccgcgggatgatctcggctccatcgtcgtgaatcaccccagcatccgcctcatgtgagctgcttcttccgagttctgaccatggcagctgcaacgagaaggcccaggccggttgtcactcgtgtggcaacgaacgaacgaacttgggcaagtcttcttcttcacggaccttgttacatatcgacatcatcgtatccagaagcattttac

SEQ ID NO: 9886 - DNA, 607 bp, Triticum aestivum
  misc_feature (14)..(14): n is a, c, g, or t
  Predicted polypeptide sequence is orthologous to G1880
gcagcacatatatnacttagggagcagcaacaacatatatatagtagtacatctatccagcagcacatatatccaacaaatatatgtatccagcagtacatgaccatgaccaacaaacatatatcaagtaatacatatatccagccgtacatgagtgcagagtccacatatgcatacgtatgcaacaaaagatcacaaacgaaaggaccgtaagtttcaggtccacacagtgcatacatatccaacgaaggttcacaacaacatacatacatatgcaaccagaggttcacaaattaaaggatcatgagttccaagttcacaccaagcatgaaccaatgagctccaccgcagcatatatgcccaccgtcaacgccatccacaatgcaaaccctcgaagcgtgttcggtgccggtcttccgtccagcaagaagctccgcgacaacggtctcgacgtcaaactaatgcatgtctgcgtccgttgccgcgcgcggtgatgtacgctgcagccggtgatgtacgctgccgccggtgaccggtgccgctgatgcctagctagctgcgacctgctgctgtgcaccgcggcagcacggtgcggctgcttcagatc

SEQ ID NO: 9887 - DNA, 611 bp, Triticum aestivum
  Predicted polypeptide sequence is orthologous to G1897
ttttttttttttttttttgaacagtgaaagggcccaaggcccatacttcattggataagcatcaaagcatagattaaacaggacccaacagaaaaaggaaatacaagtcagcccctgacttttacatggaggaccccaaactgacagcaagaaacttgatcgggtccttgacagccgccgcccggattgaatctcgccgccgccggggacgaaccacttggtgcgacgaaatcgccatagaagcataacctgctccgcatggcctccgagttgcagctgaaactgcctcccataagacacgcaagccgggaggaataaagtcggtcgcccttcgaccagaagaagcagagcaccggtgaagaccgccagccagccaagggcgccgtagctccaccatggaatcctctgctgataagcttgaactcgatctgcaggcttcagatttctgcatcttctttgctcctcatccacccccacgatggcctggaaaaacaagcaacagcagatggttgccctccagatcagggaagataacaggcttattggagagggagagctcctgccagatccactcctatctgctgccgtcctccatggacggcaagctcggg

SEQ ID NO: 9888 - DNA, 1092 bp, Triticum aestivum
  Predicted polypeptide sequence is orthologous to G1900
gacccacgcgtccgacttaatgactgcttaatacagcatgcgtcccctcaagacacattcccagagtataactagcagaacatggtatgtaccggtctatcttggtggtggtaatggggctttctactagtgcgtccgaaaaaggtccagaaatgaacgaaattgttgccgtgccaggaatgcaacataatgtttattttcactttatattttgcttcttatacctgtgactccctactaaacctggcctactaagatttgataatctggaacagtgctgaaactaaacagatggttaactggtgctgaaatgtttcggcgaaaaaaatggtgccgaaatgtatggaggcccagaactcccggtcttagagtccaaatatgaaagtctcggtatacccggaactaaactcatgggtgtcttctagatctgcacatgggtacatacaatttaagtacttgtgagctatacaagcgtggcaatggttttagtaggcgctgctgtgaataggattggttttgtatttatgacgcacaatgagtagggatgagtgtctattgtagccagggttcctcacacaaactcctagatgtaaccctcggatgttctcagctttgggtcatatcacaaacggttcctcacccaaagtcatatgtgataggcttgtattattagtgaccaataaagatagacggttcacaaaatcagtggtgataatatatatctctctcacgtggatgtctctgaaaaaaaaacgcatgttcatatgtgacactaatggcaaatctatgaatcaactagcgtgtgggcaaatcccaacatcggaacttggcacaaacccctttggtacatggaatagtgggtcttatcatggtagcacgtaaagggtgcttggttgcaagggactttttctagtccccgtgactaatgaaaaagaccttgattagaatcttttctaaatccctaaaaaataagtccctccgttttgttacataggacctattgaaaattttttaagtctcgcctcgttaaccaaaaccccccttgtgcccccgggtggagaataattgttatgggaaaaaaaaaaaagccga

SEQ ID NO: 9889 - DNA, 671 bp, Triticum aestivum
  misc_feature (395)..(395): n is a, c, g, or t
  misc_feature (415)..(415): n is a, c, g, or t
  misc_feature (431)..(431): n is a, c, g, or t
  misc_feature (613)..(613): n is a, c, g, or t
  misc_feature (620)..(620): n is a, c, g, or t
  misc_feature (637)..(637): n is a, c, g, or t
  Predicted polypeptide sequence is orthologous to G1909
ctcctatactccatactacccttcattcacctgatggaggaagtgtttccgtcaaactccaagagcaaggctggtcagatggcgggggaggcgacagcggcggcggagaagaagcctcggccgaagccagagcagaaggtggaatgccctcggtgcaagtctggcaacaccaagttctgctactacaacaactatagtatgtctcagccccgctacttctgcaaggcctgccgccgctactggacccatggtgggtccctccgtaacgtccccatcggtggtggctgccgcaagcccaagcgctcggggacctccgacgcccacaagctcggcgtggcctcctcgtcggaacacacggctgtcatgcccccctcgacctgcacagggataaactntgccaatgtcctcccgacgnttatgtctgctggttntgagattccaagaagcctttccctgaccacctttgggtcatcgtcgtcgtccaacacgacggctgtgatgtcccctggtgggacgacgtcctttctagacgtgctgagagggggaacaggagggcttcttgatggcaacctcggtcagaacaatggctactactatggtgggtctagatcangcattgngatgctgatgacgccgncagcgccgtcatttggcattccagtccaatgcag

SEQ ID NO: 9890 - DNA, 304 bp, Triticum aestivum
  Predicted polypeptide sequence is orthologous to G1919
ctcgtggtaggtcaaacaaagatgtctgtggagccgtctctgctagtcgacatccccatctaccacacattatgttcctgttatcgccacaaaaacatagcacaacaagactaaagtgctagtcgtccacctcctcgagcacctcgttgcttcctctttgctttttgagaaatctacacgaaccctatattgtgccatacttctactaaatttattgtccatcgtgttcctgcagcctctcactcatattccgtgtatctcatttcatagcttgggattttgtaacttggttaaaaaaaaaaaa

SEQ ID NO: 9891 - DNA, 669 bp, Triticum aestivum
  Predicted polypeptide sequence is orthologous to G1927, G2184
cggcacgaggctaaggtccggcagcttcctcgttgccatcctggtcgtggctttgatgcggcacacctcgcactgcttctcctcgctggactagtcgacctgcaagagatcaactcaaacaaaaattacccaagtagaacattaagtaccatggagtttatagtcattgtgagcaggatgtatcgaatacaacagatgaagtgaagcgacctcccaggagagagagtgaccgctgtgcagcgatgcatcttgtcgtcgtcgccgcttgcatagttctctgaatggatggatgaatgggtacagttctctgaatgtgaaggtgttcactaatgttctctgaatgtgaaggtgtcagaatgacagaaaatgtgtttgcttaaaatacttcagttcaacaaaaagctccagaaaagttcggagtgaaaagctccatggtgtttcttcggctgcagcatgtacatgcatctctacaaaaaaacggatgattccattctctgcaaagtccattagacaaggtctaggtcccaagaccggggaacaatatggcgctccatttgaggaaagaggaattgaatggatatgaagagtatatgtttacttttcttgtaagtaaacctaccttcgatcctcaactgctccattaatgccccctagcatgtacaagtcccc

SEQ ID NO: 9892 - DNA, 833 bp, Triticum aestivum
  Predicted polypeptide sequence is orthologous to G1927, G2184
atttaggtgactccatagaacaagtttgtacaaaaaagcatgccggtaccggtccggaattcccgggatatcgtcgacccacgcgtccgctccccagggcgagccgaagtccaccaccaacccatccccccacccccctcgaccgcctccgcgccggccgccgagatggagaccccgccgccgccgccgcgctggccgccgggcttccgcttcagccccaccgacgaggagctcgtcctcttcttcctcaagcgccgggtcgccgccggccgcccctccccctacatcgccgacgtcgacgtctacaagtcccacccctcccacctccccgagaggtcggcgctgcggacgggggacaagcagtggttcttctgcagccggctggaccgcaagtaccccaacggctcgcgcgccagccgcaccaccgccgacggctactggaaggccacgggcaaggaccgctccatctgcaacgccggccgcgccgtggggaacaagaagacgctcgtctaccaccacggccgcgcgccgcgcgtggagcgcaccgactgggtcatgcacgactacaccatcctcgccgacgcgctcccgccgcccgcacggtgtcgcgagtccctacgccctctacaagctcttcgagaaaagcggggccggccccaagaacggcgagcagtacggcgcggccttcccgggaggaggaatgggctggaccgacgaccacgaactgtggagcttgccctcctggatccccatccctaatccgcggtaaatccttacctaaaaagcccgtggaacagtgggacctaactaaaatttggggtgaaggtttctga

SEQ ID NO: 9893 - DNA, 223 bp, Triticum aestivum
  Predicted polypeptide sequence is orthologous to G1928
agtggttgttgtggctcttgaggcgggtatggttgttgctggataagtggttgctgttgcagaaacgattgttgtggcctttcttggtcatggatgcgagggtcgagctgtgcggtcgcggtggtgatggtcgttgatgcaacgaggagggcaaagaccatgaagatcttcatggtgaatttgtggttactcttgattgtttattatggatgcttgtgctcca

SEQ ID NO: 9894 - DNA, 711 bp, Triticum aestivum
  misc_feature (634)..(634): n is a, c, g, or t
  Predicted polypeptide sequence is orthologous to G1928
ttttttttttttttttttttttttttttttttttgagagaacggatgcatgtattattttcacgtagcttttcgttgatcccagtttaccttacagttggcttctacccacaaaaaactacaaagcttgcttagcttgcaagatcacgagtgcgagagagagagagagagagagagagagagagaaagagagagattacccagttcaaaacgcatcccttgctgatctagagggtagcagcaagcagtgctctgcggtgatcagaagcgaccatgcaactatcatcatggctagctatggctacccatgccatgccacggctcgttgctgatctgctgctgcggcggctgcggctgcggctgtccttgttgctgtggctcgtagcagggagccatgttggtgttgttgccggccgtgttcacggcggcgcccatgcacgacgagtcaaagccggcgaggccgaggatgtcgcggtgcgagaaggcgcgcagccccaggaagtccctggtcatgccgtcgttggcccctcccgaggcgccgccttcctcgccgctccggccctgggaaggcggtcctggcgaggctcatcatctgctggttgctgaggcacgagaggccgagcccgaacgtgggnctgccggtcgcgctggtcgccgagccggccatctgggtggtagtgcactcccgccccgccagcgccggccccgccga

SEQ ID NO: 9895 - DNA, 345 bp, Triticum aestivum
  misc_feature (297)..(297): n is a, c, g, or t
  misc_feature (320)..(320): n is a, c, g, or t
  Predicted polypeptide sequence is orthologous to G1928
caggctcttctcgcacaagctcaggaaggagctctcgcacctgcggtcggacgtcctccggtgaccgccggtggccgggcggcaaacatctcattccgatccgacgagcaaactgtacaaagtagccgagaatttagctggttctttagttggttgcggccgtagcagttcgatcttggcgatgggttagtagtagttggttcagatcgccttcttttttgtgagcggcagtgtggtgtggttgtgattttttagttggctactccacttttagcctcctttgctagctgtgtttcnctctatcaatgaaatgaaacganagcctttgtgatcaaaaaaaaaaaa

SEQ ID NO: 9896 - DNA, 525 bp, Triticum aestivum
  misc_feature (3)..(4): n is a, c, g, or t
  misc_feature (48)..(49): n is a, c, g, or t
  misc_feature (446)..(447): n is a, c, g, or t
  misc_feature (485)..(485): n is a, c, g, or t
  misc_feature (501)..(503): n is a, c, g, or t
  misc_feature (516)..(521): n is a, c, g, or t
  Predicted polypeptide sequence is orthologous to G1928
tanngtggtcgcggccgaggtacgattaatgagatacatgattggacnntacgagtgagttgagagtgggatggtcttgttcgatgtgaccgatgaggaaagatacctcacttctgccctccaccccacagtctgaccagcggtccacctctcccatatacagggtcgaactccggcacaggcactccttcagtcttcgcagtaatctccttcgttgtatccagatcagtcttgcataagttattgtcccacttcggagagcctttgggataaactccgacatactcgtagtcgggactgctcgctacattccggtgcgcaactcccgcggcgtgaacggcgatgtcgccggcggagagggagaatgtcacgcctggagaggtggaaggggagtcgagggttcctacgccgtagagacattctgtctcgccacttagcacagcatnncactcatgcgtgtttgagtggaaatgtgcggtcgggtnctgcttgaacacgccnnnacctgcccgggcnnnnnntcga

SEQ ID NO: 9897 - DNA, 1510 bp, Triticum aestivum
  Predicted polypeptide sequence is orthologous to G1928
ccagagtcggaggtggttgcgctgtctccggcgacgctgatggcgacgaaccggttcctgtgcgagatctgcggcaaggggttccagcgcgaccagaacctgcagctgcaccggcgggggcacaacctgccatggaagctgaagcagcgcgggagcaaggaggtggtgcggaagaaggtgtatatctgcccggaggcgtcgtgcgtgcaccacgacccgtcgcgcgcgctgggcgacctcaccgggatcaagaagcacttcttccgcaagcacggcgagaagaagtggaagtgcgacaagtgctccaagaagtacgccgtgcagtccgactggaaggcgcactccaagatctgcggcacccgcgagtacaagtgcgactgcgggaccgtcttctccaggcgggacagcttcatcacgcaccgggccttctgcgacgcgctcacggaggagagcaacaaggccatcagcgggggcggcctgccactgccacccatcgcgcacgcccagcaccacgccatgctctattcgccgcacgatctgatgcagcagcagcagcaccaggagctcgccgcgttccaggaccaccatcaccatcaccaggtcatgcagcagcattgcaacttcgacgtgaagccggagatgcagccgtggccaaccatgccctacgacgacgtccaccacccgctgctgcagccgctctgcagcgccaccgcgcagagctccgccacgtccgtgccgacacctacgcagcagcagcagcttcccgcggcagccgcgcacttgtcggccacagcgctgctacaaaaggcggcgcagatgggcgccaccatcggcggggccggcgctggcggggcgggagtgcactacacccagatggccggctcggcgaccagcgcgaccggcagcgccacgttcgggctcggcctctcgtgcctcagcaaccagcagatgatgagcctcgccaggaccgcctcccaaggccggagcggcgaggaaggcggcgcctcgggaggggccaacgacggcatgaccagggacttcctggggctgcgcgccttctcgcaccgcgacatcctcggcctcgccggctttgactcgtcgtgcatgggcaccgccgtgaacacgggcagcaacaacaccaacatggcgccctgctacgagccacagcaacaaggacagccgcagccgcagcagcagcagagcagcaacgagccgtggcatggcatgggtagccatgcatagctagccatgatgatagttgcatggtcgcatctgatcaccgcagagcactgcttgctgctaccctctacatcagcaggggatgcgttttgaactgggtaatctctctcctctctctccgtctcgcactctcgtgatcttgcaagttaagaaagctttggagttttttgtgggtagaagccaactgtaaggtaaagctgggatcaacgaaaagctacgtgaaaataatacatgcatccgtcgtctcttttcaaaaaaaaaaaaaaaaaaa

SEQ ID NO: 9898 - DNA, 875 bp, Triticum aestivum
  misc_feature (29)..(29): n is a, c, g, or t
  Predicted polypeptide sequence is orthologous to G1928
tcaccagccatcgccatagattacggcangctatgttggttacactatagaatactcaagctatgcatccaacgcgttgggagctctcccatatggtcgacctgcaggcggccgcactagtgattagcgtggtcgcggccgaggtgggctttttggtagcttttgccttgactctcctgagaagactcaaggcaaaagctaccaaaatgcccgggtttcagacttcaagtatacgcccagcccaccacagaggcacagtggttcagagcggtctaggaataacaatgggctctagtcgacactggagaggcgtagagcaagccctgctcccacgtatcatacgaagcagaacaatgtcaataactatacaactacttcttcatctgctccagctgtaagcctaaccagatcatcctctcgataattttaatcagctcattcatcgttgtacagaggtcatgcacttgtttttgttcagaagagcagtactagcggaagaaggtacacaattcttttaccactaatctcaaggcccctagccacacatgttcgcacgacacatcctccattttctttctatatttgccactgctggagcgtgtccaccagcgtgggccgaagatgtcgccatgtgttaaaacttaaaaataaagctgcatcatccattaatcattgaccttatcatgcaaagtcatcgggaacaaaaacctgttcctgacttgtagtgaatcaaatcgtctgctacacatgaaactaaaggtttctccagtttcaacaagcgagggaagggtttcctctgcctatccctcgctaaaatggtaccacgggtctattcaccgagtttgatattcgcaaacatggtctgcacagcccaa

SEQ ID NO: 9899 - DNA, 369 bp, Triticum aestivum
  Predicted polypeptide sequence is orthologous to G1932
agaaggacacctccgtgtactcgggctgcaaggattacggtagtgcgtccgtgtgctccgccaagatgttccccctgtgccctccctcgtacggctactgcaacttcaccaacacgaactaatgggcgcggcatgcaccacgcacgaggacaaggaaaagggagcatcagcatcaacgagatcccttctctgcacaaccgccaccaccaccacgttgcacacatcacgagtggcaccaccggacgggctgaacctgggtgtaaaacatcgatcgcgtgccttgtgttgtaacgcgcatttccggcagaaccgtcgcaaaaccattgtgacttgagtgtcccctttccttccgctgggaaaaaaaaaaaa

SEQ ID NO: 9900 - DNA, 826 bp, Triticum aestivum
  misc_feature (5)..(5): n is a, c, g, or t
  misc_feature (575)..(575): n is a, c, g, or t
  Predicted polypeptide sequence is orthologous to G1944
cacangctattagatatatggctatctaggtgactagattgaacaagtttgtacaaaaaagcaggctggtaccggtccggaattcccgggatatcgtcgacccacgcgtccgcctttcctccaaaatttcacatcgcacgcaaccttctctcgtgccgccgccgccgccgccgccgcctcttctctcccccgattctcctcgcgactgctccgagcccctcctcttccctgtgtcggctgctcgacgcgccaccgctgcgggagaaggtgaacacgaggagatgcagggtgggtggcctcgccggaagagggtgacgccgggaaccaccggctggccaaggaccgtgtgggctggcacttccccgcggcgccctccttccccgacttcgccgtcgccactgccccctcccctcctgtcaaggctgagcgtgcacagagtggacgagtcgatcgcggcggaaccagagtcactcgaggccggggtgcgagatgatgtccagcaggcggaggggtggccatgggaggagtagcccacaatgaaatccattttctctttgtgtgtgtgtgtgtgtgtnggatttggatcgaggaaggggatggcgtggggatgaggcggtggacagaggaagagggcgatgctggctggctgagcgggcggatctggtctcgtttgttctgtagagcgggcagaggagcaggccaacataacaccaacgtggtgagctttccctcctcccacatctacccccagatctgaacatcaactacaatttgtacgtttgggtatctctattcagttatacaattcgtttgggtaactctgctg

SEQ ID NO: 9901 - DNA, 495 bp, Triticum aestivum
  misc_feature (214)..(214): n is a, c, g, or t
  Predicted polypeptide sequence is orthologous to G1948
ttcggcacgagggcgccgtgggtggcggaggacctggtgaaggacttcgaggccgggctggagtacggcgtcgcggaggccgtcgtggacaggaggcaggcggcggacggcgacggggacggcaggtgggagtacctcgtcaagtgggtggacaccgaggaggcgacgtgggagcccgcggagaacgtggatgccgagctcgtgcaggagttcnagcggcaacaggcggggaacggtggcgctgcaccgccggcggagacatttgccgggtgacggcggccgtcgatcgtactcggttcgctcttcggttttgtcgtgtcgatgggacgtcgcagtatgtatccttagcgatcgaagagatttttgtgtgattatattaattaagaaaacatccccatgagatttagacattgcaatcttcaacaatgatgaagagagcactggtccgtgatttccctaaaaaaaaaaaaaaaaaaaaaactcgagggggggccc

SEQ ID NO: 9902 - DNA, 895 bp, Triticum aestivum
  Predicted polypeptide sequence is orthologous to G1950
gacccgctagtaacatgattacgccacgctatttatgtgacactatagaatactcaagctatgcatccaacgcgttgggagctctcccatatggtcgacctgcaggcgggcgggctagtgattagcgtggtcgcggccgaggtcatcgacatcctgctcgatcacggtgcaaatgttgatttgactactgatgctggccgaactgctcttcactatgctgctagtaaaggaaggcttaacattgctgaaatgctgatagctcatcatgcaaatgtcaacaagaaagataagtggggctgcacacccctgcatagagctgtgagtactggaaatgctgagctgtgtgaatacctgcttgaagaaggcgcagatattgatgcagttgacaagctaggacaatcacctctaatgcatgccgtcatatgcgaggacagaggggttgcctttctgctgatcagacatggtgccgatgttgacattgaagacaaggagggctacactgtccttggccgagcctctgatagcttcaggcctgcactgattgatgcggccaaggcaatgctcgaaggctgaggatgttttgctgccctaaggtaagagatagatggaagaacatgtggagtagaaaaactgccgctgtgtaccttgtggtataagtatgaagtgtttccctccaaaatcagattgaccagccagactttttgttcgcggttaatgattctcgtgttgactttggtggtctgcttttgtgctctcttcagatgacttactgacgattgtcgtagttcaggacaaaatgaaaacttggtctcttctgccaacagaacttttagggctgtgaatatatgtattacgcgacacctggcttgagtagatgtgacccctccggcgggac

SEQ ID NO: 9903 - DNA, 1029 bp, Triticum aestivum
  misc_feature (5)..(9): n is a, c, g, or t
  misc_feature (14)..(29): n is a, c, g, or t
  misc_feature (43)..(43): n is a, c, g, or t
  misc_feature (46)..(47): n is a, c, g, or t
  misc_feature (49)..(49): n is a, c, g, or t
  misc_feature (53)..(53): n is a, c, g, or t
  misc_feature (55)..(56): n is a, c, g, or t
  misc_feature (58)..(67): n is a, c, g, or t
  misc_feature (70)..(72): n is a, c, g, or t
  misc_feature (74)..(74): n is a, c, g, or t
  misc_feature (81)..(81): n is a, c, g, or t
  misc_feature (94)..(94): n is a, c, g, or t
  misc_feature (96)..(96): n is a, c, g, or t
  Predicted polypeptide sequence is orthologous to G1950
ttttnnnnnttttnnnnnnnnnnnnnnnntttttttttttttnttnntntttntnntnnnnnnnnnnttnnntnttttttntttgggggaagtntnacagctatgacattaggcctatttaggtgactctctcagaacaagtttgtacaaaaaagcaggctgccaccggtccggaattcccgggatatcgtcgacccacgcgtccgcccaactcagaactcgcaagcttcgcttactcgccggagcagcacgcgcaccagatggccgcggcaatggaggtcgacgccggcggagagaagccgtcggagaaggagctcttcctcgccgcggagtccggggacgccagcgtcttcgcctccctcgcccccgccgacctcgccgcagcactctccctccgcaacgaggacggccgctccctcgtccacgtcgccgcctcctccggccgccccgaggccgtcgccgcgcttgtggctgccgggggcgacgccgtggccagcgccgtgaacgggaaggacgaggaagggtggacgccgatttcctcggtggacagcagcggcaacgcccagatcatcgaaatccctgctccggcacggaggcaaatgttgatttgactactgatggtggcccgaatggctcttccctatggcggcgtagaaagaggaaaggcttaacattggctggaaaggctgatagcttcatccgcgccaaagtcaaccaagaaaagataaggttgggctggaaaacccccaggaaaaaactttgccagacactggcacaagcctgagctcgaggacaataccccgccctagaacaacgggccccaaatttggatgccacgttgtccaatgtaaggacctatacaccttacaaaaggcattcccgtcactctgtccagcgacccaaggcggttgccgctttctgctttgaattagaaaaacgaggcccaattgcctgtcttctgcagtcaccagggggggacgccctcccgcgtcccttgagtccgggggcactccctcacccacttacccg

SEQ ID NO: 9904 - DNA, 524 bp, Triticum aestivum
  misc_feature (403)..(403): n is a, c, g, or t
  misc_feature (485)..(485): n is a, c, g, or t
  Predicted polypeptide sequence is orthologous to G1957
aggagaagagactcaatgctggggacaccgtttccttctgccggggcgccaccgaggccacgcgggaccgcctcttcatcgactggaagtgccgggccctagtccatgattcgttgccaaaggtagacaggccgtcgagggcggtcaagaagcgggtgcggctgttcggagtcaatctcggcacccagcagccccaaggtggcgagttaacccacgatgccaatgccggtgcagctggagtggagtcctcagctgctgcctcatcgccgtcatcctcccagacagaagcacattcctccttggatctcggtctgtgaatgcgtgcccacggaaagttcaacagcacaattccttcagtttgtcacctttatttcttctccaccttttgtggtccgtctgtaanacattgatatagccaacattcaacttttttaggcatcaaatcctgggttggttcaaattataatacagagagatgaattagngaatatcaatccccatgattgttggtcaaaaaaaaaaaa

SEQ ID NO: 9905 - DNA, 1153 bp, Triticum aestivum
  misc_feature (21)..(21): n is a, c, g, or t
  misc_feature (24)..(24): n is a, c, g, or t
  misc_feature (33)..(33): n is a, c, g, or t
  misc_feature (832)..(832): n is a, c, g, or t
  Predicted polypeptide sequence is orthologous to G1958
cgtaccgggtcggcttcagtnctnattgcagtnacagatgagcttcctaagcagactgaatggtggacggatttcatgaatgacgactggaaggacattgctgacaacgcaggtgcggctaaaactcaaccacaggctggaccgcctgtgcaatcatcgatttcagttcaccaatcagccagtcagcaagctggtacaacttcagttcaccaaccacccctccagcaaatagttacaactcaatctatagaatcatctgtagttgctgcaccctcaccctctgccagctccaacacctccaagacacgcatgaggtggactcctgaacttcatgagcgttttgtggacgctgtcaatctgcttggtggcagtgaaaaagctactccaaagggggtgctaaagctaatgaaggcagataatttgaccatttatcatgtaaaaagtcatcttcagaagtacagaactgcccgatatagaccagaattatctgaaggtacatcagaaaggttggaagcctcaaaagaggagttgccatctatagaccttaaagggaattttgatctgactgaagcattacgtctccagttagaacttcaaaagcggctccatgaacagcttgaggtacaaagaagtctgcagctgagaatcgaggagcaagggaagtgccttcagattatgatcgagcagcaatgcaatcctgctgcagacaaggcgctggatgcgtcaacctcggtagaaggatcaaagttatcttgtgaccccccagaatcttctaccggaaaggatgttccaagcagcagtcaaaatggaacaccgagccagcaggtgacanggaatgaagatctaccatgctcgcctgaagatgtgaaccccactagccatgaatttgacatcattttgactggttgctgccaaactatagaatcaggccggtcttttatctttctgggagaaagggggtgagcattctatgacctaggttttagtggtccagtaccacaggtacagaagcgatgattccgggccatgtgaatgatctaggtttccaaaaggcaggccaagccaattcaccctgatttactggtttggagggggtttgactcttggcttcccctgttgttaggggtgcaaaataacctcttttgcctttgat

SEQ ID NO: 9906 - DNA, 1166 bp, Triticum aestivum
  misc_feature (16)..(16): n is a, c, g, or t
  misc_feature (702)..(702): n is a, c, g, or t
  misc_feature (772)..(772): n is a, c, g, or t
  Predicted polypeptide sequence is orthologous to G1958
cgtaccctccttgcgncgacccacgcgtccgccttgctgtcatctcctccccccaaagccgcaccgatccagcagcttcctcacaacccaacccaggttattctgtaggaacatatcaaaatcaatttatgggaaagacacaacgcttgtgcacaattcttgatgaggaggtgtgatctgagacagtctcacaacagcagggtttctggaggaatgtcatcctctttacctattctgccaaattctctgaaagaaaccttccatgggccttacaatccgcagctcactccgatgcaaaggcaagtgacgagtgatcttgtgcccttacatcagagtgcacttccatctgctactttgcacccaagagctggtgctatgagatcatcatatgcagcctcattaggatactcacctaatcctctggattctgcgcctaaccatgagaggcagtctatggttgctccttttgctcctcagccatcagatatcgaagtatttcagaccttatctaataatatccctggaggtcacactggggcaacttggttcccaggttcggctgatggtttatcagattacagggataacatccctgcttctggtagtcagatccagaacggcggtcctgctgtgacatctgatgtggttgctaaacaaaatgaatggtgggcagaaataatgaatgatgattggagagatatnctagatgcaacggctgctgatccccagtcaaagtccatggttcagccttccaattcggctgcatcacagnctgctgtcaaccagccagcttcatctcatggtggagagatttgcaatgtagctagtcctccccaatagcaactctgcagccaaacaacggatgaggtggactccagaactccatgagtgctccgtagactctgtaaaatagcctggtggtagtgaaaaagctactcccaagggtgtgctgacgctatgaaagtggacggtttggacatatttatgtgaaaagccatctgcaaaattccgacagctcgtataggccgacctaaggcgaggtcagcaaaaaaaaggctccaccgaggattgaccttaacctgaaacgagcatgattttattgagcgctgcgctttagagggagttcaaaaacttttttgacacctggaaccaagaaagggggtggg

SEQ ID NO: 9907 - DNA, 1101 bp, Triticum aestivum
  Predicted polypeptide sequence is orthologous to G1958
gtcatccaagagcggccgcccttttttttttttttacagggaatccggtgtcattcaaaagagcatccaacactgcgttcttcacgcagtcacataaatacaaagccacacggtaaacatggtaagggccgaaggcttaaaaggtttgctcccttgcggacacagggtaactattaactgaaagtaagaaataaaggtaaatatagcctgaccatgtttggtaccataaaacatgctccaaacacatgaggtggcagagaatataacaaatacttggattagtgcataatcaaatgcctaagatgctattgtgttcctaacaacggcgaaagcaataagtcaaaccacctcaaaacagtacatcagtgtgaatttgcttgcgctgccttctggaaacctagatcatccacatggcacggaatcatcgcttccgtgactgtgggtactgtacagctaaacctagttcatagaaatgctcacccctttctcccagaaagataaaagaccgacttgattctagtttggcagcaaccagtcaaattcatggctagtggggttcacaacttcaggcgagcatggttagatcttcattccttatcacctgattctgcttgctcggttgttccattttgactgttgtttggaacatccttcacggtagaagattctggggggtcagaagataactttggtccttctgccgaggttgaagcatccagcgccttgtctgcagcaggattgcattgctgctcgatcataatctgaaggcacttcccttgctcctcgattctcagctgcagacttctttgcacctcaagctgttcatggagccgcttttgaagttctaactggagacgcaatgcttcagtgagatcaaaattcccttaaaggtctatagagtgcaactcctcttttggaggcctccaaccctttctgatggaccttcaagattaatcctggtcaatatcggggcagttctgtacttcttgaaaatgactttttacattataaaatgggcaaattaatctgcctccaataagctttaaccaccccctttggaagtattttttttcctgggccccacaacaaatttagcacgga

SEQ ID NO: 9908 - DNA, 748 bp, Triticum aestivum
  misc_feature (376)..(376): n is a, c, g, or t
  Predicted polypeptide sequence is orthologous to G1958
tgagacagaaattagattaggctatgatcctcactttctgagctactcttgtctcgatctaatcagctccgtttgtttgcgatcccgaggcaatgatcagaagcggtcattccttctcccgatggctcatttcggccgaatcagagtctgctgtttgttctctgtatgcttccttgagatccacagcctgcgcgttcgaatgctggaaccttggtagcgcgccgagctgctttaggctctcgccctgcctcgcgatcaccatctccaggtacttgctgtgttcttctacctgcagctgcatctttctttggagctcaagctgtgcatgaagttgcttctgcaagccaatctgagttcttagcccttcactagcctncatgtgtttcatgttctgggagcaaacttcatccatgtggctgcttctctccgctgaagtgcctgcatcagatgattcagattgatggcgaactgtacgatacttctgtagatggctttttacatggtatatagttagccccttcaaccttcataactttctggactggcttttggagttgcttttttcactttccaccaagccttggtcaacgggcgtcaaacaaaacttttcattggaagctttaaggggttccaagccgcatccccttggacttggggttgggaagttaggggtcttggaaccaaggggtaaaattttttccacttggcaaaagtttcatttcccccggtttggaaagggaaaacttct

SEQ ID NO: 9909 - DNA, 601 bp, Triticum aestivum
  misc_feature (86)..(86): n is a, c, g, or t
  misc_feature (118)..(118): n is a, c, g, or t
  Predicted polypeptide sequence is orthologous to G1983
ttttttttttttttttttgtcaaatgttgccttgccataacaaccacatttcacggtgatacgaaccagaactgttaatttttccncggaaatatatacaggggaggggattgctganagggagaaatctagagacctcgaaggcacaaattatgtacaattcataagtacaaatcgagctccccaaacccatggacacagaagaaatcaagaatgaacattcgacaaggtaggagccgaaggcctgtcccggctcaccattgtgcattgaggtgttctactcgggggcgcatgaccatgaggctcccaagcagtcgaccaggacaccatgctgccgcttctcctcatcatccccaaccaatttgcgttggatcatctgctggaaatcaacgcgccatggaagtatctctcggtgctctgctcccccgtggcttttggccagagaaatgcgaatgccggccggccagcacgacggaattctgacttgtcgccggcgcgccgtccgtgcctcagcgacagggacagaccgtacggaaaagcggcgaagcatcggcgggcgggcggacggttttggcatctcacacgtcgctttcgcagccgt

SEQ ID NO: 9910 - DNA, 635 bp, Triticum aestivum
  misc_feature (388)..(388): n is a, c, g, or t
  misc_feature (398)..(398): n is a, c, g, or t
  misc_feature (440)..(440): n is a, c, g, or t
  misc_feature (445)..(445): n is a, c, g, or t
  misc_feature (474)..(474): n is a, c, g, or t
  misc_feature (509)..(509): n is a, c, g, or t
  misc_feature (512)..(512): n is a, c, g, or t
  misc_feature (533)..(533): n is a, c, g, or t
  misc_feature (556)..(556): n is a, c, g, or t
  misc_feature (575)..(575): n is a, c, g, or t
  misc_feature (598)..(598): n is a, c, g, or t
  misc_feature (602)..(602): n is a, c, g, or t
  misc_feature (605)..(605): n is a, c, g, or t
  misc_feature (609)..(609): n is a, c, g, or t
  misc_feature (613)..(613): n is a, c, g, or t
  misc_feature (615)..(615): n is a, c, g, or t
  misc_feature (623)..(623): n is a, c, g, or t
  misc_feature (626)..(626): n is a, c, g, or t
  misc_feature (633)..(633): n is a, c, g, or t
  Predicted polypeptide sequence is orthologous to G1995
tttttttttttttttggttactattcggcgcctttagcgctcgttacttggctggttactattcggcgcctttagcgcccgttacaggcgttttcgctaacgggcgcatacccacccttcgcgctgggccggcccatctactcttttctctattctgtttttcgcacaaaaaagcggctaaggtgagactcgaacacaggacctgccgccttaaattagctcctacttaccatcccgccaccaattctcacgtgactactaacatctttcccttctactccctctgttccgaaatagttgtccttggggaacttttcccgaacaagtgaaaaacaggataaagtaccaaaactaccctcaaatttgaaaatcctggtcgccggggatnttcgtcctantcaacggtcctcccctccggcaagctcatcccaatgctgcanctccngcgtccgtcgcgccggtcggaactccctnttcggcggcttctcggtcaatcaagagccaaatcntangcactcctcgccgtcgcaaanctcaaccgccggatcctggcgtnggcccccggaataaggctngtgcgcaagtccccgacgacaanaaangcnccgngtcncnccctgccnacntaatctnat

SEQ ID NO: 9911 - DNA, 745 bp, Triticum aestivum
  misc_feature (651)..(651): n is a, c, g, or t
  Predicted polypeptide sequence is orthologous to G2010, G2347
ctccttctccttccactcatcagctagctccacagttccacttccgcgacagctcccagagaagagccctaactagcttcatcttcatcgcgcctcaccggaaggcatggaccgcaaggacaagtcccgcaagtcctcctcggcagcgtccatggccgcgctcgccgccgcagctgcggccggcgacgtggcccgagccgacgggatgtccggcgaggaggaccagaagctgaagctcgtgaacgttcccgtggtctccgtcggcggctcgagctcctctgccgcggcggtggcggtgaggaggggcagtggtgctgctggcgccgtggcgacgggcgcggctggggcaggcgggccgagctgccaggctgagaggtgcggcgccgacctcagcgaggcgaagcggtaccaccgcaggcacaaggtgtgcgaggcgcactccaaggctgctgtcgtggtcgtcgccggcctccgccagcgcttctgccagcaatgcagccggttccacgagcttttggagttcgacgaccagaagcgcagctgccgccggcgcctggccgggcacaacgagcggcggaggaagagctcggcggaggccaacggcggcgacgggtgccgccacgccgaccaggacggccgtagccacccggngaacccgccgctgaaccattttcagatcagataaacctacctaagcatgctccctctcttctgtcatgcagccatgctactagctacatatgta

SEQ ID NO: 9912 - DNA, 462 bp, Triticum aestivum
  Predicted polypeptide sequence is orthologous to G2011
gaggcactgttgcaggggccgcagctgccaccattcctgtccaagacgtacgatctcgaaggcgagccgcagctggacggggtcatctcctggggtccttcgtcgtgtggaatccttccacctttgaccgggacgtgctcccgcacaacttcaagcacaagaagttctccagcttcgtcagccagctcaacacctacgtgtgtatcgtatcactgtccaatcctctgttctcatctttcttttcttttacaatctctcactggattattattcatgatgccgtcctctgctggggaggcactctgtttctgtttggtatctggcactctgtttcggatgctctatttttggttttgttccttctggtttctgctgatgtactcaacccaaatctgttgggtgtatatatatatatatatactctttgtacttcccttcatacttttagtgagaggagttgtg

SEQ ID NO: 9913 - DNA, 692 bp, Triticum aestivum
  misc_feature (528)..(528): n is a, c, g, or t
  misc_feature (606)..(606): n is a, c, g, or t
  Predicted polypeptide sequence is orthologous to G2030
cgcacttcttcacagcttgctcacgcgcccgcccggcaaaaatggcttccgctcccccgacgcattcgaatggagagaatatatcggaaatagaaatagcacgagtcaatcatcctccgcccacaacgcaagtagctatgaacggtgttcagaatggagtacatacgaatcctaacaatggcaggctcgctgaagataagcagcaagcttaccgttcctggttactcctcctgacgtcactgactgccacggtcaccttcaccgtggggcttaccccacctggtggtttctgggctgcagatgacaagacaaacggatatgtcgctggcatctcggttatgcgcgacaaatttcccacgaggtacttggccttttactacagcaacacgaccgctttcttcacgtccttgatgatcattgcaatgctcgccaaaaaacaaaacagcgaaaacacaaatagcgagcagcctgatgccatgaaaaagcatgttttaaacggccttgtcgttctttgctttttgagcttgnggaccagttatgtcgccggcacatgggacagccctagtcgagtgatttatgtcgttgctgtgtttgtagtcaacattntgtacatgttgctgccttggtttgttagtttggtccgacgctgcattcgatccagaaagccttaatgtttgggttattgctacaaa

SEQ ID NO: 9914 - DNA, 746 bp, Triticum aestivum
  Predicted polypeptide sequence is orthologous to G2035
gcgttgcaatcagcacatgtgtataacaccgtcgctgcaccggtagacagcagtgcagctcttcattctccagtattatacattagcaacagtacaagcattccagagaaaggtctgcgtgctgtacctcaacacagacctaaaacagccatgaaaaatatgtacaaggcgaatgtttcctcccaactacctgtcctcaatgttacatgccgcggcaacaggactacaaagcatagatcttcttctcatggtcttccacggcctccaggtccgacaacccttcacggacagaccaggagaaggacttgctgccgctccccctcctgatgcgccgctgcctgtcctcgccgaacgtgaaccgcgggcgcagcagcaggtaggcgaggaacaggagggtcccgatcatgatcggccctccgacggccgatatggtgaaggccatccacgcgtgctgcgggccgaccacgacgtaggccagcgacacgaacgccgcgcacgtgctgaggcacgccgtccacatcagcttgttcacgatcttgatgatctgcttctgcgcgccggtctcccaggcgaccagcgtgatctgcaccacgaccaccgcgagcgaaatgaagagggcgatggcgttcaggaggcagaacacacggaacccggtgagcttggatatgtaggcctcgccgatctctcccccgtgttcagtgtcctggtactactggcctggcacgtcgaagatcgaaacgaacgcg

SEQ ID NO: 9915 - DNA, 692 bp, Triticum aestivum
  Predicted polypeptide sequence is orthologous to G2052
gcgggggccgcgggaccgcaagtaccccaacgggtcgcggaccaaccgggccaccaccacggggtactggaaggccaccggcaaggaccgcaaggtgtcgtgcgacggcggcgccgtctgcggcgtcaggaagacgctggtgttctacaagggccgggcccccggcggcgagcgcaccgactgggtcatgcacgagtaccgcctctgccaggacctcctccacggcgcctccaacttcatcggcgcctacgcgctctgccgcgtcatcaagcgcaccgaggccggcctcctgcacggcgacgcggttgccaaggccaagccgggccaccagcagatgaccaaggttgggagcagctcctccctggtcaccacggaccagcagctgagctccctcacgcccagccctccgcgcctcgacatcgtcggcaacgccttccagcttcacagctccccctctcccctgtacggaggggaggtgatgtccggcatgggtgcgcccctggggttcccgcagcaggacgccgccggcacattcttcatcgacggcgacctcgccggcgcaggcgagacgacgcaggcgcacatgcctttcttcgacgacatgggcgtggtctcggaccacgagctcagatgggacaccttgccgctctgcactaacaacaccttctccttcaccgccggcgccgcggagc

SEQ ID NO: 9916 - DNA, 511 bp, Triticum aestivum
  misc_feature (487)..(487): n is a, c, g, or t
  Predicted polypeptide sequence is orthologous to G2060
aatagagaggagggaagaaggtgctttgtccattgcaccattgcttacgagttgccccaatgtgcaagaactttctgtgtcggtcgtgccatcgcagtccaagcggagacggtgcagcgacagtgaagttcagtatcgtgttattggtggtagagggatgatcgtcaggaatctcagggaaattaggatggagtacattgatgagagcaagagtggattggatctggttaagcttctgctcaagaaggctcagatgttggagatgatgacaattgtgccttccatggatggccttgagcaggccaagttcaggcgcaggtgttgaagttcagaaaagcttccaggaatgtcaacatccagttttgtgccactgcatgatgggatgattgtaattggtggagctcatgttctagtccctgaaggaagaagtggcttgctgtcatcagtgagccttccagtcctgttccggcacttctaagatctaacntgcacagactgcaaaaaaaaaaaa

SEQ ID NO: 9917 - DNA, 1054 bp, Triticum aestivum
  Predicted polypeptide sequence is orthologous to G2067
cctttgttttttttttggaataatgaatgccttccctctgggtaactttaaaagtcattcaggtagagattatccaccaacactgcaagggcggttctctgttttacaaaacccttcaatggagttaactatttgagttaacccaattacagtctataatcgacataagacaagtggttagaatcctaaatccaattatacacaaatgttctaaactatagtataaatttactagcttgcagggtagcttcgatcttcatacagcttggggggtcataaaattacatcttcagacaactttcatccttcagcaatcatctgtcagcaatcagcagtatcatggttttcatgcccagaacaattctcagaatcagtttccaactctgatgcctcaccttgcaacttcatttcctcagatatctgatcatcatggcagtagccttcgacattcaccgccggtggctcactgtggtcattctcctcaccatcttcactagacgatgacatggagaccgcctcaggaactagacgtgtcagcctgcttgaaggtaatcttgctattttggcccctccagatctgatcttggactcgatggccttgatcagcgaagctgcttcctcaagagctgtagcatgcacaagagggtgtggacctttttctcgcctggtcagttcagacataacacctggcaatggacctaaattacaaaaacttccttttggttgtctaatgcgttctgcagggcggtatgaaattggaactgcttcgataggtgctgccaacaatttgtactgtccatcagcagaagctccaggtgaatccctcgacaaaggcatgtatagcgtcagaggtttagcaggaatagcaactggagtttctcagaatggtcaagggaggttgaatgatttccccgggttgcccgactcgaagtggtattctggaatttctcaggaaaaccctcctttttgttctcagaatcaaattaaaacatctggatcatgcctgccttgttccccattgaggtgaaagcccttagaacggttattgtatcca

SEQ ID NO: 9918 - DNA, 718 bp, Triticum aestivum
  Predicted polypeptide sequence is orthologous to G2067
tcggcacgaggccaaaacacactagagaaatacatcaggactgcaaccataacatagccggacctactaaatctgattgcgtggttatcagtccaccagaacaagggttggttcacaaccatgataatggtgccatggtggctggaacatcactggaaaaggcagcgtcagattctgaaagagatcaacattcgagcgatcagtgtctggatcaccatcctcctgcgtcttcctgttctcaaaacagccatgtagaacaaagccattcaaatagttctagcagctcgcatggaagcaccacgtctccccagagaagtcgatctatcggtaaacttggaaagataggaaagaagtactgctgcttgggatcattctagtcccctgcatatagcatttcatcgattttgtacaggatgggacatagatcttctggcagaacgagggcacgttccgaagcagcatgagaaagcacttcatatagtgtgaggcactatgtcgtgacactgatgattctgttgaaccgagttgaggctcttatatcgtttgatcgataatatgccagttctgttatcgattcttatctttgttcagtacaatgagttcagttgtggtttccaactctcaccagcccctcatttgtgaattctattgtaaaattctgtgcaatgtaatttcaccttttagcaagtgatactaactgataaaaaaaaaaaaaaaa

SEQ ID NO: 9919 - DNA, 393 bp, Triticum aestivum
  Predicted polypeptide sequence is orthologous to G2071
ttttttttttttttagaaaaaaaaaaagctgatgttatgcaaacccagacaagctctacacactagattctgaaggactgccaaattacagcggttcttacggcccccctcctcgactacacactagcctacaggtcagcggtctctgaagcagcacgagaaaggaaactagcaggtcaatcaagcacaggtcatcggtttacaatagagcaaattatatgtacaaagcaggcaggccggtggaatgccgatgctgactccttgatcctcctcaccaggggccggtcaacgttcttcgcaagcactgccgcttcttccgtccgaactgatccttcatctcagggggcctgctctcttttctgcatttccagtatctctttctgtttccccacc

SEQ ID NO: 9920 - DNA, 568 bp, Triticum aestivum
  Predicted polypeptide sequence is orthologous to G2071
tcggcacgaggcgtcgcggttggatggacgccgcccttttgccttgtgacggaggaagccgcggatgagggcgcgctgcgccatgcgcgtgcgcctgagggcgctgccgtcgcgttgccgctgtgcctcttccagccccagccattcatccgctctggccgttgcatcccgtggatgagcagccgaggcgcctggacgcgggagccgctagcgatgttgcagatcgtttgatccagtgcaagaaaaactgaacttttcttccttggtcaaggatctcttccggttgatgcttcagccatctattcatctcaccatgtccacatactatgtgcagaaaagcagttaatcttcagatcatgggaagaacaaaaattaaacggaattagtgtttcctgattgatttcccgatgctcgttcaggcagtcgctgtgctgacgccgtttaagggttcgtgcttgactcattggctacagccgccgccgactggtagggtccccgctgatggtgtctgcgccaccgggaggagcgaggccgcatcaccccgcgccggaggacgccccatgcgcca

SEQ ID NO: 9921 - DNA, 568 bp, Triticum aestivum
  misc_feature (380)..(380): n is a, c, g, or t
  misc_feature (411)..(411): n is a, c, g, or t
  misc_feature (413)..(413): n is a, c, g, or t
  misc_feature (427)..(427): n is a, c, g, or t
  misc_feature (472)..(472): n is a, c, g, or t
  misc_feature (520)..(520): n is a, c, g, or t
  misc_feature (524)..(524): n is a, c, g, or t
  misc_feature (536)..(536): n is a, c, g, or t
  misc_feature (540)..(540): n is a, c, g, or t
  misc_feature (543)..(543): n is a, c, g, or t
  misc_feature (547)..(547): n is a, c, g, or t
  misc_feature (551)..(551): n is a, c, g, or t
  misc_feature (555)..(555): n is a, c, g, or t
  Predicted polypeptide sequence is orthologous to G2071
agatggaattgggagactgaggtgggcaaaacttaaagagcggaatgaggagttgcaagagaaaacaggcggagatgctagagaggcaaaagaatgaggtattcgagaaggttacccggcaagctggaccgacgtcgaagaggatctgcctgcggaggacgctgacgggcccttggtaagccgaaggcctgtaaactaagagcgcactactttcgacgccgcgcggttatatacatacagtagatgaatttcaaaatcgccaggagttgcgcttgtagagcagccactgatccgatgcttcagagctcaagctcctaagccgatagactgccggcgattttcacttcataggttttttaccgtccgcctgccgttccgtnggagttagagagcaatttgtatgttaaaatncnacttaaccaagttnttggggtgatactgcatttaaactaacatttcccaatttttttanggttccgggaccccattacaaaaccaatgtttaaaatggagtttttgncccnccaaaaccgatncccnggnccgntttntaancaaaaaaaaaaaa

SEQ ID NO: 9922 - DNA, 893 bp, Triticum aestivum
  Predicted polypeptide sequence is orthologous to G2071
ctagcttttaggtgactatagaacaagtttgtccaaaaaagcaggctggtaccggtccggtaattcccgggatatcgtcgacccacgcgtccggcatgtgacccgctgcggtttgaggcgaattctctgctggtgtccgtgtccgtttgatgctgaaggaggactggcggcggcgtggagaaggtggtggagaggaggcagaggaggatgatcaagaacagggagtccgccgccaggtcccgtgcccgcaagcaggcttatacaatggagttggaagccgaagttcagaagctcaaggacctgaacgaggaactggtgaggaaacagaaagagatactggaaatgcagaaaagagagcaggcccctgagatgaaggatcacttcggacggaagaagcggcagtgtttgcggagaacgttgaccggcccctggtgaggaggatcaaggagtcaggcattccaccggcctgcctgctttgtacatataatttgctctattgtaaaccgatgatggaccagacctgtgcttggttgacctgctagtttcctttctcgtgctgcttcagagaccgctgacctgtaggctagtgtgtagtcgaagaggggagccgtaagaaccgctgtaatttggcagtccttcagaatctagtttgtagagcttgtctgggtttgccaaaaaaaaaaaaaaggcccggcccgctctagagtatcccctcgaggggccccagctttacgcgtaccccagcttttcttgtaacaaaggggccccctatagtggagcccgtattaataaacttaaggcacttgggccggccgtttttacaaccgtccgtgactggggaaaaactggttaaccttgggggatactttgggggagagaaaccctttcctttc

SEQ ID NO: 9923 - DNA, 869 bp, Triticum aestivum
  Predicted polypeptide sequence is orthologous to G2071
acgctatgacattaggcctatttaggtgactctatagaacaagtttgtacaaaaaagcaggctggtaccggtccggaattcccgggatatcgtcgacccacgcgtccgcgcgcaccaatcgctcctggcagcagtagtagtaactgctcggatttgctcttgctaaattcggcagtgccgcccatacttaatcgagcccggccgcctcctgtcctcctgcttaaagcagctcgagctcgctcgctcgcccgctgctccccatcacgactaccacggccgctgtgtctgtcaggctggagctcgaacacctgtaacgccctgacttgtgcctgcctgtgtgctttttgattcggttggattaattggcgggactgagtgaggggatcggatccgatggactttccgggagggagcgggaggccgccgccgccgccgcagcagcaccagcaccagctgctgcccgcgatgacgccgctgccgctcacgcgccaggcctcctcggtctactcgctcacgttcgacgagttccagagcgcgatcggcggggcgggcaaaggactcggatccatgaacatggacgagctcctccgcacatctggacggccgaggagtcgcagggcatcggcgccgggcccaaagccgccgcctcgtcctccggcggggggggggccggaacacgggcggaatccagcgccaagggctccctcacgcttccccggaccttaacccaaaaaaacgtcaaaaaaggtctggcccgaattgatgttctttcgaaggcccttccgcttcccctccggggccgctttaaatatccctccggggggccaaagtttaccgtaacccctcttttttgtaaaaaggggccccct

SEQ ID NO: 9924 - DNA, 1228 bp, Triticum aestivum
  Predicted polypeptide sequence is orthologous to G2071
gagggggtcatggacttcaggagcagcaacggcgggtcgtcctcggagcgcaggccggcggacggggcgccgctgacgaggcaggggtccatctactccctcacgttcgaggagttccagagcacgctcggcgggggcgccggcgtgggaggcagcgacctcgggaaggacttcagctccatgaacatggacgagctgctccggagcatctggaccgccgaggagagccaggccatggctgcctccgcctcgggcgcgggcgcgggcgccggcccgccgcccacgtcgctgcagggccagggctcgctcacgctgccccgcaccctcagcgccaagacggtcgacgaggtgtggcgcaacctcgtgcgcgatgacccgcttccggtggggccggagggtgccgagccgcagccccatcggcaggcgacgctcggggagatgaccctggaggagttcctggtcaaagccggcgtggtgcgagagatccccaccgctcctgcagtgccgcccccgcccatgcagccgcggccggtccctgttgtccctaaaggcccttccttctacgggaacttcccgagcgccaacgacgccggtgcggcggcgctggggttcgcgccggtcgccatgggggatctggccattggcaatgggctcatgccgagggcagttggtatgggaggcgcccctctggttgtgcaaactgcggtcaacccggttgattctggcagcaaggggagcgaggatctgtcatcgccgtccgaaccaatgccgtactcgttcgaggggattgtgggggggaggaggactggcggcggcgtggagaaggtggtggagaggaggcagaggaggatgatcaagaacagggagtccgccgctaggtcccgcgcccgcaagcaggcttatacaatggagttggaagctgaagttcagaagctcaaggacctgaaccaggaactggtgaggaaacaggcagagatactggaaatgcagaaaagagaggcccctgagatgaaggatcagttcggacggaagaagcggcagtgcttgcgaagaacgttgaccggcccctggtgaggatcgaggagtcaattggcatcggcattccaccggtcgacctgctttgtacatatattcgctctattgtaaaccgatgatggaccagacctgtgcttggttgacctgctagcttcctttctcgtgctgcttcagagaccgctgacctgtaggc

SEQ ID NO: 9925 - DNA, 464 bp, Triticum aestivum
  Predicted polypeptide sequence is orthologous to G2085
ttttttttttttttttttgtaaaatatgtttaagtttgaacgaactcgccgctgtttgcgttaaatttgagtcgttttttacttttttgactaaccgtgggcgccgcgactggggggcaacacgcccccagtgcgcggtttagcgccggtgcgcccccagggggcgattttttgcccctcctggggggccaacggctggagatgccctaagatggatgcagcttgcaatgacaacatgacatggggggatgaggatcaatcaatcatcaattgataaaagagacaccaaatgtggcaatattctctattatggtctctttctcattaattttctgtcctgattgtatattatatggcatatttttattttattttatatatacttgccgtatccccgaatggctgtttttgaaaaatgccgtatcccgtatccccgtatgcgtatccccgtctttccgtccccg

SEQ ID NO: 9926 - DNA, 886 bp, Triticum aestivum
  misc_feature (823)..(823): n is a, c, g, or t
  misc_feature (870)..(870): n is a, c, g, or t
  Predicted polypeptide sequence is orthologous to G2085
aaccagctattgagcatgattacgcccagctatttatagtgacactatagaatactcaagctatgcatccaacgcgttgggagctctcccatatggtcgacctgcaggcggccgcactagtgattagcgtggtcgcggccgaggtagtaaacgcaaattatctggtacacatatccatgtaacaaattaatgaaaaaatgtcattccgaagcatttgtcgaacagattttctcatacgccatgcaggagaggatgttgctgtctctaacagtgtcatttctagaagatttaaatctaatgaacgctcagaaaaaacccatgtcgaaaaacgtctattatctatatacacatgcggcaacagagtcagaccatcggtacatccacaccacaatgcgcacattgcaagcctccagttcaaattatgccgattataacttctaagcatgcaactccatgacaaacgcagcgtcctctgaagcatccaccacctgatggctatgaatcatggccattggcagcaggagcaggcgctactggtgcttctggtgcagcttctagtgcgagatgttgctgctcagcagtgggtgcttcagcaactccattctgagcgtcatcggctgctggcagcacaactttcaaaggtgtatgacctttgacctctctcatcatacccttgtttgcccacgcgagtccacatgcattgcacagagtccttggtccatccggtcctcgacgcatcataggtgtattgttagaactaatacacaatgctggcatacaggtgcagaaagaggtcgaccttccactgcaccccaatctgaanttagcgcagctgccgcacctcggccgcgaacacgctaatcccgcggncatgtgcggcgggagc

SEQ ID NO: 9927 - DNA, 871 bp, Triticum aestivum
  misc_feature (2)..(2): n is a, c, g, or t
  misc_feature (4)..(4): n is a, c, g, or t
  misc_feature (19)..(19): n is a, c, g, or t
  misc_feature (365)..(365): n is a, c, g, or t
  misc_feature (447)..(447): n is a, c, g, or t
  misc_feature (467)..(467): n is a, c, g, or t
  misc_feature (479)..(479): n is a, c, g, or t
  misc_feature (490)..(490): n is a, c, g, or t
  misc_feature (514)..(514): n is a, c, g, or t
  misc_feature (517)..(517): n is a, c, g, or t
  misc_feature (533)..(534): n is a, c, g, or t
  misc_feature (551)..(551): n is a, c, g, or t
  misc_feature (619)..(619): n is a, c, g, or t
  misc_feature (633)..(633): n is a, c, g, or t
  misc_feature (673)..(673): n is a, c, g, or t
  misc_feature (685)..(685): n is a, c, g, or t
  misc_feature (692)..(692): n is a, c, g, or t
  misc_feature (732)..(732): n is a, c, g, or t
  misc_feature (734)..(734): n is a, c, g, or t
  misc_feature (753)..(753): n is a, c, g, or t
  misc_feature (756)..(756): n is a, c, g, or t
  misc_feature (856)..(856): n is a, c, g, or t
  misc_feature (869)..(869): n is a, c, g, or t
  Predicted polypeptide sequence is orthologous to G2110
gnanatgccctttgctcgncttaaccctactaaagggaacaaaagctggagctccaccgcggtggcggccgctctagaactagtggatcccccgggctgcaggaattcggcaccagcgatgcctggccatcaatagtgtcgcgcatgccattattttgcatgagcaacagcaacatcagcaacaacaacaatactcatggggcgtgggcacgttcaagctacctcaacaacaatacccatcgggccagggctccatccaacctccatttgaggcaataaggacgtttgtcttgcaaacactaccaacggcgtgcggtgcgtatgtctcacaatactgctccaccaccaccggctcatttggcggnttctttggtaactgaacaagaactataattctagatagatcgattgtttgccggtgcttaatccatggttcgattgatgtancgacgacaaataaaagtgtnattgcccaccgngtgcgaaaccngacatggtactaatttttaaattnggnaaataaaaagaacaanncatattttctttggttnaaaaaaaaaaaaaaaaaaaaaaaacttcgagggggggggccccgggtaccccaaatttcggcccctantaagtgggaggtcngtatttacaaatttcaacttgggcccggtcgttttttacnaaaccgttcggngaacctnggggaaaaaaaccccttgggcggtttacccccaaactttnantttcgccctttggcaagcnaanattcccccctttttcgcccagcttggggcggttaattaagccgaaaaaaggcccccggacccggaatcggccccttttccaaaaaaaatttgcgccaaancctgaaatggggnat

SEQ ID NO: 9928 - DNA, 402 bp, Triticum aestivum
  Predicted polypeptide sequence is orthologous to G2110
ttttttttttttttttttagggggtggcagcaggttatatacctggttagaagatgcattacatgcgatggttgtccaaaagtgaatcaaactcagcaaataaacaagcaatctaaagacgatgtatctaccagatgctccactctatgtcgttgtatttcagccacgagacttgccgctgcagcttcatctgcacgctccgccaaccccatcgtgccgatgctcgccttcatcatcgcctgctcgagcagctcctcatctgcttcatcatcagatcgccatcgcagtagagccctcgacgcagcccacaacctctcacggtagccgcggaagatgtagcggtcatcgccattcccgcttgtcgtagtgcagccagctgttgggactgcgttcgggcacgcg

SEQ ID NO: 9929 - DNA, 885 bp, Triticum aestivum
  Predicted polypeptide sequence is orthologous to G2114
acgcttgaccttaggcctatttaggtgaccttcaaaaccgtttgtaaaaaaacaggttggacagggccggaattcccgggatatcgtcgacccacgcgtccgcagggaactaggacctgtaccttggcaccttcagtacgcaggaggaggcggcggaggcgtacgacatcgcggcgatcaagttccgcgggctgagcgccgtcaccaacttcgacatcagcaagtacgacgtgaagcgcatctgcgccagctcgcacctcatcggcggggaccttgcctgcaggcgctccccgacgcgcgacgcgccggcgctgcccagcggcgtgagcgtcgccgtcgagcgccccgaggccggcgcgtccgacaacagctccgacgcctcggacggccaccgcggcgcgcacctgctgcacggcccccagtacgcgcacgccatgaagtacgaggccggcgagggcagcaacggcggagggaactggatgccaggcgcggcccggccggtcgccggcgtcccagcgcgcacccgctcccggtgttcgcgctctggaacgactgagtgagtgagtggctagcatagcacgcagcgcaaggacgtaataggtagctagctagggcaacatgcccccttggccggtggtgcaagaggacccatgataaaccttgagggggaaggccgggttgtaatcggcccaacccctgcgatacgaaggtggggggtgcccatgccttgtcccttgcttgggttggcgcctttaacttgctcgggaaggggccccacatttttggccgcaatggggaaactcttttgtaaccgggcatgcattgcactgtcctggccacccaacctagggaaaatttttccaacgggcccaaaaaaaaaaaaaa

SEQ ID NO: 9930 - DNA, 1129 bp, Triticum aestivum
  misc_feature (14)..(14): n is a, c, g, or t
  misc_feature (17)..(17): n is a, c, g, or t
  Predicted polypeptide sequence is orthologous to G2124
gttgtagtacagtncgncgacccacgcgaccgggcacaacaattctaccgtcgcgaatcgatcatggagctacagacgatagaacaaaggtacaatcgataatttacatacagctgaaccatatataatcattgacaccacaaatttcaatacatacaaggattatcttgaatccatacaagtaactttggtagatatagatatagagattgtgttgacacatcaccacaaatctgcaaccaactacagcagtccagcctaaacaaattgtttgcatgcggatttacatattgttgtaacaattcgagtatatttggattcttcactcagaagttgtgtttatttgtatgatattctgtactaaatgtaagtttaatgctccctatataaggattgtttaataagaaattcatattagaccccttgtctctggtctcctgcttcatattgtaatccgccataagtaagatacaatttatgtagcttgaacagctgtatgtgggtctttgtattacccaaatgaagcctacagctatacgcaggtggacacatctttctcgttggagcttgaagagacgtgagagctctatgattctggagaaatctgccgaacacatcttacctcagggaatacccgctgggaggctggtttacatgtacttgcttactaatctggataatcatttattagagcgctattttaatcagtttcgctacatattatggtgaacattacatccatttgtatcagttggttaaagataattagatatttattataaaaaaaaaaaaaaaaagggcggccgctctagagtatccctcgaggggcccaggctacgcgtaaccagctttcttgtacaaagtggccctatagtgaggtcgattataagctagggactggccgtcgtttacaacgtcggaatgggaaaactgctaacttgggatctttgggaagaacccttacttctggggggggaaatattggggcaacctccctaccggaattaaagcccctagggaaatataaaattttaaagggtttaaggggttaaacaaacctgactttgcctgcgggtggaaaatttggctcacgcgttatattttggaaaaatttttaccgggggcctga

SEQ ID NO: 9931 - DNA, 1127 bp, Triticum aestivum
  misc_feature (669)..(669): n is a, c, g, or t
  misc_feature (679)..(679): n is a, c, g, or t
  misc_feature (682)..(682): n is a, c, g, or t
  misc_feature (697)..(697): n is a, c, g, or t
  Predicted polypeptide sequence is orthologous to G2130
cccacgcgtccgccacaaccgcacgccaccaacacccccgccgcacccgccccacccaccgacggaccaaaccctaaccctagcccttccccggcggctgcggctgcggcggaggcggaggcggaggcggaggcggcggaggcgcagccgaggggccgcgtggtgcggatcatcgtgcacgacgccgacgccaccgactcctcctccagcgaggacgagtcggcgccgccgccgctggccccgatgccgacgaccaaggaggagcgccggagggagcgcaggaagcgccgccgcgtcatggaggccgggaggagggacgactcggggccgccgcagccgcaggcaaccggggcgcgcacgccctcggtgcggtaccgcggcgtgcgccagcgccgctggggcaagttcgcctcggagatccgcgacccgatccagggccgccgcctctggctcggcaccttcgacaccgccgaggaggccgcagcagcctacgacgccgccaagatccgcatcagcgggagccgccgcccggctgacggcgccaccggcttccctttctccttcccgccgccagagcctgccaagccgaccgtcttgcgtcttcccatgccgcagcctgccaagccgaccatcctgcgtcttcccatgccacagcctgccaagcagatnacctcgccgncgnctcctcctcctccgnctgagcctgccaagccgggcatctcgccgactcctctgccagctaaaccgttcgccctcccgttgaagctgaggctgacgctttcctttcatgcacagggtaaggacaaagggtggaaccggtgctcctccaggcaatgttcaggaagaggggggacggggattgttaatgccaaggccaaaggtggggttttttaccattgccaggcacagtcaacggtggagggttgggggcttccccagggaaggtccaggtataaagggcggggctcgtcaaaatggttaaagaaggcccctcacctttctccgaatccaagaggggccactcccattggcggaaattccccccgcgaaaacaaaaaccgcgcgggcgtgcgcccccgtttgtggcccccccgccgcgcctttcgggtgaggatagcaatcggtga

SEQ ID NO: 9932 - DNA, 951 bp, Triticum aestivum
  misc_feature (603)..(603): n is a, c, g, or t
  misc_feature (690)..(691): n is a, c, g, or t
  misc_feature (704)..(704): n is a, c, g, or t
  misc_feature (711)..(711): n is a, c, g, or t
  misc_feature (715)..(715): n is a, c, g, or t
  misc_feature (724)..(724): n is a, c, g, or t
  misc_feature (727)..(727): n is a, c, g, or t
  misc_feature (747)..(747): n is a, c, g, or t
  misc_feature (750)..(750): n is a, c, g, or t
  misc_feature (759)..(759): n is a, c, g, or t
  misc_feature (764)..(764): n is a, c, g, or t
  misc_feature (769)..(770): n is a, c, g, or t
  misc_feature (775)..(775): n is a, c, g, or t
  misc_feature (780)..(780): n is a, c, g, or t
  misc_feature (789)..(789): n is a, c, g, or t
  misc_feature (796)..(796): n is a, c, g, or t
  misc_feature (800)..(800): n is a, c, g, or t
  misc_feature (808)..(808): n is a, c, g, or t
  misc_feature (823)..(823): n is a, c, g, or t
  misc_feature (856)..(856): n is a, c, g, or t
  misc_feature (868)..(868): n is a, c, g, or t
  misc_feature (875)..(875): n is a, c, g, or t
  misc_feature (881)..(881): n is a, c, g, or t
  misc_feature (883)..(883): n is a, c, g, or t
  misc_feature (886)..(886): n is a, c, g, or t
  misc_feature (891)..(892): n is a, c, g, or t
  misc_feature (895)..(895): n is a, c, g, or t
  misc_feature (910)..(910): n is a, c, g, or t
  misc_feature (912)..(912): n is a, c, g, or t
  misc_feature (917)..(917): n is a, c, g, or t
  misc_feature (921)..(921): n is a, c, g, or t
  misc_feature (923)..(928): n is a, c, g, or t
  misc_feature (935)..(935): n is a, c, g, or t
  misc_feature (939)..(942): n is a, c, g, or t
  misc_feature (944)..(944): n is a, c, g, or t
  misc_feature (949)..(949): n is a, c, g, or t
  Predicted polypeptide sequence is orthologous to G2140, G2765
gcgtatgtagggcggtcatctcccgcagacaagctcatcatctgcctcctaccgtcctatatccatcatatatatgaagagaatgaggtgacaagacgccgccgcactaattattgtgagcctcctatccatctcactcccacttctccttccttctggttcatcaccagaaattcacattcgtccttgttcttgcactgtcctagagctggatggcagctccatgccaatccccgcaaggagggaatgagctgatggcatacgatgcatgttatcctacggtgagcggaggcccggctctgctgccccggcaggccagctcggcgccaccggctgggccgccggagctgtcgacgacgtcctcgtcgacgacggggtcgggaaggaccgcgacggaggcaagggccctgaaggtccacagcgaggccgagcgccggcgtcgggtgaggatcaacgctcatctcacggcgctcaggaggatgatccctgataccaagcagatggacaaggccgccttgctagccaggtggtggaccaagtgaagcacctgaagaggagagcaggcgaggccgcacagcaaacgccggctgtcccaccggagancgacgaggtctccattgaattctgcgccggagacaatgactccagactgtcatgaagctcggtcattgggaaaacgccggactcctnncggcaacaagggntccaagncccnagcgaggancgngacacggggaactcccgagntgngtttggacnctcgncgcgnnagagngatgntagagcacnaacgcancggntaacaccnccgaggagtgagagncgcagatactgcacggcgggttcccccgtctgnagtattcttctntccttgnattgtngngcnttgcnnacngaccacccacacacnanacaanacanannnnnnacacaancaannnncnaaaanaa

SEQ ID NO: 9933 - DNA, 539 bp, Triticum aestivum
  Predicted polypeptide sequence is orthologous to G2141
ccctggtgccaagctgcaacaagatcaccggcaaggcactcatgctcgacgagatcatcaactacgtccagtcgctgcagcgtcaggtcgagtttctgtccatgaaattgtcgaccatgaatcctcagttggagctcgacgagcagcacatcccgtccaaagagatgaaccagatggcagtgcccggcttctcctacgccggttcacccgtcgccgtcgcgaccggccacggccacggggcagagctagaaggcaccttcagctgggagcatgacctccagagcatggtgcagatggggggagccagcagcagccataggcaggacccccaagctttctacggcgagtgaaatactaccaatcacctttccttggttgcttcatgtcctgaaaacggccggttctcgattctgtgctgaggttgccctgtctggcccgttccatgtcattgaatgcaggcagtggccagccggcgactacagtaaatacatgaaggttgaaccaaaaaaaaaaaaaaaaaaaaaaaaaaaaaaaaaact

SEQ ID NO: 9934 - DNA, 745 bp, Triticum aestivum
  misc_feature (26)..(26): n is a, c, g, or t
  misc_feature (711)..(711): n is a, c, g, or t
  Predicted polypeptide sequence is orthologous to G2141
gtggggctgctcggccccctttttcngttccagccccgaatacaacaagaacacgcccgatccatccatggatcgatttacacacggccacgcacgcacggcgcagttaaaggctccagctgtgcactgcacgcacgcacgcacgggcggcagcagcttcagtggtcatattgctcgtgcatgtggcctctgctctgctgcccgtcccgttggcggtcagatgattgatggctaggcctaggccagctagctggacaaacaaactcgggccgggtggctcttcaggaggctggctggcgatggcatcaatcacatttggtaggcgtcctgggacggcctgatgctgaggtcctgcgagtgcgagtgcgaggagcccatggacgggtacgccatctgcgcaacgtgatcgctgaacgggccattcaatgcgtgggccatctgtgaatgggatccatcttttgctcctagttgcgcttgcatgattcttctgaacacgtccgagttcgccatggcggcggcgcctccctgcatcagccccggctgcgacagctgcagctgcgggtgcatcatctccggggagaatcccatcgacgaggaggacaccccagggaagcgaagaagatcctttgagagaagcccttctatgttgaggtcaagcctcgggtttactgtcgccagcttcatcgataagaactcgacttgtctttgcanggactgaacatagttgatgatctcgtcgagcatc

SEQ ID NO: 9935 - DNA, 998 bp, Triticum aestivum
  Predicted polypeptide sequence is orthologous to G2141
gggcggatgcgacgacccacgcgtccgaaaacgatattgagacgtctagggagatgaatgtggaccaaggttgaaatggtgcattattgagcggtgataggcagcaaggagacaccgagagttcacatggtgttgatgcctctagcaaggagttaagcaagccggagtgcagtggtggcgctggtcaggatgaagggcctagtgtctcttgtcccaagaagaggaaaagaccaagccaggatcgtggggtgaagcatgtacaagaagggagccagcaattggcaactctggctgcgaagcgggagaaagatgacgacgacaaagatgaaccaaagaggcctgttgggacatccagaaagtccaacgggaagcaaactgaggataaatctgatgcgccaaaggaagattacattcatataagagctcgaagtggccaggctacaaacagccatagtcttgcagaaagggttcggagggaaaagattagtgaaaggatgaaatttcttcaggaccttgttcctggttgtagtaaagtcattggtaaggccgttatgctggatgagataatcaattatgttcaatcattacagcggcaagttgagtttttgtcgatgaaactttcagctgtcaatccagcactagacttcaacatagagcgcattctatctaaggatttatttcagtctcaaggaactgcatcgtctacctttggcttcttaccagacattggccatcaatttttgcatccaccaaaacattctcaagctgcgttgcacagcattgtaaatcccgccgatgcatttggaagggtaacaaatgctccggtaggatgtacattcaaagaaggcacacatcaggtgcccaataaatttgatggagagttccacaacgtgattgggatgcctttaccctgttttatgaccatgattcaaatgataaacctgagcaatagatccgcaaccgaagcaagaatcataacgggccagagattcaacgaa

SEQ ID NO: 9936 - DNA, 836 bp, Triticum aestivum
  Predicted polypeptide sequence is orthologous to G2141
agcttgacattaggcctatttaggtgacactatagaacaagtttgtacaaaaaagcaggctggtaccggtccggaattcccgggatatcgtcgacccacgcgtccgcgggaggaagcagggcaaggacggcgcctccaagctcccggagccgcccaaggacttcatccacggccgggcccggcgcggcgaggccacggacagccatagcctggccgagagggtgagaagagagaagatcagccagcggatgaagctgctgcaggacctcgtgcccggctgcaacaaggtggtgggcaaggccgtcatgctcgacgagatcataaactacgtgcagtcgctgcagcggcaagtcgagtttctgtccatgaagctggccacggtgaacccgcagctggacttcaacaacctgcccagcctcctcgccaaagatatgcagcagcagtcatgtgggcagctgcagcagggctcgtcgcatttcccgctggatgcgtcgggcgcgccgctcccctacatgggccaggggagcggcgaccctctcggctgcggcatgtccgacggcggcggcatgggcgacgatcagggcgccatgcaccccggtggaccaggccttctgccggcccatggggttcctcgcagcagcagcagcacttcctcagcgacgccgcctctcaggttgggggctttctgggcagatctgcagagcgtggttcagatggacatggggcagaaccaggagatcgccacttcttccaacagctacaaacggtcgttgcaaacggccaacatgaaatggagctttgactcaccggcggggagaaactccatccgaccggaa

SEQ ID NO: 9937 - DNA, 535 bp, Triticum aestivum
  Predicted polypeptide sequence is orthologous to G2142
tttttttttttttttttttttttaattcaaaatacttaaactatatttggtcctgattcacgaaaaaatatacacattttacatgacaaaagtcaaataaataagctcattttacacactccaatcacagacctaatattacacatcaattttcagttattctgatctagaaggatggttccaaattgatcaaagaagcaaataaaagaaaaggccattgttggaacaaacaaaaggtgagattttgtatcagggcctcacccaaccacatttctgtccgttctcttggaaaaactgtatatatgcaataacctgcaatagaaaattgtgtcaagaatgaccaactgaataaaatgggttgcatcatataatcaataaccttctaggtgtgtgccttgtttcttttatgaaaatcagcaccaaattatttatgtgtgcatctctagttagaaccaaccaaaactaataaaatctctgaggtgaaaaacacataaaaattaatggactaaaaatatagcaggattgagcaccacat

SEQ ID NO: 9938 - DNA, 1099 bp, Triticum aestivum
  Predicted polypeptide sequence is orthologous to G2142
tacgacgacccacgcgtccggtcgtccaccttgcagggcaccaccaccagtggacgctcccctacgccggcgccgggcaggcggccaccgcgtccaggaagcacccggcggagcggaagcggcgcggcggcggcgggttcatggactctggctccagatccagcggcggcgccggcttcgacgacgacgacggcctcgccgcgcgccgcgaggtctcctcctcgctgcaagagttagctgtgagggtggatgcgaagggcgggagctgcagtggcagcggcacggatcagctgccaaacacaccaaagtcaaagcattctgcaactgagcagcgccgccgtagcaagatcaatgacaggtttcagatacttagggaccttttaccacacactgatcaaaagagagacaaggcaacatttctcttagaggttattgaatatatacgatttttgcaagagaaagcacagaagtacgaggcttcatttccagaatggaaccaagaaaatgcaaagttgctcccatggtcaaacatgtattttcgatcatcttggaaaaatgcacagagtaaagggcaaatcgcagaagatgcctcacctgacccttcacaattcatcagaaatggggcctcccctggattcaatatcacaggcaagcttgatgataaccacaccgcggtagcatctgcagctatctcaggggcaccggatcaggcagaaaccgaacacatggctagtgtgtcctgtagatcggcagacactccaacaaatattatgaataatgtttcgccccagtctcaacccacatgggcagatccatctggtgtggatgattgcgcggtgaacagtggcgtgtttaataaatcacaattgatgattgatgagggaacaatcagcgtgtcaagccattactcccagagctacttaatacgtgactcatgccttcaaagctcgggtattgatttgtcccaagcaacattatcgtccagatcaacctgggcaagcgggctgtcaaaagactacggctgaacaatcctcagtttcaggaaccaaccggcctaggccgaagaaacaattgatgggccacaccaggggaatttgga

SEQ ID NO: 9939 - DNA, 588 bp, Triticum aestivum
  Predicted polypeptide sequence is orthologous to G2143
gccatttcccaccttttttgccccatgggtgcagcaaaaccactagttaattacttctaccctctcccttttttttgcatggtttgatcaaaaccactccatgttcctgggagagagtagagtgagaaaaaatgagacaagtctttttctagggctagttaccaaggggagtttgaattttacaaaaacccatttttcatttctcccctacaccaatattgcccttttcaccctgttttttttcgacgagaggccggaccgagttttttcaaacccaaacacctacctttgccggcctctcaaatcctaccatactgttcccagaaggcttcaaatatctgtggacaaaaatggcatcttttttttcagcaccgaggggggacttttgcaagcctttgattcagaagtgcagtagtagggtgtgcctgtttttcagggccagtgcaagctggttggttggcccagcagcttggatgaaccctttgcttttagtttctttatggtttttgttgtaacaggatcaagattgtagctcgatctgtactctcttgtttgcttgcatacaagtataaagaataaataaatatg

SEQ ID NO: 9940 - DNA, 835 bp, Triticum aestivum
  misc_feature (765)..(765): n is a, c, g, or t
  misc_feature (789)..(789): n is a, c, g, or t
  Predicted polypeptide sequence is orthologous to G2145
tgtacacgacgttagttgcctagcttatcatacgacttactatagggaccactttgtacaagaaagctgggtacgcgtaagcttgggcccctcgagggatactctagagcggccggccttttttttttttttttttgccaagaaaagtatgaagtaaaacaaagtgtagttacattatacatgtataatgattggaactatatataaggaccagaatcaattaatccctatgcagttcagtgttagctagcgccacatctccagagtggtatttatttttgcagagcagcgatgtgcatctcaagactgctgacgttaatcccattgtaagcgaggggtgcgtacatccacatgtcgtcggagctcaacaacttaatctgaagctgcataaacttaacatactccactgcttcctctagcattgtactgatgtcaacctttgttccattgggaaccaagttctgcagggttttcaatctttcattgatcctctctctccttttccttgcatagaggctctgaggatcagttgctgctccacggctggtctgtgctgtttgatcatgttgctcacctctccacttggtgttgccatccaaatccccatcttctgaggtgcagctgctggagctttgaggatcgatgacataggtgtcgtcgccttcgatgtccttgctggtttgcaatcttttgccagcctttttggccttccttgatgcgtgtgcagtctgactctctgtatccagtttatctcgtgtctcacgngtgtgccatgtgtaagatcatctncggcgcagtagtttcgcatgatgatcgaatggagtctacggatcat

SEQ ID NO: 9941 - DNA, 427 bp, Triticum aestivum
  misc_feature (266)..(266): n is a, c, g, or t
  Predicted polypeptide sequence is orthologous to G2147
ttttttttttttttttttcgaaagagaaacaacagtttgatttcggtgtgatttgtgaaaaaatccagtgttctcaacatggcctggatttgaccgatccttacaggttgcaagacgccatggactgatcgagaatggaagccttatgagttctaatggcctagagctacatgctaatcagtagtggttccttcttggttgttcagtagaaccagttgggtccaacgtgcttctgcggctgcggctgctgcatggcgccggcgtantccgccgctgacaggtcgaaccctgggccgaacctgcccagctccggcgccgccatgccgaacggcgcgtcgtcgcccatgaaaaacgccgcgctctgctgctgctgctgctgctgctgctgcatcacgttgttcgcgccagcaagcgagcgtggcgccag

SEQ ID NO: 9942 - DNA, 669 bp, Triticum aestivum
  Predicted polypeptide sequence is orthologous to G2147
tgtcgtcgtacgctattcccatgccaatgtccatgggaggagaggagcaacatggcttccttgaatccggtacattgcctcctttcatgggctatggtgcatcatcatcgctggtgcccccatcgtccctacctgcatcttcttcgtaccagctgcatgacactggggccagatcgtcaatgatgggtactgcggtgctcctgatgatgaacgaccgctacttcgggaaccaccactaccagaatatggctaccccaccacgaccgttggtgtcgttctaccaccatgaccaccaacagcagcagcaacaacaacaacacatgattcaaatgccgatgcagatgcagataggtgcagatgagggcctcatgatcggggtcgagcctgggagcgggccatcatccatagtgtcgcaggaggatactttggccaggttgagcagcaacgacgttgcaacaactgctgaagagatctcatcagtgaacatgggtacggatggcatgtggaagtactgataatcagatgatccaagtactaatatatatactatcagaagatcgatcagtatataccgccacacacacacacacacacacacacagatctatatatatatctatatatatatatatatctcggtctgcactcattcactatagtgtgtgagac

SEQ ID NO: 9943 - DNA, 380 bp, Triticum aestivum
  Predicted polypeptide sequence is orthologous to G2157
tttttttttttttttttttaaatgcactttgccatattttctaaggtatggaaattatttcgctcagacagccataactgaacatatcaacccaaataaccatcacccactcttaaacctcacttttataataaaatccactaactcgtgttcaaattgaaccagtaatcgacgccgccttggcaggccatcaacaaaggacaagggcggaaatgaccttcctatcttagtgctagtaccacctgcttatatactggacccacccttcatgccgggctctaccacaatggcggcacataaaatatatcagaataatgtaccaccatttatgttcttcaagcatggcggtgtgagcttttcagtggagccagacacggtga

SEQ ID NO: 9944 - DNA, 759 bp, Triticum aestivum
  Predicted polypeptide sequence is orthologous to G2192
ttttttttttttttttttgaatagaaagaagaacttccaaaactgttcaatttctggaaaacaaatgccatattacaacaacttcggttttttactgtacccccaggacttccagcaccacgtgctaaatatgtacatcatcgacaacacgcgcatcttgcagcgttacacatattcgtacaagaaaaaattggtgcttcagtcgaacacagtaaagctgctaatgctatctagcaacacaactagcttaacaacaagtaaaaactgacctcctggaacaacttgtacatacccattgaaaaaggaaaaaaaaagttaaaaacgttgatctgggtgtcaaccggagcttccacaagaactaccaatgtgggccgcaacgtcgctaaccaacagcctgatgacatgggtaccagaatgccgggagatttctatgcattcttccaagtccgcattgcacgccaacttcacccactcgtgatcatcgtcaaggtacttgatatcaaacatgccagcatccatcctcagccttttggcaacctcatctttcaaagccataacgctgctagaacacgggaaacggaaccttacaatgtcttccttaaagctcgcctttatcgtcacagtccccgaatttcgcattggcccaaaattgctgggaggggctaacattggttggccaattgctgaaccaaagagattcttcagatccttggaactaccagaatcctctatgagcatcctggaaagtggtagctctgg

SEQ ID NO: 9945 - DNA, 1203 bp, Triticum aestivum
  misc_feature (21)..(21): n is a, c, g, or t
  misc_feature (29)..(29): n is a, c, g, or t
  misc_feature (31)..(31): n is a, c, g, or t
  Predicted polypeptide sequence is orthologous to G2192
tgccggttcaaaatgcttgtntggagttntnattaggtctgatcaatcagtgtctccgtaatctaaaggtagctggtaatggagaatccaacgaagcttctcttcaacttagtaatgtcataatgattgaaagtgaagatttcaagacaaatgtgcattttgagaactctgaaggttttcgtgaatcacccgaaggtgatacacatggaggagcccacgagttcgataaagcgaatagtaaagtatcagagggacatttgttggctgatgataactctcagaacaatggcgtatctgtctccaggccaaatggtagcgcggcttctgattcttcattgcttcacaaaaatggcaaaccccctgaaaggagacgggggaaagctgaaacaacaatcagcttagaggttcttcagcaatatttttctggaagtctgaaaaatgcagcaaaaagcctcggtgtgtgccccacaaccatgaagcgcatctgcaggcaacatgggatttctcgttggccatcccgaaaaattaacaaggtcaaccggtctctctcgaagttaaagcaagtaattgagtctgttcaaggctcagacgcggcatttaacctgacatctatcacaggccctctccctactattcctgttggtccttcatcagattctttcaataaagagaaagcaagtgaaagtaaagcagaacattcaaatcgtgctgttgatggtgacagagattcatctttacagaagtcacaagaaaatggtagccactttggtggactcatgtcccagcaaggatttgcagacactgggaacaatgttcaacttggagcagacaaagcttctctctcgagaagctcatcgggagaaggcagcataaattcacgtacttcggagggctcatgtcagggaagtcccgcaaaccgaacgtttgtttggccagctattgcttcaatgtcttggaacccctaaaccacaatgaatccggaagggtcacaaaagaactttccaaaacccgagcttaccttcccagatgcccataaaggatttggttattccagggattgtaaaaatttttggttccagcatgggcacacaagttagccccccccacaattggggccagtgaaattcggggggggaacattaagggcacttagagaaaattggggggtcctcccccgttttcaccgcgttggttttaaaataa

SEQ ID NO: 9946 - DNA, 811 bp, Triticum aestivum
  misc_feature (29)..(29): n is a, c, g, or t
  misc_feature (649)..(649): n is a, c, g, or t
  misc_feature (661)..(661): n is a, c, g, or t
  Predicted polypeptide sequence is orthologous to G2226
ccccgcggtattagatataggcctacctnaggtgatagattgaacaagtttgtacaaaaaagcaggctggtaccggtccggaattcccgggatatcgtcgacccacgcgtccgccaccacaccgcagccgctcagaccgccccgcccccgaaagaaggcgcaaattgcagacgggtccacggatcgatccccaatcccaatcttcccggccgccgcgatgggcatctccagcatgccggcgcccaaggagagcctcctgatctacctgctctaccacgccgtcgtctcgatcgccgccctggcgggcctcctccgcgccgcgctcgtcttcctcggcctccccgcgccgccctcgctgctggccggcgaggacgccgacggcgccgaccagctcacggcggccaccccggcgggccccagcctggcggagcggttcaggagcaggttccgccccgcgcggttcggccggagaaggggcgcggcggcgtcggcgacacccgactgccgcgtctgcctggtgcggttcgaggccgacgccgtggtgaaccggctcccctgtgggctgctcttccaccgcgcctgcctcgaaatctggctggactacgaccacggcaactggccggtctgttcgtcttggcttctcccgggncggcgcctccgncggcgacgaatcgtggtctgcgccgggggccaccctgaacggcctggattttgagaagacgagcgaagagaccaggaagagagagattccgcccgtccgcgtccccccgggctatgtgttagctcccgggtgtgggcgtctccgggttga

SEQ ID NO: 9947 - DNA, 479 bp, Triticum aestivum
  misc_feature (361)..(361): n is a, c, g, or t
  misc_feature (389)..(389): n is a, c, g, or t
  misc_feature (396)..(396): n is a, c, g, or t
  misc_feature (407)..(407): n is a, c, g, or t
  misc_feature (441)..(441): n is a, c, g, or t
  misc_feature (445)..(445): n is a, c, g, or t
  misc_feature (469)..(469): n is a, c, g, or t
  misc_feature (479)..(479): n is a, c, g, or t
  Predicted polypeptide sequence is orthologous to G2227
tttttttttttttttagggtatgtggataaccagacattcactgaaactttgttcaggcacaccggaacacattatcatcaaagccaagccatacaatgagttgaacacagtgcaaggtacacattatgtttctgggaccagattattagacatgttatttcactcaatcagacaaacggtgtgtgttgactacatgccgtggcgaaaactgggcacttggtgcggacactacaaactcattagtttcaggagatctcaggacagagatcacgaattaggtatacgcatggggtttgtctgacttcctgataagtggggacaccatccgtctccgccacacaattccgtttctcacacaangcaacaactgcctcaacgtaaacttggngtcctcntgaagaccttngcaaccaatgctccggatacattggtaacacggnacancctttgggcaagtttcctgggtcnacggtcaccn

SEQ ID NO: 9948 - DNA, 1100 bp, Triticum aestivum
  misc_feature (23)..(23): n is a, c, g, or t
  misc_feature (32)..(32): n is a, c, g, or t
  Predicted polypeptide sequence is orthologous to G2227
ttatgcttccaacgcgttgggangtctccctnatggtcgacctgcaggcggccgcactagtgattagcgtggtcgcggccgaggtcatgtagatgttcatactgaagtacttcaccggatttcttactattcaatagtttaaaatacacattagtgaagcaccattccacttgctgttgtccgatctacaattagatggcagtgataagcaattgatagtatgaatctgctgtttgaattgcatagtagaagattcaaatcacagtacaatcatgtcagtggtggtggtgggttgatttacctttgagcatgtcatgcatcacaacaatttagttggttacatagtggaagatgtagaactactaccactaccatttgcataacaagtagtgcctgttgtggccatgagatcagccctttttagcaattgcgacaccagaatggcccatcatgtggtgtccttgtcactggttcggttcgtttgttagggtgaaagctatttactaacatttttttgcattttgtttagagaattcaatctgttacccgcatcttaactgtaacagtgtagaattgatcttgttactactatttgttttcatgagatatgaagtactaaaaaaatgctgttgttatttcctgctgaataaataagctgcatcccttcccatttgaaaaataggagactaacacagggctaacaagtcaatgacaaatctacttctcttatcttggtgaccttccccccccaaaaaaagttctgggtggacctaaacaaagtttaggaaacatcacacatgccatctggttctgattaggtaatagtactcataggcaagataagtggtacgatttgttgtttgtttttgcttggtccctccgtggtcaccataacttgggcagctacccctgccaggtggtggctgtcggggggtgacaaaactatttgtgggaaaaccttttgcatgatttagtcttgtagctgtatctagaatttagattgtaaggcgtgcagtcgatatgtgtttaatgcccaatactgacttgacaaaaaaattttcttttgaatggtattggaatccagttggaggatgaaacca

SEQ ID NO: 9949 - DNA, 1079 bp, Triticum aestivum
  misc_feature (18)..(18): n is a, c, g, or t
  misc_feature (705)..(705): n is a, c, g, or t
  misc_feature (733)..(733): n is a, c, g, or t
  Predicted polypeptide sequence is orthologous to G2227
gtacgtcgacccacgcgnccggtttgtaagaattacactggcgctcctttctttaccttatccactgacagctcccaggactcgagcttccctgccgccccggctgtgacggcggcttcctggagcagatggacgcgccgccgccgcgccgggcgtcgcgccctccgcccccacggggtcaacgaggtcctgccccgccgcatccggcgtggcgcctcgggtgcccgcttggggttactgtacaacccagtcatcgtgctccggcgctccgccgcccctccctgcgacgaggcccccggcgccaccagcagcttcgagctcttctacgatgatggcgccggatccggcctctgcccgctgcccgagaccatgtttgacttcctcatggggtccggattcgagtggttcctcaagcagctcgcctggatcgaggccggcggcttcggcgccgtccgcccctgcgacaacccagcggactgcaaggccgccgtcgagcccatgcccaccgtcgtcgtcgccgcctgccctggccacatcggcgccgactcccactgcgtcgtctgcaaggagaccttcgagcagggcgactaggccagggagatgccctgcagcacatgtaccaccatgactgcatcctgccgtggctcgcgctgcgtaactcgtgtcccctgtgccggcacaagctgcccacagatgtggcacggnctgctccggtgtgtgacctcggtgccgncgacgaccagggcagcaacacaggggctaaggctggcagtgaggaggagacaatggttgggttgacgatttggcggctccctgggtggaggtttgctgttggcaggtgggccgacgagagggagctcccctccaggtgtttacactgaggtggattgggggttccaacaattggtggtgcaccgagggaagatttaagtggcattcgagagggaagcggttcgccccggaggggaagttaccaaattttgtgttttgaaaacattgttggcctggttttggaaaccccactccttgagggtcgaactgaacctccggtttcacccttgtaaaccaaactggggaaa

SEQ ID NO: 9950 - DNA, 831 bp, Triticum aestivum
  misc_feature (517)..(517): n is a, c, g, or t
  Predicted polypeptide sequence is orthologous to G2239
aagcttgaccttaggcctatttaggtgaactctagaacaagtttgtacaaaaaagcaggctggtaccggtccggaattcccgggatatcgtcgacccacgcgtccgaacatccgcagccagtcagctagctaggttcccagttaggcgcggcgagctagcgacgacgagccccggagcccgcccacatgtcccccggcgcgcgctcccgaaagatggaacacgcgctgctcgccgcactcctggcgtgcgcgctcgcgtcggccggtagcgcgcagccggcggagccgaggcaggggggctatgacaacgacttggccgaccaggagatgcgcgtcagcacgaccatggtcgcgctgctggccgccgtcgtcgccgtgttcttcttcatcctcgcctccatcatctacctccgccactgcaccggctactcgtacccccacgccccgcggccggacgactcccgcggctccggccccggcgccggcttctcgagcttcatcgccaggcggcagcagncggcgggcggcgacgcgcgggctcgccgccgaggtggtcgaggcgttccccaccatgcgctacgcggaggccaaggcgctgcgcgtgggggaggaaggcggccccccccctggattgggcggtgtgcctccgcgaattcgaggacgaggacagggctccggctgctgcccagtgcagcccccccttccacccggacgccatgggggaggggctcgcagccacgttccttggccgggttggccgcgtgaaccttcaacccttagaagggagggggggcagcagaggaacgaggcgaataaaccccccgggtggcg

SEQ ID NO: 9951 - DNA, 1106 bp, Triticum aestivum
  misc_feature (637)..(637): n is a, c, g, or t
  Predicted polypeptide sequence is orthologous to G2251
acccacgcttccgcgactggagcacgaggacactgacatggactgaagcgagtagaaagattttagcttagatcaagtacatatatcctctgttcctcccccgcaaacgatagacaggcctggccggcgcagcctgtgacgttcgagctcccgccgggcgtccacgcgtcgtctccggccatggggttccccctggtgtgctactgcgttgccatccccaagccggtcatcgccttctgcaagctcgtcgccgccgtcagggacgccttcctcctgctgctctccctcgtcggcctctgccgctccccgcgccgctccgtggacgacgccccgctgcccgaggaggtcaaggagcgcctcccggccgtcgagttctccttgctggcgcgtccggcaaagcaggggtgccacgacggggacgacgacgtcgccgccgcggcggccacgtgcatcgtgtgcctggagaggctgcgggcggcggacgaggtgcggcggctgggcaactgcgcgcacgccttccaccgcggctgcatcgacgggtggatcgacctcggccggaccacctgcccgctgtgccgctcccacctgctgccccgcgcgcggagggacggcccgctcgccagcctcctcacgcgcngttggtgacgaccaaccgcgccactcgttagctcggaagccacgtctttcgttgtcccagcgcggtggcggccgacacagagaatcgcgatctcgaccgggtgcacgtatatttaaaaatggtgggtttacattcgtctcaaaatcggggatttattttagtttagggcgccaatttggtatagcccatccactcaagaaggcacccaataagggccccaagccttagtttttttttccgtaaagaaggatttagttggtcccaaatatatccccgggccgggtttgggctaagtggatcctcgaaaatgttaaacagcccccaaaagccattttcgctggttcgaaattgtaacaatcccaacccggggggaactcccaacgtaaaaagtgggtattaacccaaaaccccttatggcttcaattaaaaaaaaaaccttggagggttgtgttaaaaaaaaaacaaaaag

SEQ ID NO: 9952 - DNA, 642 bp, Triticum aestivum
  misc_feature (376)..(376): n is a, c, g, or t
  misc_feature (396)..(396): n is a, c, g, or t
  misc_feature (401)..(401): n is a, c, g, or t
  misc_feature (408)..(408): n is a, c, g, or t
  misc_feature (444)..(446): n is a, c, g, or t
  misc_feature (473)..(473): n is a, c, g, or t
  misc_feature (479)..(479): n is a, c, g, or t
  misc_feature (484)..(484): n is a, c, g, or t
  misc_feature (489)..(489): n is a, c, g, or t
  misc_feature (503)..(503): n is a, c, g, or t
  misc_feature (506)..(506): n is a, c, g, or t
  misc_feature (520)..(520): n is a, c, g, or t
  misc_feature (523)..(523): n is a, c, g, or t
  misc_feature (534)..(534): n is a, c, g, or t
  misc_feature (543)..(543): n is a, c, g, or t
  misc_feature (545)..(545): n is a, c, g, or t
  misc_feature (562)..(562): n is a, c, g, or t
  misc_feature (569)..(569): n is a, c, g, or t
  misc_feature (571)..(571): n is a, c, g, or t
  misc_feature (581)..(581): n is a, c, g, or t
  misc_feature (586)..(586): n is a, c, g, or t
  misc_feature (605)..(606): n is a, c, g, or t
  misc_feature (613)..(613): n is a, c, g, or t
  misc_feature (632)..(632): n is a, c, g, or t
  Predicted polypeptide sequence is orthologous to G2269
gattaaaacattggtcagactgtatactgatcatggatgttgattaagaaagttgcaaattttgtgcatgcaacttccacactgcttaagtgtattgttattcttctaggcaaaagctgacgaaatctgatcaaacttgtcataatcaaccaatacctactttgatctagtccctctactcttcataagtacaaggcttgctatgtactaaatcaacacattcaatatctcctttgatctagtcgctctactcataggaataagaacttaatatgtactgaattaacacactttccgcaaaaagaacaacttcttgtggctgggttgcctacagaagttaaaaattctccttggtggaactcgatttcgtgttggncttcctccaaaaatcttgcncaagncaccacnctttggttacacggtgcaccgcagtagaaacccgannncgtcacggggtttaggcaaaccttgtnaacttncccantttgncgggaaatggcctnaancggtccggaaaatncanccttcttggangttaggacngncagggatacccgacggntccgtcngnaaacatgatntaggnccagaacctctgcgacaanncctcagnccggacaccaagggggcgnccatttccaa

SEQ ID NO: 9953 - DNA, 665 bp, Triticum aestivum
  Predicted polypeptide sequence is orthologous to G2311
gcgaggaagcaagcgactgcacccaaaccctagccgacgcctcctcctcctggtgccatggcgctgcgctctccctccagcacttcgcggcggaatctgggaccccgttattcgccgccggcggactctctgcctcccacctctcaggctggatccggcaatggagctagagctggtgttgctatgaaggtgaaggaggctgaacatatgttggcaaatttagaagaagagggagtggagatagatggcaacatagctagtattattaatgatgagatagctagaattaaagctgaagctgagagggagaagattatcaatgtgctgacaaggaacgggcggatggtactgctcactattgcatctgctgctgctggtttcttcctgggaggggaatgttacgaacgggccctctatgcgcaactggccatgatttttggtgaaccatagcgtagggcttgcaggtccactctgcttatggtatgtaaaaccaagcaggtagtcttggtaaaacattgttacctaactatggtatggaaaacctgtttatgttgtctaataattgttgtgctatatactggggattttggcaggtaatgatgtaactcttactgttttttttgtttgcgggaaaactttcaatctattcatcttcaaaaaaaaaa

SEQ ID NO: 9954 - DNA, 1103 bp, Triticum aestivum
  misc_feature (767)..(767): n is a, c, g, or t
  Predicted polypeptide sequence is orthologous to G2311
tgcgacccacgcttccgaaaaagcccacaggatgacaagactccgagtccaaagtacagttccatgatcctggaagctctcgacgaactgaaagagccaaatggttcagaagttgctacaatttgcaatttcatagagcaaaggcatgaggtgcaaccaaattttagaaggttgctttgtgccaaattacgaaggcttataggcgtgaacaaagttgagaagattgataagtcctataagctgacggattcatatgcaaaaagggctctggctccaatgaaagatccatctctaaagaagaaggattcagccaagtcatccaaggcagcaaagggtctaggccagttgagtcctgcactggacgcagctgaagctgcagcgatgaaagtagccgacgcggaggccaaatcgcacctcgcaaacgagcacatgatggaggttgaaaggatcggcaagatggctgaggagaccgagtctctcctcgagctcgcctcagagctctacgagcgatgttcaagaggagaggcgctcacaatactgcaagtggcgcacagggagttttgatggtgttgtcgaccccgtcagctgcgcgccgacatctgctctcttgtacatggatggatggaagcgtaggcccagcctgttgtcttcttgcccgcgtgttgtctctgtgttgtagcataactcgaatcaattcgttggttgtacctgagagggcattcctttcattgcctaggaatgattttaagttggtgcattttggatancaaaaaaaaaaaaaaaaaaaagggcggccgctctagagtatccctcgaggggcccaagcttacgcgtaccccagcttcttgtacaaagtggtccctatagtgagtcgtattataagctaggcactggccggccgttttacaccgtcgtgactgggaaaactgctaccttgggatctttgtgaagggaaccttactctgtgggggtgacataattggcaaactacctacccagattaaaggccctaagggaagtataaattttaaggtgtttatgtggttaaactacccccttttctttctggtttgaaattttggttaccgggtataaatattaaa

SEQ ID NO: 9955 - DNA, 842 bp, Triticum aestivum
  Predicted polypeptide sequence is orthologous to G2319
acgcatgaccttaggcctatttaggtgacactaccaaaccaggtgttgtacaaaaaagcaggtagcaaccagtccggaattcccgggatatcgtcgacccacgcgtccgaccgacagatttacccgctgcaaataatagctctagtagcatagagtgccaatctggaacttgggcaacttctgatgcgattgagcaagaaacttggccaacttccgatgcgattgagcaagagattatacttccagcactgcatgccatgccagactttgctcaagtatacaactttcttgggggcgtatttgatccagatacaacaggacatttgcagaagttgagagagatggatcctatagatgctgaaacggtactacaactgatgaaaaatctatcggtaaacctgtctggcccggactttgagacacacctgagcatacagcatccctgactgttgcagaggaggatgctctcgtcgcacggtggcggcatgtgctaagccaagcacaagatcgtaggagatccggggtctactcagacccttcgcattccattcatgtaatctctagtcaccctcttcctgagcacggatccatgcttgcggcattgctaatttagctaagcgcatggaccgctctgcagggtaaggagcaaatgaggggagaggacagtacattgttgtcagaggtgcgacatgttgcagtatcgcttgttgtcagaggggcacatgtttctgcatcaccacttgcctatgtttgtacatagttcttggaaatcttttcggggcttttagatggtgggaacttttatccatccggtggatgaaggctttgtgggcatgaataag

SEQ ID NO: 9956 - DNA, 855 bp, Triticum aestivum
  misc_feature (228)..(228): n is a, c, g, or t
  misc_feature (546)..(546): n is a, c, g, or t
  misc_feature (614)..(614): n is a, c, g, or t
  misc_feature (696)..(696): n is a, c, g, or t
  misc_feature (702)..(702): n is a, c, g, or t
  misc_feature (729)..(729): n is a, c, g, or t
  misc_feature (768)..(768): n is a, c, g, or t
  misc_feature (776)..(776): n is a, c, g, or t
  misc_feature (842)..(842): n is a, c, g, or t
  Predicted polypeptide sequence is orthologous to G2319
acgcttgaccttaggcctatttaggtgacactatcgaacaagtttgtacaaaaaagcaggctggtaccggtccggaattcccgggatatcgtcgacccacgcgtccgaagccatacaccatcaccaagtcgcgggagagctggaccgacccggagcacgacaagttcatcgaggcgctcctcctgttcgatcgcgattggagaaagattgaggcgtttgttggctccnagacggtgatacagatcaggagccacgcacagaagtactttctgaaggttcaaaagaatggaacaggtgagcatctgccgccacctaggccgaagaggaaggcggcacacccgtacccacataacaaagcctcgaaaaaggcccctgaagttgacttaccacaacagcctcctcatgtcgtggagcaaggatgtgttatacctatggatgcacctactgtcgctacaaactcaagtgcagacgacacgtttccttcctgggatgatgttcttgcccagccttatagcccaagacatacacaagatttaggcgctgcanataatagctctagtagcatagagtgccaatctggaacttgggcaacttctgatgcgattgagcaaganatttggccaacttccgatgctattgagcaagagattatacttccagcactgcatgccatgccagactttgctcaagtatacnactttncttgggggcgtatttgatccagatacnacaggacatttgcagaagttgagagagatggatcctatngatgctgnaacggtactaccactgatgaaaaatctatcgggtaacctgtctggcccggactttgagaacatctnagcatacagcatc

SEQ ID NO: 9957 - DNA, 421 bp, Triticum aestivum
  Predicted polypeptide sequence is orthologous to G2343
tataagcagctaccaaatggttgagagggagtgtgcattgcagtgttgagatcagtcactggtcgatctgatctctaagctgaggtgtgtgcatggggcatcactcttgctgcaaccagcagaaggtgaaggggggcctgtggtctcctgaggatgattataagctcgtccggtacatcaccacccatggctatggctgctggagcgaggtccccgagaaagccgcggtgtgggaagagctgccggctgcggtggatcaactacctgaggcccgacatccggcgagggcggttctcgccggaggaggagaagctcatcatcagcctccacgccattgttggcaacaggtgggcccacattgccagccacttgcctggccggaccgaccacgagatcaagaactactggaactcgtggatca

SEQ ID NO: 9958 - DNA, 436 bp, Triticum aestivum
  Predicted polypeptide sequence is orthologous to G2346
ttttttttttttttttttttttgaaaatcaaaacaaattaatcgaccaagtcctgcgagtcagatttcatggctgaccatcacagagggccaatttctgggttgaacaagcgtacaaaatggaagaattcgttacaaagttgaccattacaagggcacaacccatttctgcatcacagccaccggaacgtaatcatagatacctgctcaacaagtacatcacagtagcatacctaaccagataatcatcttatgtgctgtgaaagatcaactccatcatgtccaccaccaatttctatttctgcagtgtagacactttcgaatggatgatagtgagaaagggttctggtctcaccaagtttcttgaactgcaaagactcaagattgaccataaagaggacaccgtgtgtccacacaaacaccacattattctcctc

SEQ ID NO: 9959 - DNA, 616 bp, Triticum aestivum
  Predicted polypeptide sequence is orthologous to G2371
accatcctgcctctcccctcctctcttctcttctctccactgcccaacttttgccatagacaagaacctctaggtagcttacctccagagcagcaatggccatgcaccctctctctcaggggcacccacaggcctggccatggggggtagccatgtacacgaacctacactaccaccaccagtacgagagggagcacctgttcgagaaacccttgacgcccagtgatgtgggcaagctcaacaggctggtgattcccaagcagcacgcggagaggtacttccccctgaacggcggcgactcccccggcgagaaggacctgctcctgtctttcgaggatgaggccggcaagccgtggcggttccggtactcgtactggacgagcagccagagctacgtgctcaccaagggctggagcaggtacgtcaaggagaagcagctcgacgccggagacatcgtgcacttcgagagggtgcgcggccttggcacaggcgaccggctcttcatcggctgcaggcgtcgtggcgagagcgcgccgccaccacctgtacgtgtacctccgcccgctctgaacgccggggagcaccagccttggagcccaatgtgttacagcacgtc

SEQ ID NO: 9960 - DNA, 656 bp, Triticum aestivum
  misc_feature (309)..(309): n is a, c, g, or t
  misc_feature (614)..(616): n is a, c, g, or t
  misc_feature (651)..(656): n is a, c, g, or t
  Predicted polypeptide sequence is orthologous to G2382
ccacgcgtccgcccacgcgtccgcttcgacaagatgctgtccgtcatgtgcccaccgacgccgacgccgacgccgccgccactactgccgccactaactcctctcgtgacgcggcgccgtgacacgcatccagtgccacgccgttcgtggggggtggacgtcggggagcttgtgctcgctggatgtagcaaagtggtaccagggaattcagtgccagatgcgcaattgaggggaaaacagacatatgaagctggcgcagtgcagggggaggaatttgcgattctcacagaggcaattcataggcttaangaggtttatgagagagtggagagtagcaggaggcagcacatggcggagttgaaacgtatgcggaaggatatgcaaagggaccttgaggtgaggcggagagagattttggaaaaggcacaaatggagatagcgagtcttgaggaggaggatgcaaaggagggtgctgttaacaatagattagaggatcacaatggtgttgaggagcagaacaatggcgctttggatgcttctccttagcccagcacgtacaagttcagcaaatgaggaacaaagctgggatatcatgtcaatagttggatccacannntgtttcagacacaaaatggggatttcatgtcaatnnnnnn

SEQ ID NO: 9961 - DNA, 518 bp, Triticum aestivum
  misc_feature (354)..(354): n is a, c, g, or t
  misc_feature (356)..(356): n is a, c, g, or t
  misc_feature (390)..(390): n is a, c, g, or t
  misc_feature (401)..(401): n is a, c, g, or t
  misc_feature (407)..(407): n is a, c, g, or t
  misc_feature (419)..(419): n is a, c, g, or t
  misc_feature (444)..(444): n is a, c, g, or t
  misc_feature (463)..(463): n is a, c, g, or t
  Predicted polypeptide sequence is orthologous to G2404
ccttgacgttgataacatgaattacgaggagctacttgcactcgaggacaggatcggctatgtaagcacagggctgcgcgaagacgagatcgttcgcggccttagggtgggcaaacacctgccgttcgaccgcaagcatttctcaacagagacggagcggagctgcagcatttgtcaagaagagtttgaagcgagtgaggagatagggaggctgagctgcggccacggctaccatgtgcactgcatcaagcagtggctctcccggaagaacgcctgcccactttgcaagaccgccgtctcaaaaccatgagatagatcatacgtagattcatacgccgcccagtttctttttcncnggtataatacatgtattcatatcgtatctgaaangtgtttgtccntgtgcntaattttccttnttaaaggcctctacgctctgcatancacattgttgattaaaaangatcacagcacacatcatatagaaatgatatgtcgctctcttgaaaaaaaaaaaa

SEQ ID NO: 9962 - DNA, 878 bp, Triticum aestivum
  misc_feature (576)..(576): n is a, c, g, or t
  Predicted polypeptide sequence is orthologous to G2404
acgcttgacattaggcctatttaggtgacactacagaacaagtttgtacaaaaaagcaggctggtaccggtccggaattcccgggatatcgtcgacccacgcgtccgcacttctctagccttccacacgctagacaacaaacgcgaccccgcgcccctctgctctgcctgcgcccgcccgctcgctcacaggcgctgcctggcagtgccattactgcccccacccgtctctccgggcccgagcacgccagggggaaccgggttcctcctcatggccggtgaccgccgcggcgggtcgcccacggtggagcgccggcgggggatccggcgcctcctgctgccccgcggggaggtctcctcgtcctcctcgccctcggtgccgctgcctccgccggccgcagccgaggtggggcggaggaagagcttcgcctccgcggcgctgcgcgggctgggctgcacgtcggccgcggcctcgcaggcgtacgcgccaggggcgggctccgcggctgcggcggccgtgcggtcgtccgccgactggcacgggcgaaggaagaaagggaaggacaggaggaagganaggggaggaggttggagaagcggccttgtgggcggagggatcggcggcaacgtgtggggcgccccggggataccgttccgcgcggaggcgtcgtccgtggactgcggggggcgcccccacacatgctgggggagggggccgcgccgccaacccccgaagggccccacaaaaaagggaaccccaaaatgcctactgggcttcttgggaaccggtcacgctcccaggcttggctcctttccgaggaatcggctgggtggctctggggggggggggatattcctcacgagtttctcccctccacg

SEQ ID NO: 9963 - DNA, 855 bp, Triticum aestivum
  Predicted polypeptide sequence is orthologous to G2404
ttgaccttaggcctatttaggtgacctctagaacaagtttgtacaaaaaagcaggctggtaccggtccggaattcccgggatatcgtcgacccacgcgtccggtggcgcgccaccagatgctggggaggggccgcggcggcgacgccgagaggccgcacagagagcggccctgcctgtcccggagggcgagcatgcaggagcagatgtcctcgtccttcatggagtcgccgccgccgccgccgctgcatcacctggacggccccttcttcggcgccgacctgctcccctccgcgcgcctccgccggatgcgcggctaccgcccctcccccggcggcctcgaagaagagatcatgatgtttcagacaagagtgttgttgggaggaatgaatgtgtatgatcggtaccaggattggcgccttgatgtcgacaacatgacttatgaggagttgcttgagcttggagaaagaataggacatgtcaacacagggctacgcgaggatgagattgttcgcaaccttaggaaggtcaagcctgattcgtcattccagtttccgacggaagtggagaagaaatgcagtatttgtcaagaagagtttgaagcaaatgaccagatggggaggctgggctgcggccacagctaccatgtttactgcatcaagcagtggctttctccgaaaaacgtttgcccggtttgcaagaccgctgtccccaagacttggaacaagtcccgacccccgggctacccttattgtggccctgggggggacctaagatgaaaaggtttcactttgttggcgcttttgtaacggccccgccacaggttattatttggtggccataacccctccccttcc

SEQ ID NO: 9964 - DNA, 735 bp, Triticum aestivum
  misc_feature (22)..(22): n is a, c, g, or t
  Predicted polypeptide sequence is orthologous to G2423
caattatatagacaagggattntacaattaatagtagtttgcagagattgtgaagtgaagtagctagctagcatcaaagtcccggtagtctctcggtggaaacaggttcccactcaggttcacttggatgtggtgctgctcatcaatctccactatatcataggtgcatctatactttttttccaataaagaggtgcctctatacatatagcacaaataaccatgatcctaatacctgatcaaggcatacaaatccatcgaaaattagccctcaaactttatgtagctcaagtacatcttaatacaagttcccaactgaaataggccatgagagggtcctcttgcaactcgacctgtgtttactcatactcacatgatggctctgaagctttggcagtttttgtgtagttactaaaggctggaagctacaacttctaggacattgatggtactattgccttgtaccagactggatttgctgacatcttctaggaataatattttgacagcatatactttccatgtccctgtttgagatctttaggagttagtttcagaatctttttcgcgatgacaccaatgccgtaccataatagcttaaaaatcgttgcagaggagtgagcggggatgtccgttgagctggtcaggatctcttcgcacccctgttgaacgccgatgaggcagacgaaccatcgaagactccctcttgatttgggatgggaatgttgaggaaag

SEQ ID NO: 9965 - DNA, 440 bp, Triticum aestivum
  Predicted polypeptide sequence is orthologous to G2455
agccttcagcacagcagccaagaattgggcacattatccaaatatccatttcggtttaaactccggacgagagggtggcaagaagctcgtggatgaggctgttgcagcagcaccggctccgaaaaagatccaaggtttctactgatagatgtccgagctcatcaatcatcaactgggtggaagaattaataccacaaattataatttactgtaagtaaagaattaagggggaaagggaaagttaagttataattaccttataccttattaatgggtgaaaacttgtgaagagatgtaccgtacatagtaacagtggtgagtgataagtgggaagtgaagcatacaatcacatgaattgctattaggcgccatgcacttgcattggttgaactgagaagacttaataaaccatttgacgacctaaaaaaaaaaaaaaaaaa

SEQ ID NO: 9966 - DNA, 695 bp, Triticum aestivum
  misc_feature (9)..(9): n is a, c, g, or t
  misc_feature (510)..(510): n is a, c, g, or t
  Predicted polypeptide sequence is orthologous to G2456
cgaaaactngaggagtactcgtagatacgatacgatacatctcaagatctcatatgatccccccagcaccctagctagaatgcagcgaaattaaggcaatatattctatgggaagacgctaaaacggagtggcgcccatgctagatgccgctgtggctgctgcggccgccgccgctgcgtagagacttgtccttgaagagcatgcaatccccagctccgtccagctggctttggatgctggtcttcctcatcaggccttggtccggcatcagaccgaaatggatgtgtggaaaatgagcccaattcttggcagctgcgctgaaagcctccctgtgggtgatgtccggattgttggccttgatacgctgaatctcgtctttgatgaatcggttgtatgccgagggaactctctgccgcttctctggatgcttagtcccagacgcagcgctcttcctctgcggggtctccctctgcgcgggtttctccggcggcggcatcatggacatggcncggcgtgttgatggcgcagctgttgctgctgctggtgatgctgctcacgttggggctggcctgatcagtcagtaggctcgacggcgcttggaacgacgacatttcatccaggagcccgtgcggcgacgccggcgaggtcggggagaggagcgacgggctgaaggggagctggttggcggtggccg

SEQ ID NO: 9967 - DNA, 1176 bp, Triticum aestivum
  misc_feature (873)..(873): n is a, c, g, or t
  Predicted polypeptide sequence is orthologous to G2456
aggcatgcttccaacgcgttgccgagctcgtattatggtcgacctgcaggcggccgcactagtgattctaatacgactcactatagggcagcaggaaaccgagcagtcggcaaagagcgccccatcggcgaacaggcctccggagaagcgtcagcgagttccctccgcctacaaccgcttcatcaaggatgagatccagcgcatcaaggccggcaacccggacatcacccaccgcgaggccttcagcgcagccgcaaagaattgggcccatttcccgcacatccacttcggcctcatgccggatcagggattcaagaggaccttcaaggttcaggatggcgccgaagacatgcttctcaaggatggtctctatgctgcggcggccgcggcggctgccaacatgagcgttactccactttaattacctagctaatgagcaagcctctcgagttctgcgaacgttcgaagttagctaactctcttctgcggctccaatctagggttccttgttagatagtatcatcaacatcgcgtgtgtgttagatctactactttcatttctgtccgtttggggcctggaacggagaatcgggttgaatacctaggtttctcagttgtcatgatcatctgtttggctatctataggtgtagtgagtttgtcttctctatttccattacttcatcttttccatgtttatcttttcacttccacaacttcttacacctattcacctgtagaaaagtaggtgtgtcttaagaacatgttttcagcattactgatgtatgtctttccttcccttccatgtattttcggtcaatggaaaacaatccatcttcatggaatagctggcttgcatctgtaacctcggccgngaccacgctaatcccgcggccatggcggccgggagcatgcgacgtcgggcccaattcgcctatagtgagtcgtattacaattcactgggcggtcgtttacaacgttcgtgactgggaaaaccctgggcgttacccaacttaaaccgcctggcagcacatccccctttcgccagcttggggtattaccgaagagggccgaaccgatcgcccttcccaacagttgcccacccggaatggcgaaggggacccccctgttagcgggccaattagcggggggggttgtgggtggtaccccccacggtg

SEQ ID NO: 9968 - DNA, 1218 bp, Triticum aestivum
  Predicted polypeptide sequence is orthologous to G2456
ttcgctgccgcgtcaaatccactggtcccaagaagccccagctctggccgctccgggcagttgatttgcacttgcaccgcctgctagaacagctaccactagcgtgatcgataaccgggcatgtcgtcgtcctcctcctccggggcctccgccgccttcacgccagtatcgcagcagcagcagcagatggcgccggagaacctcagctcggagcttcagcccccggcgccgatgcagccggaggcgccttccgagcagctctgctacgtgcactgccacttctgcgacaccgtcctcgtcgtgagcgtgccgagcagcagcctcttcaagacggtgacagtgcggtgcggccactgcagcagcctgctcaccgtcgacatgaggggcctcctcttcccgaccacgaccaccactgtcgccgccgagtcagccgcttctgctgtcaccaccacgacgtccccgccgccggccgccgctgctcaccacggccagttccactaccccagctcgctcaacctcgcgcccggcaaccctccccgccactccctcctggatgagatatccagcgctaacccgagcctgcagctactggagcagcacggcctcggcggcctgatcgcggctgcgggtggcaggaacgccgcggcacctgcgccgctgccgccacccccagtcgccggggggaaaggtgggaaggagccatcaccacggaccaatcccgtcgtcaacagacctccggagaagaggcagcgcgtgccgtcggcgtacaaccgcttcatcaaggacgaaatccaacgcatcaaggctggcaatcccgacatctcgcacagggaggccttcagcgcggctgccaagaactgggctcactttccgcatatccactttggcctcatgccggatcaccaggggctcaggaagaccagcctcctacctcaggatcatcagagaaaggatggccatgggcttctaaaggaggggctttacgcggccaacatggggattgctccgtactgatatcaagctagcatatccatgctattgccatcgcctccttgactagctcctatcgactattactatcaggctatgtttaattagctagggctttctgccatggtaaacaatataattacctcagttcatatgacctattagctataattaagtgatcaatatcgatctagtagcacactcttcctgccaaaaaaaaaaaaaaaa

SEQ ID NO: 9969 - DNA, 1078 bp, Triticum aestivum
  Predicted polypeptide sequence is orthologous to G2457, G2459
gcacgagggaaagctagacagctcaatttctccttcctctctgcccatacatatctctctctctctccatcgatctaacctacacacccagagaaagagagagaagcagcagtagctcatgtaacctagctagcctgcagttctccacggcaacgcttcttcttcttggctgccgcctgttgaacctcgccgtggtctgaacggctaggggggcagtgaggcggcggcgccaggggataatcagaaggaagaatgtcgtcgtcgggccagatcacaccggcagaagaagtctgctacgtgcactgcaacttctgcaacaccgtactcgcggtgagtgtccctgggaacagcatgctcaacatcgtgacagtccggtgcgggcactgcacaaacctactttcggtgagcctgagagggcagatgcactcaccggtccctcctgcggcacaggtccaggagagcagcctgagcaagcccaatggcagcaacggcttcattcgtgaccacggcagcgcctacaatagcccggagtttgcttcgtcttcttcttcatcgtcgtccaaattccggatgccgacgatgatgttctcatcgcaaaacgatctgctgcaggagcaaacgctgcacgcacgtcctcctgagaagaggcagcgtgttccttcggcgtacaacagattcatcaaggaagagatacgaaggatcaaagcaaacaaccccgacattagccacagggaagctttcagcactgccgcaaagaactgggcacattatccaaacatccatttcggtctaaaccccgagcgcgacggtggcaagaggctcgccgtcgacgatgccgcgccggctgccaagaagatccaaggtttctgttcatagacacgacggctgggagtccaaacaagaacaactgtatctatatatagtattagtaatatcgcatatgtgtatacgtaccgcatgtgagtaagtaaagatgcaaaggaaaagagaagtcgctacgtaccttaccttatacaattgtacgtacatatatatatatatatatggcgatcgagtgaataaaaaaaaaaaaaaaaaa

SEQ ID NO: 9970 - DNA, 1115 bp, Triticum aestivum
  Predicted polypeptide sequence is orthologous to G2457, G2459
gcacgagctacacacacactcgtccccctcctccaccttcttcttcttcttcttcttcttcttcttctacctcccaccctcctaccctccacatcctcgtcttctgttggctcttcgcgcgcgcccaagctcactcttgacctctccgtcccaccgacgccggccacccaccgccggaacgacccgtcgtccgttggctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcagcccacggccgccgcccatggtgcagcccctctccccaaatgaccaccaccaccccatggggccgttccagggatggactgactgcaggaggaaccagccgctgccaccgctggcctcgccgacatcaagtgatgccagccccagagctccctttgttgtgaagcccccagagaagaaacatcgcctaccatctgcctacaatcgcttcatgagggaggaaatacaacgtatcaaagctgcaaagccagacatccctcacagagaagccttcagcatggctgctaagaactgggcgaagtgcgaccctcgctgctcaacgactgtctctgcttccaacagcgccccagagcccagaatagtagtgcccggtcctcagctgcaggagagggccaccgagcaagtcgttgagagcttcgacatcttcaagcagatggagcgcagcgcctaaggcatcacaagcatgctgggattaattagtactgctaccgcatgcatcggttacttatcagctagctcatcatcatcatccgtcgctatgcatatatataatgcataagcgcacgcgtttaatttatgtttggttacttcgttgctgctgttgctgtgtcgttaagttgatggtgttgtctgttatatttgttgttggagcgtacgtacgcaccctttaattatgaacagctgctaccttataatattttttcatcgcgaaaaaaaaaaaaaaaaaaaaaaaaaaaaaaaaaaaaaaaaaaataaa

SEQ ID NO: 9971 - DNA, 898 bp, Triticum aestivum
  misc_feature (427)..(427): n is a, c, g, or t
  Predicted polypeptide sequence is orthologous to G2457, G2459
caacagctatatggatgattacgccacgctatttattatgatactatagaatactcaagctatgcatccaacgcgttcggagctttcacatatggtcgacctgcaggcggccgcactagtgattagcgtggtcgcggccgaggtttttttttttttttttttttttgttttttttttttttgtactcactcacaaactgattcataaattaacttaggtttttcttacgttactcacaatatgaaagtatcatgcatatatgaatatatgtctcactaaaaaccttgaactttctgggggataggtgccgccatggactcctccagcttcttgctgctctcattggagcctaccccgaaatgaatgtttgggaaatgcgcccaattctttgctgcggtgcttaaggcttctctgtggcttatgtcanggttgtttgtttttatccttcgtatctcctccttaatgaatcggttatacgctgaaggaacccgctggctcttcttaggagctggtctcatgtggagcatatgctcttggtcactttttgttgagacatcattggtattcggtatttataagagtgtcatactccgggtgattccaccaaagctgatattgttgggcttgaaattctcctgggaatgattttgcacaggtggggactgaattattccctcagtttacccaacacaggttcttcattgccgccacggacggggacaatttcagcatgcttttatttggacaaatacccgcaaaattgtttttttaaaattttttgcacttacaaacatcttccgcggagggaattgtttctacttcctggggggccgttcaaattcctgcgcattgtggcggggagaattcaatttgggcccaatttcccttcattaatttt

SEQ ID NO: 9972 - DNA, 515 bp, Triticum aestivum
  Predicted polypeptide sequence is orthologous to G2465
agggggcggcgccgccagcgaggagacggtgagcgaccacgacgggcccgtgctcgaggagttcatcccgctcaagcccagcctatccttgtcctcttccgatgacgagactagcacccacgccgcggcgccggtctcaaacgctaaggccgagacgccgccgcccacgccggagaccaagaaggcgatgccggactggctccagtccgcgcagctttcgacctggagtgagccccagcaatcatcatctcttcgaaaggtgctgccatgcagaccggtggcgctgaacgccaccaggaccgggggagcgttccaccccttcgagaaggagaagcagcccgaggctgagctgccggcctcgtcaaccacggcaccggcaagctcggcgttggtcggagacagcggcgacaaagccaccagcgacactgaggtgcacgacaaggacagcaaggatatcactgagaaagacacagacaaagacaaagacaaagaggggcagtcgcagcctaaccgga

SEQ ID NO: 9973 - DNA, 691 bp, Triticum aestivum
  misc_feature (2)..(2): n is a, c, g, or t
  misc_feature (4)..(4): n is a, c, g, or t
  misc_feature (7)..(7): n is a, c, g, or t
  misc_feature (633)..(633): n is a, c, g, or t
  misc_feature (678)..(678): n is a, c, g, or t
  misc_feature (691)..(691): n is a, c, g, or t
  Predicted polypeptide sequence is orthologous to G2505
gngnttnatccgtaagctcgaaattaaccctactaaagggaacaaaagctggagctccaccgcggtggcggccgctctagaactagtggatcccccgggctgcaggaattcggcaccagcctcccctctccatctctgtgaaagcatcggcgcaaaaaccagttgacctgaccatgccgtgcgcgggcgcctattaatacccctcgtcttcctcgcgcccctcctcgatatccctctcggtagacggtacaatcataccgatcaggagccagctgctgcttcttgtgttgtgttggtcccactgccgagatcggcagcagaagcagccgtcggtcctctgtacctctcgttgatcgcttgatccgaggggatccgaggggatccaaggcgagctgcgtgcgtggtggcggcgatgagttcgctgagcatggtggaggcgaggctgccgccgggcttcaggttccacccacgggacgacgagctcgtgctcgactacctgtccaggaagctcggcggcggtggcgccggaggggcggcggccgcggtggcgagcatctacggctgcccgccatggtcgacgtcgacctcaacaagatcgaaccctgggactcccgaaatcgcatgcattgcggnaaggagtggtacttctacagcttaagggacaagaagtacgctcangccagcgaacaan

SEQ ID NO: 9974 - DNA, 529 bp, Triticum aestivum
  Predicted polypeptide sequence is orthologous to G2512
ccacgcgtccgggaagaatgaaccttggtactgctggaggaagaataaacctcggtactgctgaaggaagaaaggagctcagtcgcattattgctcagaaggtgcccccttgtcattatcaagaatggaagcctcttcacattccgcagctcattccaaccactccatatggtgcggagatcttgccaaccactccaaatgaagttactgctgaaaggaatgctgtccgggaaaatacgcaggctcaagaaactaccgctgaaggaagaaaggagatcggtcacattcttggtcagtagttagccctgcgttgttatcttgacagtggtaactctcttcacgactagtgtgttccacttcccgcaacagactgctagcgtctcccacttctactagtcgctacctaagttgtttaggcgcttccactgattacgttgataatggcatgccttctcaggagtgccaagcttctcctaattatgcccctcgacatttgtattgcctaggtacctatgaaatgctttttgtt

SEQ ID NO: 9975 - DNA, 851 bp, Triticum aestivum
  misc_feature (751)..(751): n is a, c, g, or t
  Predicted polypeptide sequence is orthologous to G2515
aagctatgaccttaggcctatttaggtgacctccagcaacagtttgtacaaaaaagcaggctcgtaccggtccggaattcccgggatatcgtcgacccacgcgtccgctttccaaccaccgagaaagacgagagaagagagaaacaggacagaaggcggaggagaggagggtggttgggatggcgcggcgcgggcgtgtggagctgcggcggatcgaggaccggacgagccggcaggtgcgcttctccaagcgccgctcggggctcttcaagaaggccttcgagctcgcggtcctctgcgacgccgaggtctcgctgctcgtcttctcccccgccggcaggctctacgagtacgcctcctccagcatagaaggtacatatgaccgctatcaggcatttgcaggagccggaaaggacgtgaatgaacccggtgcaagtaacaacaatgatggagatccttcaaatatacagtcaaggcttgaagagattactacctggtctcttcaaaacaatgctgatgactcagatgctaatgagctagagaaactggagaaactactgacagatgctttgaagaatacaaaatcgaagaagatgttggcgcaacgaaatagtggtgcaggaacgagtgcaagcggcgagaactccagtcgtcctaggggacagaagggaggaaggacttgagcagccatgtgatgtgcctgcatttggtacaaggagagctctgctgctgatgcacactcttccccagntattggatatgaaagagttgtgaaggatgctgcttgttggggcaattcaataaaagggtggtggggtaacaccacataatgtccttgttaaggtatctgg

SEQ ID NO: 9976 - DNA, 678 bp, Triticum aestivum
  misc_feature (13)..(13): n is a, c, g, or t
  Predicted polypeptide sequence is orthologous to G2520
gtcgcttcctttntcttaagaatgataccgctacagaaatcctggaatacatgaaggttgcgaatacatgaggaacagtcctgaatccgaaggtcaaaacaaaaaggcaccgtgctcggcggttctctctaaatacatgtctgacgtctctaccggcaattacagctccaaaaactatgaataaaaccgcatttggaacgagatggtggcgcaaaaaaaaatgatctacggtatgaaagtgggggttgcttggccgaggattcatggcacgctttgttgggcgccaccctggacttttgttctgctcacgtcactctttcgtaggtgccaccaatctgcatgtgaagccattctgcagccggcgagccctgggcgtactcccttggtgtttgcgggtcaaatgttaaccctggagctgtgttgtatgccggcgcagcgaagtctttagttggaaatgtttcaactccgttgtgagcatgggcatgggcgttaaccgcctcgagcttcatggacaggaactcaatttggcgttccaaagcttggacataattgattatctcatcaaggactgatgctttcccaataaccttattacatccagggacaagatcttggagaattttcatccgctcggttattttctcacgccgtgccctttctgcaaggctatggctgtca

SEQ ID NO: 9977 - DNA, 810 bp, Triticum aestivum
  Predicted polypeptide sequence is orthologous to G2522
ctgggtcagggggttctggttcgggcgcactgacggagaaacgtggcagagggcggccacctgggtccgggaagatgcagcagctggcttctcttggaaaatggtttcttggctctgttggaacgggctttactcctcatgtgattattatttcggctggagaggatgttgccgccagaataatgtccttctcacaacaaggcccaagagctatttgcatcatctcagcaacaggggctgtctccacggcaacccttcatcaggattcagactccggtgcggtgacatatgagggtcgatttgaaatcctgtgtctttctggatcatatttggtggtagaagaaggtggtacccgcactcgaagtggaggcctttgcatagctttgtgtggccctgaccacagggttatcggtgggagtgttagtggagtcctgacagcagctggaactgttcaggtgatagtgggaagcttcatgtatggtggcgggtcaaagaagaacaaaggcaaagcggaccaggacgtggagaacgaagagcagaacggcggcggcggcggcagggaagagacccccacgttggcgctgccggagcacccccacaacatgctgccccacccgatgagtggatggccacccggcctaatgaaccagatggacccgagagcgtctcccatgtatgggagcagttcaaagcagcaaaacaagacccaaagcggaccagaaattggaggaccgaaaacgcaaccgcggtggccggcggcggtggccaaaaaccccctcacgatggcgcatcccgaggacaaccatgaat

SEQ ID NO: 9978 - DNA, 729 bp, Triticum aestivum
  Predicted polypeptide sequence is orthologous to G2522
attttttttatttttttttatattttttattttgtctcattattttttatgagggctcagattcgcctttgatatatcatacaacctagctccatcttctttcaccagatcaacccccaccacagaggtcgagctcctctggttatcactcagcagaatgaccatccaagagagagccggtcaatattcggtgagaatgataaggtgccaaaagaggggagagtaggtttttgaagcccacagctcctcgaataatcgaagacaagtttatgtcagacatgttttatcatcatcgccccaaatagatagatagatagatggatcgatggatggatggatagaaggggttagattgtgctaaagtttccgacatggttcattttgtgttgaacctttccaaaaaggtcaaaacagtgacttcaacggcatcatgaccatagtatccatacatacatgcattccagaagttggctctattattaaccatgctctcaggagctgctcatgcctggcatcaaccaaccaaacctcgggctcggacgctgcatcagacaacactgtatggttcccagcccacgccacaaccgaatccaaggcaatggaacggtggtggctggcggcaccatagtgtcagtccacccagaccatgggtcagcgagtaggcaatgacagcttgactgatttgtgtaggatatatatactaatatacatatttagacatagcggacg

SEQ ID NO: 9979 - DNA, 904 bp, Triticum aestivum
  misc_feature (15)..(15): n is a, c, g, or t
  Predicted polypeptide sequence is orthologous to G2522
gaacagctagtgagntgattacgccacgctatttagtgtgacactatagaatactcaagctatgcatccaacgcgttgggagctctcccatatggtcgacctgcaggcgggcggactagtgattgtggtcgcggccgaggtcccacattggccagcaggtgtaccaccagaaccatgtcgagatggcgccgaagcacggtgctggtgccggcggctcacagcatatgacgcagcacagcatcggtggcgctggcggtggcgggtcgcagcatatggtgcagcacagcgccggcggtggcggtggctcacagcatatggcgcagcacagcggtggcggtggtggctcacagcatatggcgcagcacaacactggtgctggtggcggtgctgacgggggcatggacattggcatgggtgttgtggccgtgagcggtgatgctaaaggggatcaggggggcgaggctggccaggatgagcaggtgaagaaaaagcgcgggaggccaaggaagtataagcctgatgggtcggtgacgctggggctctcgccatctccgtcgacgcctcattcgtcgagcccaggaatgggcacgatggttaccacacctggctcaggatttgggcccgggacaggatcagggggctctggttcaggcgcactaacggagaaacgtggcagagggcggccacctgggcccgggaagatgcagcagctggcttcgcttggaaaatggtttcttggctctgttggaacaggctttactcctcatgtgattattatttcacctggagaggatgttgctggcaaaataatgtccttctcacaacagggcccaagagctatgtgcatcatctcagcaacaggggcgtggctccacgggaacccctcatcaggaatcagactccg

SEQ ID NO: 9980 - DNA, 572 bp, Triticum aestivum
  misc_feature (28)..(28): n is a, c, g, or t
  Predicted polypeptide sequence is orthologous to G2559
ggaaacagagaagatgagctctttgatnaaagcatgggtggagaacgagaaggccaaggccgagaacaaggctgctaagaagctatcgtctattctttcgtgggagaacacaaagaaggcaaccatagatgctcaactgaaaaggaaggaagaagagttggaaaagaagaaggctaaatacgctgagaagatgaagaacaaaaaggcaatcgcccacagggaagctgaagagaagagagcaatggtagtggcccggcgtggtgaagaagttctcaaggccgaggagatggcagcaaagtaccgtgcaaccgggctggctcccaagaaacttctcggatgtttcggggcataagaagcacctcaatcttacgcgttggaggtgatctgttctgtgtagttgtttttcttctttacattctgaaaatgtgtcctgttttctgtgagttaagtttgtgactcttcatgttatctttttttgctgggagctactcttcatgttgcatacatgtaactgcaaagacagatttttggtggtacatatatagcatgcattgtttcgcgtaaaaaaaaaa

SEQ ID NO: 9981 - DNA, 524 bp, Triticum aestivum
  misc_feature (148)..(148): n is a, c, g, or t
  misc_feature (384)..(384): n is a, c, g, or t
  misc_feature (442)..(442): n is a, c, g, or t
  misc_feature (521)..(521): n is a, c, g, or t
  Predicted polypeptide sequence is orthologous to G2559
ttttttttttttttggggcaaataaaactgtatttattaaatactacacattaatagatgcttcgacgaacaaaacttacatcaaaagaataaatgtatcaatccatcaggcctgcactcctacgcttatacacaattcccttacaantttaaccagataccaaacctcccaacagcaaaactcacacacacaccaatggtttccagaacaccatcatgtacacacacacaccactagcaagttatgcaggaaacctgtaagtaacaatcccaacatatgtacgctctgcagatcgagagtgttgataccatgctcgattcacagtcatcatgctttcaggagcccaaagagcttcgtcggagcctcgcctttggcacggtacntggcgggcatctcctccgccatgattatctcctcacctcgcttcgcctccgccaaggntctcttctcctcaagccgacttgtggagcatcgcaaacttgttcctcaagcttccccttggaaggcggcttcctcctcncaa

SEQ ID NO: 9982 - DNA, 737 bp, Triticum aestivum
  Predicted polypeptide sequence is orthologous to G2559
tttttttttttttttttttagataaatccatgaggcaagaagagagatactctgaacatctcatgcagaaagccatgaagtcgctacatcagacccaacagacattacaaaagaaaataattgtttgatcttagacaacgcgaacagtggatgctatatatgtaccaccaaaaatctgtctttgcaattacatgctatgcaacatgaagaatagctcccagcaaaaaaaaagaaagataacatgaagagtagcaaacttaactcgcagaaaacaagacacattttcagaacatgaagaaggaaagcagctacacagagcaaatcacctccaatactgaggtgcttcttatgccccgaaacatccgagaagtttcttgggagccagcccggttgcacggtactttgctgccatctcgtcggccttgagaacttcttcaccacgccgggccactaccattgctctcttctcttcagcttctctgtgggcgattgcctttttgttcttcatcttctcagcatattcggccttcttcttttccaactcttcttccttccttttcagttgggcatctatggttgccttctttgtgttctcccatgaaagaatagacgatagcttcttagcagccttgttctcagctttggccttctcgttctctacccatgctttgatcaaagagctcatcttctccgtctccacctttgcaagagcgacgtctctttcatgtgagcccctg

SEQ ID NO: 9983 - DNA, 1122 bp, Triticum aestivum
  Predicted polypeptide sequence is orthologous to G2559
gcggccgcccttttttttttttttttgggggcaaataagactgtatctattaaatactacacactaacagatgcttcgacgaacaaaacttacatcaaaagaataaatgtatcaatccatcaggcctgcactcctacgcttatacacagctcccttacaaatttaaccagataccaaacctcccaacagcaaaacacacacacacacacaccaatggcttccagaacacaaccatgtacacgcacacaccactaacaagtcatgcacgaaatctgtaagtaacaatcccaacttatgtacgctctgtagatcaagagtgtcgatgccttcctcgatacacggtcatcatgctttcaggagcccgaagagcttcgtgggggcctcgcctttggcgcggtacttggcggccatctcctctgccatgattatctcctcgccccgcttcgcctctgccatcgctctcttctcctcagccgacttgtggagcatcgcgagcttgttcttcagcttctccttgtacgccgctttcttcttttccagttgctcctcgatctttttcagctcggcctccatctccgcctccttggcgtgctcccatgaagtgatgaaggacagattcttggcagccctgttctcggctctcgccttctcgctctcctcccaggcgttgatcagcgttgttctcttctcagacataatcttggtgagataagcatctcttccagatgaaactcttgtaccttcagcatccttgaagacggcgacgatggccttggaattgtcgggcacgggcaacaatggccttctcctcggcaatgtccttggtggccggggtcgtctccacgtccaccttcttcgccacctcagacgccatctggctcggctcgggttgctaacttcgaactcgaattcacccaaaaaagggcctcgggcatcgaaatttaacaagcagcaggctagttttatagcagctattaactccccgggggggtgtgtattggaaaaaaagttaggcttatgttctcttccctgggtgattggacggggggggttattttttacttcgcgggaagaaaaaaagggggacaaaaatgttaacgggggcgaacattttctcctccc

SEQ ID NO: 9984 - DNA, 691 bp, Triticum aestivum
  Predicted polypeptide sequence is orthologous to G2565
gctccctggcggacactttagctgaaagtaagaaatgaatgtaaatacatcctggccgggtttggtaccataaaacatgctccaaacacaagaggtggcagagaatataacaaatactgggattagtgcataatcaaatgcctaagatgctattttgcatccctaacaacagcgaaagcaagaagtcaaaccccctcaaaacagtacatcagtgtgaatttgcttgcgctgccttctggaaacctagatcatccacatggcacggaatcatcgcttctgtgactgtgggtactgtacaactaaacctagttcatagaaatgctcacccctttctcccagaaagataaaagaccggcttgattctatagtttggcagcaaccagtcaaattgatgtcaaattcatggctagtggggttcacatcttcaggcgagcatggttagatcttcattccttgtcacctgcttgctcggttgttccattttgactgctgcttggaacatcctttccggtagaagattctggggggtcacaagataactttgatccttctaccgaggttgacgcatccagcgcctggtctgcagcaggatgcatagctgctcgatcataatctgaaggcacttccctagctcctcgattctcagctgcagacttcttggtacctcaagcggttcaaggagccgctttgg

SEQ ID NO: 9985 - DNA, 381 bp, Triticum aestivum
  Predicted polypeptide sequence is orthologous to G2574
attcggacgaggccgaccaccgccgcgacggcagctgcagcatcatcacgattccctccctacgttgttacgacgcaaggcccggcgggctgggttcagaagaatggcttccattcgctggccaggcccacctagtagaccaagaactaccacgacccaggcgttcgttcaccgatcgtcttccacggcagagccatcggtcgatcatttgatttgacccaagggcaaaaggagtcctcgaaccactgcacggcggcgacgttaaattttactgccggagaaaacccccccgctttctttccctttacccttgttctgtgttcttgattgggtgagacatggatccgaggatggatggacctgtaaaaaaaaaaaaaaaaa

SEQ ID NO: 9986 - DNA, 611 bp, Triticum aestivum
  Predicted polypeptide sequence is orthologous to G2574
ttttttttttttttttttttcccaagaaaaatgcttaccacttggtgctgtcaccagctacaaactctcatgtggtcggatgttaatgaattacacaagtggcaggctacgtacactgaatttatttacagtgacaacacacatctacaaaggaacacatattcagagtatagatgttgctgccgccatgacaaccatttcttttttggatcaaagctagctagccagtatctgaagatacaatctcggaatacagtttctcccttcttctgcatgcatgcagaaatgcaacgcaagaaagacagtggagcagagcattatactgtgtgaatgtaccagttggatgtaagatatcggggacgatgagtcgtcggccatggcggtcgaaaagcacacaccaagccacctaattaacttgttcgtcggcgcacatggagcagataacagacggtagtagcttccgcagctcactcaagaaccactaacttcagacttgacagtaaagaacaatacacaaaaacgaacctgcatggcgtgctgcggatgaatcaggtgagaagggtgccgatagggctgcaaccacattgtccttcttccctcctctcagcgca

SEQ ID NO: 9987 - DNA, 1066 bp, Triticum aestivum
  misc_feature (39)..(39): n is a, c, g, or t
  misc_feature (815)..(815): n is a, c, g, or t
  Predicted polypeptide sequence is orthologous to G2574
cggtatccgtgcgacccacgcgtccggggggtgatcacncaaaagttatagatctttttagcacaaattgttccggtagtttcaataggcgtagtgaagcttggtgtagacaggtagaggttcctcctgttacagatgctcgaagtgcatgcagatacagaaatgctatgatggattatgccaatgtaactgttccaaaaccaaaagtagctcctgaatccaatgatgaaccaaatggcaggcttaacggctttgctgaagttgatgattttagtgatcaaacgggaagtggccatgacttcagaccttctagcttctcaagtgctaaacattatgaggaccagattgttgatcgtggctttcctgtttcaaagcgtggcgaggtcaataatactgtgaaagcaagagacgtcaaccttaattcatgcctggacacaatatctttcccgattgctagtgcaaacaatcaaacttctactgctgttgatgaggctaatcaatcatccattgctggaaaatgcttcattggcagttttaataataatgatggtgcatctactacatcatcctgttctggctcaaataataaagtatctggttcccttggtggatctaacggatcctctaatgctgccagatgcatcggtggtagttatggtaatgatgctgcagctaacatttttggaaacaagaacaataccatggtgtaccagcctagtttgaacacatgccccatctctcatgttgcaactaatgtggattctcttgtttcccgttcaacacatgcaaagaacagtgacaaagagcgtgcatancatacccaggaaacaatgaataccacacagaacagaggcagtaatgaagctggtgaaggctataataatgatgtctatactggtagtatcactgaaaggagtcttgccagtgtattaataattgagttacccaaaaaccacattctgagccgctgtggactaacggactcaagcactttgaagccagtaatttaccaggggttttggggtcaccggctgaaatggtcttttggttataaaaatttgccaaa

SEQ ID NO: 9988 - DNA, 459 bp, Triticum aestivum
  misc_feature (209)..(209): n is a, c, g, or t
  misc_feature (257)..(257): n is a, c, g, or t
  misc_feature (286)..(286): n is a, c, g, or t
  misc_feature (293)..(293): n is a, c, g, or t
  misc_feature (303)..(303): n is a, c, g, or t
  misc_feature (322)..(322): n is a, c, g, or t
  misc_feature (327)..(327): n is a, c, g, or t
  misc_feature (345)..(345): n is a, c, g, or t
  misc_feature (361)..(361): n is a, c, g, or t
  misc_feature (365)..(365): n is a, c, g, or t
  misc_feature (372)..(372): n is a, c, g, or t
  misc_feature (389)..(389): n is a, c, g, or t
  misc_feature (407)..(407): n is a, c, g, or t
  Predicted polypeptide sequence is orthologous to G2587, G2686
cttgatggcaatgaattaccatgtcaatacatccaatagcgctttgtgggatcacatgccaatggttttccacacctgacctgagccgaaatttttgcaccgtacttccgccatgttaggccgcgtttcatcttttgcttgttctgatagtatttcaaccctttttgtgggaaaagctgatattgggttagatgttgggtatagaagancatagagggaacctggacaaagcatttccggcagcacggccatccttncatatgccctgactttgggtgcattgtgntattaantgggtacctncctttgagcaacccgatgnacctngtccctggtaggtttggnaaactatcctggccangcantaataantattgtgaaagtttaanacaggcaaatccatacanacaggtattaacaaatttgggtattttttttgaaacctggaaaaaaaaaaaa

SEQ ID NO: 9989 - DNA, 747 bp, Triticum aestivum
  misc_feature (699)..(699): n is a, c, g, or t
  Predicted polypeptide sequence is orthologous to G2592, G2713
gcacgagaagagacagaacagtttcgagtttttttttttttttttttaccagacaatgggcatccatagaaaaagctcaaaggcaaatcatgaaggtgagggaaccttaggttaaatccggaagagaccaaccgcatccacgaaactttgcttcaaaggaagcaatcatggtgcgaagcaacgcatgctaccgagtcccagttccagcaagctacaaacaaagcagaattacaagcaaacgaaagggagtgtccgtgatctagaatggaagtcctatggggggaatgagggttctactactttcttcccttccctcgaccgccgccgcctgtgtcgtcgtcgacctccgtcggtcgccggttttattcacaggccagtttcgtgtcgaagctgctcaggcacattgcgaaggcctggaacgccgacagcgggtagcggtagtccatggtgaacatgtccttggacaccttgccgaactgcaggatgatcttgtcctgctccggcgccggggcgggctgcgacggggccggggccggcgcccccgcccccgcccccgtggcggggagcgggggctggctcggcgccgcgatcagctggaagttcttcaccgaggcgatggtcacgcggccgcggaagttgaggcaccagcactgcagctgctcgtgccacctcggaaccttgttgcggagcaccagcggnctctccttgttctctccgtcttcgtcaccgcttatggcggcgcctccg

SEQ ID NO: 9990 - DNA, 725 bp, Triticum aestivum
  Predicted polypeptide sequence is orthologous to G2592, G2713
aggaattcggtacgagggtcgcttgtgcggctgtctgtcgaacctggagagaaatgtgtcaagagattgttaagaacccagagttttgtggaaaaattactttccctgtctccttgaagcagcctgggccccgtgatggaaccatccagtgcttcattaaaagggataagtctacacaaacttactacctgtatctgtgtcttacctccgctgtggttgctgaaaatggcaagtttcttctattggcaaaaagacactcccgtccaacctgtacagagtatacaatatttatgaatactgacaatacttctaggtcaagcaacatgtacattggaaaattgaggtcaaatctccttggaacaaagtttgtaatatatgatacccaacatccatgcaacatacccaatgtttcacagtccgggaaaacaagccgtaggttctactcaaggaaggtatcaccgaaggcctcacccagtacttacagtatagcacaggtttcgtatgagctgaatgtcttggggactcggggccctaggcggatgaactgtgttatgaactccatacctgcctcatcccttgtggctggtggcactgttctatgccagccggacagtgccgttgctcattcccttgatgagtcatttggcagcatctccttctcgaagtcatccattagggatcgctccatccgattcagcagcacccgattctcgggcatctcaata

SEQ ID NO: 9991 - DNA, 696 bp, Triticum aestivum
  misc_feature (664)..(664): n is a, c, g, or t
  misc_feature (666)..(666): n is a, c, g, or t
  misc_feature (672)..(672): n is a, c, g, or t
  misc_feature (675)..(675): n is a, c, g, or t
  misc_feature (696)..(696): n is a, c, g, or t
  Predicted polypeptide sequence is orthologous to G2592, G2713
agctcaggtctcctatgagctcaacgtcttgggaacccgaggtcccaggcggatgcggtgcgtaatgcactctatccctgcctcatcgctcgaggctggtggcagtgtcccttgccaaccggatatcatcttttcccgttccctagacgaatctttcagcagcatgccggtctcgaaatcttctgtcatggaccattccatgcgttttagcagcgccaggttctctgacgtctccataggaggtggcccggcgatcagaggacaggccttgagcgacggcgaagattcgaaggacacgcctttgattctccgcaataaggttccaagatggcatgagcagctgcagtgctggtgcctcaacttccgtggccgggtgactgtcgcctgtgtcaagaacttgcagctcactgctgacgtgcagcctgctgctggagccccaacttcaccacaccctgcgccagcacctacgcctgagcatgataaggtgatactccagttcggcaaggttgcaaaggatatgttcaccatggactaccggtaccctctctcggacttccaggccttcgccctctccctgagcagcttcgacaccaagttggcgtgcgaatagaactgcggggttgcaaccgtcatggctgcaccgatcatcaaaaggctgaccgtncnccaaantangtggggactccattctgttgn

SEQ ID NO: 9992 - DNA, 549 bp, Triticum aestivum
  misc_feature (494)..(494): n is a, c, g, or t
  misc_feature (531)..(533): n is a, c, g, or t
  misc_feature (545)..(549): n is a, c, g, or t
  Predicted polypeptide sequence is orthologous to G2592, G2713
tagcgtggtcgcggccgaggtacaattacaatgcctgagactgagagaccaggacaactctcaaccttgcaagaccacacatccctagcactacctttgcaactcaacatctcttcacatttcataccagtcccaagcagaggcagcatcagacatgcataggtagcaatcaatcacatagtggaagcctgtccctgaaccacagacacaccttcaacccctaaccctccctaccaacagctttaacaagcatatcatctcccctacccgattgataacagctttaaccagcacactgggggactgaaactgaaccaacaatttgcagagaaatttactcatgcacttgatgcgtatgttcgctcgtttgttcccaggcctgggcgcggaagctcgacggagagacgacactgaatgaccactgatgtcgtagagaatctatttatttattcacacgccagcttggtgtcgaagctggtcaggcagatggcganggcctggaacgccgacagcgggtacctgcccgggcgnnngctcgaaatcgnnnnn

SEQ ID NO: 9993 - DNA, 1128 bp, Triticum aestivum
  misc_feature (802)..(802): n is a, c, g, or t
  misc_feature (806)..(806): n is a, c, g, or t
  misc_feature (812)..(812): n is a, c, g, or t
  Predicted polypeptide sequence is orthologous to G2592, G2713
acccacgcttccggatgattttctcattcagtttgccaacataggtgctgctcgaatgagaaatatcatcagagatgagcgatatcacaaaagaagcacctatgttggcaaactgaaaccaaacttccttggcacaaagttcacaatatttgatagccaacctccttgtgatgctgcggtgttgcctaacaacaagccaagcaaaaggcactcgaagcaagtatcaccaagactgccactaggtaattacaatgttgctaccgtctcatatgagctcactgtcctgcgcaaccgaggaccaaggagaatgcagtgcaccatgcactcaataccagccgtgtgcatccaggagggcgggaaggccccaacccctactggcatggtccactcactcgacgaacaagtgtccaccctatcaactagtagcaaaggaaaggaaccaaacatcgaattcttgtcaacaagcctcagcgctgatttatccggaccgatctcgaccagcgaagcgcctctgcttctgaagaataaagctccccgctggcacgagcagctgcagtgctggtgcctcaacttccgagggcgtgtcaccgtagcatcggtcaagaacttccagctcgtcgcctcggttgacccctccttgggcgtccccgctgcggagcaggaaaaggtgatcctccagttcgggaagatcgggaaagacatattcacaatggattatagatacccgctgtcggcgttccaggcctttgcgatctgcctgactagcttcgacacgaaaccggcctgcgaataggcgtaaccngggncagcgnagacgtgttgcctgcccccttggatgctgtaaattctgatatctttgcttcgactctcgggacgaatgcccctggggagatggtaggtggtagattgatggtacctttgccggatcaagatgtggcaatgatatccccgtattctggcaaacccccaggatgattggggcactggtgtagcgactggtagtataatgcgtgtggtgtgggaagtttagcatgacatacactgcctttatggacatgtcaaaaaaaaaaaaaaaaaaaaagggggcgccttaattttcctcgagggccaagtttcgcgtaccagttt

SEQ ID NO: 9994 - DNA, 1107 bp, Triticum aestivum
  misc_feature (14)..(14): n is a, c, g, or t
  misc_feature (21)..(21): n is a, c, g, or t
  misc_feature (26)..(26): n is a, c, g, or t
  misc_feature (28)..(28): n is a, c, g, or t
  misc_feature (31)..(31): n is a, c, g, or t
  Predicted polypeptide sequence is orthologous to G2592, G2713
cccacgcttccgtncagacgnattancngtnatattggactcacagaagcaccggctgatgatgggaagttcttgcttgctgcacgcaaatgcagaaagcctacatacacagactaccttatttatcttgatatgggtgatatgtcaaagggaagcagcacctatattggcaagctaaggtcgaactttctgggaacaaagtttaccgtctatgatgctcatccaccgtatgatggggctgtcgtctcaaaaagccggtctgctcgtgtgattggtttgaaccaggtctccccaagagttcctgctggcaattatccagtttcacacatttcttatgagttgaatgttttgggctccagaggtccaagaaggatgaactgtgttatgagttctatccctgcatcagcagttgaagaggggggcaaagctccaacacaaactgaatttccccttggtaaccttgactccttcccgtcgattccattcttcagatcaaaatctgctcggatagacagtgcacccgctcaggctcaggacaaagagaagctggtgctgaagagcaagtctcctcggtggcatgagcagctgcaatgttggtgcctcaatttccgtgggcgggtgacggttgcgtcagtgaagaactttcagctggtggcttcggatgagaatggagcagctggccaggagcatgacaaggtgattctgcagtttggaaagataggcaaagacttgttcaccatggactaccgctacccgatatcagcatttcaatcatttgcaatatgtctgagcagtttcgataccaaaattgcttgtgaatgagacaaggtggtgggggaaaatcatggcagctggaaggagggaggaaactgaagcaaagtattgggtggaccgtcgcctgaagtgtgccagtggtgtatatataaagctatccctctatctagttaatttcccaaaattaaagtctgttatctaccccacttccatgattcaaaatggtggtgtgcatttccaaaccgatgagtaattgggtctccctcccaatgtaggaccacggtgcattcagaactccgaggattaaaaaaaaggggttttcaattcttccat

SEQ ID NO: 9995 - DNA, 1118 bp, Triticum aestivum
  misc_feature (31)..(31): n is a, c, g, or t
  misc_feature (732)..(732): n is a, c, g, or t
  misc_feature (738)..(738): n is a, c, g, or t
  misc_feature (742)..(742): n is a, c, g, or t
  misc_feature (814)..(814): n is a, c, g, or t
  misc_feature (822)..(822): n is a, c, g, or t
  Predicted polypeptide sequence is orthologous to G2592, G2713
cgcgtccggtacaaagctaattatcgtctcnacctgtcccttacttctgctgtgcttgatgacaatggcaagttcctactgtcagctaaaaggagtcggagaacaacttacaccgactatgccatttctatggatcctaaaaatatatcccggtcaagtagtggctacatcgggaaattgaggtcaaatttcctcggcaccaaattcatcatctacgacacgcagccgccttacaatgccagtaaactctgcccgcaggaacggaccagccggcggttctcctccaggaaagtctccccaaaagttccagctgcaactggcagctacccgatcgctcaggtgaactatgagctgaacgtgctcggcacccgcgggccaaggcggatgcagtgcaccatgaactccatcccgacatcggcggtagaccccgacggcgttgtgcctggccaacccaaggagctcctcccccggctattcgaggaatccttccgcaccaccgcaagttccaggtactccacagacttcagcagctgccgcttctccgagtttgggggagggcctctgagagaagaaggcggcgacgaaaatgcgggagacaaggagagcccgctggttctcaagaacaagtcgcccaggtggcacgagcagctgcagtgctggtgcctcaacttccgggggcgcgtcaccgtggcctcggtcaagaacttcagctgatcgccgcccctgccccgncaccgncagnctccggaggagaggcggctcccgagccgtcttcacagacgcaaccgccccagcagcagcctaactctgctgncgcacagncgcagcctgctggcagttccttgtcggcgtcctcgtcctcgagccaccatgacacggtgctgctgcagttcggcaaggtgtccaagacactttcacatggactaccggtaccgctgtcggctttcagggcttcgcatctgctgaccagctcgacaccagctgcgtgtgagtaataacagatctcagtgcacatagccgtcatgagtaccgctttcgccaaatccgccccggcctggaacggaataaggaacaacaatgctcagggttaacaaatccctgaaatgtgggtcattcat

SEQ ID NO: 9996 - DNA, 865 bp, Triticum aestivum
  Predicted polypeptide sequence is orthologous to G2592, G2713
acgcttgaccttaggcctatttaggtgaactacagaacaagtttgtacaaaaaagcaggctggtaccggtccggaattcccgggatatcgtcgacccacgcgtccgccacaaccacttgttcctttcttcaccgcccctcgcccctccccatttccgccgatccgacccggcccttccccgccgcccgctccagctccaggttctactgttactgcttaaaagaatttgagttggccacttctattggcatgatagtgttcaacactaggagatctcttgtgttatatatagcagggctcttgatttttaaaatttgaagtagatgtcattccgtagcattgtgcgcgatgtaagggatagctttgggagcttatctcgaagaggatttgacatcaggattctgggcaatggcagagggagatctcatggtgctgtccatgagttacatgaccccgttcctgtaatccagagcagctgttgggctaacttgccttccgaattgcttcgagatgtgattgagaggttggaggctagtgaggctacatggccctgtaggaagaatgttgttgcttgcgcagctgtctgcagaacatggagagagatgtgtaaagagattgtaaaaaatccggagttttgtggaaagatcacttttcctgtgtccctcaagcagcctggccctcgggatggaactatgcagtgcttcattaagcgggatagatctacccaaacttactacctgtaccctctgcttacctcagctgtgcttgtcgaaatggcaaattcctctgtcagcaaaaggatctgccgtgcacatgtacagatatataatatctatgaacgcgaatagtatatcgaggtctacca

SEQ ID NO: 9997 - DNA, 861 bp, Triticum aestivum
  misc_feature (623)..(623): n is a, c, g, or t
  misc_feature (770)..(770): n is a, c, g, or t
  Predicted polypeptide sequence is orthologous to G2592, G2713
acgcttgaccttaggcctatttaggtgacactacagaacaagtttgtacaaaaaagcaggctggcaccggtccggaattcccgggatatcgtcgacccacgcgtccggcgccggaaagcctttttctcgctgtaggagaaaggtcgcgggttcgatcacaggtggaaagctcgtcgcttttgctcccctgtccgtcttctttggcttccgggggctttggggaaagaggaggagagatcgctcgctgctggccacaaagggttgggatctcctctccgcggaagaatctctttcaagtttgggtagagctcgatttggggccgtgccggaaagctcattccgaagaccttgaccgctaggagatcggtgaagttctggttgtcatcgcagggtctccggcagatatgtctttccgcagcatagtccgcgatgttagagagagcttcggaagcttatcaaggcggggctttgacgtgaggatttcaggcctccctggtctttccggccatcatcaccgggggaagtcttttgggccaccggttgagccacacggcggggctgtggtggctgatcagaatggctgggttggtcttcctcctgaattacttcgtgatgtgatgaanaggctggaggaaggcgagagcacttggccctcgcgcaaagatgtcgtcgcttgtgcggctgtctgcagcgcgtggagagagatctgtgaagatatagttcagaagcccggagttctgtgggaaactcactgttccggtgtcgcttanacagccaggacctcgagatggattaatcagtgcttccttagaaagggacaatcaccactaacctattatctctacctcttgcctagccctg

SEQ ID NO: 9998 - DNA, 863 bp, Triticum aestivum
  Predicted polypeptide sequence is orthologous to G2592, G2713
agcttgacattaggcctatttaggtgacactatagaacaagtttgtacaaaaaagcaggctggtaccggtccggaattcccgggatatcgtcgacccacgcgtccgtgtagctgtgcttagtgagaacggaaagttcctgctagcagccaagaggaatcgacgaacaacatataccgaatacgtaatttctgtggattctaaaaacatctcgcggtcaagcaacggctatgttggaaaaatgaggtctaatttcctcggcacgaagttcatcgtctacgacactcagccgccatacaatgccgggagcctcgtcccatgccagcgcggcagccgccgcatctcttccaggagggtgtcaccaaaggtgcccaccggtagctaccccatcgcccaggtgaattacgagctcaacgtgctgggcaccagggggccgaggcgtatgcagtgcacgatgcactccatcccagcctctgcagtcgacccggatggcgtggtgcctgggcaaccccagcagctgctccccggtccgttcgacgagtccttccgcagcacgaacgcctcctccaggttctccatggcagacttcagcagctctcgcttctcaagctcccgattctcagatgtaagtggtgggttgcggcgagaggaagaagatggggaggccaaggagaggccattggttctccgcaacaggtgccgagatggcatgagcagctgcagtgctggtgcctcaacttccgaggcagggtgactgtggcctccgtgaagaactttcagctgaccgcagccgcgccacaggtggcagctgctgcatttgcgccgtctgaacctttcgaagcggcccagaagcagcagctccagc

SEQ ID NO: 9999 - DNA, 1118 bp, Triticum aestivum
  misc_feature (989)..(991): n is a, c, g, or t
  misc_feature (993)..(993): n is a, c, g, or t
  misc_feature (1003)..(1003): n is a, c, g, or t
  Predicted polypeptide sequence is orthologous to G2592, G2713
tcggcgacccacgcgtccgctttttccaggtcaaacttcctcggcacaaactttttaatctacgacacgcagcccccgtacaacggggccgtagtcccacctgttggaaggagcagcagaaggttcaactcaacaagggtctctccgaaggtgcctgccgtcagttacaacatagcccaggtgacatacgagctgaatgttcttggcacgagagggcctaggcggatgcgctgcatcatgcactccataccggcctcctcggtcgagcccggcggcgtcgtccccggccagccggagcagatcgtgcctcgagccctgggggactcgttccgcagcatcacgtccttctcccagtcgttccgcagcagcgccacctcctccaggtccatcatggaccagtccatggacttcaacagcgcgcgcttctccgagatcagcggcggcgggatgacggacggcgacggcgagggcgaggtcaaggagcggccgctggtgctccgcaacaagcccccgaggtggcacgagcagctgcagtgctggtgcctcaacttccgcggccgcgtgaccatcgcctcggtgaagaacttccagctcaccgccgcgtcgaacccgccgccggcgggcgccccgacgccctcgcagcccggcccgggtcgaccggagaaggtcatcctgcagtttgggaaggtcgcgagggacatgttcaccatggactaccgctaccctctgtcggggttccaggcgttcgccatctgcctcagtagcttcgacacgaaactggccctgtgataatccgtgacaccaagacgaagcgaaagccaagaagaggggggcgccggcgcaaatgatccgacgacggggccctgggtccttagggtgtggtagatcgggttcgcgtttccgcgtcggtgtttccctgctgtaatggtgcttgcggcggtagtaattgaaccggagttttctatatgaaaacatgtgttctgggcccnnncnacaccaaggnacacaagccctcggccgcaaaaagggggggccgcctaagtttcctgggggccaagattacgtccccaggttttgtaaaagtgggccaatagggggcatttaaacaggggcgccca

SEQ ID NO: 10000 - DNA, 970 bp, Triticum aestivum
  misc_feature (48)..(48): n is a, c, g, or t
  misc_feature (572)..(572): n is a, c, g, or t
  misc_feature (617)..(617): n is a, c, g, or t
  misc_feature (639)..(639): n is a, c, g, or t
  misc_feature (698)..(698): n is a, c, g, or t
  misc_feature (707)..(707): n is a, c, g, or t
  misc_feature (710)..(710): n is a, c, g, or t
  misc_feature (725)..(725): n is a, c, g, or t
  misc_feature (734)..(734): n is a, c, g, or t
  misc_feature (760)..(761): n is a, c, g, or t
  misc_feature (765)..(765): n is a, c, g, or t
  misc_feature (768)..(768): n is a, c, g, or t
  misc_feature (770)..(770): n is a, c, g, or t
  misc_feature (777)..(777): n is a, c, g, or t
  misc_feature (792)..(792): n is a, c, g, or t
  misc_feature (817)..(818): n is a, c, g, or t
  misc_feature (845)..(845): n is a, c, g, or t
  misc_feature (848)..(848): n is a, c, g, or t
  misc_feature (852)..(852): n is a, c, g, or t
  misc_feature (868)..(868): n is a, c, g, or t
  misc_feature (878)..(878): n is a, c, g, or t
  misc_feature (881)..(881): n is a, c, g, or t
  misc_feature (884)..(886): n is a, c, g, or t
  misc_feature (889)..(889): n is a, c, g, or t
  misc_feature (891)..(892): n is a, c, g, or t
  misc_feature (909)..(910): n is a, c, g, or t
  misc_feature (912)..(912): n is a, c, g, or t
  misc_feature (916)..(918): n is a, c, g, or t
  misc_feature (920)..(920): n is a, c, g, or t
  misc_feature (925)..(926): n is a, c, g, or t
  misc_feature (929)..(931): n is a, c, g, or t
  misc_feature (936)..(936): n is a, c, g, or t
  misc_feature (939)..(941): n is a, c, g, or t
  misc_feature (950)..(958): n is a, c, g, or t
  misc_feature (967)..(967): n is a, c, g, or t
  misc_feature (970)..(970): n is a, c, g, or t
  Predicted polypeptide sequence is orthologous to G2604
ggcacgaggagttttttttttttttttttaattgaacataaacatggngggttcatatatctgtctgatccagttacacagatgattcgacgaatttcgagcactatgtattaccaaaaactcttgtttattctgcaagctcgccaggtccaacgaaggagggaaatggagaggggaggaagagattgcttctgggaagaactctatacatgtgcactcaaagcattcttattgcgggaagctgccttcagtatgaacttgaaggacttcagttgctgggcttttgctctgcacccgatgatgccccaactgatgtgacgaaactgcagactgcacatttgacggacctcgcgccatactggtacatgagcagcattcgacaactcccgcagtttacatgcgcaacctgattcgcttccattgccaggttgacagtgtggcagcaagaacactgtacacttgtggcgccgcgtatgtacatgagaagagtgtggcatcctccacaaactagctgcgccatctcagtcccgggagccggaacagcggtcaccgtactgcaaactgcgcagcanaccgacgttgcgccggcaggaaacatgagcagattccggccccanagcagacaaagttggctttgangctcctgcattgggaaccgggtggtgtgaaaggccacaaggaaggaagtttggggtaanggggccaanaangaacccggcatttgnccgggcccncgggttggccttgcacccgggggttnncccnttngnttgcccnaactgggaacttttncaccgcttcccggggggggaaaatnngaaggggccttggggaaaacaagggtnggncccnttccccctaaaatggnaaaaaccccngcntcnnntgncnngggaaactggggctttnngncccnnncncaccnnaannnttttnttnnnccccccccnnnnnnnnnccccccaanggn

SEQ ID NO: 10001 - DNA, 1047 bp, Triticum aestivum
  misc_feature (328)..(328): n is a, c, g, or t
  misc_feature (381)..(381): n is a, c, g, or t
  misc_feature (629)..(629): n is a, c, g, or t
  misc_feature (635)..(635): n is a, c, g, or t
  misc_feature (678)..(678): n is a, c, g, or t
  misc_feature (689)..(691): n is a, c, g, or t
  misc_feature (723)..(723): n is a, c, g, or t
  misc_feature (760)..(760): n is a, c, g, or t
  misc_feature (763)..(763): n is a, c, g, or t
  misc_feature (791)..(791): n is a, c, g, or t
  misc_feature (821)..(821): n is a, c, g, or t
  misc_feature (841)..(841): n is a, c, g, or t
  misc_feature (864)..(864): n is a, c, g, or t
  misc_feature (872)..(872): n is a, c, g, or t
  misc_feature (916)..(916): n is a, c, g, or t
  misc_feature (961)..(961): n is a, c, g, or t
  misc_feature (964)..(964): n is a, c, g, or t
  misc_feature (992)..(992): n is a, c, g, or t
  misc_feature (1000)..(1000): n is a, c, g, or t
  misc_feature (1014)..(1014): n is a, c, g, or t
  misc_feature (1044)..(1044): n is a, c, g, or t
  Predicted polypeptide sequence is orthologous to G2604
tttttttacttgaaaaatgaggcgcaatgcccttgtgtttatttattgtttgtgtgcatgcatgccttgtgtgtgaatgtgtaggtatgtgcaaacttacatcatcgtacttgctgagccctgagccacaacttatttatgctactccctgctgtacttactgaactacatacaccacacaatgtccagctctcaaactggctgctggtgctccagctcacattcacttgacatgctgaccttgcctgcctcagagctgctgtgctgtgtttgccattctcatgtgaatgtgcctccactgtgttctgatcatgcactgctgtgccgnatgtgtcaccactgtgctgtgctgtgtcccctgctgctcactgcatccatganttgacatctggtgtcctgtgctgactgaaatgccctcgtcacatgacattgatcactttgtgctgctggaaccaccatccttgcacactcccccattgtgactgtgatgccaattgacacctgaaaactggttgatgcatcacttgctgctgtgagtgtttgtccaaaagacttgacacagaattcacaatgtttggtatccatcacactgtggctgaagccaacacacctcatcagtaacaccatcntctgtngctgtatgaatcatcagaaaagcacaaaccaaaccctggcganaacaggtgttnnngacatttggctctgacccaggcttgatgtagncaactgaatgagctggatactcacaaactgaaacccngcngcgattgagccccttgtggagtgtcgtngccaccccaacagaaacctgacccagaacngacctgatgacggaaacacnctgacgcctggctggggaaaccntttcctcnggataaaccctctggcatttggaattcactcttggactccactncactcaccggaaacctcgggaaaagccgggaagactcggcgagtncanggacgattcggcatttggcacgacatgnggcacagncccaacacactctncccatccgaactcaccgcccatggacccanatg

SEQ ID NO: 10002 - DNA, 647 bp, Triticum aestivum
  Predicted polypeptide sequence is orthologous to G2604
caatgaaattgttttttctgggctaggatttctcccaagcatcaacgaggttcaggttggagtttactttcctttggattgggacaggataagggccgctcgggatcatgagactcagtacaagataattgaggaagaaaagcaggaagaaaggcgcaagagaggtgagctcaagaagaaaatccaggaacagctagctcagaatacaaacgaacccattgtgacggtggactgagtacgtctggaacagccacaggctgattcgatgatccgtacaaggctgaagacgatcagagcgggctgcctgggagcaacagccaggtgggtccaaatccaatatggtacctacgtgggtgcgtaccgtaccagtgcatgtgccgccattccctgatatatatcatatatgtgctatgcgcatgcatgttgttcatttctgttttccaaaggattggtggtgtacgtgtctgtgcctgcgcatgttgtaaacaagtactgtatttgaatacagcctcttctacctatttcttcttggtttctgtattataaattgaagatgcttttacgagacaagaatccatttatgtggcccattcaaatatactcaagtggccaaagtttatttccttttaaaaaaaaaaaaaaaaaaa

SEQ ID NO: 10003 - DNA, 388 bp, Triticum aestivum
  misc_feature (365)..(365): n is a, c, g, or t
  misc_feature (368)..(368): n is a, c, g, or t
  misc_feature (370)..(370): n is a, c, g, or t
  misc_feature (378)..(379): n is a, c, g, or t
  misc_feature (384)..(384): n is a, c, g, or t
  Predicted polypeptide sequence is orthologous to G2604
ccgccgtcgtcacatccccagccgaccacatccacccctccctcggcttcgaaatcaagctcaccgtctgattgggtaaccctgggcgtccgatcgaccagagctagcgggttctgcacgactctgctcaactgccgatggttagtaccaccagacctaattccatatctgacctgcagcatcttcactactgcatttcttaggcaaactgttataagagaactattgtggtcaatgtgcacaacaatggctttattcgataagtccacatggtaacaatgactgtgttgctatgtattatatctcggtatagttcttgaataatatagcactgctgagttgtgatttaagagctatggtgccanaananaaagaaannccggncaaa

SEQ ID NO: 10004 - DNA, 846 bp, Triticum aestivum
  misc_feature (15)..(15): n is a, c, g, or t
  misc_feature (19)..(19): n is a, c, g, or t
  misc_feature (90)..(90): n is a, c, g, or t
  misc_feature (534)..(534): n is a, c, g, or t
  misc_feature (684)..(684): n is a, c, g, or t
  misc_feature (699)..(700): n is a, c, g, or t
  Predicted polypeptide sequence is orthologous to G2604
gaccacgacgttgantagngagcttaccatacgagttagtatagggaccactttgtacaagaaagctgggtacgcctaagcttgggcccntcgagggatactctagagcggccgccctttttttttttttttcaaatcacttacataatcaatatttcaaacagaacagtacaaacgtagttcatcaaataaaactaagtctactacaatctgtatatagttattacaacccagatatgcctactattacaatattacaatatttacattctattacaatcaaatagaagagacgactctttgctgagtagagctatatggtttcgaacttcaaattttgtagaactcgagctcctggcgctgggggtggcacggcggtgatggcttggcacatggcgccgcacacgctgggcgccctgacaggtaggccagcacccttcggcaacggtggcacacgatttggctctgcataactacaatcaaagcagataagaaagaggagcaacggcgtaacgggcaaggcattcgaggttngcgtcacacagtaccagcaatctacgaaatgtacccaaaaataatctgatcgtctgtccgaccaacgacccgacatcgctggccagaccccacgggccacactatgcaaaaactatcagcacacatgcagcagggcaaaatagaatccangagggcatgcagtcnnattatattacacaatcatatatgtttatgctcttgttcagagtactactgactggacccaaaaccaagcgtcccagcaaagttactcaacatgagatatgatgcatcatggacattatgtgggcaatcagtacccagaaaagggga

SEQ ID NO: 10005 - DNA, 544 bp, Triticum aestivum
  misc_feature (344)..(344): n is a, c, g, or t
  misc_feature (408)..(408): n is a, c, g, or t
  misc_feature (431)..(431): n is a, c, g, or t
  misc_feature (449)..(449): n is a, c, g, or t
  misc_feature (521)..(521): n is a, c, g, or t
  Predicted polypeptide sequence is orthologous to G2632
cccatcttcctcctcatgctacttcatcgcccaaagtagctcgtccttctcttctccatccactaacaccagccaagcgctgctctcctcttctcgcccacggtggctaggcagccacttcctggctggcagcgccgacgtgtttgctgcaacagctggggcggtgacagcgtgctcgtcggtgcaccgggacaagggcggagtccccgtgccgtggtggtgtagctcaccccgattgtggctgcaggcaacggagccggtgtgcagtggctcggttgctcgccagatctggcggccgaccatatgccatgccagcgcgcgggggtgtggcggaggcgcggtangagggtggtgttgctcgtctgccggtaagcgcggatgtgggagttcgaattcctccggtgaaantccacatgactgtaccatagaancaagtctctccctctttngattataccaaatggattaactgagacttcttcaatatcgctcccctttgtcaatcgatgggaccatataancacaggactctaaaaaaaaaaaa

SEQ ID NO: 10006 - DNA, 589 bp, Triticum aestivum
  Predicted polypeptide sequence is orthologous to G2632
agaagagtcgctgccaagcaaaaggatgcgcgctaccacgcggaggtggccctgcgtaaatacaaccgagcgaacaacaccaagtttgagctggtggaggtaaaagtgatatctatattttacgagtttggagggggcggcgcccattataacttcacagctaagcagcctgaggaccagcagaatgctgatgccgacagtaccaagctattcttctctgaagtcgacctctattttcggagtgagaaagatgtgattatgtgctgtatagttggggaaaatgacgcagggcgttgctatggctgcgaaaaccgccagcctgttgttcacccaagcagcgaagcatatggcggtggtagtagtacctgtattgactatcctggttcggacagtgatagcgacagcgactagtactcgaaccctggtggctagtgctggcttgtgtggccagtcttctctcgtgtgtattggcttgccctttgcgagaataatcatggcatggagtttttttttgcggggtaatcatggcatggagtgatcaacttgagaaatgtgtcatgtgggatggaggactgatctcactgatgtg

SEQ ID NO: 10007 - DNA, 685 bp, Triticum aestivum
  Predicted polypeptide sequence is orthologous to G2633
gaattcggcacgagctccctcttctccgggcgtcaatccccctctatctcctccccgcaccagctcttgtactactcggagcacctacacccctgaccccgactccgaccacccatccatccgcttcttgcttcttccgctgtccgggccaagaatctgagatcctgtccggcgccgccgcttgtttcttgatggccgcatagatggcaggatcaacttcattttgagcttgtcccacaaggttgcaatcaccagtatgtcagctaaggcttcagaacgtacatatagatgctcagatgattcacaaatggcgtactacaacaactcggtgcctttagcagaaaatggacggttctatatgatgcaaaatcatctggatgttcactacacatcttcaggtgatgggtcacagaaaattagttccaatcctcaagtatttgaagcacagtactgcacactcgaatcatcatcggcaaacggtgtttatactacacagagctccacatcttctcatagcatctcccctataagtgggagccccctgtctcagaatgatagccactcataccacacatatgattcacccccaactgcttcatgtgttaccgagataccggatttccagagtaaactgaaggagctagaaaatgcaattcttggacctgaattggacatagcctctgac

SEQ ID NO: 10008 - DNA, 1103 bp, Triticum aestivum
  misc_feature (24)..(24): n is a, c, g, or t
  misc_feature (30)..(30): n is a, c, g, or t
  Predicted polypeptide sequence is orthologous to G2633
ccacgcgttccgaggaaacaactncgcacnccgctcacagcccagagccaccaacacccacctcttctctttctcttcccctctccctcccttcgcgatctcccttcccccggcgctagctcttcgccatcgccgcacgaatcctcctcccctcgacttcagctcaagggttcgacggcgagccaccggccggagctaccgcgcagagattttcgtttcatctggatttctgggctagaagatccatgcagtgattagtgtgtcagattcttcaccgaacaagtatggccgatactccaacttcccggatgatccaccccttcagcaacatgcaggggcagaacccgaaacagttccagttccagtactccgacaacccacagcatccctgccgcccttaccagccatctccagacacccatgttgtgccacagcatcactacagcctcaagtcccactcatcagatgctagctatgagaaccaggttgctcagatgaagcacactttggactcctcggcggcagacggctacatgaggcatgactcgccctccagccatagcttcactcctccgtccatcaggagcggcagtggcagcccttcgtctcacgacgacagccactccgactccaccaacggatctcctgtgagtgcttcgtgcgtcactgtgactgaggatcctaacgatctgaagcaaaagctcaaggaccttgaggctgaaatgcttgggccagacgctgagatagttaacagcctggagagctccgtgcaaagcagctatcgctggagccggagaagtgggcgcagatgatggactttcccaggggcaaactgaaggagctgctgcttgcttgtgccagagctgtggaagagaagacatgtacgcggtcgatgtgatggtgccggagctgaagaagatgggttcggtctcgggcagcccgctgagaggctgggagcctaatggtgtcagggctcgtgccaggctcgcctcctccggcactccatctacaagccttgaggtgaggagccgaagagcctgacggctgtcctaatgcattcctggatgaggcccgcccctaataaattcgggtactgttggcaa

SEQ ID NO: 10009 - DNA, 556 bp, Triticum aestivum
  Predicted polypeptide sequence is orthologous to G2636
attcggcacgaggcaagtcccaaagcaatttggaagcagcaagcagcgcaagaagaatttgttagagaaactgatatggcgtccatgatgggaggagactttgtggaggcctacgtgctcaagaacgcctacaaggagaagctgaggcgcatggaccaagccgaagccgcggcggcggcgctcgacggcgcgaagagcaggaaggacatggaggccgccggcgccgctggagagaataaggctgctgttggtggtggtgcgagcagcaggggaggcttctttggcctcatcaagaagaaggtgcaccccaaacccaaagcagcggcggctacttcctcttgattatattgctgttctgacatgccacgaagttgtaagccacagctgctagagctgccgcgcctttcttctagctaggatcaggagcgggtgtgtagagtttgttgtttcgatcagcttctcttggaagagtgtgtgtaaagcaagttcttttgttatttggtcaaaaaaagttgacaaaaactaagcgaagagtaatcctgcatcaaaaaaaaaa

SEQ ID NO: 10010 - DNA, 444 bp, Triticum aestivum
  Predicted polypeptide sequence is orthologous to G2640
taaacatagtggcaagcaaatatacaccaaactctcagcaaaatcaccagtacagcaaaattcccagaaaaatcagcgttacaacaaagtcatgcacctccctagctaggttcagaagcagggatactagagcatgcatgcatgcctagatccagcatgcattgcttcttccaacttcttcatcctaaagctcaagacgaatcatgaatagaggccaccatctccggctctgtacagctgctcagctactagctgctggccttctatgttgcacgcctccagtccccagtgccagggtgcacacctgcacactgccggccgccgaggagactgctgccgctggccatggcgactgggcgcggtggccgacaccggcgtggaagcagcagggcgcaggcacgcagtcattgccagcctgccggggaaggatgcagcgtccgtcga

SEQ ID NO: 10011 - DNA, 706 bp, Triticum aestivum
  Predicted polypeptide sequence is orthologous to G2650
cggcacgagggttgccgaaatttaatgaggagctcaagggaaaaaatgaaccaaggagaagggatccagagaaggagaattaagatgtgcctttcacttataatttctaaacactacaggaatcatgatatcgtgttagcataattgcatggttacgtgttagaagtgtgaatgtgggaggcttggccgggggattgtgagctggagattgtggaggaaaataaacaagactgatttgactgtaaaaaaatgttgatgtgctttttatgaaatatttggccaatcatgtgttgcaacgtgggcacatattttcatagttctatatcagtcatatctgacagagatctggatgttcggtatatgatatgtagtatactatgcagaccgctgttaaatatcatatacccagcccgtgtactacatatcatatatccactctgcacactacatatcatatacccagtctaatgaaccatgcggttctggcatgaagaaaaatccgtatatggattttttttcatggttcatgggaccaacaacattgaaagagcatttcagctgtatgattaggcttcttgaattctgacgtggagtatgtgatcgcgagctcacaggagctcggaatcacgcccgtccagaattgctatgagattcgtcgcattaaatgctatagccaagttggtgggtccatgccgacaaaggaaaa

SEQ ID NO: 10012 - DNA, 683 bp, Triticum aestivum
  Predicted polypeptide sequence is orthologous to G2655
ctagaatggattccattttcaggacgcggcaggtacacgacatgcacagatgcagggagcagtgcgcgcgtcacaggcttgcacgacgacggtctcctccttggcatcgatcagccatcagcatcagctcgagctgctgagtcgaccggcctcctcctcctcccgctgtatcctggccaggatctcatgcacagcggccgcaatatcttccacagagcccagcttggagccatcctccacctaccgtacgtgcatgcaaaacaaagaaagatcgatgccatcaccaccaccggacgccgttcttatatagaaacggaaacaaaccgtcgacgtgccacggctcgatccgtcgatctgtctccatcaccttatactccatgtaaataaactacttcaggagaaggttaattaccttaaggctgaaggaatacaggaccatggcgtcgacggtggtcacgttgagatggagcggcgggatgcgcagctgctgcagcccggcgacaagcctcaggagctgcttcggccgccgccgggacagcaccttgaggctcgcgtggccttccaccatggtcacctcgatgtcggccacgcccgcctcgctcttgtcgccgctcgaatcggcaccggagccgccgtcgctggcggtggcctgcgtggcattacacgaggtggagtactgtggg

SEQ ID NO: 10013 - DNA, 725 bp, Triticum aestivum
  misc_feature (253)..(254): n is a, c, g, or t
  misc_feature (257)..(257): n is a, c, g, or t
  misc_feature (259)..(259): n is a, c, g, or t
  Predicted polypeptide sequence is orthologous to G2679
ttttttttttttttttttttatgaaaatcattagtatcgatcaaattaattacacaatcacaagggacacctctatctttgcctacttttacacctcgggactgaccggtgctacaatggcgggccggttgccggaaaccggcaacagagactataactatccacatatacacatgaatagggaggctttgttattacaaatttcgtgggcgaacctactactttaacagtcacactgagctccggccttccnntanantcaaacaactctatgcggaggggtcacttgttctcggattctcggggtcgccgggggcttttggcctttccacagcttctgatgggaaggaactcacaccggggccggtggttgctccatggtttcttcgagcgtccagctccatagcatgctcggacgatgtgttggcttctgtcaacccggctgagttattagcatttatcttcccgcgtgtgataagcagccggaggtagtctcgaaaccctgtcaacaccgtcttttcttgcagagcgcttagctctggagtgtcctgatcatgaaatgctgatggaaatgaagttctataatctgatccaaacgcggtgccctgctcgtcacacaatagcgcctgtgttcctggagaggcaggtctataatcctcttgggtgttattgcaaggtgattcgagatcaccagcagtccgctgatctatatgggttgcaacatc

SEQ ID NO: 10014 - DNA, 605 bp, Triticum aestivum
  Predicted polypeptide sequence is orthologous to G2717
ggctgcctcccacccctcttcctcctcctcatctcatgccaccctcgcctagaacccctccgcctcccgatctccggtgcaatcttacgcctactccccgcgccccgatcgcctcctgaccctcgtcccatcggatcctccgccgaattgccggacgaatccatcgaattgcccccatcaataacgccgctgccctagaggaggcaggacgagacgagacccttgggggttggttgttgcgggggcgcggtttctggccgcgccgcggtgctctaagtgcgtgggatgggtgcgccgaagcagaggtggacgtcggaggaggaagccgcgctcaaggccggcgtggccaagcacgggccgggaaagtggcggaccatcctccgcgacacggacttcagcgccgtcctgcgcctccgatccaatgttgacctcaaggacaagtggcgcaacttgagtgttactgctggaggatatggctcaagagaaaaggcaagaatggcgttgaagcaaggcaagcgtgttcccaaggttaacattgaaccaatggacgttgatgcagataatctggacaatgttcatgatacagtcattgatgcaaaaccatt

SEQ ID NO: 10015 - DNA, 897 bp, Triticum aestivum
  Predicted polypeptide sequence is orthologous to G2717
accaaataccttggcctggggcagaccagacagacaagcggcaaactghhaggcaccgttcattcggaagattcgccgcaaaaggaaggtaaggtaatccaacacatggtgaatdaaattccaacatggcagttacctaaaccatgacagcaacaagggtccagaaagatggaatgaccatcatctgtatttattcaacttctcatcatcccacagcccgttcagatcgcatttacgtctctktaatgtgggagttaaatatgagtttgtcttcctccatccctcggcaaaccggcatgagggagaaaggtaactagcttcaaggtgcaagtyagaaaaccaagcaagtttgcgctgcttgaatctgggatgagcttkcatggattaaaataacagatcagcattgccatcagctcgatggctccagtaacaccaaagcatcagttagtttgcgctggaattcagcaaagatgcacgcgcgcacaacaaggtcagaggaaagcggacgctgaagcaggkcccacaagatgtktcaacctcgaatgatcaattttgcggaactcctgttttttaatgtcaacattgctgcytccgcaaaggcttktkcagcyacagcatcagcttctgcagcctccgcttccctcattgcggcttcagcytccgccatgatagcgtctgccttagcaaccgcacgagctgctgcagctgcagcctcttctgcgcycatgtttctcatccgtkcaagtkcagcatctacctkagadttggtgtgggckgtaaagcbatcccgctctaccttctctaccttggttggctccttttttatatyawcaagcagcagcattttggagcktcgcccttctaaaaaggacgagctaggggctatcctgtaccttc

SEQ ID NO: 10016 - DNA, 787 bp, Triticum aestivum
  Predicted polypeptide sequence is orthologous to G2717
ttcggcacgagcctagacctgccgccgaacgtgccctagccaccgccggcgcctcccgcgcgcggtcgacgtctccgccccacatcgccgcgcctccgcccccgccccgtccgcagcctttgcttcccagatccgcctccgatttgtttggcgacaggcgctgttgctttcgttgtaggaggaggaggaggaggaggaggaggaaggggagccctagccttctagggcaaggccgaagcagatgggggcgccgaagcagaagtggacggcggaggaggaggcggcgctcaaggccgggataggcaagcacggggccgggaaatggcgcaccatactcaaggaccccgagttcagcaacatcctgcgctaccgatccaacgttgacctcaaggacaagtggcggaacatgaatgtcaccgtgaacgcgtcgggcactcgcgacaaagtgaggacgacgacgacgacgacgacgcccacggctaagaagccgaggtctgctccgaagcaggaaacccactcgacggcgatcaccaccatcacctctgacggtgatgatgacgtcgtcgacgtgaagcctatcataaagcctattgtgacgtttactacaggttcagggaataaatcgctatccaggctagaaaatatcatactggaggccgtgaagaccttgaatgagcctacagggtcatacaaaacagccgttgctaattacatagaggaacaatactggccacctgctgattttgatcatgtactgtctgcaaaactgaatgagttgacatcatct

SEQ ID NO: 10017 - DNA, 851 bp, Triticum aestivum
  misc_feature (15)..(15): n is a, c, g, or t
  misc_feature (696)..(696): n is a, c, g, or t
  Predicted polypeptide sequence is orthologous to G2717
cacccggtagtgcgntaaggcctatcctaggtgacttagtataacaagtttgtacaaaaaagcaggctggtaccggtccggaattcccgggatatcgtcgacccacgcgtccgcgtgccctagacctgccgccgaacgtgccctagccaccgccggcgccccccgcgcgcggtcgccgtctccgccctacctcgccgcgcccccgcccccgtcccgcccgcagccttcgtttccgagatccgcctccgatctgctcggcggcaggcgctgttgctgtcgttgttgaaggaggaggaggaggagagggagccctagactcctagggcaaggccgaagcagatgggggcaccgaagcagaagtggacggcggaggaggaggcggcgctcaaggccgggataggcaagcacggggccgggaaatggcgcaccatactcaaggaccccgagttcagcaacatcctgcgctaccgctctaacgttgacctcaaggacaagtggcggaacatgaatctcacggtgaacgcgtcgggcactcgcgacaaagtgaggacgacgaccacgacgacacccacggctaagaagccgaggtctgctccgtagcaggaaaaccacccgacggcgatcaccaccatcacctccgacggcgatgatgacgtcatcgacgtgaagcctatcataaagcctattgtgacgttnactacaggttcagggaataaatcgctatccaggctagaaaatatcatactggaggccgtgcaagaccttgaatcagccttcagggtcatacaaacagccgctgctaatatctataggacgaacattggtcggcccctggttgattttgttcctgt

SEQ ID NO: 10018 - DNA, 968 bp, Triticum aestivum
  Predicted polypeptide sequence is orthologous to G2754
gcgcttaccgcgttaattattttcaactattacgagactgtatatggcagagttctggcaacacacktacaacctccttcagaatagactaccctaagtgcataacagtcttactacatacagtatagcttgctgacccaaagcaaatggggaagaaggtgcgggctcaagtttagttagagcacctaatctacgggtgcaacgcccggtcaataattacttccttttggattcttttcgagatatgttaccacatactgtatcacatatgccatgcggtcgataattacttgggcggataatgttttcccccaaacatcaactagctagcggtgaccaagccgaatcacccgaaatgccgaggcgtcgtcgtttctaggccagggcggggctcagctggtgagcgccgagagcacgccaccaccgctcttggaggccatcacgacctcccagccaggccctttcagggggataagagggggggcatcggcggcggcaggcggcccggtgaggtcgctccggtccatcaccttcaaaaggtcctcgtcgctgatgtcggtctggatcatcctgtcttcctcgtcccgctcgtccctcagcagcgcaasagctcctcctcatctaagacgttaggcttcgcgctattttgttcaaactgtcccttcccgatcacaacgtgctctagcttcagctttccaaaagctctcttgataatccgtccctcaacagagttggatgttgccaaccgataaacatgcactgggcgcgtttgaccaatccggtggcatcgatccatggcctgcaaatccatctgaggattccagtcactgtcatacaggatacatgtatcagcagaagcmagaattgattgcmagcccaccggcacgagtgctcagaataaagacattcatactgctgttcaacgtcattaaactcygctatctgtcycatcctgtcttctaatttaa

SEQ ID NO: 10019 - DNA, 1128 bp, Triticum aestivum
  Predicted polypeptide sequence is orthologous to G2754
ccgagagcggccgcccttttttttttttttttttccagactaattcagcagccactagtagtttcataacagtcttacatagctactagggtggttgccttggatgaaagagctcgagttacatcacaacacagctcgccaaaggatcgatcagctcctaatctagggggtgcaacgcccggtcgtccataattacttaggggggatacatcatgttcacaaaaacatcggccttaacacaggcgacgaacaaagccggagcaccagtacaccgagggcgtcggtcgtcgttgccaggccggtgactggggcgggcgcggggctcagctggtgagcgctgagagcatgccgccgccggcagccaccacgacctcccagccaggccctttgagggggaagtgcggggcggcatcagcggctgcacgcgcgccggtgaggtcgctccggtccatcaccttcaggaggtcctcgtcgctgatgtccgtctggatcatcctgtcttcctcggcctgctcgtccctcagaagcgccagcagctccccctcatctaaggcgttaggcttcgcggcatcttgctggaactgtcccttcccgatcactacgtgctctagcttcaactttccgaaagctttcttgatgatccgtccctcaacagaattggatgtcgccaatcgataaacatgaactggctgtgtttggccaatacggtggcatcgatccatagcctgcaaatccatctgaggattccagtcactatcatacaggatacaagtatcagcagaagtaaggttgataccaagcccaccagcacgtgtgctgagaatgaagaattcataccactgtttaagtcattaaacgctgctatcgggtccctcctgtcttccacctaacataacatcaattcggcgacccttaaggcctttttaagacaattatagttaaggatgtccaaaattttggtccttgtaaaaaattcgggagcgtgggttgacaaaatcccgggaattcggaacggtaccaccctgttttttggcaaaattggttctaaaggttccccaaaaaagcccaaaggggcaaaacggttccctggtgaaaattttatccccccgcggggctaagtttaactta

SEQ ID NO: 10020 - DNA, 532 bp, Triticum aestivum
  Predicted polypeptide sequence is orthologous to G2766
ccacgcgtccgctctctccggtgctgcagtcacacacacgcccacggccaggcattcacctctctcttcttcctccacaatgaaccaagcaccactctctgctggaccgtggcggcagaatcgagcacgggtgcgcgcggccgtcttgctcgtgactggtggctgcttcgcgttcgtcgacagattgcgatgctgctgctgctcgtatgggctcccggtgaccgggccagcacgcgctggggctggctgggctcctagcagccggcctccccgcctcctccaacatcgcctggagaggagctcctctgtgcttccgagccgcctcctcgagcagggcagccagagggaagggagtcgccacatggaacacaactggaacgccccgccttggagctcactgcctcctggccgccgtccatctcttggtggtgcctgttaggcaggcattgatgcttatcctcggctctctctctgtcagatgtctccttcaggccgaggaggatgagtggggctctcgcaactgggccgctgc

SEQ ID NO: 10021 - DNA, 836 bp, Triticum aestivum
  misc_feature (622)..(623): n is a, c, g, or t
  misc_feature (836)..(836): n is a, c, g, or t
  Predicted polypeptide sequence is orthologous to G2766
cacaggctattagctttaggcctatctaggtgacattatagaacaagtttgtacaaaaaagcaggctggtaccggtccggaattcccgggatatcgtcgacccacgcgtccgcgacggcgacgacggcatggtcaccagctacagcaacatcgactcccagtttggctcgtctctggacatgcctggcatggacgactacctgcagctgcagcaggactccgtcgcctgcagggtccgcgccaagcgcggctgcgccactcacccgcggagcatcgccgagagggaaagaagaacgaggatcagcaagaggcttaggaggctgcaagacctcgtgcccaacatggacaagcaaacaaatacttctgacatgctggatattgctgttgactacatcaaagtgctgcaggaccaaatcgagaaactgaaacaggaccaaggaaactgctcttgctcagccgatcagaagtgctgacgccgaaacccagatatgtgaggttatgtttgtaccaatgtgattagcaagcccaagttttgcttcgggagattaagttgtaaatgcccttcgtatctcaagtagtctccatatgcctatcttcccctttcgtggttgtactatggatnnactagttcaatggcttaaagactaggaggtgacaagtagagtgttgtaatttgagtatgtaaggcattgccaatctttcatttcaaaaaaaaaaaaaaaaaaaaaaaggcgggcgctctagagtttccctcgaggggcccaggcttacgcgtacccagctttcttgtacaaggtggccctatggtgggtcgtattataagctacgcactggcn

SEQ ID NO: 10022 - DNA, 529 bp, Triticum aestivum
  misc_feature (444)..(444): n is a, c, g, or t
  misc_feature (460)..(460): n is a, c, g, or t
  misc_feature (471)..(471): n is a, c, g, or t
  Predicted polypeptide sequence is orthologous to G2768
gcaacttcttcggctgcgatctccggcatggcagcgacttgttcgtcaacaaccactggttcgggagcggcctcttgtggtatgaccggcgtcacttccctgggcacaaccgtcctcgtgcctggctccggtgttcccttggagtggttgcgctgcacccagcggttgccagtttggtggcgtcggcacacccagctgttgccgtgatgacgacggcggaagccaccaccagggccggagcggcgtccggggcacccagcggttgcggcggcggaggctacaattcctgtccaaggcggcatggcggcgagtgccaaacgccccggcgatggtaagcacaatgccgaattacaaacctggggcgatggcttcttgcgacaaccttgcaaaagcaaatgctattcccgcaaattgcatcttctcaactgtttctcgtactttccnatcctcctaactctcngttcaaaatanttaatgatgtacgtcaacctatatacatgtaacagctgtaactcgtaaaaaaaaaaaa

SEQ ID NO: 10023 - DNA, 691 bp, Triticum aestivum
  misc_feature (215)..(215): n is a, c, g, or t
  misc_feature (218)..(218): n is a, c, g, or t
  misc_feature (285)..(285): n is a, c, g, or t
  misc_feature (399)..(399): n is a, c, g, or t
  Predicted polypeptide sequence is orthologous to G2768
ttttttttttttttttttttttttttttttgtggaaaagaaatgcagcacaatatattctccgttcttacggtttgggttacaggatggcgagagggatggcaggagacgatatcaggagctacggttatagcaaagggataactagggagacagtcaccaccatgctctggcatggcttgtcccctaacattgtgccagcttgcgcaaggctantgnagatttacagacagtgtttcttcggctcctcaaataagaaattgttagagactggatgagggaatcnatctactgttgctctccgaagtagtagctagtacaaatcgattacaggagcatcgctctcgaatggagaatgaacaggggaagaactagggttggggaaaaggaaagtaggtanccgccggttcgtcctgatccactggatggtgtgctcttcgtgtgtctcccctgaagtagtcgtgctcgcgggctcagttgttccattcaggcccgtgggtgcgcgggctgggccgcttgactcgtgtgggccgttgggcagctgtagagttgttgtggtcgctgcccagtgggtccctctcgtcaggggcgctaacatccccctctccttgagatgaggcttgtccccaagcctctgcatgcgggaagcacgccatgaggctggccttatcctcccaggtggtgcccaaggt

SEQ ID NO: 10024 - DNA, 1062 bp, Triticum aestivum
  Predicted polypeptide sequence is orthologous to G2768
ccacgcttccgcggacgcgtgggcggacgcgtgggcgctgatcccaaatcacagagccacaccacctcggctgctttggaaagggacacgaagcaatgtatggacaaccagctatcgcaagcttctcccgacgcccgcctccaggtcgccacagaaggtgatcaagtcgaccggcctcagaagaattctgatctgaagagcaacactgaaggctctgcagggcgatcagtagagaaagccatacctaatgctgacctacccaaactgaaggatgtgagcgaatcaactatgaagaatggtactatttcagggaccttagaaccaaaagttgctaagactgatcagttgaagaagaagcgaaagaaggcagactcatctaaggctgttcatccaaacaatgttgattatggttacaacgttccatttgaccctgcatattgtaaccctttcaacggtggatatcaaatgggtccatttggggtacctgatccatacatgtacggctcaatgggcatgccctatggtggtttcccgatgggtccgtttggtatgaatccctttggcaatattccgccgcaggctcttgccatgcaaggctatccgccaaactatcaaagctgggaaaaccaggccgcgttacaccgtgatgccgaagctgctgcacgctcaaggcaggtctcccagggaaacgctggagctgctgcacgttcaaggcagaccgagaggccacatgactctggtgcttggccccggccatcagatcgcaaccagcgcatgggctctccctcaggcaaccagcgcatgggctctcctcaaggcagagagctgagggacaggccccagtcaggacctgaggcatcagagcgcaaccagcgcttggggtcctcctcggggccgaaagtccagaacagggtcccggctagatctaaaccatcagagcgcagccgggcttggtttctcctcgccgcagagagtgagggaagtcccggccaagaccggggaagagtattaaggacatggggcgttccgacgaaggtccagtgactccccgggggttcccca

SEQ ID NO: 10025 - DNA, 566 bp, Triticum aestivum
  Predicted polypeptide sequence is orthologous to G2771
ttactgtaacacttgtacacaatagcattagcaaaggttcaggagcataggtttatgcagctacagtacaacaataccagtattattatagagatattaaaggagcagtacttaataaaagagacactgaaaattgaataagtagtaatatcaaacaaatatttatacgtacgaccgtgaccaaagtcctctgttacttaaacctgaaaaactgaaatcgcgaggagtcaggctccatagatgtttccatgtccagaattggatcactacacttttgccctcaacagtcgaatgatctgccgctaatagactaactgaagcacccaacctcatatagccgcagccagtgacgcacatcacattgaacaaataggggaggagccggtgctcacccgagggaaaccagcgtcagggacgaccacgtctgggtcgaggtggggagctccgacggcgagtgcggtccggagtggaatactaggcggaggcggcgtgggttgtgttgctgtgctcgatctcggcctggtctggatttgttctcaattacacagatcgagcgccgaccgatt

SEQ ID NO: 10026 - DNA, 673 bp, Triticum aestivum
  Predicted polypeptide sequence is orthologous to G2771
aaaaatcaaataatcccaaaacattatgagtagttttctggaaaggaggggttcaacaagagatcacttaaattgcataataaagaccaccattttgacatatcaagtaattccatcctatagacacaaacctcactaccagtctgtcatgcattcctaaaacggtatgcctctccagcggtcacatgtgcacggctgggaactttccccgagtgttttgtctgcaagagatggtcaaattacacgatctgtgaatagacggcacacccagctagtatttaacaaaaaaaatgccgttgaattcccatcatgtagaagaaggcactgccaccatgaaacctcatttttcgctgaagtcaaggtctattgcggatcaatgcaagcagcttcaatgttgaacctcaaacatattgtgggcactgtgatacaggatcagcagcaacagaacatggccgtgtctggcctggggaggatcagtagcaacagaacaaccttcaccaccttcttcctcctctccaatgcctggacctcccctctccttgacctcacgaccgcttcaatccacctttactgttgcaatcaggaagcacgacctgcaaaggcggtggcagcggcggtgactccataatatggtggacgctgcaggcgcgtcggccagggaggcgacgtccgg

SEQ ID NO: 10027 - DNA, 561 bp, Triticum aestivum
  misc_feature (4)..(4): n is a, c, g, or t
  Predicted polypeptide sequence is orthologous to G2771
aaantgaacacttggagattcattctttcatggtgaaaaaaatgtcatttatttacaccaacagacaaccaatccaatctgtttgtttgacattgacgaaaactactgccgcacaatacaatctagatccaaattttacaacggtgtattactgtagcactcgacaagaccaacatcaccagccatttgatccaaattttacaaaatcccagaaccaagaccaccaacatctccatttggccgacacccaatggaaaagaaaaaaagatgaaaatgtctatccgagcacgagcagaagatctatattccatcaccgactatcttgttcaactcagtctacctcttgattgctggccaaactccaaaactctagtttggcaggatattcttcttcctgggactgctgaaccgacccgggcacttgaggtgctcagagaggatggtggggttgatcaaccactgtcttggctatcttccttgaggtgctcagagaggatggatgggttgatcagctggtcgtatgtggtccggtcaagcagcatcccatggggcaccttctcc

SEQ ID NO: 10028 - DNA, 816 bp, Triticum aestivum
  Predicted polypeptide sequence is orthologous to G2771
acgctatgacattaggcctatttaggtgacatactagaacaagtttgtacaaaaaagcaggctcgtaccggtccggaattcccgggatatcgtcgacccacgcgtccggcctggtgatccaaaggacttgaaactacagtgctctcctaaagctaacaaccttacatggtgcaagcagccagtcgtctattcaaagaacagatctgacgagttgcagcagtggggatccaacctgattaaccgtttccagataggagggaggacggtatttgatcttgttgagcaggcaagagatacagaggactggaaagtggagagctcttgtgatgctaacaacctttctggcggcaaggacaagggcggatcttacgaggtgcagcaggggagatccaagcccattaaccgccggcaaaggaagcggaaccaggcacggggcagggaagctggccgtgatgaacgattggtggttccatattgccgccaactggagcagtatgtgttgattttcttgtgcctgctcttcattgcctacatctgtgcaccgatcactatgaagtggttaggccatggccctttagtatcctactagtgcatacattccgtctaatatgtgcacagtatcgtcatatctgcattatgtaagaacatacttgcattatgtaaaaacataagcttatatgaggggatgcctcctgtgcgtggagtagcatgggatggtactgttgtggacaaaaaaaaaaaaaaaaaaaaaaaaaggcggccggctctagatatcccttcgaggggcccagctttaccgtacccagctttcttgga

SEQ ID NO: 10029 - DNA, 657 bp, Triticum aestivum
  misc_feature (327)..(327): n is a, c, g, or t
  misc_feature (383)..(383): n is a, c, g, or t
  misc_feature (415)..(415): n is a, c, g, or t
  misc_feature (424)..(424): n is a, c, g, or t
  misc_feature (458)..(458): n is a, c, g, or t
  misc_feature (492)..(492): n is a, c, g, or t
  misc_feature (507)..(507): n is a, c, g, or t
  misc_feature (575)..(575): n is a, c, g, or t
  misc_feature (591)..(591): n is a, c, g, or t
  misc_feature (600)..(600): n is a, c, g, or t
  misc_feature (606)..(606): n is a, c, g, or t
  misc_feature (612)..(612): n is a, c, g, or t
  misc_feature (615)..(615): n is a, c, g, or t
  misc_feature (635)..(635): n is a, c, g, or t
  misc_feature (638)..(638): n is a, c, g, or t
  misc_feature (645)..(645): n is a, c, g, or t
  Predicted polypeptide sequence is orthologous to G2783
ctcgagttttttttttttttttttttggttaaattacttgattcataataacttcttatacaaaacacacactgaaattacaaaatcttgataaagcaacacaccaacacaccctcacactcgcctgacacagcgacacacacgcacatctgttattctgaactcccaactctgcagtgcagataataaacggggcttcgcgggaatggcagaagacctaacgataccacgcatgcaaaccaatcataattagcaccgtccaccactcactgatcaccaacccgctggatgatgagattcatcactggggcaagacgggggggttanaacgacccagtgggtgcccgttggtatccaccaacgccgccaccgctaccgtaagnggcgttgggaaggacggttggtatctgggttnggctgccgnttcggtcccggctaagatgggccttatccgggtngggctggggctttactcccgctttggcggaacgnttcttgtggtggaantcccatattgctcctgatcggcccacaaggtcatggacccatccaacgatccccgacgctgcgtgttnccaacgacaaccaagngggccccgnaagganatttgnggnctgcgggaaggcctttgagnggncttactncaacatcggcat

SEQ ID NO: 10030 - DNA, 1344 bp, Triticum aestivum
  Predicted polypeptide sequence is orthologous to G2783
gcacgagagcaaactggacagcttcagggctatggctttgtcgagtttgcaagccatgcagcagctgagcgagttcttcagacattcaatggtcaaatgatgccaaatgttgagttggcatacagactgaactgggccagtgctggtgaaaagcgtgatgataccccggactatacaatctttgttggggatttggcagctgatgttacagactacatgttacaggagacattcagggtacattacccttcagtaaagggcgcaaaggttgtcactgacaagatgacaatgcgttcaaagggttatgggtttgtgaagtttggtgatcctacagagcaagctcgtgccatgactgaaatgaatggaatgccctgttcttccagacctatgcgcattggcccagcagcaaataggaagacaacaggggttcaggagagagtaccaattccaaatacaaatactcaaggagctcagtctgacaatgatcctaacaataccaccatatttgttggtggccttgaccccaatgtcactgaagatgccttgaaacaagtgtttgctccatatggggaagttgtccatgtcaagatccctgttgggaagagatgtggctttgttcagtatgctaacaggccttctgctgagcaagctctgcaattgctgcaagggaccttggttggtggtcagaatgtgaggctttcatggggacgaagcccttcaaacaaacaaactcagcctcaggaagccacccagtggggtgcaggtgctgctgctggtgctgctggtggttactatgctggatatggacaaggctacgaggcttatggacaagggtatgcacagcctcaagaccctaacatgtatggttatggagcctatgctggttatcccaactaccaacaaccagcagcggcaccgcagccaccgccaccacaacagtgagctctcctcgttgggtcgtccagacagatgagaacccctgtttgaaggcactgtcaaggctaatgttgtagcacctgtcgatagagagagacggttcctggactccggattttgattgccccatggcaaggtctattgttctgttattatgcactatgttatgatcagctgttgtccgtcccattgtggtgatcctttggatatgtacttggaaacttagctttgtttcgccgcatgtccttgtctactgttatttaccattgctatcttgtgctgttaaattatatactattgtaccgtttgcttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10031 - DNA, 1160 bp, Triticum aestivum
  Predicted polypeptide sequence is orthologous to G2783
gcacgagctagtctcgagctgctgcggaatatgctctggggacctttaatgggcagatgatgcctaatgttgaacaagtttttaagctaaactgggcttcttgtagtgctggtgacaagcggggtgacgatggttctgatcacacaatatttgttggtgatttggctgctgatgttactgacgccatgttggaagagatattcaaagccacctacccatcagttaaaggtgctaatgttgttactgacagggccactggtcgctccaaaggatatggttttgtacgctttggagatctaaatgagcagacacgtgctatgactgagatgaatggagtgccattgtctacaagacaaatgaggattgggcctgcagctaacaagaagaatataggtactcagcagacatattcaactaatgggtaccagagctctcaagtaaatgaggcggcgaatgatcccaacaatactacaatctttgtgggcgggttagattccaatatagatgagaactatctaaggcaagtttttactccatatggcgaagttggttatgtgaagattcctgtaggcaagcgttgtggatttgtccaatttaccagcagggcgtgcgctgagcaggccatcagtgcgctgaatgggtctcagattggtagttccaatgttcgcctttcatggggccgtagccaaaacaaacagcctccccagcaggatgcaaaccagggtaatggcaacagctactatggatatcaacagggtcctgatgcatactatggtgcacccaatgcgcaagatcctagcatgcaaaactatggatactctggttatggcagttacgagcagcaacagcagccatctcagcagcagcaacctccacagcagcagccaccacagcagcaacagcagcagcccccacagcagtgaccattgaggcgatggagcgcaatcagagattcagagctgcatgaactgaatgctaccgcgtcatgagttatcgtataggtgtccttgtttgtaagatgggtcgtatctagtagtactttgactgttgggcagtagctctagttctattcagtgcttctcttggttttaaattatcgaactatgtccatgactgagttaagcttttaatgttattttggatcaccaggttctaaaaaa

SEQ ID NO: 10032 - DNA, 522 bp, Triticum aestivum
  Predicted polypeptide sequence is orthologous to G2784
gtggaagctgcacacggtgtccgccgccacggacaggaacggcaaggtcgtcctccggataagaagatgaacttggtcatgcaggccttctccaacgccaaagaatgcgtggtggaggacgtccggccgtgcgcgccggagaaggcgagccgggaggaggacgcgacgtacccggtggaggtgaggacgagcaggggcaaggtggagctccgcgccgacgactacgccgtgtacaagaggtgggtcaccaccgtgacgcacatgctcacctcctccaccgccatcaccatgcgcaattaaccatcgatcgatcccgccactgccgaccgatcgaatccaatccactgacgtacgtgcgcgaccggaagtaacaaaggggtcgtacgtgtacatgtgttcgatttcagatctcacgcttctggttttaatcccctcccagattgatgtgtaactaaatttagcctcttgatgtggtgactttgtcaattttaaaatttgttggctcggtctttaaaaaaaaaa

SEQ ID NO: 10033 - DNA, 318 bp, Triticum aestivum
  Predicted polypeptide sequence is orthologous to G2784
tttttttttttttttttgtaggagctatagtagtagagggattgaattatagaaggagagaacgaagtgtcacctactcaccttgggtagttgggttggataaaaaaggacaaccctctcctcctcctcaataatgccacttacaggatccagcatcttgttgttgcggggactcgctgcacttgggcagggaccgtcctgcaggctttgcagacgaaggcggggctcggccacgagccggccgccgagatccaggaaggagcccaagtgcagcggcggcagtcatgtcgatgtatgaagttgcacggggtgatagca

SEQ ID NO: 10034 - DNA, 1088 bp, Triticum aestivum
  misc_feature (715)..(715): n is a, c, g, or t
  Predicted polypeptide sequence is orthologous to G2789
cccacgcttccgcgactggagcacgaggacactgacatggactgaaggagtaaaaaaacgccaacgcccatagttccgtcccataccatacaaccactcgctagcaaccagaaactcactgccgccgccgccgccgccgccgccgcttgcattggagaagctcttgcaggagcctaaggctgtgtgtgccatcttcgttcctcggcgacgaccgcgaaaattgtagggctggcagactggtggccggccggcgcggcggccgaagcccaagccgaggagatggggagcatggacggccacccgctccagggcaaccacgcctacgcccacgtccctgccggcagcaacaacgacgaggacgacgcgtcgccgccgccctcggccggcgggggctcctcggggtcgggccgccggccgcgcggcaggcccccggggtccaagaacaagcccaagccgcccgtggtggtgacgcgggagagccccaacgcgatgcgctcccacgtgctggagatcgccagcggggccgacatcgtggaggccatcgcggccttctcccgccgcaggcagcgcggcgtctccgtcctcagcgggagcggcgccgtcaccaacgtcacgctgcgccagcccgcggggaccggggcggccgccgtcgccctaagggggcgcttcgagatactctccctgtccggcgccttcctcccggcgccggcgccgncccgggcgacggggctcgccgtctacctcgccggcgggcaggggcaggtggtcgggggcagcgtgatgggggagcttctcgcgtccggccccgtcatggtgatcgcggccacgttcggcaacgccacgtacgagaggctgccgctggatcaagacgcgaggagggcgccgtgctgtccgggtcggagggcgcccccacccacctggagcaccaggcaacgggggcgccgccgtgccccgccgatgtacgcggtgccccaaacccccccctaccaacttttcggccattggggcaagcggccgtggccggcctccgccaatttatcttagcccttacccgggaaggtgaatcggcccgccggttctctaaccta

SEQ ID NO: 10035 - DNA, 684 bp, Triticum aestivum
  Predicted polypeptide sequence is orthologous to G2791
ccacgcgtccgcagtgagtgaagcacaagggacactgattccttcaaagataagctcaacgatccataacaataaaagtgagtaccctgtccctatcagccattctgctgatgcgcagaacaaggcaaattcagctaatggaaatagtgccagtgctaagccacgagcaagggctcgtcgtggacaggcaactgaccctcatagtattgctgaacggcttcgcagagagaagatctcagagaggatgaaaaatctccaagaccttgtaccaaattcaaataaggcagataaatcatcaatgcttgatgaaataattgattatgtgaaatttcttcagcttcaggtgaaggtcttaagcatgagtaggctaggagctcccggggcagttcttcccctccttgcagaatctcaaactgagggccatagcaattcatctctatcacctccaaccgcttcacaagggcttctggatgcagcaggcccagaagacagcttggtctttgagcaagaagttataaagctgatggaaacaagcatcacaaatgcaatgcagtaccttcagaacaagggcctctgcctgatgcctatcgctcttgcttcagccatatccaaccagaaaggcacttctgcagctgcagtccctcctgaaaggtgaaaacagaaagcacatcatgctcctcccat

SEQ ID NO: 10036 - DNA, 632 bp, Triticum aestivum
  misc_feature (7)..(7): n is a, c, g, or t
  Predicted polypeptide sequence is orthologous to G2802
tgcaggnaattcggcacgaggagaaggtggactacacgcggtacctggcggcggcggcggcccccaacacggagcacgacatgggcggcgacaacagctcccccgacgagcagtggttcgtgcggttcggcgaggtcatctccaagcacaccatgtgacgcgacacgcgaaccgacgacgccccccaaagtcttctcctccccaaggtgtagcgagagccggaagatgcagctaggacagcatagtagagcacagtgcagggaaaataggcctagggtttctttctgagtagtacatggatggatggtgccattgctcttcctcacaccttcccattttgctcttcttcttcttcttcttggtggtgttgattatcagaagcaagcatggtggagctcttgctgggcattcatggcgtggatcggtcaggttgagagtgatccatctcgtgagcgccttgaaggcccctagcaaaactttatgcgctctgatgatgacgatgaccagaggcagagggggagatactactactgctactgctgtgacgatgatgatgggttgttggatcctgtgagcgcattgaattgtattgatcgaaccccatgccctgccgcatgatgcgtcgtcggcaa

SEQ ID NO: 10037 - DNA, 689 bp, Triticum aestivum
  Predicted polypeptide sequence is orthologous to G2802
ataactttatttcttggaaacaatctcgaatgtgaatccaactcgttacaaagtaaagtaacagtaagcaattaaaactaaacaattttgcgtcactaaaaagaaaaagaagcgtctcaaactaagcgaaaaacaaagttaatgtacatgcaaacagtattactttttacaattgaaaaatatctaatgcacatcaaaagttgtgacaaacaatgatgtgcttataatcaaacttggattaaggttcattagttatgcttctatcaggctccattctgatgtcagcacaacaatgcctttccccaaccgttctcctcctctttcccctcaacacctttgcaaagttaaattgtatccttttccccccattgacagagcaagatctatgagatctcccggttcttctcccaattaacagtagtgcattctccaagaaagcagtaccgtatattcaaggagggagagaccatactagctagagaaagaggtcgtggttgcttttgtttaatctggtatttaccagtcttgttgctactatccatgatgatcttggttgtcaggaggccagtatgggtaaggccattctgtctcttgggagtgaggaatcgaagtctctccttttgtgcatgtagacgtgcaccccattaccagttcttccaagccagcagacctgcggtcaatcttttgct

SEQ ID NO: 10038 - DNA, 573 bp, Triticum aestivum
  misc_feature (543)..(543): n is a, c, g, or t
  misc_feature (572)..(573): n is a, c, g, or t
  Predicted polypeptide sequence is orthologous to G2802
tcgagcggccgcccgggcaggtgaattcctgcgatttcagatgcaatgatcagttgtactgcaatccagggatgcagcaggccaggacaatggatgacgatggtgttatgagtggccaggttttggggcaaggtgccggcgactctatgggctgtgtaaaaccaggttctttaaaccccccaggctgccgtgggggccaaatgctgtaaacaggtcgaggactccgaggcgcctattgtctccttgcgagagactattggcttccccgtacaaggaggattgtataaattgctggttctaccagagggccgcgtttggttcaaactgtcgtgtttgtggctctgttgccaatgatgccttctatggtgcccggggcgccacaagttcattagctatgatgctgtcaagacatccccctttattgttgcttagttccagccttggtaatgttcttggagttggacagccttcgctcctagtcctagatgctcgccgataattagtagaacagaccgtgtttgaaggtatcttgaataatttagntttcagcacccaggttttgtgcgaagatnn

SEQ ID NO: 10039 - DNA, 204 bp, Triticum aestivum
  Predicted polypeptide sequence is orthologous to G2830
acggatgttgtcgatacaggcagttttttgcattggtattgaactgtaggactgtacagtggtggtatgtagggtgagtagcaggtaaagttgtaagtatgtgtagtacgtgtgtaggcgaagctctgaattctttggtctccttggacgcgcgtacaattcacaataattttggcttggaccttgacgcgcaaaaaaaaaaaa

SEQ ID NO: 10040 - DNA, 699 bp, Triticum aestivum
  misc_feature (35)..(35): n is a, c, g, or t
  misc_feature (43)..(43): n is a, c, g, or t
  Predicted polypeptide sequence is orthologous to G2834
tcggcacgggggcgcgcacggcgaccgattcaagnaccctggnacgcgctctcccggcccggtcaggcaaagccagttgatggccgcgatgtgcgcttttcctgtcctttcacggggtgcaaccggaaccgtgcgcaccaccgcttccggccgctcaagtcagcggtgtgcgcgcgcaaccacttccgccgcagccactgccccaaactctacgcgtgtgagcgctgcggtggcaagaagcgttttgctgttcttgccgatctccgcggccacctccgccactgcggtgaggaggcacagtggcgctgctcctgcggcaccaccttctcccgcaaggacaagctgttcggccatctcgccctctttgaaggccatatgccagccatgtcccctccgaacaaggatgcagtgacaacgactacagaggcaccccttgatataatggatgaaggaggaatcgaagagcaggaagatggcggtgaaggtggttttgatccggagttcttcaaggagtggatggaggagctcaaagatgatggcgtgcctgctggtggcacagtctggcctggacgggcagcagctgggcaatagcctgtgttgcaagttctgtttggggtgtatggtaacagccgcaaggggcattggctgccaaagtgtctgaaagagcggtggggagatgcttctgaagaacagcacaga

SEQ ID NO: 10041 - DNA, 699 bp, Triticum aestivum
  Predicted polypeptide sequence is orthologous to G2834
cacttaagaaagaagcatggaccaaaatggctccctgaatagaggaagaactgagacggtcatacatataacattcatacataacaatcgacaccatcatggttgtctacggcgacgaactccatcagctgtctccactaagctgcccaaagctgcaagaacccggtcctgaaggcaggaaggagaaggggttctcggagatgtcgaatccaggtcgggcgaagtcatcgagggcgccgaagcaggggtcgaagttcaagggagagaaataaccacgtgtgtcatcggcaactttcatgtctagattcggaataccatcagacgtgctgcctgggaagttataccctgtgctccccaccatgtcgtccatcgcctcgctcctctgctccgatgctcctgttgctttaatatcatccattggaagagcaggtgtgtgcccttggaaaagcgcgacatggccgaacagcttgtcctttcttgagaaagttgttccacatgagcagagccacttgtcacgcccacagtgcttctcatgagtcttcaagtccgcaatgactgagaacttcttggtgttgcatcggctgcaggtatacctcttgtcgcaatggcttctcttgtagtggttcttcacacacaagattgtcttgaggggctggaacttcctgtgctctttgttgcgcttgcaaccgacatatgggc

SEQ ID NO: 10042 - DNA, 1080 bp, Triticum aestivum
  misc_feature (1031)..(1031): n is a, c, g, or t
  misc_feature (1059)..(1059): n is a, c, g, or t
  Predicted polypeptide sequence is orthologous to G2837
ccagagcggccgccctgtatctttatgattttttcttttttttttcctttttaatttttaccgaaaaaggcttgcgccccgctttataaataaagcacccaccaaggacaaagtatcaaggtaacaacagaacacagcgcacacacaaacgcaacgccaccgcaagtcatgaaccacaccaacaagcacggacacacacacaatacccaagttccgttgtgggcacggcacatcacgcccaacacaaaaggacgaagacacaatctgagacgatgggggcggagtggacgacatgacgatctaatctggttccggaggaggtgggggaagcggcggtgtcaatcggagggccattagctgggtgatgatggaggtgatggcgtctctctccctgggccggctaagcggccgccaaagcaagatgatgccggccttcggggtccgcacggccactgtcgtgcgcgcacgccatggccaggacgccgccgcccttcgcggtggctcgtggaatgaaacagcagccgccgctgccattctcatgcacgtgcgcatcgcctggcctccgcgcctcggatgtcgccgcctccaaatgcttgcgccggcagccgccggcgaaatgccccacaattgcgtcgccgggtcaccggaactaccctcgacggaggagcgggcgggacgaaatccttgtgcacgctggtccgccgcgccgccgtgtcttatctgggggcacccctcgcccgtccccccggaatggagctctctctcgggagcgagtgaatcgggaccaaaagggggatttctaaccccttcagcccatgtcagggtcctcgtggcccaatcgcggacgcgtgggtcgagtattctccgggaattccggaccggtaccacctggttttttggaaaacctggtcctttggggccccaaaaaaggccaatggccaagcggttccccgggggaaaaggtttcccgccccgggcctaggtaaaaccccaggggtgaacggccccgggttttttttggtggtaaaaantccgagggcggccccccgcacttgacgntccaaaaacaagcctgttttt

SEQ ID NO: 10043 - DNA, 879 bp, Triticum aestivum
  Predicted polypeptide sequence is orthologous to G2846
gcggtggcggccgctctagaactagtggatcccccgggctgcaggccgacccagaggtcaccgcagcctctcctgcaggctctagagcccaaactcctcaagtctagcactgaacctgcggatcaggacgcctgctcgtcgtcatcggcgacgagaaggagcagcgcggcccctccggcagcgaagaagccccggacagaaacgccgatgccgactttcaaggtgaggaaagagaagctcggggacagagtcaccgcgctccagcagctggtctcgccttttggaaagacggacacggcatcggttcttcacgaggccatcggatacatcaagttccttcacgatcaagttgcctctctgagctctccctacttcatcaggtgtagtggcggtccggtgcagctccagcacaaacaggcttcggatggtgacgccggcgaggcgaaggaggacctgcggagccgcggcctgtgccttgtcccggtggcgagcacttacacgatgggcagcgagacggcggcaccggagttctggcaccctaccttcggaggcacgtttcattgattctaataagatccatagacatgcaagtagtatctagcacattatagccaactcagctagctagacagccatgcatatatgtgtgcgtgtgattgtgtgtgtgtgtgtgtgtgtgtgcgtgtgtcggttaagcaatgtgtactcatggtctcatgccacaccactaaatcacagtgttgaagcaaaagcggaaaatagcttttaagcgcaatcaaaaaaaaaaaaaaaaaaaaactcgagggggggcccggtacccaattcgccctatagtgagtcgtattacaattcactggccgtcgttttacaacgtcgtga

SEQ ID NO: 10044 - DNA, 491 bp, Triticum aestivum
  Predicted polypeptide sequence is orthologous to G2847
gctcgcattcagcttgtcactctctgtctctcttgtagctcggctcagttgttctgttccctgcaagccgcgaccgatccatgtcgagcctgatagatatttggacggtggaggtggacaggatccgggccatgaggagaacggtggagccgttcagacccacggcttcgcccggcgcacaagaagccggccacgtagctcagccgtccggcgacggagccaaggatcaggctgctggtgctggctcgccggcgtcgccggtgctcgtccgggaggacgccttcttgtccatcctggttgattgtttcggtcagtagattgcaccggtcgaacgctatgcagcaacacgttcctaagctctagctaggtgcaacgcaactgaagtgtctttcgtgattgctgtagcctgctgaattatcaagttcggcggcttctgaatgtctctgttacaatacaaatcaacgcctatctccaaaaaaaaaaaaaaaaaa

SEQ ID NO: 10045 - DNA, 596 bp, Triticum aestivum
  Predicted polypeptide sequence is orthologous to G2847
taacttgctagatttacatatacaacaaacccataaattttgcaaggactgaaggaggacgaccagctagagaagaaatagaccggccatgcacagcttccttcatgaaaagcctcttcgcagagaacaatgcagatacagaaggcttaatcgctttcacccccatgatatgattacactacactcgcatagcatagcatcaagagcaatcagccttagtagagtgactgctcatgatggtatgtacgtacttacgcgcgctgttacgtactcctgcaccaccccatgcacaacacatatacttgctgcaagaccagtcgtctcttctactggaggatcatcccgccaagcggcgccggggcccagtagtcagcagcgttgtctccgccaaagtgggacgtgcacgagactgggacgaggcacaagccccggctcctcaggtccttcttgctcgcctcttcattcacagcaccctgctgctctggttggcctggagcctgctgctgtactcctccagtgttgttattatggtttagcaactgtccggggtactctgggaagaggccagggttgctttctccagttggtccattttg

SEQ ID NO: 10046 - DNA, 415 bp, Triticum aestivum
  misc_feature (23)..(23): n is a, c, g, or t
  Predicted polypeptide sequence is orthologous to G2851
gcccgtttcccattcctctccanggcaagcaggcgacggcgatttgggagagggagaagggaaaagggggtagagacccgctccgaaaccaggatgttgtgctcagttggcttcgttcattgtgagatgaacaacggcaggagcttgggcatgttttttcgggatgtcaatgaaagcttggcgtttggtaggtcgtacccgtatggctcgcttgatccgtcgtgctaggtcgtaatcttgccagtcctgtgagttgtggagcccagctagagttgttatgctaccaaatcaatacttacgccgccatttttatcagactttcgctgtcatttaatagccttagggctatgccagataatggtattcatcaatgatgtaatctcatatacatgtatttgatgaatattttggtacc

SEQ ID NO: 10047 - DNA, 1062 bp, Triticum aestivum
  Predicted polypeptide sequence is orthologous to G2851
gacccacgcttccgcaaacaagcccaattgtttttcttctcttcttctctcccccacaccctctccctctctcccaagaacatcatataccccattgctcaaagaaaattaagccactggccccttgaagattgagctgagatttccgcacaccgggtgcaagggccggaggggcgagagcattcctttcagcgggaagccggcaacgcatctccccctctctatctcctctttctctcaccagaggcgagtgatgaatcgaggagaattccagagctccctagtgcaacagatgatctggagtggcactggggatggtggtaccagtagtatcatgagtagcttgaagccatgccacgaggaacaagaggcgtctcccaagctgccctccttgtcttctccctccatgcttttctcccagcagtttcctcacagcccatcaggcctgggtcatatcaacggcggcacctctcttctaagcttgcatgacggcagcaccggcacccaggagagccacatgccagagtcatggagccagatgatactcagtgggggattggttggagatcaagagagagggggatacaacgccaccacggctctcctgtcaaagggactagagaattggggggctcatcaggctgctgtaagtgcatgcatggttggtaccaaggaggacggccccatgcctcagtccgtcgccggaggcgctgcttcttacaacttctatgggagccatcttgctggtgacggacatgagatccaggccaagtcccagctgagccagatgcttctggcctcctctcctaggtcatgcgtcaccacaagcctgggcagcaacatgctcgacttctcaaacagcgtggcgccgccccctccggagctgaggtgccacccacactccgacaactcatcccgagtgcacagcaccgccacaggttcagctctcaagaaggctagggtttcaggctcgtcctcagcacaatctactctaaaggtgaggaaggagagctaggggacaaaatactgaccttaccaaatgtttccccatttggcaagatg

SEQ ID NO: 10048 - DNA, 868 bp, Triticum aestivum
  misc_feature (542)..(542): n is a, c, g, or t
  misc_feature (556)..(556): n is a, c, g, or t
  misc_feature (558)..(558): n is a, c, g, or t
  misc_feature (574)..(575): n is a, c, g, or t
  Predicted polypeptide sequence is orthologous to G2851
acgcatgacattaggcctatttaggtgacactatagaacaagtttgtacaaaaaagcaggctggtaccggtccggaattcccgggatatcgtcgacccacgagtccggcgccgccgccgctgcgcacaggccacatctcgtcgccctcctccacatcttcggccaaggcgctcacttctccggccgtcctccacatctcctcgccctcctccacatctccggccaaggcactcacttctccggtcgtcctcctcatcctccaccccatccacttcctgttctccaagactgcaacatggtgctcggcggctgcggcaacgtagctgatggagcgcgagccgaccagttcaacggaggcagtagcacggggcagcggcagcagcatggagggcgtccgcttgactgggaaggtgatggaactgcaaataggagtggcagcggcaaccatgatgcaagtgcaattggttcccaaagctcttggaaaggaattaaagataataacttatatgatccttggaaccatacatggccgtattatgggnggttaggaaggtcnanggagtggctgaatganngatggagaggatcccattgtgggatggagctgatgcggcaagtgctatttttgagagaataaggcgctcaactcaagcaggaaggattcttatgttggtacgaaggctaataagaagaaaagaaagaggagtcttgatgaggaaaatgagtatgtccaaactgaaagtgaggatgatgacaacaagaatgagtatgttgaaaatgaaatgagaatatttaaggggggaggggggtttttgggggtttccccagatccgcaagaacccaagggcgggtgaaaaaagagtcccgg

SEQ ID NO: 10049 - DNA, 697 bp, Triticum aestivum
  misc_feature (19)..(19): n is a, c, g, or t
  Predicted polypeptide sequence is orthologous to G2854
atggcctgttatacaaagnactcccttctatggccctccgcaagatcggtgtcgtgagaagaagtcgagaacttttggagaaccgcccgttatagaactaaagaccaaatcgctcgaaattcatcatgccgagtcatgaaaggggtcattgcagtaagccaacgggatgaaccacgaatgaagcgccgtgcaagcaatacagagggaaagaatgcgcttacttcatcatcggaccgtaaccgccgccaccaccgtaggggtgttgcggaggcatacccatgcctgggccaaagggaactggtggaggtggcgcagggcggtaaggggtgccagctgggccggagttgttctgtgagcgaccccagctgagacgaacgcgagagttgccaatcgggtagccctgcatctggttgatggccatctcagcagcatggcgctgaacgaactggacaaagccacatcccttgcctggaggaatcttgacgtaagtaatctcgccgaagccctggaagaaggagcggagctcgtcttcggtaacgtagccggaaaggccgccgacgaagacagtggtgttgttggggtcggtgaactggttcatcggctggggggcacccgtagtagccgcccattgggggagcgcccatggagtacatgcccattccggggccgccgccgccttgtggcatgcccatgccgc

SEQ ID NO: 10050 - DNA, 573 bp, Triticum aestivum
  Predicted polypeptide sequence is orthologous to G2854
tggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctggttatcccaattaccaacagcaacaagctgcacagcagccacagcaacaacagtgaggcgtgtttgctccggtaggtcattgggttgtcgagatggaattaattaatattatttcaaggcactcttatattgcattcttgtcaatagaggtggtttcgaaaggctcctgattttgatggtcccatggcccggtctcatctatttatatcacatatgccctgttatgtctatgaacaagtggtgctctactgtgattgctgtgttgagacatgcttaatttctttccaaaaaaaaaaaa

SEQ ID NO: 10051 - DNA, 599 bp, Triticum aestivum
  Predicted polypeptide sequence is orthologous to G2854
ccacgcgtccgcaagggacatattctgattctaaccagaacaatagcagactttttgttggtcaacttgattcatgtgtgactgatgaggatctagataaagccttcagtccttatggagagcttactgtcaaggtaatagaggggaagaactgtggcttcgtcacatattcgagcagggcatcagctgtggaggctatgacaattctaaatggaagccagctgggagataatatcataacagttaactgggctcgtcctgctcctaagaagcaggatcaatggaatggtgtggaccatggacaccctcaaagctctggtccaggttatggttgctgtcccgaggatcctaacattcttggttacacaggccatcctggatatgcatatcaccaacagcagcagccacagcagaccccagtacagtgaggacgccagagcagggaacgtctcagtcgcagggtgcagcgggattcttgtgacataaaactcagaaggacttttgctggaaataactgtattagttactcaagatgcctggaacaacattttttgcggcaagtttatttctctgggaaaatagttgtccgtgctgctgct

SEQ ID NO: 10052 - DNA, 884 bp, Triticum aestivum
  misc_feature (643)..(643): n is a, c, g, or t
  misc_feature (652)..(652): n is a, c, g, or t
  misc_feature (682)..(682): n is a, c, g, or t
  misc_feature (814)..(815): n is a, c, g, or t
  misc_feature (864)..(864): n is a, c, g, or t
  Predicted polypeptide sequence is orthologous to G2885
ttacacagctatatcgattgattacgccacgctatttattttgatactatagaatactcaagctatgcatccaacgcgttgggagctctcccttatggtcgacctgcaggcggccgcactagtgatttcgagcggccgcccgggcaggtgggcttttttttttttttttatttttttgatacaaacaaactcttagactgaacaacgatacaagctcacagactaagtaggaacagaagccatggagaaactgtaagcaacaacacatagcttccaaaccttcttgtgacatcagtacacacatctaacataaacataagacgcacaagaaatgcacctgagcaaagcaccaacacatgagatcagctaaccaaatgtcttagaaaccagtcacactgcactccaattccacacactgtttggagcagctgagccaacgagtctagtactctagtcctcaccggagtagtcagattcgctcggctccgacgcatcttcatcctcggactcatcatcttcgctcccagaatccgcgtagactaccgtcaccttcctctcccttactgtccttctcggtgcaaccagctcagcagagctgccggaaggaggagcacctcggccgcgaccacgctaatcccgcggncatggcggncgggagcatgcgacgtcgggcccaattcgncctatagtgagtcgtattacaattcactggccgtcgtttttacacgtcgtgactgggaaaacctggcgttacccactttatcgccttgcagcacatcccccttttcgcagcttgcgttatagcgagaggccnngcacgatcgcctttccaacagtttcgcagcctgaattgcgaatggaccncccctgttaccgcgcataat

SEQ ID NO: 10053 - DNA, 611 bp, Triticum aestivum
  misc_feature (449)..(449): n is a, c, g, or t
  misc_feature (505)..(505): n is a, c, g, or t
  misc_feature (534)..(534): n is a, c, g, or t
  misc_feature (559)..(559): n is a, c, g, or t
  misc_feature (576)..(576): n is a, c, g, or t
  misc_feature (580)..(580): n is a, c, g, or t
  misc_feature (582)..(582): n is a, c, g, or t
  Predicted polypeptide sequence is orthologous to G2933
gagaagaagaaggaggagctgacgcgggccagctgcaagcccggcgtgctgaccatgaaggagaacacggctccgatcgtgtccgccacctgcctcgacgacagggaaatcatggtccaggtcagcctagtgagcaccatggccggagttctgcccatgtccaagtgcatcaaagtactggagaacgaaggccttcgcctcatcagctcgtcgacttccgcgtttcagaacaggacgttctatagcctccatcttcagagaacccaacggacgatgagcaaggagtgtccggcattttgtgaagaactggagaacgccctgacgcaaaaggcaggactacgtctacatcaccaccaagtagattatatgtagcataagaatggtgtatatatattgtcgtgtttaaccaccatgaatcacaatacatgcatgccatagttatagggcanataccaagataaatagtattgctgatatcatcatgatatatagtacctataatcancgtgttcatattatagtaattatattgtnatcattctatggacctgtttatcanctcgcctaggtagtgtnacananaaaaaaaaatcagggggccgtacaatccc

SEQ ID NO: 10054 - DNA, 712 bp, Triticum aestivum
  Predicted polypeptide sequence is orthologous to G2933
tttttttttttttttttttttagcaaacatcatctatattcgtatacaaaaataaaggttaagtttacaactttatgaacgtgccaatgtctaaaataccgtgttagtacagcacgaacaggaaattaagggcgcatgtaaaaacgtacctcaaagtggaagctgtaaaatgttctattgacctcggtggagaaagtcgatgaactgatgaggtgaagccctttgttctcaaatacgtttatgcacttggatagaggaagacttgcagccatgttgctcagcaggctaacctggaccatgatttcgttgccatcgagaggagtggcagaaacaatacggcatgtgttgtccttgacgcgctgcagtctttctctgcatttggctgtactgagctcctgtttcttcttcttgagatcctcgacctgcttctgcagcttgggtatgtagtcgaggacctgacacaccgtcgtcggaatgctcagcttctttgtgtgatctgcgttggggatgagagaacggagagtcgagtagagctgattgagctgcgtccgccggtcgcgctcgtacgcgttgtggttgagcttcttatgcgatcctgaaccggaaccaaccaatccggagccacccgaggaggccgctttcgccggtgccgttgccggtgcggagaactcgtggatgtcgaagtcaaggtccacgtccggtaactgcaaag

SEQ ID NO: 10055 - DNA, 709 bp, Triticum aestivum
  misc_feature (656)..(656): n is a, c, g, or t
  misc_feature (681)..(681): n is a, c, g, or t
  misc_feature (683)..(683): n is a, c, g, or t
  Predicted polypeptide sequence is orthologous to G2933
catcaaacctgccatgagaagtagttaatgctaaccatctctcaataaaattccattagcttagagggtcttcccctactaccaggctaccactaccgcttcctctagagtctcacaaagaataacgccattaattaggagccagatagctcgctggttaggtggctaattaagctaggttgttccaccatcacccctaacctctccacacgaactcgaccgagcagaatctagctgctgcgagctgccggcctgcaatggggcaccagcaccagatgttcgaagacccgttcgcgagcagcatatcgtcgctggaggcggacatcttctccgtcgccgccggccaccaccatccgcagtggccgggcctcgaccacgacgtcccgttggcgccggctgccaacaacggcacatcgtccggcggctacggctcccccggtggcggcgacggctcgggctcccaccgcaagatcagccacaacgcgtacgagcgcgaccgccgcaagcagctcaacgagctctactccgacctccgctccctcctccccgacaccgatcacacgaagaaactgagcattccgatcacggtgtcgcgggtgctcaagtacatcccggagctgcagaagcaggtggacggactggagaagaagaaggangagctgacgcgcgccaactgcagcncngcgtgctgaccatgaggagaacatgc

SEQ ID NO: 10056 - DNA, 780 bp, Triticum aestivum
  Predicted polypeptide sequence is orthologous to G2933
actcaagcatatacaatcaataatcaccaacgccacatacaaacttatatgggacacccactacgcagcacccatgctacaggcatctcatagctatttaaggaatctttatttatgatagttaagaacaataatcctctagtgctgcagatatagtcccgctgcttccatgatggcttgttccaatttgtcacaaaacgatgggcactccatgtttagtgctccttgacttctctgaagatggaggttatagaacgttttgttcccaaaggtggaggaagtcgatgaactgatgagctgaagtccttcgttctccagtacatttatacacttggaaagaggtagagctgtagaagcatctgtatctctcagcaagctaatctgaaccatgatttccttgtggttgaggcaagtagcggacacagttggagctatgctgccggtcacgctcagtacccctggtttgcagttggcactagccagtttctctttcttcttctccagattctcgacctgtttctgcagctcggggatgtacttgagcgctcgacacaccgtcgtcggaatactcagcttcttggtgtggtcggcgtccgggaggagagaacggagcgagaggtatagctcgttgagctgcttccggcggtcgcgctcgtacgcgttgtggctgagcttcttgtgggcgccggagccggaaactgacgatgccgcgtttgcactgtgccagcagagagctcccggacgatgtcatcctcgagaacgtcgaggtccagggcgagg

SEQ ID NO: 10057 - DNA, 872 bp, Triticum aestivum
  misc_feature (15)..(15): n is a, c, g, or t
  misc_feature (20)..(20): n is a, c, g, or t
  misc_feature (723)..(723): n is a, c, g, or t
  misc_feature (758)..(759): n is a, c, g, or t
  misc_feature (872)..(872): n is a, c, g, or t
  Predicted polypeptide sequence is orthologous to G2933
aaccgctaggtgcgntaagngctattcaggtgacacagtataacaagtttgtacaaaaaagcaggctggtaccggtccggaattcccgggatatcgtcgacccacgcgtccgcaaagaataacgccattaattaggagctacatagctcggtggttaggtagctaattaagctaggttgttccaccatcatccctaacctccccacacgaactcgaccgagcagaatctagctgcttcgagctgccggccggcaatggggcaccagcaccagatgttcgaagacccgttcgcgagcagcatatcgtcgctggaggccgagatattctccgtcgccggcggccaccaccatacgcagtggccgggcctcgaccacgacatcccgctggccccggctgccaataacggcacctcctccggcggctacggctcccccgggggcggcgatggctcgggctcccatcgcaagatcagccacaacgcctacgagcgcgaccgccgcaagcagctcaacgagctctactccgacctccgctccctcctccccgacaccgatcacacgaagaagcttagcattccgatcacggtgtcgcgggtgctcaagtacatcccggagctgcagaagcaggtggacggcctggagaagaagaaggaggagctgacgcgcgccagctgcaagcccggcgtgctgaccatgaagggggacacggctccgatcgtgtccngccactgcctcgacgacagggagatcatggtccanngtcagctggtgagcaccatgggcggagtctgccatgtcaagtgctcaggtgctgagacgaaggctcggctcatagtcgtcactccggttcagacagactctatattcatctcn

SEQ ID NO: 10058 - DNA, 481 bp, Triticum aestivum
  Predicted polypeptide sequence is orthologous to G2964
aggaacaaatcgaagaagatatgcaccaggtttttcagcgactaccacttcggcgatgactgtcgttttctccatcacttccccaccatggacatgatcaggctatttacgaaaaaagatgaacaactggacctaggcgctgaggggagctcaggaagccaatgtgtcttgggagcagcttcaagaccaggctatgcatgagctttgtcgtcgggggtgccacttggccgatggcaaagttgagctgcgcatgccagacgcatcttcagaagtccaagatcaagtagttttcatggtatttgtgatgattgtgtgtctgttgttttgcagaaatgcctaaatagaaacttatcttttttgttgtagtccattttttcggttcaatgaaggcatgataggcaaggcaacaaaaatggattgaacaggaactcattgtatctcttagtatgttcctctaattctaaaaaaaaaaaaaaaaaaa

SEQ ID NO: 10059 - DNA, 502 bp, Triticum aestivum
  Predicted polypeptide sequence is orthologous to G2964
tttttttttttttttttttttttttttggcacaggttcagagaagctagcatcatccaacaagttgttcaagggtctcagttttgggcaaaatgaactccactgtcctcaactgatgaaactactatagatgaataaagtgagggtgaagatactgaaagagggagctctacactggcatacaccccagaaagactaagttatttgcttcttagacatctatcaaaagctgaaccgaaaacgtaacaatccatatagaaaatcgcaatacaacaggctaatcacctaaagatgcagagatatatatagtcacaaaaggcaatggagaattagtgcgccgcgcccaagatgcgtttcggctctcaagcagcgcccttccgctgctcgttctcgccatgagcgaagtggcatcggtcgccgaacgtgcaggttcccttcacgaagttctcgcacagcttggtcttgtagttgctcctgcccccggggccgcctcggcctgccct

SEQ ID NO: 10060 - DNA, 698 bp, Triticum aestivum
  Predicted polypeptide sequence is orthologous to G2981, G2982
ttttttgagctaaaagttaaaatcaggcctggagcttcacatgccgatcagcctaccatcggctgcaaagctaaattagaacatcacatttccccatggacataatttacaagcctttttacatgttaagttacagaagccaagggagtataaatccaagtagctctcaaaacattaacaacccattttagtgcctagtgttcatgcttgacacgccctttcagtatccctggaataggaggtgaggttcgtagcctaattccatttggccttgcaggttgtggtgatcgacgcccataaacatttgatgcacttgagcattcaaccgcatttgcaaccagagccactgtaccgtcagtttcttctttaccagagaaccccattgctttcaatacaaaggaatcatcgtgcaactcaaacggagtgctattgaaatcaaaatgcaccaactgcatatcttctgatatctccacttcgacagttgcatgaggacgtgtctgaaccaatatgaatggcagggccactccgccagatggagcatctcccgaaccatatagctgctcatttcgctctaccaaattttggaggcccgcatattgatcttgtaattcctgcagatatgcacttttcttgtcaattctacctttcagcccaatgacctcagtcttcaatttatcaatatcactcaaacctcgtgc

SEQ ID NO: 10061 - DNA, 681 bp, Triticum aestivum
  misc_feature (492)..(492): n is a, c, g, or t
  Predicted polypeptide sequence is orthologous to G2989, G2990
gtttggtacgtagcattgaggctctacatctggaccactggacgtgacacaaccaacggcgggttcgaggttgtgtgtccatctacgaaagagtggtgtgtaatctttgtcaagcaagtgacatcgtggaggccatggacgtcaagtaccccagcggctctgtcaagaaggtgaggcaggcagctgtggcgccggcggtgcaagaggcgaagtacaacgagtgcggcaggaaccacgcactggctagcggtgggcatgtcgtggacggctgtggggagtggatgcccttgagggacctcaaccccgccgacgcgtcgtcgtacaagtgcgcagcctgcggctgccaccgcagcttccaccgcaaggtgatgacggagaggtcgccgatgttggcgcccatggtggagacagtgctccacggcctgccgcagcgcaggaaggaggagacgccggaggactggctcccgggtgtcgactctgacaccaactcanatggcatgaagtacgactcggatgccacagagtacgactcagaaggcacggagtacgatgacgagcgctccgtgccccaaccactgcaacctccacctgtgtaccatccagcacaggtgacgcaacaactctcttctgggcaacataacttcctgccgagggcactgcagatccacaggcttgccaccc

SEQ ID NO: 10062 - DNA, 894 bp, Triticum aestivum
  misc_feature (816)..(816): n is a, c, g, or t
  Predicted polypeptide sequence is orthologous to G2990
caccacgctatgagattgattacgcccagctatttaggtgacactatagaatactcaagctatgcatccaacgcgttgggagctctcccatatggtcgacctgcaggcggccgcactagtgattagcgtggtcgcggccgaggtaaagactgacctttttcttctcatgagctaaaaatcaagagttcaaagctgctacttgaaaagtgcatctgcatctacaactattttgctatacaaatgtgcatctcaaaaaaagaaaccacaagatcaggaatcaagatcagccaaaacttctcatacaaacgttgactaaagtagccactagcctttctgagttttgcatccctcatggtagaattatccatcactggtgatggaggcaatggaactgcaaaatttacaccacacatcacgcatgcatgcgctcccatgtgcaaatgcatcaacagccactcacccaaaaacatgtacacccgggcatgcacatacggcacacacgctgatgcgaggaggaactgtacgccttggcctttatttgggggggggggggggggggggcttgttctgaaattgatctctggattaacccggtttctggtcattggtggaaaaccccctttttctggactaatttaaattctccccccgggggcagaacattaacgttacattttctggggccacccttggttgcacctattaaaaaacgcgcatggctttggatgtaatggctgatggggcacatatttaacattaggtacacttccaatttggggaagttttttgggatgggctttttagaaggccggtaancaccacaagaaggtacttcccgtggttgggcggttagcacattcataagtccatctggccctctcttttgctgggtag

SEQ ID NO: 10063 - DNA, 1153 bp, Triticum aestivum
  misc_feature (472)..(472): n is a, c, g, or t
  misc_feature (475)..(477): n is a, c, g, or t
  misc_feature (479)..(479): n is a, c, g, or t
  misc_feature (481)..(482): n is a, c, g, or t
  misc_feature (484)..(486): n is a, c, g, or t
  misc_feature (555)..(555): n is a, c, g, or t
  Predicted polypeptide sequence is orthologous to G2991
gcaggctggtaccggccccgggatggtcgggatatcgtcgacccacgcgtccgagttttcctcactcccttgacccccgcccgtccctcactaaagccctatagcggtagtaatccttgtcaagccgggtgacaccgagaagcgagcggagggagagcggagcatggaggccatggacgtcaagtaccggccggccctctaccccaacggctccgtcaagaagctccggcaggcggcggccgtgcagccgccggcgccgccggcggcggtggaggccgtgcccacgtacaaggagtgcctcaagaaccacgcggcggccatcggcgcgcacgccgtggacggctgcggcgagtggatgccggtggtggaccttaacaccgccgacccggcctcgtacaagtgcccggcctgcggctgccaccgcaacttccaccgcctcgtgatggtggaggggtcgccgccgcccgcggcntcnnncngnngnnncctgcggcgggggcccccatgcccttccctatgccgggcacggtgcccatcctgctgcgaagcggggcngggggagtcaaagcgggaggacgggtcccgggggtcgacgggtccgatctcactgccactcggatggctcggcgtacgagaagcaggggtcgtctcccggacctctcaccctgcagcggggcaccgttcgggcccggtggcggggaaggccgcgggaatctatccggggggcaaaggcaaacatgcgcggccatcaagcgaaggggcgggggggggcgatcggtcgaaccaggccccggccagctctgcgtggggaaggtcccgctcacacgggtgggcgcgcggcaagaaagggtgccggagcggctccgggggggggcaaaccggggggcgggggcggtcgggcacccgggggggggccgctagagccgggcagggggcggggaccgcggggcgctccgacgtgccgagcgcaacggggctccgggcggggtgggagaaacacgggcgcggctcgggggcgctggtcggacgcagagggtcagggcgggtggcggcgggtcacgggggtggggggggcgtcggggcgaagcactgggtcgcggggacgcagcgcagcacggcgtaggtcgacccgcaggcggcgaggctcgccgga

SEQ ID NO: 10064 - DNA, 637 bp, Triticum aestivum
  misc_feature (13)..(13): n is a, c, g, or t
  misc_feature (130)..(130): n is a, c, g, or t
  misc_feature (151)..(152): n is a, c, g, or t
  misc_feature (171)..(171): n is a, c, g, or t
  misc_feature (197)..(197): n is a, c, g, or t
  misc_feature (205)..(205): n is a, c, g, or t
  misc_feature (210)..(210): n is a, c, g, or t
  misc_feature (256)..(256): n is a, c, g, or t
  misc_feature (259)..(259): n is a, c, g, or t
  misc_feature (268)..(268): n is a, c, g, or t
  misc_feature (284)..(284): n is a, c, g, or t
  misc_feature (295)..(295): n is a, c, g, or t
  misc_feature (311)..(311): n is a, c, g, or t
  misc_feature (345)..(345): n is a, c, g, or t
  misc_feature (348)..(348): n is a, c, g, or t
  misc_feature (401)..(401): n is a, c, g, or t
  misc_feature (443)..(443): n is a, c, g, or t
  misc_feature (450)..(450): n is a, c, g, or t
  misc_feature (457)..(457): n is a, c, g, or t
  misc_feature (521)..(521): n is a, c, g, or t
  misc_feature (553)..(553): n is a, c, g, or t
  misc_feature (570)..(570): n is a, c, g, or t
  misc_feature (601)..(601): n is a, c, g, or t
  misc_feature (635)..(635): n is a, c, g, or t
  Predicted polypeptide sequence is orthologous to G2994
gcaatacacaacnctaaagaccttacaacagtgttgaacgcaaccacctgacatatatgttcataaccaagtccacagcaataactcagacacacacacacacacacacacacacacacacacaagtgcntgcagaactcagtaccacgcnngcccacatcagctaaagcngggatagttgctcaatataaacaatnacaccttncaganggggaccgcaccaccaaaaccggcaccggttctagctctggtattnctntgggaccanggagacttctctctgnctctgggcttnttaggggatgaagaanaagacgcctctgatacaatctttgaaaactcgtnatnattttcatgatcgaagtatatgaagtcggattcgagcattccacctaaatcanacccccacttatggtgtaccggaaagccatactgagcgttgntgcccgngaaatanacattcccacaagatggatgtgcaatcttacatgaagtacggtcgcaaatgatgcagcgaatanaatacgcattgatggaatctttcacagggcancagaaaggcacatttgntgactgctcaactttactatcaactatgctncagaattcggcaaagaagagtgcccacgatctgnta

SEQ ID NO: 10065 - DNA, 441 bp, Triticum aestivum
  misc_feature (248)..(248): n is a, c, g, or t
  misc_feature (276)..(276): n is a, c, g, or t
  misc_feature (318)..(318): n is a, c, g, or t
  misc_feature (333)..(333): n is a, c, g, or t
  misc_feature (382)..(382): n is a, c, g, or t
  misc_feature (397)..(397): n is a, c, g, or t
  misc_feature (421)..(421): n is a, c, g, or t
  misc_feature (434)..(434): n is a, c, g, or t
  Predicted polypeptide sequence is orthologous to G2996
ggttttttttttttttttttttttggtggaataaaagttcaacatatatactagaatggcaaaatccaacacattgaaacaacaaacatatgaacacaccaccttcactaagacaataccgttacacgaacaaggccatagtcctgaaagagggtgacgtgatgacatgattgaagcagaaacaatgtgcgtgccatgattctaacgctaggttgatgcttacggagcagcatcatgcagccaagtgntctccaccaccaccttcttccccctccnggcgggggcccccgaaggacactcatctcctccaactagctngtttctccctccaancaactcctactggcaaccaagccaactggagcaaacaaccctctctggncttctcccttctctnccaaacaaacggttttctggggangccaacaagcggncaagcct

SEQ ID NO: 10066 - DNA, 864 bp, Triticum aestivum
  misc_feature (607)..(607): n is a, c, g, or t
  misc_feature (714)..(714): n is a, c, g, or t
  misc_feature (827)..(827): n is a, c, g, or t
  Predicted polypeptide sequence is orthologous to G2997
aagcttgacattaggcctatttaggtgacactatagaacaagtttgtacaaaaaagcaggctggtaccggtccggaattcccgggatatcgtcgacccacgcgtccgtttttttttaccaggaatgatcatgcattgatatgacagagaagcaacagtgatcagcccaattagaagagagtgaaaaagaacagaagaactttccaacagttaaaaactttacaagggcgcgaggagcgttgcctcctactatggaacctgtctcctgccatggctactgctgctgctcttggctatgctcctgaagctgcttctcctcctcctgctgctgctgcctcctaccgctgctactctgcttgttgttgtgcatccagaccttgagcgcctgcctccggaccccggcctgcgcgcagaaatgccccaccatcgcctcgtcctgccgctgcagcctccacccgacgcgctccgcgaacgccagcatctgctccttctgctcccgcgtgaacgtcgtcctggagcgcttccgcggtgccggcgacggcccacgccgctcctcgctggaggactcggtcgtcgtgccggtgccgccgctggccgcaaggccgtangggaacggcaaacgctggtgcgggtgcttgctggccgccggcgggagcagcaatggtgcgcgcgcgctggcagccagcagcggcaagtgggcgcgcccccgcgaggngtcgcggcggtgaaaactgcggtggcagccgcaggccgcgcatgcgagtgggtcctcggggggagccggcatgaactcgcagcatcccgtccaggacgtgcccggcccgcggncgctctaaagtatccctcggagggcccaagcttacgg

SEQ ID NO: 10067 - DNA, 275 bp, Triticum aestivum
  Predicted polypeptide sequence is orthologous to G3003
attagctcatcatactgccgccaagtcctagttcatcatcatgtcagagagaggtgtccaaagttttttcctctttttcgtcttcttcttcttcttcttcttcttctgcgtccgtcatcatcaaaatgtctgatactgctacaaattctttggtgtgcatactctgggaaccaaacagtcggtcaaaagctaggggaatgtaaaatgtaatgtgttcagttgggttgagattgggaaataagtcaaagcttggagttgtgtccaaaaaaaaaaaa

SEQ ID NO: 10068 - DNA, 630 bp, Triticum aestivum
  misc_feature (623)..(624): n is a, c, g, or t
  Predicted polypeptide sequence is orthologous to G3044
ggtcgagttcctctcgatgaagctctcggcggtcagccccgagctgaactgcgatctcgatctccaagacatcctttgcccgcaggacgcccgctccacgtttccgggatacggccagcgattgggcaacgttcatcccaacaacaatatgtacagggcgtcgcagccgggcctctcgcgtccagaactatacgggaacgggatcatcatcccaaaccacccagcaagtgttcatatggcgaggacggctcagcagctgtctgcgtttccccataggagcatcgtctgggacgaggaacttggcaatgttggtccgtctgctttcccgtcggacgtcgtcggcgccagcagcttggagaactccgagtcgatgaaggtggagtagctaggcaggctgcagctgacggttaaccatgtgcaaaggctgcacagatctcctcgggctttagcgagtttaactgctgtcgttgagaggacgattctctatgtgtgtgtgtgcgtgtgtgacttttgtacagtttgactaagcagacggatgaaaagcttgtggtccgctgtgatgtgcctgcctggactagaattattagtggtaataatgattgggtttgatgagttgatctaannaaaaaa

SEQ ID NO: 10069 - DNA, 898 bp, Triticum aestivum
  Predicted polypeptide sequence is orthologous to G3055
aaccgctacttacgatgattacgccaacgctatttagtgtgacactatagaatactcaagctatgcatccaacgcgttgggagctctcccatatggtcgacctgcaggcggccgcactagtgattagcgtggtcgcggccgaggtagcttggacttcggttttttgttaagtactccagtaagcaatgctttttgggatgtaagctgttaaacctatcagctaccgctcgtgtgcctgcacagaagtatttcagagtttagtgggactggatcaggttttgatcaaaaaaaaaagaaaaaaacaaaaaaaaaaaaaaaccaactgaccggaaaagacgcccaaaaatcaaaaggccctcctggccgggaggatgctccatatcccccggtcctgcctatcgggagtattataactatggcccgaccggccctatacagagtcgtgtttgaatacaccgtggggtgttccaaaatattgggattggaaaaatcccgcttttcccaactaaatctctttggaagagatccccattgatcgacctgccctaaaattgaaaaggcccgatgggaaaggccttcccactggtagcggcgccttaaatgcggagtggtgtggccctacagcgcgacgttaaccgccaggcgggtgtggggctttaacccccgcgtcgatccgttatacttcccatgcgtcctatcgccccggtcctttggggtttcctcgcttccctttttatccgggtgccccggttttgcccccgaaaccttttatttggggggcccccttcccggttcagattatttgggttaggggccccgtaccggggaaaatggcataggggagggggtttcccctttgtgccatcgcccccataaaggttattgggccctttttttt

SEQ ID NO: 10070 - DNA, 870 bp, Triticum aestivum
  Predicted polypeptide sequence is orthologous to G3055
gacattaggcctatttaggtgatctatagaacaagtttgtacaaaaaagcaggctggtaccggtccggaattcccgggatatcgtcgacccacgcgtccggagcgagggcgctccatcatcgggatctgacagagtggccatggactacaccaacgccatccatatcatcccggacgccgccggtcccgaaagctgggccaactctgcggcgcctcctggcggggactctgggatttgggccaccgaggacgactacagccagtggaacggcgaccaggggcttagcgggggttgctatggcggtgacaggaactcgtcgcagccgcattcaagggccggcggcgagcagccgccgccgggcaagaagcccaggggcagtgggccgtcgggcggcggcgacgccgggagcacgagcaagtcgcgcgcgattgggaagatgttcttcaagacgaagctctgctgcaagttccgggcagggacgtgcccgtatgtgacaaactgcaacttcgctcatgggatggaggagctgcgcaagccgccccccaactggcaggagatcgtggcagcacacgaggaggcgacggaacagagagaggagcacccgatcccgatcatgacgtcgtccaacgtggtgccgggtgacagcgtgtctgggagggcgtacaaggagcgggcactggcaagaagctctccacccaagaaggggagcccctatggcgacccatggactttcttgcatgatgagcaatccaaaggcgcgtgaaaaacgtcccgattagcccaatcgccctccggttgggcggggggaagctacaaacttctgcctgctgggcggctggcccccctcctccaaaagggacccgacaatt

SEQ ID NO: 10071 - DNA, 520 bp, Triticum aestivum
  Predicted polypeptide sequence is orthologous to G3060
ttttttttttttttttttcgggtctgaagcacatttcattcaaaaaagctgaatctaaatcacaatccatagaaccaaaatacaacaggcctaatcacctagagccaacagcaagggacaacagaatagtcacagtagcagcacaagaacgagcgaggatccaccgcagcagcggggtcatcagacgggggcacccttccgctgctcggtctcgccatgggcgaagtggcagcgctcgccgaaagtgcaggtgcccttgaggaagttctcgcatatcttggtcttgtagttgctcctgcctccaggaccaccgccaccgccaccgccgccgcctcggcctgctggggccgctgtgccggcagggttcttcgacggcgtgctggcgctgatgctggcaatgaaatcacccaccatgtcgttggcttgctttatctggtcgaaactgccttccagctcaatgttcttcaggtctgggtttgattcgtggtcgcgtatcgagagcttgacccccgtgatgcgg

SEQ ID NO: 10072 - DNA, 1079 bp, Triticum aestivum
  misc_feature (14)..(14): n is a, c, g, or t
  misc_feature (744)..(744): n is a, c, g, or t
  misc_feature (800)..(822): n is a, c, g, or t
  misc_feature (878)..(878): n is a, c, g, or t
  Predicted polypeptide sequence is orthologous to G3060
gcttccgaccaatnacaacactgcagaaggctgcaagtttggcgacaagtgccatttcgcccatggcgagagggagcttggcagggcaccatcctcctacatgtcccaggaaagttcctatgctcctcctatgggtggtcgatatggaggtcggcacgaaccacctccgccagcttcgatgggccctccagctggaaactttggcgcctcgtccacctgcaaggtcagtgttgatgctgctctcgccggaggcatcatcgggaagggtggggtcaacacgaagcagatctgccgcatcacgggggtcaagctctcgatacgcgaccacgaatcaaacccagacctgaagaacattgagctggaaggcagttttgaccagataaagcaagccaacgacatggtgcgtgatctcattgccagcatcagcgccagcacgccgtcgaagaaccctgcaggcgcagcggctcccgcagtccgaggcggcggcggcggtgggcctggaggcaggagcaactacaagaccaagatatgcgagaacttcctcaagggcacctgcacgttcggcgagcgctgccacttcgcccacggcgagaccgagcagcggaagggtgctgccgtctgatgacaccgctgctgcggtggatcctcactcctccttgtgctgctactgtgactattctgttctcccttgctgttggctctaggtgattaggcctgttgtattttggttctatggattgtganttagattcagcttttttgaatgaaatacgcttcagaactttcttgctgtccaaaannnnnnnnnnnnnnnnnnnnnnnaaaagggcggccgctctagagtatccctcgagggggcccagcttacgcgtacccanttttcttgtacaaagtgtccctattgtgagtcgtataataagctaggcactgcccgtcgttttacaacgtcgtgactgggaaactgctagcttggaatcttgtgaaggaactttactctgtggtgtgacttaattggacaactacctcacgagatttaagccctagggtaatttaaaatttaaagggttaaggggtaaaca

SEQ ID NO: 10073 - DNA, 726 bp, Triticum aestivum
  Predicted polypeptide sequence is orthologous to G3060
cggcacgagggctcggcaatcagacgttcatcaacaactccatgccaccccatatgggaccaaggcccactggtcactttggacctccggcaatgcccagccctggcatggccaccccggcaggcttcggggcttcttccacagccaaggtcagcgtcgatgcatccctcgcaggcgccatcatcgggcggggcggagtcaacacaaagcagatatcccgggtcaccggggccaagctggccatccgggaccacgaatcgaacgaggccttgaaaaacattgagctcgagggcacgtttgatcagatcaacaacgccagcgccatgctcagggagttgatcttcaggatcagtggcggtgccaacgctcctccgccgggcgtgatcccggctggaggatctcaccgcggcggcggcggcagtgggcagggaagcaacttcaagaccaagctgtgcgacaacttcacgaaaggatcgtgcacgtttggcgacagatgccactttgcccatggcgagaacgagctgcgcaagtcggctgccgtgtgagattgatcaacctcacccaacatgatttgtagtagcgattagtcggtgtaactctgaaccttgagggctgatgatggattttctgactgtccctgagattatgccatcgattttatggatttcatatttgtcatgactcttatcagcctgttgtggtcttagtagaaagcttgacatgtta

SEQ ID NO: 10074 - DNA, 860 bp, Triticum aestivum
  misc_feature (10)..(10): n is a, c, g, or t
  misc_feature (400)..(400): n is a, c, g, or t
  Predicted polypeptide sequence is orthologous to G3060
ctagcattangtgacctatagaaaagtttgtacaaaaaagcaggctggtaccggtccggaattcccgggatatcgtcgacccacgcgtccggttaaaaacgccacgtgccaaactaaacctttgccccagcgcgacaccccatcttctccggttgtgaggccccgtgctgggtgctcctcctctctctctctaccgacgccgcccccgccagagagaaaccctagcctagggttccacgcgccgccgccgccgccgacgtcgaccccgcgtcgccctccccccgagctcgccatggacgcgggccgcaagagggccgtgccggagggcaccaacggcggcgccgccgtcaagcgcgccagagaatcggagtcggttcaagcgggtggaggaagcaaatcnaagccatgcaccaaatttttcagcactgctggttgtccctttggttcaagttgccattttctccataacttccctggaggtcaccaggctgtttcaaagatgaccaacttgagtggtccagctgtttcagctcctcaaggaagaatgcccatgggacctggtgttcctgatgggccacctacacccagcttgaagactcgcttgtgtaacaagttcaacacagcagaaggctgtaaatgggggaacaagtgtcattttgctcatggagagagggagctcggaaagcccatgctgttgaacaactcgatggcacctccaatgggaccaagacccaacggtcacttccagccctcaccgatgcctggcccagacatggttcctccctcacctttggcgcatcggccacagccaagatcagtgttgatgcatcccttgctggcggcattattgggaaaggtgg

SEQ ID NO: 10075 - DNA, 860 bp, Triticum aestivum
  misc_feature (120)..(121): n is a, c, g, or t
  misc_feature (746)..(746): n is a, c, g, or t
  Predicted polypeptide sequence is orthologous to G3067
gacccgactcttagttagtggcttatcatacgacgttgtattgggaccactttgtacaagaaagctgggtacgcgtaagcttgggcccctcgagggatactctagagcggccgccctttnntttttttttttttttttttttttttttttttgaaggcattcacgtacattcacaggaatatggacaaaacgcatctggccgatgctactagcaggcagccgcaccgcgtcacagcccgtgcaaacgttaacagagtggcaggcaagaggcaaccgagagagaaaagaatggttaatttgagtgctcggttagcgcgggatcaaggcttgcagatgaccacgaagcacggcagcagctccctcgggttcagcaggtagagctcttcgatgttggcgtagggccccaccttgccggccagcgagtcgaacccggtctgccccacgaactccctcacgttctctagcggcttgtgcaccctcccggcgatcaccctgcacaccagcagggccctccgcgcgccgccggccgcggctgccgggtcgtcttcctcgtcggcggactcgaaggcccggccggtggtggacgtggtgaagacgccgacgccggcgccggccttgccggccttcttggagctggaggaggagaagccgtggcggatgatgcggcaaacggcgcacttttcggaagcccaaaggctgttggcgccggcgggagcgaacgcccaggcgagcgttgcgccgttggnaccgcaacaattcgtttccgtcgtggagggagcgcgggttgttttttggccaactttctcgcctttgagctttacgcctccccggttttccttgaaagcggtgcaagtttctta

SEQ ID NO: 10076 - DNA, 713 bp, Triticum aestivum
  Predicted polypeptide sequence is orthologous to G3067
tttttttttttttttttttttttttggtccacacctgtacatgcatatatatcgacctatggcctcatgagaatacaagttgcatattcctaataagatttacactataagtaccgctgtaaatccactaagaaaaacactgtaaatccaatatgaatccaccgtaaaacattgtaaaattcactaaatattacaccaagcattttagttcaaatccactaagacactacaaatccagtaggaattacagtgtaaatccagtaagaattacactgtaaattcacatagaattacagtgtaaatccagtaggaattacagtgtaaatccacttagaattacactggacactgtaaatccagtataaatcttgaaacaagggactccgaccaatcttgaaaagtctgaggcttagcggcatttgaagactgaacaagtccaactatttgttgcacaacatcatttccaaaccgtgaagcataagccgtttcagctttacaggcaaaagagacattatcaacagctggagcatgaacttctgatgttgaaatcttattggcaaaggggatactataggttactgaacatgaaaacttttcacaagacttctgtgcgtaaactgatggtgataaacgcttcaacggcctcttgccatacgaacgactgttgctcttatgtaattccgagaaatccttaactttgttacctctccata

SEQ ID NO: 10077 - DNA, 679 bp, Triticum aestivum
  misc_feature (666)..(666): n is a, c, g, or t
  Predicted polypeptide sequence is orthologous to G3074
tgatttacaaccggcgaacctgtctagttatatagttgctacactatatagttgctacacaaaatactagctactactggctattgagcaatcaacatatgtcacatcctaaatcacttctgcagcatctgcgggtacacatactacaagagaattgctactacattgtcaagctgggcctgctaggatgtacatcatgtcatgtctacctatcagcttctcaaactaaatccacgctagagtcacgtcattcttcattgtcatagtcttcgtcctcctctaatctatggtttgacgacagcgcaaactgcaccgggtccatggccatcttgttcatctcaggcatttgccagcccaggaaatccttggtctccacttcttctttcaactgtgaaaccgacggtcctgaagtctggacttgcggtgccacggtcaccacaggagctgaaggagccgaaggctggacttgcggcgtatcctcctcgtagtcagcaagatctaagttcaagtcaatgttccttaaggaggccctggcattgctcaaaggggtatgctctttggtttcacttgtgtccagaacaacgtctccaatctctaccttcaggtggcctggtttgctaaattgggcacaacctaattcatggtgttcaatctccctctcagctncacgcccagcacg

SEQ ID NO: 10078 - DNA, 950 bp, Triticum aestivum
  Predicted polypeptide sequence is orthologous to G3074
gcacgaggaggaagaagctgggcacccggttccccgcggcacggatcaaaaagataatgcaagcagatgaggatgttggcaaaattgcactggctgtgcctgttttagtttcgagagcccttgaattgtttctgcaagatttgatcgaccactcatacaaaattactcttcaaagtggtgcaaagacactgaattccttccacctaaagcaatgtgtgaagaggtacagctcttttgacttcctaactgagattgtcaacaaggtgccagatctcggtggcggtgaatcttgtggagatgaaagaggattacccagaagaaggaaattttcaaatggaagcgacccagagaatgaggagccccgatctagcaaaatgcccataagaagcttgaacaccagtcccagaggacgaggcagaggtcgaggaagagggcgagggcggcctccaaccaagagaaaggaaattggttatgtacagtttgaggatgagagcagcatgtttgctgaacaaagtgaacccttgccaggagatgagatagttccggagaccaaccgtggcaatgagagtattccccaaagctcacatcctctagtggaggctccatcagccatgacgccagctgtgatttcaaaggttgaagaagctagcaccaaccatcagccagattggcctatgccagatgccattggaggcattggtgttggaccatccagttttggacatctgacagtgcaggttgatgaggtagaggactacgacaatgaggattaggcatagtcatcctctcattcatcatatgctctaacaggacagttctcctggtgttgtacattgtaaatattgtttcaagtagttactgcagctatgatgtgtaacctatttctttttcccaataattggttctgagttgccgcattgttgacctaaaaaaaaaaaaaaaaaaaaaaa

SEQ ID NO: 10079 - DNA, 677 bp, Triticum aestivum
  Predicted polypeptide sequence is orthologous to G3075
agctccttaagctaacaaagcaaaactaataaaccaatcaagtcttgtcccgcaagacacctctcatgacatagttacccacaggcgcaggcacaggcacaggtcttactctgtttgttactcaacctatccttgcctagtacagacagacagaagaacatactagtacaaacagctcgaccctcggatcacgtccttccttctccctccctacgctacacaggctagctagcacagcacaagtactggcatgacatgcaccacacccaccaccttgtctgtccattctatggctccttcgccacagccttgagcgcatccccggccgtcaccctcagcggcacgaaatctgatagaaacttgtaccgtttctcgttgcacaccgccgatgaaaggttctcgtaggtaattgactttttacgttccttcagggcattctgatgagcatccttcgcaaatacttccaagaataactccgaggccttgttgacgaggaagacggcctcattgttagatcggatggtggcgtccttgtcccgcatcagcagccgcacccgcgccatcgggaagctgcaggtgcccggctcggcggccacccggcgtcgcccctgccgccttgcccttctgcttcttcgcaggcgaagagccattctgcccgctcttcgccgcatttgggg

SEQ ID NO: 10080 - DNA, 608 bp, Triticum aestivum
  misc_feature (20)..(20): n is a, c, g, or t
  Predicted polypeptide sequence is orthologous to G3075
agggtgggttgacaacatgnaatgtgcttcccttgcccaaggtggatccatatggatacaacatagtacatacattctccatacatacgctggctggtctcaacctaacctgacctactacacaagaacatggtgcacaggatagctagcacaagacaagacaacctatggcatgcgtgcgtgtctccctcatggtctgcctaggaccgctccaccacagccttgagtgcatctccggctgtcaccctcagcggcacgaaatctgatagaaacttgtaccgtttctcattgcacacctccgtcgaaaggttatcgtaggtaattgactttttgcgttccttcagggcattctgataagcatccttcgcaaatgcctccaagaataactccgaggccttgttgacgaggaagacggtctcgttgttagatcggatggtggcgtccttgtcccgcatcagcagccgcacccgcgccatcgggaagctgcagatgcccggctcggcggccaccggcgccgcccctgctgccttgtccttctgtttcttcgcaggcgaagagccattctgctcgctcttggccgcctttgggggttccagatcgccatgctt

SEQ ID NO: 10081 - DNA, 763 bp, Triticum aestivum
  Predicted polypeptide sequence is orthologous to G3083
gaccacgcgtccgagggagagaacggacgatggagctggaggcggcgacgcggcgcttccagctctggctccgcgggctgcggtcgctccgccgcgacctccggacggcgcgctgggccgacgacccggcgcagctcgccaagctggtagccggctacgtgtcccacttcgccgactactgcgcggcgcgggcggagctggacccggtgtggacgctggcggcgccgtgggcgagccccgtggagcgcggcgcggcgcactggctggccgggtggcggccgaccacgctggtccacctgctctacaccgagtccggcagccgcttcgaggcgcagctcccggacctcctgctgggcgtgcggtcgggcaacctgggcgacctcagcccggcccagctggcgcagatcgacgagctgcagcgccgcaccgtggcgcaggaggacgagctgtcgcgggagatggcgcgggtgcaggagggccacggcgcggtgggcgccggcggggagctggtggacgtgggcgggctcgtcggccgcgtcggcgcggtgctggccggggcagacgcgctgcggctgcgcaccatgaagcgcgccgtggagatcctcgagccggcgcaggcggccgagctgctcgtcgcggcggcggacatggagatcaggttccgcgagtccgggctcaagtacgacggcgtcggcgccggcgggtcgtaacgtccagccagctaggtcggtcatcatcggcgcacggcaggtccagaccgttt

SEQ ID NO: 10082 - DNA, 655 bp, Triticum aestivum
  Predicted polypeptide sequence is orthologous to G3084
acaattctcaaactgaaattctatcaaaccataccttcaaaggccaacataatggcacttaaaataaatgctaatctgcactcacgctgcaatctggtgcccattcttctggtgatttgttcaaagctacaaccaagcaaagatattttacatgctatatgaactaagatatggattttgtgttcccaggtctataatatccgtgctcagccggttccctgcaagcgctttcggccatgacctcaagttctgcagctaggccgtgaatgttttgatccttctcaccgtccaccgatgatggcccgacagaaatcagggaaggagaaaaggatgtttttgtcatggtcgtcggaacgacttgccgtggatgcagtcatgcactggatgacatcaacggctagccatggacgagcacctcgccgcctccataaaatatggatgcacgggattctgctactaacatttcagtgtgttttgttgcggtgctgtgacatatacaccttcagcgcgcatgtaatgtttgtcagctactactttagataaataaccactgtattctattgtatttgtaattgaratgttcatatgtgtttaaccatctggcaaagaggctcactggatgtttcttataatattctatctgtaatagacatgt

SEQ ID NO: 10083 - DNA, 562 bp, Triticum aestivum
  misc_feature (561)..(561): n is a, c, g, or t
  Predicted polypeptide sequence is orthologous to G3086
accaaaactggagcctgcttctttgaacatcacattgttctcatcttctccttgacgatgttgtgcagctgcctgcttggatctagccaattaatctcaaaagttgattctttctcttcattaggcccagcagagttaggaaggaacccgactatagtctatatcccgtgctcgacaaatcagcagggatctcacctagtgatgccaacctgagcctctgaatctcccgctccttctcgtcacacatagaaggcaagtaaataagcacgataagagaagcatcgtcttggcgagtagggccccgcggtgatctctcttgtacgctgctgagcaggcacttgcccgtaaatcatggcatgtggcggtggcggcgatggctgcgtgtactgcggcatcacgggtgggatcgctccctagtgtctgatgatcggcatgcctaacatgcacctctgtgtccgtcgtctccaatggtcctgcccctttgttggctcgtgcgccgctgcagctggtgtcgttatgctcctccaaggtggcgcccttcttggaaaaaacgtaagtggnt

SEQ ID NO: 10084 - DNA, 691 bp, Triticum aestivum
  misc_feature (335)..(335): n is a, c, g, or t
  Predicted polypeptide sequence is orthologous to G3091
ctttgttttcgccatgaagggggggatggtgcctacatggctagagctattgcttgcaacacagttcttcgcaatttgcaccaaccatctctcctctactcgtaatgagtgtaacctattctgcatagactgtgaggaatcaaagggtgccttctgctattattgtcgttcgcgccatcattccacccatcgagtaatccagataaggcggtcatcataccatgatgtggtcagggttgccgagttaaaagatatacttgatattagtgatgtacaaacgtatgtcatcaatagtgcaacggttgtatttcttaatgagcgcccacaacatcgtnggttgtggtgtttctgcgatcaaggcatcatcgtcatcatacaattgtgagatttgcaatcgtgctcttcttgacccattccgcttctgctctctgggttgcaaccttaaaggaatcaaagaggatatgaggacaactgttccgattggagatattattgactatacaaggaaggatgatgatacagattccagtaacacaagtggaaattctggtaacaatgaagagagttgcagtgatgcagattattgcaaggataatccatctccaccaagggttattcgtcaccgccgaaaggggatccctcggcgtgcaccttttttttgagagaaagctgttatgaataatttgctggc

SEQ ID NO: 10085 - DNA, 729 bp, Triticum aestivum
  Predicted polypeptide sequence is orthologous to G3091
attcggcacgaggaaacatctttgtttttgcaatgaagggggggacggtgcctacatggctagagctactgctcgcaacacagttctttgcaatatgcaccaaccatctctcctctactcgcaatgagtgtaacctgttttgcatagattgcgaggaatcaaaggctgccttatgctattattgccgttcacaccatcattccacccatcgagtaatccagataaggcggtcatcataccatgatgtggtcagggttgccgagttaaaagatgtacttgatatcagtgatgtacaaacatatgtgatcaacagtgcaacggttgtatttcttaatgagcgcccacaacaacgtggttgtggtgtttctgtggtcaaggcatcatcatcatcatacaattgtgagagttgcaatcgtgctcttcttgacccattccgcttctgctccctgggttgcaaccttaaagcaatcaaagaggatatgaggacgagcattccaactagagatattattgactatacaaggaaggatgatgatacagattgcagtaacacaagtggaaatactggaaacaatgaagagagttgcagcgatgcagattattgcaacgaaaaaccatctccaccaagggttattcgtcaccgccgaaaggggatccctgagcgtgcacctttttattgagagaaagctgttatgaataatttgcttgcatcatagcaaatgaattgga

SEQ ID NO: 10086 - DNA, 871 bp, Triticum aestivum
  misc_feature (30)..(30): n is a, c, g, or t
  misc_feature (735)..(735): n is a, c, g, or t
  Predicted polypeptide sequence is orthologous to G3091
cacccgctagttaagattaggcctattcanggtgacattatagaacaagtttgtacaaaaaagcaggctggtaccggtccggaattcccgggatatcgtcgacccacgcgtccgttcctcccctgctctcccgcatccacattcttccttctcgtttcgccggcgcaggatggcaatagaccacgcgtcccctcttgcgctcaagagcggcggcgccgccacgggaggagcggggcgtgacgaggaggcggggaaccagcggtggccgccgtggctgaagccgctgctggcgacgagcttcttcgtgcaatgccgggcgcacgccgacgcgcacaagagcgagtgcaacatgtactgcctcgactgcatcaacggcgcgctctgctcgctctgcctcgcccaccaccgcgaccaccacgccatccagattcggaggtcgtcgtaccacgacgtgatccgggtgtcggagatacagagggtgctggacatcaccggcgtgcagacgtacatcatcaacagcgcgcgcgtggtgtcctcaacgagcgcccgcagccgaggccgggcagggggtcacacactaaagttggagaggtctgcagcgcaccctcctcgactcgttccggttctgctccctcggatgcaaagtatgcatgcagtttttctttaaatccaagcttcggccatggcctgggcgcattgcaagcttggtaaccagcacggggttttcttccccgnaaaatttatggcccttcgggcggggacgggcccaaggaaaaacccgggggctttgggggggggtggaaaaaaaatcggagcgggggcaaggacccccggtcggaattcggaacttcgtgcaaaacacacagggggt

SEQ ID NO: 10087 - DNA, 1103 bp, Triticum aestivum
  Predicted polypeptide sequence is orthologous to G3091
cccagaccggccgcctttttttttttttttttttagagcagggccatcatcatatacattaatctctctgtggtgtggtaatttttggtttctgtcctagtgatgatgatgatgattataagcagtaagaaaaggctggtgctttttcagctgtgtttccatccatccacctccctttcttgcctgcctgctttctccctgaaaagctaatggtggaatccacatcgagaagcacaaccgaaggcaatggcgggcaccgaagtggtggccgctttctcgctccattcactctgcaactgggcgtgtgggtcgcagctttgtcaatggcggggtggtgcgcgcctagcagtcgatgatgaggttgccgaacggcgcgcggtgcgggatgcccttgcgccgcttggccgctggaggcggaggcggcggcggcgtggacggcgtgaagctctgcctggcggcattgcgcagaggagaggaggaggaggccgcctcggagtccgacgagcccttggcgcggccgggcctgctggcccgcatcatcctcgccttgtcgttgccgcccccgtcggaggagcagccggcgaccttgcagccgagggagcagaagcggaagttgtcgaggaggctgcggctgcagacctcccagaggttggcgccgccggcgccgccgccggccttgccgggctgcttctgctgggggcgctcgttgaggaaaaagacgcgcgcgctgttgatgacgtaggtctgcacgccggcgatgtccaatgaagcgcctggatttcgaaacccggatgaccttttggttatgaggaacgggcgatctggattggtgtggtgccccccgttgccgttcccccacgcaacacgaaccaaacgcccgcccccccgcgggccgcccccgggcgggcccatcccaggcccaacaatgttgcccctcgccctcccagttgcaactcgttggtgcttctttgctttggcccaagaaaacccgcggcaacgaaacggggcgtcctcaactgtggggctctggttcctcccctcccggcgggctgcgtcacatttggcctccggccctcctctttctctcggggcttgggaggccc

SEQ ID NO: 10088 - DNA, 628 bp, Triticum aestivum
  misc_feature (471)..(471): n is a, c, g, or t
  Predicted polypeptide sequence is orthologous to G3111
tttttttttttttttttttttttttttttttttttttttttcaagctaagtgcatgtttttatagcaacttccacatatgtacaaataggttacaatcacaaatccccccatcaaatatgtatgtacacacgccttcatgctcaatggttcccatttccagagtagccacacctaaaaagaatcagcacccagcaggcccccaaaccaagagaaaggtaaataagaagctaaccgatggatgagcttatgcaccggctaatttccctcaacacacttttcccttggccttttgcccagagtgcgcacgccactaatgccgagctacagcgacgtcagcggcacagcggcaccgccttgaggagcgcgtcgaggccgccgggccgcgcgccgcaacgtccgctccgctcgccgcgcggcagctcggcgacgagcacccgccggcaggacgggcaggaggagtgcgagcgcanccaggcgtcaacgcaggccgcgtggaacgcgtggctgcactgcggcagcacccgcatgtgctggccgtcctcgaactcggcgaggcagatggcgcactcatccgcctccgacgcctcgccgccgtcggcggcgtacctgacggtgggcagcgcgcgc

SEQ ID NO: 10089 - DNA, 1099 bp, Triticum aestivum
  misc_feature (49)..(49): n is a, c, g, or t
  Predicted polypeptide sequence is orthologous to G3111
cacgcttccgccaccacccccttacgcttctctcgcgtctcgccacaanctttaattttgcggaaaaggcccctccaactaccggcgctggacgaacgtgggcgatgctccggccatcgccgtattcgtcgaggcgtctcctccagagcggcgaccccagccgcatcccgggcatccccccggccgatccgcccgccggcgtcagctcggatgtcgtcgtcatcctcgccgccctgctctgcgcgctcatctgcgtagtcggcctcgccgccgtcgcgcggtgcgcgcgctcccgccgcaacgccaacgcccacgccaaccaatcctcgccgtccggcagcccggcccacgccctggcggccttcggcgggggcggcggtgggcataaccatggtactacaactactacgacgacaggcgcgtcggggggcagcgtgacgaccaccagcaaggggctcaagaagaaggcgctcaaggcgctgccgaagctggcgtacgcggacgcggtggccgcggctgcggcggcgaggggcgccgtggcggggggcgaggaggaggaggggcaggacgggatcctcgccgagtgcgccatctgcctgacggagttcggcgagcgggaggaggtgcgcgtgatgccgcagtgcggccacgggttccacgtcgactgcgtcgacacctggctgcgctccaactcctcctgcccgtcctgccgccgccccatcgtcctcgacgaccccgcgcccgccaagcggtgccgcaagtgcgaggagaccatcctggaggcggtcatcgcctcgtcgtcgtcggccggcggcagccgcggcggcggccgtgggggattctgccgtagtagcagtagagaggcgtcatgtcccctggcgggtgggtcaggtcggtgtggggtagtgagctgctccttctgctgggggccacgctggagtactacgcagtgaagttttcttctcagaatggaaggagaataatagagcgggaatggtgacctttctgcaccttttcgcccgcattgggctaaggtcagaaggtgggattggggaaatgactcaaatttgaaaaggggcgggctctctgaaaaatttta

SEQ ID NO: 10090 - DNA, 4012 bp, Triticum aestivum
  Predicted polypeptide sequence is orthologous to G3967
ctccgtattggagcgctcctgaccgagagacgttaagcgcctatggttggaactggttgatatgatatctggtcacattgtgggatgcaatccccccttagtggggggtgattgaagaagtcaacaataggaggacttgcatcttgctgaagttttctgcttctgagtttcttgagcaggctcttaaactaccaagtatgtcagtgtcaaatgggaagtggattgatgggctccagttctcatcactgttctggcccccgccacacgatgtgcagcagaaacaggcacaaattttagcctatgtcgagtactttgggcagttcacatctgacagcgagcaattcccggaggatgtagctcagctaattcaaagttgctatccatcaaaagaaaagcggttggtagatgaagtattagcaacttttgttctccatcaccctgaacatggtcatgcagttgtacatccaattctttcacgcatcatagatgggacactgagttatgatagtcatggttccccattcaattccttcatctctttatttacccaaagttctgagaaagagtactcagagcagtgggccttggcctgtggagaaattcttagagttctaactcactacaacaggccaatctttaaagttgcagactgtaaccaccagatcagaccaggccacagcaagttgttttgcacagagaaagcaattactcttccaggaaatgaacccgaagggaagccattgaggccattatctccttggatcacagatattgtgctaactgcacctttgggcattagaagcgactattttagatggtgtggtggagttatgggaaaatacgcagctggtggagaattgaagcctccaacaactgcttacagccgaggagctggcaagcacccacaactcatgccatccaccccaagatgggctgttgccaatggagctggagttattttaagtgtctgtgatgaggaagtagctcgttatgagacagcaaacttaaccgcggcagctgttcccgcccttctgctacctccaccgacaacacccttggatgagcatttggtggcagggctaccccctctcgaaccatacgctcgcttgtttcatagatactacgcaattgccacaccaagtgctacgcaaagattgctttttggtcttcttgaagcaccaccgtcatgggctccagatgcacttgatgcagcagttcagcttgttgaactccttcgggcagctgaagattatgctactggcatgcggcttccaaaaaattggttgcatcttcatttcttgcgtgcgattggaactgcaatgtctatgagggctggtattgctgctgatacagctgctgcgttgctttttcgcatactatcccaaccaatgttgctttttcctccactaaggcatgctgaaggagttgaagtgcaacatgaaccactgggtggctatgtatcatcatacaaaagacagctggaagttcctgcatctgaaaccacaattgatgccactgcacaaggcattgcttccttgctgtgtgctcatggtcctgatgttgagtggagaatatgtaccatctgggaagctgcctatggtttgttacctctgaattcatcagcagttgatttacccgaaatcgttgtagctgctccgcttcagccacctactttgtcatggagcctatacttgccactgttgaaagtatttgagtatctacctcgtggaagtccatctgaagcatgccttatgagaatatttgtggcaacagttgaagctatactcagaagaactttcccttcggaaacctctgaatcatctaaaagaccaagaagtcaatccaagaaccttgctgttgctgaactccgtacgatgatacattcactctttgttgaatcatgtgcttcaatgaaccttgcttcccggttgttgtttgtagtattaactgtttgcgtcagtcatcaagctttgccagggggcagcaaaagaccaactggtagtgaaaaccattcttctgaggaggccactgaggacccaagattaaccaatggaagaaatagggtcaagaagaaacaagggcctgttggtacatttgactcgtatgtgctggccgctgtttgtgccttatcttgcgagcttcagctgttccctatcctttgcaagagcgcaacaaactcaaatgtaaaagactctataaagatcctgaagcctggaaaaaacaatgggatcagtaatgagctacagaacagcattagctcagcaattctccatactcgtagaattcttggcatcctggaagctcttttctccttgaagccatcatcagttggtacctcctggaactatagttcaaatgagatagttgcagcggctatggttgccgctcatgcttctgagttatttcgccggtcgaaggcatgcctaaatgcactatcttccctgaagcgatgtaagtgggatgctgagatttctaccagggcatcatccctctaccatttgatcgacttgcatggtaaaactgtgtcctccatcgtgaacaaagctgagcctctagaagctcacctgacttttacatcagtaaagagagatgatgaacaacacattgaggaaaatggcaccagctcatcgggtagtggcaacttggaaaagaagaatggttcagcctcacacatgaaaaatggtttgtcaagaccactcttgaaatgctcagaagaggctaggcgaaatggtaatgttgcaagtacatccgggaaagttcctgcaactttacaggctgaagcttctgatttggcgaacttccttaccatggataggaatggcggttatcgaggctctcagactctcctaagatctgttatctcagaaaaacaggaactaagcttctctgttgtctcattgctctggcataagcttattgcatctcctgaaacgcagatgtctgcagaaagtacatcagctcatcaaggttggagaaaggttgtagatgctctttgtgatgttgtttcagcctcaccagccaaggcttcaactgctattgttctgcaggctgagaaggacctacagccctggattgctcgagatgatgaggaaggtcagaagatgtggagagtcaaccagcgaatagttaaactgatagctgagcttatgaggaaccatgatagcccagaagcattgataattcttgctagtgcttcagaccttctgcttcgtgctacagatgggatgcttgttgatggtgaagcttgtaccttgcctcagttagagctcctggaagtaactgctagagctattcatctcatcgttgaatggggagacccaggtgtagcagttgctgatggcctctcaaatctgttaaagtgccgtctatcgcctaccatccgctgcctctcccacgctagcgcacacgtacgtgcgctcagcatgtccgtcctccgtgacatcttgaacagtggaccactaggttccactaagatcattcaaggcgagcaacggaatggcatccaaagcccgacctaccaatgcgcggcagcaaacacggtgaactggcaagcggatgtcgagagatgtatagactgggaagcccgcagccgccgcgccaccgggatgaccctcgccttcctcaccgctgcggctaacgagctcggctgcccccttccttgctgacaaggccatatttggagctgacaatcagcgacacttgacagttggcgcgagcagttgctgcatggtcagcgagcaggatggctaattaatcccttgctcaaggatggcttcccagtctgccctgcccccatgatgtgattcaaaactgatgtatattagctgatgttcccaatcatacggagctttgctcccccggtgtgattttaacttgcaatctgacgttagatgttcaagcatattgaaactgcttgtgctgtaacttgtattcatgatgtaaccgaaagatgtccgctatggtaaatgaagacatgtcatttttcgttctccaaaaaaaaaaaaaaaaaaaa

SEQ ID NO: 10091 - DNA, 939 bp, Lycopersicon esculentum
  Predicted polypeptide sequence is orthologous to G28, G22, G1006
caaatactcataatgtatcaacttcccacttctactgagttaactttttttccggcagaattcccggtgtattgccggagttcaagtttcagtagtctcatgccatgtttaaccgaatcatggggtgacttgccgttaaaagttaacgattccgaagatatggtaatttatgggtttctacaagacgcttttagtatcggatggacgccgtcaaatttaacgtccgaggaagtgaaactcgagccgagggaggagattgagccagctatgagtacttctgtttctccgccgacagtggctccagcggctttgcagcctaaaggaaggcattacaggggcgttagacaaaggccatggggaaaatttgcagcggaaataagagatccggctaaaaacggcgcacgggtttggcttggaacttacgagtcggctgaggaagccgcactcgcttatgataaagccgcttttaggatgcgcggtactaaggctctattgaatttcccgcatagaattggtttaaatgagccggagccggttagagtgacggttaagagacgattatctgaatcggctagttcatcggtatcatcagcttcggaaagtggctcgcctaagaggaggagaaagggtgtagcggctaagcaagccgaattagaagttgagagccggggaccaaatgttatgaaagttggttgccaaatggaacaatttccagttggcgagcagctattggttagttaaaatatggagctaagaactcaatggctagggcttgtttggctttgaagtggacagaaaatagcaaatcattccactaggtgagaagtggaccaaagaggccatttggattatgtgtatctaacgtgtaaagtgcactttttagtttgtgcttttatgaaaaaaaacacacattttcataaaaaaaaaaaaaaaaaaaaa

SEQ ID NO: 10092 - DNA, 482 bp, Lycopersicon esculentum
  Predicted polypeptide sequence is orthologous to G28, G22, G1006
tattattcatccaaaacaagaatgagtattgtaattgatgatgatgaaatcttctctttacctagccttgatgaacttgaatccatcacacatcttctttatgacgacgattccgattttttcgaaactctttccccaatgagtttagatgttacaacattattgcctaatattcctacctccaattcaattgaatcccccgtaacaccggaggaaacaaaagaaccatctgtggcgtgtgaggacgcgccacaagattggaggcggttcataggggtgaggcggaggcagtggggcacgttttcagccgaaataagagatccaaataggagaggagcgaggctgtggctcggaacttatgagtccccgagggatgcagcattagcttatgaccaagccgcttacaagattcggggaaccaaagttcggcttaattttcctgacctgattggctcggacgtacctatgccacctagagtaac

SEQ ID NO: 10093 - DNA, 478 bp, Lycopersicon esculentum
  Predicted polypeptide sequence is orthologous to G28, G22, G1006
ttcataaccaaaattcaaaatgtattcaaattgtgaactagaaaatgatttttcagtactcgaatcaattagaagatacttacttgaagattgggaagctccattaacgagctctgaaaactcaacatcctcagagttcagccggagcaacagcattgaatccaatatgtttagtaattcatttgattatacacctgaaatttttcaaaatgatattcttaatgaaggatttggatttggatttgaattcgagacttctgattttataatccctaaattagagtcacaaatgtcaatcgaatcacctgaaatgtggaatttaccggaatttgtggctccattagagacggcggcggaggtgaaagttgaaacaccggttgagatgacaactacgacgacgaagccaaaggcaaagcattatagaggtgtgagagtgaggccatgggggaaattcgcggcggaaattagagatccggcg

SEQ ID NO: 10094 - DNA, 704 bp, Lycopersicon esculentum
  Predicted polypeptide sequence is orthologous to G28, G22, G1006
atggatcaacagttaccaccgacgaacttcccggtagattttccggtgtatcgccggaattcaagcttcagtcgtctaattccctgtttaactgaaaaatggggagatttaccactaaaagtcgacgattccgaagatatggtaatttacggtctattaaaagacgctctaagcgtcggatggtcgccgtttaatttcaccgccggcgaagtaaaatcggagccgagagaagaaattgaatcgtcgcctgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttggatgtcaaattgaacaattgacaggtgtccatcaactattggtcattta

SEQ ID NO: 10095 - DNA, 1051 bp, Lycopersicon esculentum
  Predicted polypeptide sequence is orthologous to G481, G482, G485, G1364, G2345
tttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacacgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattacatcattgtttctctaatagttgatgtttgaataagccttttttagtgtaccaaaaaaaaaaaaaaa

SEQ ID NO: 10096 - DNA, 485 bp, Lycopersicon esculentum
  Predicted polypeptide sequence is orthologous to G481, G482, G485, G1364, G2345
accagcaaaagactaaccactgttctatgtattcagcttttttttgggtatgcatccaaagttctttgttcatcttaaaattcataattgggagtttccatagtctaagccttgtgcaaaagaaccttcatacatgaactgcgtattggacccaagctgacttccaactacatcttttctaacagatgcatcaccaacccttgcagatcccttggcatctccctccatctctctgtatcgagtcaaatagaccttcagtggttcaatgtagtcctcaaatcccaaggtagccagggctgatagtaaatcatctccgttgatcgtctttctcttctctttctgacacttgtcactagcctcgctagtaataaaactgatgaactcagatacgcattcctgaaccgtgtctttagaatccttagcgatcttcccattagcaggcaatgccttcttcattatgcgtccaatattagcgatcggtaggt

SEQ ID NO: 10097 - DNA, 806 bp, Lycopersicon esculentum
  Predicted polypeptide sequence is orthologous to G481, G482, G485, G1364, G2345
cggccgaattggtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgatgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccgtgtcatatttaaagtttgtaaattga

SEQ ID NO: 10098 - DNA, 658 bp, Lycopersicon esculentum
  Predicted polypeptide sequence is orthologous to G867, G9, G993, G1930
gtagttacaccgagcgacgttggaaaacttaataggcttgttattccaaaacaacacgcagagagatatttccctttggttgccaaagtaaataaaaatgataatacttctaaaggggtattattaaatttcgaagatatgaatgggaaaatgtggcgatttcgatattcgtattggaatagtagtcaaagttacgtattaactaaaggatggagtcgttacgttaaggaaaaaaagttgaaggccggagatatagtgagtttcaaacgatgttctggagttgaaatcgaagataaacttcttattgattcgaagaacagaataatacgaggcgaacaagtaaaaatggttagattatttggagtgaatatatgtaaggttcaagatgttagtaataatgttgttgttgagaaaaatatgagtgttggcaaaagaatgagggagatggagttgttggcatttgagtgtagcaagaaacaaagggtaataattgatgccttgtgaatttttcttttgtttgtaattttttttttttgtactttggtttttttagatgttttaatttatataacttccaattgtatattagtgttattaggaaaaaaaaaagggctcaaaaagagagctaatcaactatggtgtaaacatagatgaaaat

SEQ ID NO: 10099 - DNA, 670 bp, Lycopersicon esculentum
  misc_feature (56)..(56): n is a, c, g, or t
  misc_feature (97)..(97): n is a, c, g, or t
  misc_feature (132)..(132): n is a, c, g, or t
  misc_feature (174)..(174): n is a, c, g, or t
  misc_feature (207)..(207): n is a, c, g, or t
  misc_feature (276)..(276): n is a, c, g, or t
  misc_feature (460)..(460): n is a, c, g, or t
  misc_feature (554)..(554): n is a, c, g, or t
  misc_feature (613)..(614): n is a, c, g, or t
  Predicted polypeptide sequence is orthologous to G1945, G2155
aatatatagaagaaagaaaaaaccattctagcaacattgatatgttcgctaaactnaatcaaacccaaaattcccagctccacggccaattgacagnacccaccgcagcgctgccgtcctcctccgccaacnggtggcgccaccatagaagtcatccggcgttcacgtggccgnccacccggctcgaaaaacaaatccaaatccaanctcaaacccagttgcatcatagcaacacgtgatggtcacgtggaaaaacccactatgagtccttacatnctcgaaattcccatcgggattgatattatcgattcgatctatcgattttgcgggaatcaaaatttgggtctatgtattctaaacgggtcgggtactgttactaatgttacacttaaacagccttcaattaacccatctgattctacaattaccttccatggaagcttcactattctttcgattncagctacaattataccgagtgatttttctccgattccgaacgggttcagtatttcattagccggtccacaaggtcaagttgttggtggaccggnaattggaccgcttttttcagctggaccggtttatttaattgcaacgacgtttaataatnntttttatcacaaatttccggcggaggacgacggcgagggcggtcagtcgccggatt

SEQ ID NO: 10100 - DNA, 546 bp, Lycopersicon esculentum
  Predicted polypeptide sequence is orthologous to G1945, G2155
cgatttctgccggtgttgttcaggcgaatgcgaatattccatcgaacaatgggataacaaatgggttcacaatttcattagcaggtccacaaggtcaagtagtaggtggtggtgtagttgggcctctagttacggccgggacggtttacctaatcgctgcaacttttaacggtccgtcttttcatcggttaccggcggaggaggaattagcaaggaataattctggtggtggaaatgaagatggatcgtctccgcagcaacatgcggaggtttccggtggaggagatggtggacatccaccgtcaacgacggcgccggaaagttgtgggatgtcgatgtacagctgtcatttgccgtcggatgtgatatgggctcctactgctagacaaccacaaccaccgccttactgaaaattcttgggatctgtgctctcttatgctgacaaattttcttcactaatctgggtttttgtaatttgggacttttttttttctagatatttatttagttgactttagatgaattgtgttatctttaatgttaatc

SEQ ID NO: 10101 - DNA, 1783 bp, Lycopersicon esculentum
  Predicted polypeptide sequence is orthologous to G2
gaggaaaaaaaaagtgaataaaactagttaacatacaaaagcaaaagtatattaatgaatgattgaacaagagtaaaaagccaagttactagggacaaagaataaagaaagagagaaaaatgtgggatctaaatgaatcagaagaaggttgttcttcaccgatagagtttgaaggcgatgatgagaaaggtaaacgggtcggatccgtttcgaattcaagttcatcagctgtagctgttgatgatatatctgaagaggaattagatggagaaagagggaagaaaaagagaggtaaaattttcggcttctctatggtgggtctgggtaacggcgatgaagaacagccggtgacccgacagttttttccggttgatgagtcggaaatgggtggtgttgctgctgaaaatggatgcccgaattttcccagagctcactgggttggagttaaattttaccaaacggagacacttggcaacacgggattggccaggcctgtagatatggttcagcagcaacagcagcctattaagaagagccgccgtggaccaaggtctagaagctcacagtaccgtggggttaccttctaccggagaactggccggtgggaatctcatatatgggattgtggaaaacaagtttatctaggtggatttgatactgctcatgcagcagctcgggcatacgatagggcagccataaaattccggggagtagaagccgacataaactttagcttagaagattatgagtccgatttaaaacagatgacaagtttaacaaaggaagaatttgtgcatgtgcttcgaagacaaagtactggttttccgaggggaagctccaagtatagaggggtgactttgcacaaatgtggtagatgggaagctagaatgggacagttcttaggcaaaaagtacgtttatttgggactctttgatactgagattgaagctgccagagcgtatgataaagctgccatcaagtgtaacgggaaggatgcagttacaaattttgatccaagcatttatgagaatgaactaaactcaattgaatctaccgataacgtggctgatcataatctggatttaagtttgggtggttcaagctcaaagcaaggaagtcaagaattgggggataatagaggtcaaaattcttcatcaataatgcaattggatattgattggcagcgccatggtttaaggcctgagaagcaatctgccttaattgatgctcgaagaagagaaaacaggtacaatgaaacagaaacgttgcaacttttaagccagacgcacttgcattctccagcctccttgaagcataacaataataataatagtcaagtgcaacggtttggccaatttatgagacctggtgatcaatcccatatgattcaaatgtttccacagcaatttggctcatcaaattatcaaattcaatttccaagtggcagcaatggtggaagaattggagctacaaatgtaagagatctatcgcttgcggcgacgagtaatggttcttcacaatggcaatccaattttcctcctcagatatttgtagctgctgcagcatcatcaggattccctcagcagatagtaagacctcagaattggtcctcagaaaatggtttccatcattcactcatgagaccttcttgactcatttaataacttgccatatttctatttgtgttttttttaagataatgtgtagattaaagggttgatattcttaatactccatatatattacctaaggctcttggtttgaaatcaaaaaaaaaaaaaaa

SEQ ID NO: 10102 - DNA, 827 bp, Lycopersicon esculentum
  Predicted polypeptide sequence is orthologous to G2
cttgcaaccaaatatcgaaaaatacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccaggtaaaatattcggattttcgattaaagaccacaatttggaatcgccggtagttacccggcaattttttccggtagataacgagtctaccaattttccaagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggtttttccaagagggaagttccaagtatagaggagtcactttgcataaatgtgggtagatggggaagctagaatgggacaattctttagggcaaaagtatgtttatttag

SEQ ID NO: 10103 - DNA, 535 bp, Lycopersicon esculentum
  Predicted polypeptide sequence is orthologous to G2
agaccaccaaaaaattaaaaacatttatttagtagctgtacttgtggatggtataaattggcagcttacatgagtaagaaatctagttcaatatctcttcttcagttagctttgtaccaactatatccatagagttggaatctctcaaaagcttttttttaccatcaagattaacccttgtaaatattatattacattatagtttacatcacaaccctccttcaggtgcgtgcggttcgctaactctcttagacgcaaaatattccatgcatcgatcgactgtctcgatagaaaattaattggatggtctggtgagagagtagttaaagccacttttgtgaggccagttttgatgtcttaatatctgctgagggaatcctgatgatgctgcagcagttgcaaataggtgaggaggaggaacagtattgctttgccattgttgagtatctcttctattgctgctgcttggaaactgaacttgataatttgaggaggtgaattgtggtggaatcatttgggagtcaccagctctcat

SEQ ID NO: 10104 - DNA, 696 bp, Lycopersicon esculentum
  Predicted polypeptide sequence is orthologous to G2
ttgtcgcaacaagtgcagccaatgaaaaaaagccggcgtggtccaaggtctagaagctcacagtaccgcggtgttactttttatcggagaactggccgctgggaatcacatatatgggattgtggaaagcaagtttatctaggtggatttgatactgcacatgctgctgctcgtgcgtacgatcgggcagcaataaaatttcgtggaatggaggcggacataaacttcaacctcgaagattatgaggaagatttaaaacagatgaagaatttaacgaaggaagaatttgttcatgtactgaggaggcaaagtactggttttccgaggggaagttctaagtatagaggggtgacattgcacaaatgtggtagatgggaagctagaatgggtcaattgttgggcaaaaagtacgtttatttgggactctttgatactgaaaatgaagctgccagggcttatgataaagctgccatcaaatgtaatggcaaggatgcagtcactaacttcgatccttgcatttatgaaaatgaacttaattcatctgaatgtagtaataaagcagcagatcacagccttgacttaagcttaggtagttcgagctcaaagcaaaacagccgtgaaatggaggatactaataagaatcaaaattatccttctatccaatttgatggtgattggcgacaccaagggtcgaaa

SEQ ID NO: 10105 - DNA, 1552 bp, Lycopersicon esculentum
  Predicted polypeptide sequence is orthologous to G4
gacaattatacattttccgtcaaaacataaatcatgtgtggtggttctataatctccgattacatagaccctagccggacttctcgccggctcaccgccgagtttctatggggtcgtttcgatctcggtaagaagcaaaaaaatcccaacaattatcactctaaagctaagcatttgcgatctgaagttgttgacgactttgaagccgattttcaggacttcaaagagttatccgatgatgaggatgttcaagtcgatgtcaagccatttgccttctctgcttccaaacactctactggttccaaatctttgaaaactgttgattcagacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagcagtgcttctgcagatacgggatttggttcgttcgtcccttcagctggcggtgatatctacttcaactctgatgtaggaagcaactcttttgaatgctctgattttggttggggagagccatgctccaggactccagagatatcatctgttctgtcagctgctattgaatgtaatgaagctcaatttgttgaagatgccaattctcagaaaaagttgaaatcatgcaccaacaaccccgtagctgatgatggaaacccccgttactatggtacctgaagagcttccagcttttgaacctcagatgaatttctttcatctcccatatatggagggaaattgggatgcatcaggtggtaacttcctcaacacaagtgcaactcaaaatggtggtgaaaatgctatggacctgtggtcctttgatgatgttccttctttaatgggaggtatcttttaagtcaacatgccttgagttttgtaaataaggcttcatgtgagtgattttttgctgttgtataatgtacttagtgcaaatatttgatatgttaatttgatctccgttaacttgttcttttaggtgtgtctggtggtggaagaagaatgatccacagagaaccatgattaagccatggataatgcactaagtagagcagtgcataggtaattaggtttaattaactactagtagagatgttaaattcgagttttacttaaaaacaattgggctgtatggattatgagaattgatgagacctcgatgcttgctataacgttacctttttagtgttgctttcacaaaaaaaaaaaaaaaaaa

SEQ ID NO: 10106 - DNA, 1518 bp, Lycopersicon esculentum
  Predicted polypeptide sequence is orthologous to G4
gatccgcaaaagcaaattttgacagtacttttcacttctcaccggtaccggaaaaagcatgtgtggtggtgccataatctccgattggataccgccgtctcgatcttcgagccgactcaccgccgaccagttatggggttgcgccgatctgcaaaacaagaagaggaacaagaagaagaggaatccttccaattatcactctaagcgcttgagatctgagaatgtagactttgaagctgattttcaggattttaaggatttttctgatgatgaagaagcttatagtttggatatcaaaccatttgctttctctgcttctgaactctctggaacctctgctggatccgaatcactgatatctgttgatgcaaacaaggaagttgagaaatctgccaagagacagaggaagaatcagtatagggggatcagaaagcgtccttggggtaagtgggcagctgaaatacgtgatccacagaagggggtccgagtttggattggaacttttaatactgcagaagaagctgccagagcttatgatgctgaagctcggaggatcagaggcaataaagctaaagtaaactttccagatgaagcttcagtgcctgcctcgaggcaagctggtaaggtgaatcctcggaaggttctttctgatgagagctctaacccagttccacccaacaccatgcttatgaacaacttgaatagtggatattgtgacaatgtgggcctgctcgaagagaaaacaaagactctgaatggctacgaagctttgtgtgtgactcctgtagatacaggacctaacccatatccccatccagctgctgctggtgtttacttcaattctgaccaaggaagtaactcttttggcccctcagacttttggggagaaacatgttcaaggactccagacatatcatctgttctgtcagctgctatagaatgcgatgaagctcaatttattgaaggtgtcgacctggaggagaaaccaaaatcttgtaccaacaatttggtgcctaataatgtgaacactgaacacaagccacctgaagtattttcaacttttgaatcccagttgaagttctatcagacaccatactcagaaggaaatatggatgtaccagtcgatgccttcctcgatgctgatgctactcagggtgttgaaaatgctatggacctttggtcctttgatgagctttcttctttaatgggaggcatctgagaaatgtgttacctgcagattctgtgtaaataagggcttcatgtgaagataaggtgtctgtgttaaggaggaggatgacaagttgacaaccattcaagcatgtttaggattccatggatggtgtactgagtagctgttttggttgtatagaccaataggtgggtaattagtttattaacaactgttgacaacaagctgaagtttccaaattttgcatcaatgtggatgataattgatggttcaaaatgctttaatatttcacaacttgggtgcttgacattgataaaaaaaaaaaaaaa

SEQ ID NO: 10107 - DNA, 1391 bp, Lycopersicon esculentum
  Predicted polypeptide sequence is orthologous to G4
ttcaaattgagctttttctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggccccaaatccgtgagatctggtgattcaaactgcgaagctgacagatcctccaagagaaagaggaagaatcagtaccgggggatcagacagcgtccttggggtaagtgggcagctgaaatacgtgatccaaggaaaggtattcgagtctggcttggtactttcaattcagccgaagaggcagccagagcttatgatgctgaggcgcgaaggatcagaggcaagaaagctaaggtgaactttcctgatgaagctccagtgtctgtttcaagacgtgctattaagcaaaatccccaaaaggcacttcgtgaggaaaccctgaacacagttcagcccaacatgacttatattagtaacttggatggtggatctgatgattcgttcagttttttcgaagagaaaccagcaaccaagcagtacggcttcgagaatgtgtcttttactgctgtagatatgggactgggctcagtttccccttcagctggtacaaatgtttacttcagctctgatgaagcaagtaacacttttgactgctctgatttcggttgggctgaaccgtgtgcaaggactccagagatctcatctgttctgtcggaagttctggaaaccaatgagactcattttgatgatgattccagaccagagaaaaaactgaagtcctgttccagcacttcattgacagttgacggtaacactgtgaacacgctatctgaagagctatcggcttttgaatcccagatgaagttcttgcagatcccatatctcgagggaaattgggatgcatcggttgatgccttcctcaatacaagtgcaattcaggatggtggaaacgccatggacctttggtccttcgatgatgtaccttctttaatgggaggtgcctactaagctgcatacacatcttcccctgctaagttttgtaaataacgcttcatttgagtgaagtttgcgcctgcgtttacgtttatcaccaaactaaaagactatatatgtgttgtattaatttattcaaaatttactcgtttgatatatgtaagtatgtatccttgttttcataaaaaaaaaaaaaaaaaa

SEQ ID NO: 10108 - DNA, 767 bp, Lycopersicon esculentum
  Predicted polypeptide sequence is orthologous to G5, G974
caaatctttctccaattgtcccttcttttttttttagccctctaaagttttcgcaattagaaacaaaattaagtttttcaaactgtctataactcactaaaggcctcgggtttcttcattgatcctctttttttctctggatcagtaaaaaaaaggggcaattcctctgttttactctgttttcctgaactctgttctctcattttatgaagttattataaatggacagaattcaagaaaacaactctatgtctagtatatttgatgagggtgctcaaattcgatcttcattatctcaactaattctaacaagtagtacaaacacattcgatacaattttttctcattgtcaagaaaataaccaaatgagtaatagtcctgtttttgagcctttaggtacttcagtctacctcagacaaagagatttgctacaaaaattctgtcaagaaaacatagcaaatatctcaataccaacaacttcgaaaacaatcccttttcgaaactctttgtatacacaaagttataagcttccagagaagaaaaaactatacaggggagtcagacagaggcattgggggaaaatgggttgctgagataagacttccacagaatagaatgagagtttggttaggtacttatgaaactgctgaagctgctgcttatgcttatgatagagcagcttataagcttcgtggcgatatgcaagattgattttcctaaatgtcgcgatccgagtaaagtgggatttggagatgagagaaatgatg

SEQ ID NO: 10109 - DNA, 786 bp, Lycopersicon esculentum
  Predicted polypeptide sequence is orthologous to G5, G974
ctaaaatattgtgtgtgtatttacattttctttcccccccccccctctctaacatcccgcttctttagatccctttctgttgtcgtctgtctttcaatttcagaaattttatacaaaaatcaaactcccttttaggtgttttgtttttgaaagccaggtgatccagaacagagatcaacgttctctttttattttttaaattgttcaaacaaccacaagggtctgtttttcgtatccctaaaggttggtttttttgatttgtagaaagctttgtaaaaatctctacctgttgtgtagttttgatattagaaagaggtaatactttttgtgtgttttgatattaaccatggcagcagctatagatgtatacagcagcagcagtaacttgtcagatcctttaacagaagaacttatgaaagcacttgaaccttttatgaaaggtgtttcttattcttcttcttcttcaccttcaacttcgtcttcttctttctatacttttggtgagcctaatttgtatactgatttctgcacaatcccatcaacggctacccaaatgttttctcaagggtattcgtgttttgacaatatgggtgtagctgaaacaggttcaattgggcttaaccatctaaccccttctcagatcttgcaaatccaagctcagatccaatttcaaaatcaacagcaacaactacaactattacatcaacaacaacagagcttaggtttgttaacacccacttcaacatattctaagaatctgaattctactaactttcttggtatgaa

SEQ ID NO: 10110 - DNA, 835 bp, Lycopersicon esculentum
  Predicted polypeptide sequence is orthologous to G5, G974
gtttgttccacttccacagagatgaattcccaaatcttttcaactgggttttctgggtatggaatggagcaacagggttcaattgggctgaatcagttaaccccaattcagatccagcaaattcaagctcaaatcaactttcaaaaccaacaacaacagcagcagcagcagatgatgttacagactgcccatcatgcttccaccatgaatttcttggctccaaagccggttccaatgaagcaatctgggtcgccaccaaaacccacgaagctctacagaggtgttagacaacgccactggggtaagtgggtcgctgagatccgtttgcctaagaaccgaacccgcctttggcttggtacatttgacaccgctgaagaagctgctctggcttacgacaaggcggcgtatatgcttcgtggcgactttgctcgactgaacttccctcaactccgccacaacggcaacctaatcggcggcgactttggtgaatacaatccattgcattcctcagttgatgctaagctaaaggacatatgccaaagcttggcacaggggaagagcattgactctaagaagaagaaaaccaaagggttgtcggcggagaaagcggcggtggtgaagatggaggaagaggagagcaaaacagcagaagttggatccgaaagtgacgggtcccattccggttccggtggatcatcgccggtgaccgaactgatattcccggagttcactgaggaagagccaacttgggacatgtcagaaaattttttgttgcagaagtatccatctcatgaaattgattgggcctctctataaaattagaaaataattaaga

SEQ ID NO: 10111 - DNA, 469 bp, Lycopersicon esculentum
  Predicted polypeptide sequence is orthologous to G8
tttttttttttttttttttctaaaaattatccaatccacaaaaatggtattcatacaaaagaaatcaatgactatgtttatacctatattactagttacggataagtacatgttatggaagtggtaggcggggattaatctggtaaaagcactgcgaggcatttgttgaagttgctaatgcagatgttgatgaagtgatagaagtagtagatggaatgaagaatcctgatgatgctgccgtgcagaacattgtcaatgggctgtttgtatcaacctgactaggcatttgcagtgcccaatttggaggtccttgtgatgaacctgtgtcctttctcttgtcatatgctcttccctcatagctggaagagaaattagaatagattccagtccacaattgagcttgttgggacgacattggtagtcccttgagatgtgaacttccaactattactgaaccaggtttatccat

SEQ ID NO: 10112 - DNA, 882 bp, Lycopersicon esculentum
  Predicted polypeptide sequence is orthologous to G12, G24, G1277
cggccggggatatcacattttctcctttctccatcttctttcttctgaaaaaaactaacaaaacaagtgaatatatttaatttttttcagtatgatggaaggagagaagagaaaacagaggcaacaccagcaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaatgtataggggatgaccatgaaattcacgatctatcagctgcttctattaaaaagaaagctactgaggtaggtgctcgagttgatgctctgcaaactgcgattcacaattctactgttaattctgttgaatcaaactgtaattcgaattctaaatctacaaggatgatgatgaagcctgatttgaatgaatatcctagcccggaaagttgcgacgaagataactgaatctctgcgggttaacagaggccaaaagggggattatttttatgttgattagatatactgaggatccatgtatgaaatataatccgaagggattatatgttaatattatcaattatgatagttattaaaggaaatttaatctccaaaaaaaataaaacaaaagaaagaaaaaaaaagaatgagaaaacccaaaaaaaagaaaaaaaaaagctggcggccgcttcggcccagtcaactctaactcgagaagttatgcatgcgccgcaatcgagccatgccaattcgccttaaggagtcgattacatcactggcgtcgtttacacgtcgtgactggaagcctg

SEQ ID NO: 10113 - DNA, 467 bp, Lycopersicon esculentum
  Predicted polypeptide sequence is orthologous to G12, G24, G1277
ggcttatgatacggcggtctattatctaatatgcccttcggcccgattgaattttcccgagttgttagttggtgatggtgggcttaatgatttgtctgctgcttcgattcgtaaaaaagccatagaagttggtgctcaagtagatgctgtacagaactcgcttgcaacccatcataaccatacagaggaaaaggtgcactctgagacggcaagcccctcagaattgaagccttgttggtttcaagagaagcccgatttaaacttgaagcccgagcccgaagatccagaagtggattactggtaatatttagttaatatcgatattaccaataacagtatctctactagtgtaatttttaattatttttttggctttttgttggttgggggaagaggaagtgctttggtaagaatacaagcgccgctccaggttgtgtagcttggtagcctaagattgttattttctt

SEQ ID NO: 10114 - DNA, 819 bp, Lycopersicon esculentum
  Predicted polypeptide sequence is orthologous to G19
aaaaaagagttagaaaagatgtgtggaggtgccataatctccgattatgatcccgccggaagcttctaccggaaactttctgctcgtgacctctgggctgagctggaccctatctccgactactggtcctcttcttcctcatcctcaaccgtcggaaaacctgattccgctctgtcgccggtgactcactccgtcgataagcctaataaatcagattccggcaaaaaaggtaataagactgtgaaggttgagaaggagaagagtagtggaccaaggccaaggaagaacaagtacagaggaataagacagaggccatggggaaaatgggctgctgagattcgcgatccacagaagggtgtacgcgtttggcttggtacattcaacacagcagaagatgctgctagagcctatgatgaggctgctaagcgcattcgtggtgataaggctaaactcaactttccagccccatcaccaccagctaagcgacagtgcactagcactgtcgctgctgctgatacaccaccagcactactccttgagagttctgacaactctcctttgatgaactttggatatgatgtccagtatcagagccaaactccctactaccccatggaaatgcccatagttagtgaagattatgaactgaaggaacagatttccaatttggaatcgttcctggaattggagccatctgatcaattttcagggatcgtcgattctgatcctcttaatgtttttctgatggaggactttgctttcactcatcatcagttctactgaacatgatcaaagtgttatttcgggagtattttatgg

SEQ ID NO: 10115 - DNA, 600 bp, Lycopersicon esculentum
  Predicted polypeptide sequence is orthologous to G20
ggcttcaaatgctactctgtttactttaatttcagcttccttaaattctttctgctccaggactgtgttgcttatggcttccctttcctctgagcctactgccaagactgagggtagcagtggcaatgatgctggtggtggagaaacatcagaagctatggggcatatagggactgatcaactgttattatatagaggactgaaaaaagcgaaaaaagaaaggggttatacagccaaggagcgcataagcaaaatgcccccatgtactgcagggaagcgcagctccatctatcgtggtgtcactaggcatagatggactggtcgttatgaagctcatctttgggataaaagtacctggaatcaaaaccaaaataagaaaggaaagcaagtttatttaggagcatatgatgatgaggaggctgcagcaagagcatatgatcttgccgctttgaaatattggggtcctggaaccctcattaatttcccagtgacagattacacaagggaccttgaagagatgcaaaatgtctcaagagaagattatcttgcatcattaagaagaaagagtggtggtttctccagagggatctctaaatatcg

SEQ ID NO: 10116 - DNA, 1003 bp, Lycopersicon esculentum
  Predicted polypeptide sequence is orthologous to G25
gaaaacttttctatacatttttcatttctgtatcaatcaatattctttgtttctgctgttttgagtaaacacactaagatgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaacattgcttgtgatactactgttacttacaatcaagaatcaaataactgttaccccttttactcaatcgagaacgttgaacctgttatggaatttgcaagttataatggaattgaagatggaggagaggagatggtgaaaaatttgaataacagggttgtagaggaagaggagaaaacagaggatgaagtgcagatactttctgatgagctgatggcttatgagtcattgatgaagttctatgaaataccgtatgttgacgggcaatcagtggcggcgacggtgaatccagcggcggagaccgccgtgggcggtggctcgatggagctttggagttttgatgatgttagtcgtgtacaaccaagttataatgtagtttaattattgttttgtttaaacttttcataattttattttatcgaattaggaagaattgagtttttataatttaatcaattgtgtaaaactatgtttctaattcattaatattatattggatatgttgttatcaaaaaaaaaaaaa

SEQ ID NO: 10117 - DNA, 1782 bp, Lycopersicon esculentum
  Predicted polypeptide sequence is orthologous to G38
ctctacaagctttttgttaagagactaaaaaaaacaaaaaaaccttgaagaactcaccaatttgatcaattcatttattaaaaaaaaaaacagagaagaaaagagaaatggctattatggatgaagctgctaatatggtttgtgtgccgttggattatagtagaaagaggaaatcaaggagtagaagggacagaacaaaaaatgtggaagagacactagctaaatggaaggagtataatgagaaactagacaatgaagggaaagggaagccagtgcgtaaagttcctgctaaaggttcaaagaaggggtgtatgagaggtaaagggggaccagaaaattggcggtgtaaatacagaggtgttagacagaggatatggggtaaatgggttgctgagattagggaacctaaaagaggtagtaggttatggttgggtacatttggtacagcaattgaagctgctttagcatatgatgatgctgcaagagctatgtatggtccttgtgcaaggcttaatttgccaaattacgcgtgtgattctgtttcctgggcaactacatctgcatctgcatctgcatctgattgcaccgttgcttctggtttcggcgaggtatgtccggttgatggtgctcttcatgaagctgacacaccattgagctcagtgaaagacgaagggaccgcgatggatattgttgaacctacgagtattgatgaagatacgcttaagtctggatgggattgtctagataaattaaatatggatgagatgtttgatgtagatgagctattggctatgttagattctactccagttttcaccaaggactacaattcagatggaaagcacaacaatatggtatcagattcgcaatgtcaggagccgaatgcagtggtagatcctatgactgttgactatggctttgattttctgaaaccaggcaggcaagaagatcttaatttcagttcggatgaccttgcattcatagacttggattctgaacttgtcgtttgatagttttcgcagttgaaagatgcaatgcaagataacatgtatcgtcattgattgagatataggacgcgaggaagagaaaactcgagatgttgagtttggacaatgttttcgtatcgttcaatttttttttatttcatgttgggcagcattggttgcccttttcccaggccagctgattctcgataagtttttgcatcgaagattatgcatttggtgttctggaggactaatcttgtacagatctaaccggcctagtgagtcaataattgttcgttttggtgtgttgatatgacgaataaagatgtttctgggattcatagtttgttgtaaagtttgcttgacaattagaggtactgatttttgtgctttcattggaacaatgtagaatgcattgacggcatttacagttcattcataacttgaacaataagtttggcagtgtgtatttgtgttactttgtgaagtattcccaggggattcgccaacgaatgctgtgttgtgtgttcaagtgtttcgagtagatcagagaagtactggaagcagtggtgctatagtgttttatgttagccctcatcgtggtttggtagatttgtgtagttctgttttgcacttaggcttttttatctctatcagaagttgtactcaggatgtaatagtagacgttttgagacgtttcaaaatgttccagttcatgttctttaccacattgtaattcaataaattctgcggtaatcttaagatgtggaaaaaaaaaaaaaaaaaaaaaaaaaaa

SEQ ID NO: 10118 - DNA, 819 bp, Lycopersicon esculentum
  Predicted polypeptide sequence is orthologous to G43, G46, G1419
ttcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaactttgattaacaaatttgaattcctaaaaaaaaaaaaaaaaa

SEQ ID NO: 10119 - DNA, 1347 bp, Lycopersicon esculentum
  Predicted polypeptide sequence is orthologous to G43, G46, G1419
aaaatgggttctccacaagagacttgtacttcacttgatttgattaggcaacatctttttgatgaatctctggaccagacttgtttctcttttgaaacaactcaaacttcaaatcttgatgacatcgcaagcttctttaatgctacttcaaaaacagagtatgatggttttttcgaatttgaggcaaaacgacatgttatccattcaaattctccgaaacagagtaacttgagagaacggaagccatctctgaacgtagcaataccggcgaagcctgttgttgttgtagagaacgttgagattgagaagaagcattacaggggagttagacagaggccatgggggaagtttgcagcggagattcgtgacccaaatagaaaggggactcgagtttggttaggaacatttgatactgctgtggatgcggcaaaggcatatgacagggcagcgtttaagcttagaggaagcaaagcaatattgaatttcccactcgaagttgcaaactttaagcaacaaaatgatgagactaaaacagagacgaagtcgtcaggcagtaaaagggtgagaggagaaacagaggaattagtaatcaagaaggaaaggaaaatagaagaagaaagagtactcccaacggcggcggctccattaacaccgtcaagttggtcgacgatttgggatgaaaagggtatttttgaggtgccaccattgtcaccattatctcagcttgttatgatataattttggattataagtatttgatgaatatgcacctgactataaactaagtctgaggtgaattaggattataattatgtgtctctttggatctttaatctttaataatttctttcattaaaaaaaaacctcgtgccgaattcggcacgagggcaaaagcttcttctggttccatgcagcagaactcacaacacatgaaaacttccgcaactgatgatgttcctcaaacattcttctcaagatccccatctagcacgtctgttgcagggaaggcttctgaccaacctaaaagaacaccggtgtctcaggaggaaattgagtccattttgttaggtggctgcaactaattttgaggcgaagatgtgcagacagaggacatagtttttcgacgtctggcttacatttgggtgatttcttttgcatgtatggtataactgacacagttttctggaattataagtgtattctgcaaatgacatctttaattaatgatcattagacattggaggctaatgcgtggattggcttactaccttgatactgaatgtaaacatttgcagactatgcattataaaattttggtccatctgaaaaaaaaaaaaaaaaaaaaaa

SEQ ID NO: 10120 - DNA, 1105 bp, Lycopersicon esculentum
  Predicted polypeptide sequence is orthologous to G43, G46, G1419
gcggcaggtcgaaaaccttcgttaaacatttcgattccttctgttaagaaaacagaggaaccaaaaacaggggaagtaaaaacaggggaaccaaaaacagaggagccaaaaacaggggaagtgaaaacagagtactctgttaaggagaaaatggtagaaaattcggagaaaaagcgatacagaggagtgagacaaaggccatgggggaaatttgcagcggagattcgtgacccaactagaaaggggacacgagtttggttaggaacattcgatactgcaatggatgcagccatggcatatgacagagcagcatttaggctcagagggagtaaagcaatcttgaattttccacttgaggtaagcaatttcaagcaagaaaatcatgagattgagaaaaatgttgtgaatttgaattcgaatacgaattcttgtgggaaaagggtgagaagggaaatggagaatgatgacggaattgtaatgaagaaagaggtgaaaagagaacaaatggtggcaactccattaacaccttcaaattggtcttcaatttgggattgtggaaatggaaaaggtatttttgaagtgccacctttgtcaccattatcaccacattcaaattttggttattctcaacttttggtatcatagtgaaatccccaaaagatccattgagtatgttatggaatattatatagcggaattatactgccatcacgatcccatgagatttagtcttttgttatgttgagagttttaaaatgttatggcagaatatattactgtcacaatccactgagatttagacctttattgtgtcgatccactgaaatttagtcgagagttttaaaatgaaatattttgaacaagtatgaagtgatttcaagttgtaataaggaatttactttggaaattttggataaaaatagcacatgtacaaatgaagaaacatggaatgatggagggagaatggaagtgttttgaatcatggatatttttaattattttttgatttcattgattaagcttttttttttccatgtaaatatgaattttaatttggttggtttattttgaaggaaaaggttcaaaaaaaaaaaaaaaaaaaaaa

SEQ ID NO: 10121 - DNA, 618 bp, Lycopersicon esculentum
  Predicted polypeptide sequence is orthologous to G129, G136, G140, G146
gcacgagctttggaagttgtgtgagttttcagaaagcctttgaagttcgccggaaaatagcaatattttcaattcaagccaatcagatgggaagaggaaagatagagataaagaggatagagaacaacacaaacaggcaggttacattttgcaagagaagaaatggattgttgaagaaagcctatgaactctctgttctatgtgaagctgagattgctcttattgttttctccacacgtggacgcgtctatgaatactctaacaacaacattaaggcaactattgaacgatacaagaaggcaactgctgaaacctctaatgcttgcaccactcaagagctcaatgctcagttttatcaacaagaatcaaaaaagctgcgccaacagatacaaatgatgcagaattcaaacaggcatctggttggtgaaagattaagttgtttgaacgtaagagagctgaagcagttggaaaatatacttgaacgaggcatcagcagaatcagatcaaaaaagcatgagatgatactggctgaaactgagaatttgcagaagagggaaattctactggaacaggagaatgcattccttagatcaaagatagcagaaaatgagaggcttc

SEQ ID NO: 10122 - DNA, 761 bp, Lycopersicon esculentum
  Predicted polypeptide sequence is orthologous to G129, G136, G140, G146
gaaaaatcatttgaagaatggggagaggaaaagttgaattgaagagaatagagaatcaaacaaataggcaagttaccttctccaagagaagaaatggtttacttaaaaaagcttatgaactctctattctatgtgatgctgaagttgcccttctccttttctctccttctggcaaagcttatcatttcgcgagccacgacatcgaaaggactattttaaggtacaagaatgaagttggattgtccaaaaatagtgatcaaggtcccagagctatggaggtttggagaactaagattgatgacatgacaagaacaatacatgaacttgaagctagagataagcatttttgctggagaagagttatcaaatcttggtatgaaagattgaagcagttggagcgtcaactcagagttggagttgaacgcattcgatctaaaaagcataaaatccttcatgaggagaacatccatcttcaaaagcaagtaaaattatatgaagtagaaggagctcaaggattctcgatacaaatccaaggatgaggattatatgatttacagagcttcaattgctaccttaagtggacgtatacgtagcatatattataaatagtgtgtatgatatatttaggatgataatttttttgtgttgtttgaatatatttattgactatctagaattttcattccaagttaatgttaggtaaaagaaaaatatgaagttactatgttaatattataatttgaaatatgaattttatgctc

SEQ ID NO: 10123 - DNA, 1084 bp, Lycopersicon esculentum
  Predicted polypeptide sequence is orthologous to G129, G136, G140, G146
cattatatactaatttgcaaccaaaaaacttaaaaatcttctctttcctttccttacaaggtgaagtaatggacttccaaagtgatctaaccagagagatctcaccacaaaggaaactaggaagggggaaaattgagatcaaaaggatcgaaaacacgacgaatcgacaagtaacattctgcaagaggcgcaatggtttgcttaaaaaggcttatgaattgtctgtgctctgtgatgctgaggttgctttggttgtcttctcaaacagaggcagactctatgagtatgccaacaacagtgtgaaagcaacaatcgagaggtacaagaaagcatgctcagattcctcaaacactggttcagtatccgaggccaatgctcagtattaccagcaagaagcctccaaactgcgcgcacaaattggaaatctgatgaaccaaaacaggaacatgatgggtgaagctcttgctggaatgaaactcaaagaactgaagaatctggagcaaagaattgaaaaagggattagcaaaatccgatccaaaaagaatgagctgttgtttgctgaaattgagtatatgcagaagagggaagttgatttacacaacaacaatcagtacctgagagcaaagattgctgaaactgagagagctcagcatcagcatcagcagatgaacttgatgccagggagttcatcaaactatcatgagcttgtgcctccacctcagcaattcgatactcgaaactatctacaagttaatggattgcaaaccaacaaccattaccctagacaagaccaaccccctattcaactagtctaatgtgcttgagagattgtcttctttctgatgtgatctacatataatccacaaaagaagactgctattaagcttgaagattaatggaacttaagtatgtataccatattattaattacttgttgcatgagctaagactcttgaatattgtatgttaattaagtggacatgtattttttttgcttggtgtacttccttttctgccagtgaactatgaagaattaagcttgttatattaagttcacaactgtttttctgtccaaaaaaaaaaa

SEQ ID NO: 10124 - DNA, 916 bp, Lycopersicon esculentum
  Predicted polypeptide sequence is orthologous to G129, G136, G140, G146
gcatatcttatccattcaactcactcagatcgatcgattcgatcgatgggtcgaggaaagatagagataaagaggattgaaaacaacacaaatcggcaggtgacgttctgcaagagaagaaatggattactgaaaaaggcatatgaactttcagttctatgtgatgctgagattgctctcattgttttctctactcgtggtcgactctatgaatactctaacaacaatgtaaaggcaactatagaacgatacaaaaaggcaacagcagaaacgtctagtgcgtacactactcaagagctcaatgcacagttttaccaacaagaatcaaagaagttgcggcaacagatacaaatgatgcagaacacaaataggcatctggtgggtgaagggctgagctctttgaatgtgagggaactgaagcaattggagaacagacttgaacgaggcattacaagaattaggtccaaaaagcatgaagcaatactagctgagactgaggatttgcacaagagggaaattcaacttgaacaggaaaatgcattccttagatcaaagatagcagaaaatgagaggttgcaggaactaagcatgatgccatctggtggggaagagtataatgcatttcaacaatatttagcaagaaatatgctacagctcaacatgatggaaactgcactaccatcttatgatccattgtctcctgatcacaaaaggtaaatccatttctactgaggaggaaggaatacgcacttttcaaacatataaataatctttactacatgtttgctattagtatactctggacatctcaactttttttccaatagaccctgcatcatttcctaaaatttggggcttagttatgaaatttaattgaatttgggtaaaagatcgtcacaaaaaaaaaaaaaaaaaa

SEQ ID NO: 10125 - DNA, 1116 bp, Lycopersicon esculentum
  Predicted polypeptide sequence is orthologous to G129, G136, G140, G146
gttttttttttcttcttttcgatacaagacgatatggtttttcctattaatcaggaattacttgtcgatgagtcgtcttctcagttgagaaaaacaagtggaggaactggtggaggaggtagagggaagattgaaattaaaaggatcgaaaatacgacaaatcgacaagttacgttctgcaagcgtagaaatgggctattgaaaaaagcttatgaactttctgtcttgtgcgacgctgaagtttcactaattgtattttccagccgcggccgtctctatgaatatgccaataacagtgttagggcaactattgataggtacaagaaacaccatgctgattccactagtactggatctgtttctgaagctaacactcagtactaccagcaagaagcatccaaactgcgacgacaaattcgagatatacagacttataacaggcaaatagttggagaggcattgggcagtttaagccctagagacctcaagaatttggaagggaaacttgaaaaggccattggtagagtccgttccaaaaagaatgaattgcttttctcagaaatagagctcatgcaaaagagggagattgagctgcagaacgccaacatgtatctacgcgcaaagatagcagaggtagagagagcacaagagcaaatgaacttgatgcctggaggcggaggcggaggcggaggcggaggaggaggaggatctgatcatcaataccatcatcagccaaattacgaagatgctcgcaataactccctgcctgtaaatctcctggaaccaaatcctcattactctcgtcgcgacaatggtgaccaaactcctctccagcttgtctgataataatggagcaggtattctgaaatttggggtcaaggctcttcatcttcagaaaaatgtgtactacaatttttaacctatagtgttgtaaatcataatcataattattgccactgagatttaaactgtttatttttaagcaatattattcagtcatctgttaattaaggaatgaaaaatcttgtttgttatattatgactacttctatatacttttacagccttatataaataatatgctattgaactataaaaaaaaaaaaaaaaaaaaaa

SEQ ID NO: 10126 - DNA, 639 bp, Lycopersicon esculentum
  Predicted polypeptide sequence is orthologous to G131, G135, G155
gcgcttgaaatgtcgatgctgtgcgatgctgaagttgctttaattgttttctctcaaaagggaaaaatctttgagtattcttctgattcatgtatggaacaaattcttgaacgatatgaaagatactcatatgcagagagacgtttgcttgcaaataattctgaatcaccggtgcaggaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaactgcagaaaaaggaaagagctatcctagaggagaataacatgctaaccaagaagattaaggagaaggataagatagtagaacagcaaggtgaatggcaccagcaaactaatcaagtttctacttcaacatctttcctcttacaaccacatcaatgcctaaatatgggaggtaattaccaagatgaagtagcagaagcaaggaggaataatgagcttgacctaaatcttgattcattatatccactttacaacatgaataaacatcta

SEQ ID NO: 10127 - DNA, 1151 bp, Lycopersicon esculentum
  Predicted polypeptide sequence is orthologous to G131, G135, G155
gccttccacttcccaataacgatacagttttttaatttatcatttgccaaaaacaaagaattactaaacataaatatccatttccattgcacaatatacatatatatacacacaaagaagaaagaagaaagaaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttgcatggaaaggattcttgaaaggtatgaaaggtactcatatgctgaaaggcagcttaatgctactgatattataaccccgggtagctggactttggaacatgctaagcttaaggccagacttgaggttttgcaaagaaaccaaaagcattatgcaggagaagagttggacacattgagtatgaaagagcttcagaatctggaacaccagctcgattctgctcttaagcacattcgctctagaaagaaccaattgatgcatgaatccatttctgagcttcaaaagaaggacaaggcattgcaagaacaaaacaacaatctttcaaagcaggttaaggaaagggagaaagagatggcccaacagactccgtgggagcaacagagtcatgatcatctcaattcatcttcgtttgttttgccacacccctttaacaatcttcacataggggaagcatacccaaatgcaggagacaatggagaagtagaaggatcatcgcggcaacaacaacaaaacagtgcttctgtggtgcctccatggatgcttcgccatctcaacggttaaattaaaacttaatgaagtataaagcaagcggacaatattatgttatctattaatcactaatagtatatgcacatatattatatatatgtatgttacatattagacaaacacaactttcatatctacttaattgtgtatggtgtatatatggctgttgtgtaacaatatgcacaatatattgtagtagtaccatatatcatcctctctttggatgttttgtcttaaaacattttaccactagcacccaaaaaaaaaaaaaaaaaa

SEQ ID NO: 10128 - DNA, 1082 bp, Lycopersicon esculentum
  Predicted polypeptide sequence is orthologous to G131, G135, G155
ccacacccttctttttttttcttccgtctgtctccatttgatatgatatatatattacaacaacaattattcatagtatagaaaaaatatccgaaaaaatgggaagaggaagagtccagttgaagcgaatagagaacaaaattaaccgtcaagttaccttctcgaaacgtcgatctggtttgctgaagaaagcccatgagatctctgtgctttgtgatgctgaggttggtttgattgttttttctactaaaggaaaactctttgaatatgccaacgattcctgcatggagaggatacttgaaagatatgaaagatactcatttgctgagaaacagcttgttcctactgatcatacctccccggtaagctggacccttgaacatgcaaaacttaaggccagacttgaggttctgcagaggaaccaaaagcattatgtgggagaagatttggagtccttaagtatgaaggaacttcagaatctggagcaccagcttgattcagctcttaaacacattcgatcaagaaagaatcaattgatgcatgagtccatttctgtgcttcaaaaaaaggacagagcattgcaggagcaaaacaaccagctttcgaagaaggtgaaggagagggagaaagaggtggcacagcaaaatcagtgggaaatcaactcatcttcatttgttttgccacaacaactggactctcctcaccttggggaagcataccagagtactaatgtaatagataatggggaagtggaaggaggtagttcttcacagcagcaaggtgcagctaataatactgtgatgccacaatggatgcttcgtcatcttaataattaaaaggtatcattaatacttcaatataattaactaggtatataattttgatgccacaatatattaattaaaaggtatcattaatacttcaatataattaactaggtatataattttgatgccacaatatattgtctatgtgtacttgctttcaaagacatgccacaatatagatggattgttgtaaaaacattataatatatgttaaaaataaattttgatgtaaaaaaaaaaaaaaaaaaaaaaaaa

SEQ ID NO: 10129 - DNA, 956 bp, Lycopersicon esculentum
  Predicted polypeptide sequence is orthologous to G131, G135, G155
tctctatctatgctaggtagcttatatgatttaatagttcgattaatttaaatacgcattaaagatagaggatgggaagaggtagggtagagttgaaacggatcgagaacaaaataagcagacaagtaacattctcaaagagacgatctggattattgaagaaagctaatgagatctcagtattatgtgatgctgatgttgcattgattgtgttttctaccaaaggcaaacttttcgagtattcctcaaatgactcaagtatggaaagtattcttgaaagatatgaaagatgctcatatgcagagagacagatgaatgctaatgattctgatcccaaggaaaattggagtgtggagtatccgaagctcatgtcaagaattgaacttttacaaagaaatataaggcattacatgggtcaggatctggaccctctcagtttgcgtgagctccagagtatagagcaacagattgatacttcattaaagagaattagaagcaggaagaatcaactgatgcacgagtccatttctgagctgcagaaaaaggagaaagcgctccaagaacaaaacaacttgattactaagaagctaaaagaaaatgagaagacacaacccaactcatcaggccaaaactcagcaacagttcatgtgtttccatcacattctcaccaccaacttcctaaccttacaattgggggggcttttggaggaatgaacagagatggatcgggtcaggctcatcactatccgggttcaaataacaataataataattcctcattgataccgccatggatgctccgccacgtcagcaacgaaggatgaaataatattccggagagtataattaattaattgtatatgttttgttccaaacaatattaatcaactttcctgtttgtgatgtataattagcttaagctaataaaacttttcatccttaaaaaaaaaaaaaaa

SEQ ID NO: 10130 - DNA, 478 bp, Lycopersicon esculentum
  Predicted polypeptide sequence is orthologous to G131, G135, G155
cttttttgaagatgggaagaggaaaagttgaattaagaaaaatagagaataaaataaatagacaagtaacattttcaaagagaagaggtggattagtgaaaaaagctcatgaaatttcagttttatgtgatgctgaagttgctttaattgttttctctcaaaagggaaaaatctttgagtattcttctgattcatgtatggaacaaattcttgaacgatatgaaagatactcatatgcagagagacgtttgcttgcaaataattctgaatcaccggtgcaggaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaact

SEQ ID NO: 10131 - DNA, 1049 bp, Lycopersicon esculentum
  Predicted polypeptide sequence is orthologous to G131, G135, G155
aattcgattgaagatgggaagaggaaaagttgaattaagaaaaatagagaataaaataaatagacaagtaacattttcaaagagaagaggtggattagtgaaaaaagctcatgaaatttcagttttatgtgatgctgaagttgctttaattgttttctctcaaaagggaaaaatctttgagtattcttctgattcatgtatggaacaaattcttgaacgatatgaaagatactcatatgcagagagacgtttgcttgcaaataattctgaatcaccggtgcaggaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaactgcagaaaaaggaaagagctatcctagaggagaataacatgctaaccaagaagattaaggagaaggataagatagtagaacagcaaggtgaatggcaccagcaaactaatcaagtttctacttcaacatctttcctcttacaaccacatcaatgcctaaatatgggaggtaattaccaagatgaagtagcagaagcaaggaggaataatgagcttgacctaaatcttgattcattatatccactttacaacatgaataaacatctatgaataatttcactctttgctaatcgcttgaaacgttgaaaggagctcactatcaggacagacaaatgagtataagcgattagcgataaaaactctatgcgagaggaaattatatatgatgttaattaatctatgcttgagaaattcttaattatatatattgagtgtctttatattgatatgcatgtatagaaccttattattatgaatttctatgtattaatgttttaagtatgttaaaacttaattgtaaatggaatcaagtccattctctttgtatcaaaaaaaaaaaaaaaaaaaaaaa

SEQ ID NO: 10132 - DNA, 1072 bp, Lycopersicon esculentum
  Predicted polypeptide sequence is orthologous to G131, G135, G155
tagttagaaaaaatatccgaaaaaatgggaagaggaagagtccacttgaagcgaatagagaacaaaattaaccgtcaagttaccttctcgaaacgtcgatctggtttgctgaagaaagcccatgagatctctgtgctttgtgatgctgaggttggtttgattgttttttctactaaaggaaaactctttgaatatgccaacgattcctgcatggagaggatacttgaaagatatgaaagatactcatttgctgagaaacagcttgttcctactgatcatacctccccggtaagctggacccttgaacatgcaaaacttaaggccagacttgaggttctgcagaggaaccaaaagcattatgtgggagaagatttggagtccttaagtatgaaggaacttcagaatctggagcaccagcttgattcagctcttaaacacattcgatcaagaaagaatcaattgatgcatgagtccatttctgtgcttcaaaaaaaggacagagcattgcaggagcaaaacaaccagctttcgaagaaggtgaaggagagggagaaagaggtggcacagcaaaatcagtgggaaatcaactcatcttcatttgttttgccacaacaactggactctcctcaccttggggaagcataccagagtactaatgtaatagataatggggaagtggaaggaggtagttcttcacagcagcaaggtgcagctaataatactgtgatgccacaatggatgcttcgtcatcttaataattaaaaggtatcattaatacttcaatataattaactaggtatataattttgatgccacaatatattaattaaaaggtatcattaatacttcaatataattaactaggtatataattttgatgccacaatatattaattaaaaggtatcattaatacttcaatataattaactaggtatataattttgatgccacaatatattgtctatgtgtacttgctttcaaagacatgccacaatatagatggattgttgtaaaaacattataatatatgttaaaaataaattttgatgtatgaaaaaaaaaaaaaaaaaa

SEQ ID NO: 10133 - DNA, 730 bp, Lycopersicon esculentum
  Predicted polypeptide sequence is orthologous to G133
aaaaaaaaaaaaaagaagaagaagttatggctcgtggtaagatccagatcaagaaaatagaaaaccaaacaaatagacaagtgacttattcaaagagaagaaatgggctattcaagaaggctaatgaacttactgttctttgtgatgctaaagtttcaattgttatgatttctagtactggaaaacttcatgagtttataagtccctctatcacgaccaaacaattgttcgatctgtaccagaagactattggagttgatatttggactactcactatgagaaaatgcaagagcagctaaggaagctaaaggatgtgaataggaatctacgaaaagagatcagacagaggatgggagaaagcctaaatgatctgaactatgaacagttggaagaactcatggaaaatgtggacaattctctgaagcttattcgtgaaagaaagtttaaggtgattggcaatcagattgaaacttacaggaaaaaggtaagatgtcatatttctatatgttgaaatataagtaactaataaaaagtgtgttatctctttaagttaagtttttagatggaatgatcacacacttaaatactaaaaaaaagaagaagaattcatattttggttgattgcaggttaggaatgtggaagaaataaatagaaatctcctacttgaatttgtaagtgcttaagcttgttaataccttttttttttttttgcatagcatagaaattaa

SEQ ID NO: 10134 - DNA, 945 bp, Lycopersicon esculentum
  Predicted polypeptide sequence is orthologous to G133
ggaaaaattgagatcaagaagattgaaaacttgacaaaccggcaagtaactttctccaagagaagaaacggtattttcaagaaacgtaaagaacttactgttctttgtgacgctaagatctctctcatcatgctatcaagcaccaggaagtatcatgagtacacaagcccaaacactacgacaaaaaagatgattgatcagtatcagagtgcacttggagttgatatctggagcattcactacgagaaaatgcaagaaaacttgaagagattgaaagagatcaataacaagctaagaagagagataaggcagagaacaggggaagacatgagcggactaaatttgcaggaactatgtcacttgcaggagaacatcactgaatctgttgctgagattcgtgaacgaaagtaccacgtgatcaagaatcaaacagacacctgcaagaagaaggcgaggaacttagaagagcaaaatggaaaccttgtacttgacttggaagcaaaatgtgaagatccaaagtatggtgttgtggaaaatgaggggcattaccactctgctgtggcatttgcgaatggagtacacaatctttatgcttttcgcctacaaccattgcaccccaatcttcaaaacgaaggaggatttggttctcgtgatctacgtctctcctgaagatatcagttcacagtaatggcgttaaacattaatgctgagttactatttcaaatcaacttcccgaattatatcttattcctaaaaaaattaaatattgcaagctgcaaacactactttatctaactaatttgctccgagtctggatttggttctgtgttaagcactctattattctaggtgtttcaactcctttctatatatgaattatgatgccttgaacgcatgttcaattaatcaattttccttttcgacttaaaaaaaaaaaaaaaaaaa

SEQ ID NO: 10135 - DNA, 771 bp, Lycopersicon esculentum
  Predicted polypeptide sequence is orthologous to G134
atagaaaacacaaacaacaggcaagtaacttattcaaaaagaagaaatggtataataaagaaagctaaagaaattactgttctttgtgaagctaaggtttcacttataatctttgctagttctggaaagatgcatgaatattgtagcccttctactacgataagtgatatgttggatggttatcaaaaagcttctgggaggagactatgggatgctaagcatgagaatttgagtaatgaaattgatagaatcaagaaagagaatgacagtatgcaggttaagctcaggcacctcaaaggagaagatatcaatcaacttacccataaagagcttataattatggaagaagccttacaaaatggactttctagtatcagtgccaagcagtctgaaatcttgaggatggtcaggaaaaatgatcaaattctggaggaggaaaataagcaacttcaatatgctttgcaccaaaaggagatgggagccattggtggaagtggaaatatgagaggaattcatgaagaagtgtatcatcaaagagaaagggattatgagtaccaaatgccatttggcctacgagttcagccaatgcagccaaatctacatgaaagaatgtaaaattatattaattcccactttaaattaagaactctaataattttaatttgggtttctactatagctagaacactaattaatcaattctagttatatgtaatgagtattagctaagactttgtttcatggtggaattattacctaattttatggctc

SEQ ID NO: 10136 - DNA, 963 bp, Lycopersicon esculentum
  Predicted polypeptide sequence is orthologous to G137, G145
ttttcgggggttttgtgcttttgtaagtttgagaaagaggaaaaagaaaaatgggaaggggtagggttgagctaaagagaatagagaacaagatcaacaggcaagtgacctttgctaagagaagaaatgggcttttgaagaaagcttatgagctttcagttctttgtgatgctgaggttgctctaatcatcttctctaataggggaaaactctatgagttctgcagtagttctagcatgctaaagacgttggagaggtaccagaagtgcaactatggagcacctgaaccgaatatatcaacacgagaagcactggaaattagtagccagcaggagtacttgaagcttaaaggacgttacgaagcattgcagcgatcacagaggaatcttcttggtgaagatcttggtcctttgaacagcaaagaacttgaatcacttgagagacaacttgatatgtcgctcaaacagatcagatcaactcggactcagttaatgttggatcaacttacagattatcagagaaaggaacatgcattgaacgaagccaacagaaccttgaaacaaaggttgatggaaggaagccaactaaatctgcagtggcagccaaatgcacaagatgtgggctatggccggcaaacaactcaaactcagggcgatggcttctttcatcctttggattgtgaacctactttgcaaattgggtatcagaatgatccaattacagtaggaggagcagggcctagtgtgaataactacatggctggctggttgccttgaaggctcacgattctgatcataacattattataaatatgctcaatggttttcctatcatcataaacattgaatatctcctaatttctgtatgttgtttgagaaaatgtttcatcctggacctaacggggatccataagacaatcccgttattgttagtaaatcataaactagatttctttgagtgctt

SEQ ID NO: 10137 - DNA, 1042 bp, Lycopersicon esculentum
  Predicted polypeptide sequence is orthologous to G137, G145
caaatctctgaaaaaattgaagattgatttctcaatgggaagaggaagagttgagcttaagagaatagaaaataaaataaataggcaagtcacttttgctaagagaagaaatggacttcttaaaaaagcttatgaactttctgttctttgtgatgctgaagttgcccttataatcttctctaataggggtaaactctatgaattttgcagcacttcaagcatggtgaaaacaattgaaaagtaccaacgttgcagctatgctactttggaagccaaccaatcagttactgatactcagaataactaccacgaatatctgaggctaaaagctagagttgagctcctccaacgatctcagagaaactttcttggtgaagatttgggcacgttaagctcgaaggaccttgagcagcttgagaatcaattagagtcttccttaaagcaaatcaggtcaaggaagacacaattcatgctggatcagcttgcagatcttcaacaaaaggagcaaatgcttgcagaatctaatagattactccgtagaaagttagaagaaagtgtagctggatttccacttcgattgtgttgggaagatggaggtgatcatcaacttatgcatcaacaaaatcgtctccctaacacagagggtttctttcagcctcttggattgcattcttcttctccacattttgggtacaatcctgttaatacagatgaggtgaatgcagcggcaactgcacacaatatgaatggatttattcatggatggatgctttaatctgataattcgaacaagctaatccatgtttggttaaacagttatacagtaataatgtattgcatgtattatcatccttttttgttttgttgcaaattttatttcgaaactctcttcaggaattatggcggcgatcgattaatcgaggacagtaaatgtaatgtatgcataagttgctactttaacatttgaaacctcctgaccatgcatttctgattgtatcacaatgtgtaattaaatggaattgttgtattttttgtatcattg

SEQ ID NO: 10138 - DNA, 842 bp, Lycopersicon esculentum
  Predicted polypeptide sequence is orthologous to G137, G145
atcggccgaattggggtaaactctatgaattttgcagcacttcaagcatggtgaaaacaattgaaaagtaccaacgttgcagctatgctactttggaagccaaccaatcagttactgatactcagaataactaccacgaatatctgaggctaaaagctagagttgagctcctccaacgatctcagagaaactttcttggtgaagatttgggcacgttaagctcgaaggaccttgagcagcttgagaatcaattagagtcttccttaaagcaaatcaggtcaaggaagacacaattcatgctggatcagcttgcagatcttcaacaaaagttagaagaaagtgtagctggatttccacttcgattgtgttgggaagatggaggtgatcatcaacttatgcatcaacaaaatcgtctccctaacacagagggtttctttcagcctcttggattgcattcttcttctccacattttgggtacaatcctgttaatacagatgaggtgaatgcagcggcaactgcacacaatatgaatggatttattcatggatggatgctttaatctgataattcgaacaagctaatccatgtttggttaaacagttatacagtaataatgtattgcatgtattatcatccttttttgttttgttgcaaattttatttcgaaactctcttcaggaattatggcggcgatcgattaatcgaggacagtaaatgtaatgtatgcataagttgctactttaacatttgaaacctcctgaccatgcatttctgattgtatcacaatgtgtaattaaatggaattgttgtattttttgtatcattgaatcatatgcttatc

SEQ ID NO: 10139 - DNA, 729 bp, Lycopersicon esculentum
  Predicted polypeptide sequence is orthologous to G137, G145
atgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagttacggatacgataacgtacaacccgaaaatgcagcaccatcaacacatgatgctactggagtcgtacctggatggatgctttga

SEQ ID NO: 10140 - DNA, 943 bp, Lycopersicon esculentum
  Predicted polypeptide sequence is orthologous to G137, G145
atgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcttggcattgtggtgagcaaagtgtacaatatagacatgaacagccttctcatcatgagggattttttcaacatgtaaattgcaataatacattgcctataagttacggatacgataatgtacaacccgaaaatgcagcaccatcaacacatgatgctactggagttgtacctggatggatgctttgaatttggagtatatggagagaaaaaatccttttagttatacgagttatttatttttattaaaaaaataagttagatggagaattatatatatcatactttaaagaactcatattgtttgaatgttttagctagcaaacactttggattatatataatattgtgatatatttattggcccaaaaataaaaaaaaaaaaaaaaaaaaaaaaaaaaaa

SEQ ID NO: 10141 - DNA, 1697 bp, Lycopersicon esculentum
  Predicted polypeptide sequence is orthologous to G137, G145
gtcgacgggaaccattagattttaaagacattaaatctattacccttaccctaagaataagaagatgtaaagtagaagagaaaacaaccaaaaccatatatatacatatatataattacattatattgtcttataacatatagtcttttaaggaaaaacaaatttagaaaaaaaataatattattttacatttttttttcttcatacaatatgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagtatggaacaaattcttgaacgatatgaaagatactcatatgcagagagacgtttgcttgcaaataattctgaatcaccggtgcaggaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaactgcagaaaaaggaaagagctatcctagaggagaataacatgctaaccaagaagattaaggagaaggataagatagtagaacagcaaggtgaatggcaccagcaaactaatcaagtttctacttcaacatctttcctcttacaaccacatcaatgcctaaatatgggaggtaattaccaagatgaagtagcagaagcaaggaggaataatgagcttgacctaaatcttgattcattatatccactttacaacatgaataaacatctatgaataatttcactctttgctaatcgcttgaaacgttgaaaggagctcactatcaggacagacaaatgagtataagcgattagcgataaaaactctatgcgagaggaaattatatatgatgttaattaatctatgcttgagaaattcttaattatatatattgagtgtctttatattgatatgcatgtatagaaccttattattatgaatttctatgtattaatgttttaagtatgttaaaacttaattgtaaatggaatcaagtccattctctttgtatcaaaaaaaaaaaaaaa

SEQ ID NO: 10142 - DNA, 1191 bp, Lycopersicon esculentum
  Predicted polypeptide sequence is orthologous to G137, G145
gtcgacgggaaccattagattttaaagacattaaatctattacccttaccctaagaataagaagatgtaaagtagaagagaaaacaaccaaaaccatatatatacatatatataattacattatattgtcttataacatatagtcttttaaggaaaaacaaatttagaaaaaaaataatattattttacatttttttttcttcatacaatatgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagttacggatacgataatgtacaacccgaaaatgcagcaccatcaacacatgatgctactggagttgtacctggatggatgctttgaatttggagtatatggagagaagaaatcctcttagttatacaagttatttatttttattaaaaaaataagttagatggagaattatatatatcatactttaaagaacttatattgtttgaatgttttagctagcaaacactttggattatatataatattgtgatatatttattgtcaagaagagtatggcaatattgataacactaaaaaaaaaaaaaaaaaaaaaaaaaaaaaaaaaaaggaaaaaaaaaa

SEQ ID NO: 10143 - DNA, 1231 bp, Lycopersicon esculentum
  Predicted polypeptide sequence is orthologous to G137, G145
ctaaagttaaaacaatgaatccctaaagaagataggaagaaatgccatagataaaaacaacccatgttcactttttctctctctaaacattgaaattcaaccaaaacaaaaaacaaaagttgataagaatcctttctttctttctttgtgtgtgtgtgtgtctagctagggtttgcatttctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctttgtgatgctgaagttgctctactcgttttctctaatcgtggaaaactctatgaattctgcagcacaaacaatatgctcaaaacacttgataggtaccaaaagtgcagctatggaacattggaagtcaatcgatcaatcaaagataatgagcaaagcagctatagggaatacttgaaactcaaagccaaatatgagtcgctgcagcgatatcaaagacaccttcttggagatgagttggggcctctgactatagatgatcttgagcatcttgaagtccaactagatacttccctcaaacacattaggtccaccaggacacaaatgatgcttgatcagctttctgatcttcaaactaaggagaaattgtggaatgaggctaacaaggttcttgaaagaaagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtacgatccaataacaacttcaagccaaataacagcagtaacaaatgcccaaaacgtgaatggtatgatacctggttggatgctgtgaatgaaaaagtcctttatcttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaaaaaaaaaaaaaaaaaaa

SEQ ID NO: 10144 - DNA, 1081 bp, Lycopersicon esculentum
  Predicted polypeptide sequence is orthologous to G137, G145
ctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctctgtgatgctgaagttgctctactcgttttctccaatcgtggaaaactctatgaattctgcagcacgagcaatatgctcaaaacacttgataggtaccaaaagtgcagctatggaacattggaagtcaatcgatcaatcaaagataatgagcaaagcagctatagggaatacttgaaactcaaagccaaatatgagtcgctgcagcgatatcaaagacaccttcttggagatgagttggggcctctgactatagatgatcttgagcatcttgaagtccaactagatacttccctcaaacacattaggtccaccaggacacaaatgatgcttgatcagctttctgatcttcaaactaaggagaaattgtggaatgaggctaacaaggttcttgaaagaaagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtacgatccaataacaacttcaagccaaataacagcagtaacaaatgcccaaaacgtgaatggtatgatacctggttggatgctgtgaatgaaaaagtcctctattttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaatcataatgtggatgatgatgaaaaaaaaaaaaaaaaaaaaaaaaaaa

SEQ ID NO: 10145 - DNA, 441 bp, Lycopersicon esculentum
  Predicted polypeptide sequence is orthologous to G138
tttttttttttttttttttttaaacaaaaatattagatacatatatatatcataaattccaagatgtcatagtgcatagttgagatggggccggcagttgttatttttataacaagttgagtgaattattctcctcactacttcaacaataattgtaagttgctaaatacagattagtggccaccacaaaaacaacattaattatattagttcatacaatacaagagaacaaatattactatgttaatccattagagcatccaccctggaataaatccattaatattatgagcagttgttgctgcattaacctcatgatcatttgcacccatatttggattgtatccgaattgaggcgatgaagaattcaaacggagaggttgaaagaaaggttgtgcagtagtttgtggagggagtcgattgtattccattgtttgtcct

SEQ ID NO: 10146 - DNA, 651 bp, Lycopersicon esculentum
  Predicted polypeptide sequence is orthologous to G142, G148
cagagctggtaccaagaggtctctaaattaaaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaaggacaaggtgttccttttccatggagtaattgtaatgcatctttagatgaagcaggaagcagcacctttcatgtccaccattctcaatcaaatcacatggactgtgatttacctgatccagttcttcaaatagggtatcatcagtatatggctgcagatggagcctcagggtcaaggaacatggctgttgagagtaacattatccatggttggggtctttaatttctaattctaattatggattatactagtacaagttttttgcttttaagtttttcagattaaaaaactcaagtgacatataattatgatttgaaatgcatgttatatagtaatgtataattttagcaagtgtcatatacactcctg

SEQ ID NO: 10147 - DNA, 866 bp, Lycopersicon esculentum
  Predicted polypeptide sequence is orthologous to G147
gctagttcaaactagtgggaggttgtctgccaaaaaagcagcaaaagaaattgaatctatagaagaaaagaaagaagatggctcgtggtaaggttcaaatgaagaggatagagaatccagttcatcgacaagtcactttctgcaaacgtcgagcaggccttcttaagaaggccaaagagctctccgtgttgtgtgatgccgaagttggtcttttcattttctccgctcacggaaagctctatgaacttgctactaaaggaagcatgcaagggctgattgagaggtacatcaagtcaaccaagggagttgaggtggctgaggaagccaaagatacacaacctctggacccaaaagaggagatcaacatgctgaagaatgagattgacgtactccagaaaggcttaagctacatgtatgggggaggcgcaggaacaatgacactagatgaacttcattcacttgaaaagtaccttgaaatttggatgtatcatattcgttcagcaaagatggatatcatgtttcaagagatccaactgttgaagaataagggagggatactggaagctgcaaacaaatatttacaggataagatagatgagcaatacactgtgactaacatgacccagaatttgactgactttcaatgcccactaactgtacaaaatgagatatttcagttttaacatatgctcactatgtaagttattcttgttgtgaagcatctatgtaatttggtaaggagatgtaataatgatgattgagtaatttcactttggagagatgaacatataagtatgttattatgttcaatttaggtaatatgtttagtgtgtgagcctttttagtgtaaaaaaaaaaaaaaaaaa

SEQ ID NO: 10148 - DNA, 1201 bp, Lycopersicon esculentum
  Predicted polypeptide sequence is orthologous to G151
gagatacaggaggaggaaattaaagaggggaagggaaaaaaattcatcaaagacttgtcttttggtgttttttttttttttcatatagtttaagggaaaagagaagatgggtagaggaaaaattgacataaaattgattgagaatctaaataatagacaagtaacattttctaagaggcgtgctggcttgttgaagaaagccggggagctttctgttctttgtgattctgaagttgctgttattattttctcaagtactggaaagctttttgagttttcaagtactagcatgaaacagacgctttccagatacaacaaatgtgtagcctcgacagataattctgccgtagaaaagaagtcagaggacaacgagcagccacagttgcagcagcagacacatgtgctgaagcaggaacaaaaagaggtggacagtcttaaagacgaactcgcaaagctcaagatgaaacaacagcggttgttaggcaaggaccttaatggtatgggtttgaatgagctacggcttcttgaacatcaactaaatgaaggactactagccataaaggagagaaaggaggaattgctgatacagcaactagagtattctaggaaacaggaggagaggtctgcgctggagtgtgagaccttacgtagacaggtagaagagctccgagggttatttcctttaagtgctagtttaccgccaccttttcttgaatatgatcgcccattggaaaagaagtattcaattttaaaagagagtaaggagagtctggattccgacactgcatgtgaagatggagtagatgatgaagattccaacacaactttgcaattggggcttccaactatttgtcgaaagagaaagagaacagagcaggaatctccttcaagcaattcagagaatcaagttggctcaaagtgactattgtctttcgggactcatcccccctcctttgtaacttgttaggcacatgtcaggttaaatgatattgaaccagttttcatgtttaaaacaggttcatctagaccagtgattttgtcagggacttagatggcttaagtaagataaagatgctggtttcattttgattttgaacaatatctctggacagtgtattttaagatggagatgagttcagctctccatttttactgattatgaatctgaatctgaatcatttaaaaaaaaaaaaaaaaaaaa

SEQ ID NO: 10149 - DNA, 1359 bp, Lycopersicon esculentum
  Predicted polypeptide sequence is orthologous to G154, G627, G1011, G1797, G1798
tgcatacatcaaacccataaataaagatccttcatatatatatattcttgtttcttcttctgtttatatatatatatatattttctaggaatctaattccttaattattttcttttccatcctctttcctttttcccggaaaatcggaataaaaatggtgagaggaaaagtagaaatgaaaagaatagaaaattcaacgagcaggcaagtgacgttttcgaaaagacggaatggacttacgaagaaagcttatgaattatcagttctttgtgatgctgaagttgctttcattattttctcacataaaggaagactttttgaatttgctagctccaacatgcagaagataattgagagataccgtggacgtacaagagaaacaacgacggtggataaaagcactgaactcgagcactacatggagaacttgaagcatgaaacagctaatatggcgaagaagatagagattctcgaaatttctaaacggaaactaatggggcaaggattagggtcatgttcaatggatgaactagaagacattgacagccaactggagaggaccctcaaaattatcagggctagaaaggctcaattgttcaaagaggaaatagaaagtctaaagcaaaggagagattattgctccaacaaaatgcaagtttacgtgaaaagtgcgggcttaggccaatgcaatcagagtcagcacccgcacctgcacccgaacccataccagcaccaccatcaacaccaccggctcaatcgaaagaaaggggaaattgtagccaaagtacaaagagttgggaagtggagactgaattgtttattggccttcctcaaacgcgctgcttatagtagcttggatcagtggttgagccaggttttttttttttatcaaaggaattcaaacctcgaagaagtacacagagaaggcaaaattgggttcaatctctactctatatacactacattaaaagataaattttaactatatatgttataatgttatttttcgctgtaggagaatcagttaaacaaccccaccaatcctacgtggctccgccccgaccgggacaatgggaccatttgttcatattttgtttatggttctcctcagttatttagattaagaggttaggatttctcagttatttacaaccataaggagttgcaaaattcaataaataataccttacaataagagtgtaatatttctttctatttttcatgtatttatagtatactttctatttttcaaacattctaaacagctcaattgttttgagtgtatcacaagtttgtttttggtttataatggattataaaatttataggtgaattcaaaatttgaaaaaaaaaaaaaaa

SEQ ID NO: 10150 - DNA, 585 bp, Lycopersicon esculentum
  Predicted polypeptide sequence is orthologous to G154, G627, G1011, G1797, G1798
gtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaagtctttatggaacaaatggaaagattgaaagaaagggagagagcccttacagctgaaaatatgatgc

SEQ ID NO: 10151 - DNA, 573 bp, Lycopersicon esculentum
  Predicted polypeptide sequence is orthologous to G154, G627, G1011, G1797, G1798
gatttttttaaatcaatttctatgtgattaattccttcttcaatattaagtttttttttttttttttttttaattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataataagaggcaataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtacaacagatagaaaaacagttggaacggagtgttggcaccatccgggcacgaaagcttcaagttttcaaggaacaggttgagcgactaaaaaaaaaaaaaaaaa

SEQ ID NO: 10152 - DNA, 828 bp, Lycopersicon esculentum
  Predicted polypeptide sequence is orthologous to G157, G859, G1759, G1842, G1843, G1844
ttactcttcacaaaaaaatcataacaataatgtgtagggtaatcaatttcaagtactccattatacaacttaaaaagagggaaaaataggcatataagtcaccctctagtaaatatgtcaaagtagagaagttaactttaatcatcatccattagaaacaagaacaaggatgaataattattagttttattgaaactaattttgcaggttcctctggtgcagaagcaaggcttttcgacgaatacgacgataatcactagaagaaattcagggtaactttttgttgtccacaaatcatgtggggtgctggaaggtcagacatttcattcacttttgtgtttttcttgatactagctatattgtcctccagatgtttcttttcctctagcagcagtttttccttctcatgaagaaccttagcagattcaagcatcaaatgtgtctttctagctctgagatgtattagagcagtttgaagttcgttttccaaatggataaggtcagtcaaagtgagaccatcagcatttgtttcctcgagttgcctttctgttgtttgtagcagttctcccattgttgtgaaccccgacacctctgcgacctggatttctgcattgatctctttttctgctccaacatggctttcatatcgtcgaagcatcgctgtcatactgttattgctggagaattcatggagtctaccacgatttgagatgataacaacagcaacatcgacatcgcagagaatagaaaattctttagctttcttcaataaaaccttcctccggttacagaacgcaacttgcctgcatttttatcttgaattcgctt

SEQ ID NO: 10153 - DNA, 667 bp, Lycopersicon esculentum
  Predicted polypeptide sequence is orthologous to G157, G859, G1759, G1842, G1843, G1844
atttattaccctgttatcactgtttggcacaaaggcaagacttcttatttccccaaaagaaccaactcttccaacgacacttcaagatagaaaaccaacttttgggttattatgctcaaatagccaactaaaatttcagtggctttaataacctgtattttgtttatgactgggtttacagtgtaaaatgttgagttgtgttatttcttcatgcaatctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcgaagaaaatgagatggcaatgaatctaaataacatcgcaccaacccatatggattgtggacaacagagggagaccctgaattttctctagagtctagacacactaatggca

SEQ ID NO: 10154 - DNA, 700 bp, Lycopersicon esculentum
  misc_feature (625)..(625): n is a, c, g, or t
  misc_feature (653)..(653): n is a, c, g, or t
  Predicted polypeptide sequence is orthologous to G157, G859, G1759, G1842, G1843, G1844
gctgggtaggtgtaacgccgatgatagaagaatcttctagacatctgaaatttgtggattagggcttttcatcggcgaaaaaaaaaatggggcgaaggaaggtagaaattaagcgaattcaagataaaaattgcaggcaagttgcgttctgtaaacggaggaaaggtttattgaagaaagctaaagaaatttccgttctctgcgatgtcgatgttgctgttgttatcatctcaaatcgaggcaggctccatgaattctccagcaataacagtctgacagaaatgcttcaacgatacaaaagccacgtcgaagcagaaaaagagatctctacagaaatccaggtggcagagcactctaaatactcagggttcataacaatgggaaaactgctacaaacaacagaaaggcaactcgaggaaactaatgatgatgttctcactgtgactgaccttatccatttggagaacgaacttcaaactgctctaatacaactcagatctagaaagacacatttgttgcttgaatctgctaagggtcttcatgagaaggaaaaactgctgcaagaggaaaagaaacatctggaggacaatatactagtatcaagaaaaacacaaaagtgaatganatgtctacggatttcgctgactttccancccccattcgatttctggacacagaaaataccctgaatttcctctat

SEQ ID NO: 10155 - DNA, 2519 bp, Lycopersicon esculentum
  Predicted polypeptide sequence is orthologous to G175, G877
ataatcttgtacccaatctagccctttttccacagagagagaaaaagagagagaaagagggagaaaggattgcttttgctttttcccatttgtttcttggaagaaagtctgtgggtggagttgggaaaagaaaataaattctaagttaatttggcgtttgagttgctcatgatactagtatcaacaattgatgggtggatttgatgatcatgttgccattatgggagattggatgcctccaagtccaagtccaagaacgtttttctcttcactgctaggcgatgatggtgggtcaagattatcgtttgatggcaccaatgaaactagtggaaacttagcttctggtcctcaagaacatgttggcaattcagatggagttgatacagcaccagctgcaatcagtgagccacaaccggtgaagttgagtgtgccgtctgaccagaaaatgaactctcgcggaggaggactcttggaaagaatagcagctagagcaggatttaatgccccaaagctgaacacggagagccttagacctgctgatctgaggcagaatcaaggagttcgctctccttatttaactattcctcctggccttagtccaacaaccctgctagagtctcctgtttttctctccaattcactggtgcaaccatccccaacaactggaaaatttctattttcctcaggcattgacaatagaaactcggcattgatgatggaggatacagataaaaggaaagataatgctttagagagtatcaattcatcatccttttctttcaagccagttccagagactgctccatctctttttcctggcacgaccagcagatcttggttgcaggtgaacccgtccaatttttctcagcaaggatttccaaacattgaagtttcggttcattcccagaattcgcttgtatctcaccgtgtggaagctacacaaaacccgactcagaatggaacgcttcagcaatcatctgatttccctagattttctgctgagaaggatgtcatggctaataatgttaccctagattctaggacttttcagacagttggtagtgctgtggaccattctccacctctcgatgaaccgcaagatgaggacattgatcaaagaggaggtggagatccaaatgttgctggtgccccagctgaagatggttataattggcgaaaatatgggcagaaacaagttaaggggagcgagtacccccgaagttattacaagtgcacacatccaacctgtccagtcaagaagaaagtggagcgatctccagagggtcatattactgagattatatacaagggagcccacaatcacccaaaacccccacctaaccgtagatcagcccttggatccacaaattcacttggtgacctacaggtggacggtgcagaacaaggtgcaagtggtgttaatggtgatctcggtcaggcaaacttccacaaagcacctggtggtggaggaggttttgattggaggaacaacaatcttgatgcaaacttgggctccgagcactgcaacagatctgcccctttctctgctcagaataacactcgtttggaatcaggtgatgcagtagatgtgtcgtcgaatttttcaaatgatgaagatgaagatgatcgtggaactcatggcagcgtatcacaaggttatgagggtgaaggggatgagtccgagtctaaaagaaggaagcttgagacctactctgcagatatgactggtgctactagagccatcagggagccaagagttgtggttcaaactacaagcgaagtggacatccttgatgatggatatcgctggcgcaagtatgggcaaaaggttgtcaaagggaatccaaatccaaggagttactacaagtgcacaagtgctggctgcaatgtcaggaagcatgttgagagggcctcgcatgacctgaagtcagcgattaccacctacgaagggaagcacaaccacgacgttcctgcagctcgcaacagtagtcatgttaattcaggtgcctccaacactcatccagcttcagttactgcccctgctcaaaaccatttacataggccggaggctgctcaacttcagaatgctatggcgcgatttgacaggcaaccttcattgggctcatttggtctgtcagggaggcccccccagcttggacctaacccaggatttagctatggaatgaaccagcaaggcggcctatccagtctagcaatggccggatttcatcctaatcaaaacaagccaggggaggttcctatgcatccatatctaggacagccgcgacccatgcatgatatgggatttatgttcccaaaggaagaaccaaaggtggaacctctgtcagatcctggcccaacagcttatcagcaatttttgaacagtttgttgcttggacctcagatgtaaatttacagtttttgtcttctctaaagaacagaaagttagagatgctgattttggtacttaatgggcatacctccctacacaaagtcctataatacaactttttgaagct

SEQ ID NO: 10156 - DNA, 626 bp, Lycopersicon esculentum
  Predicted polypeptide sequence is orthologous to G184, G186, G916
gaaacttcttcttctaattctgatagagctggtttcttcaagaacaagcctgtttttggttttaatttaagtcctaaatttaacgctgctgaaatgttttcctcctccgatgagaaacgtagcatcgttaatgaagtcgactttttcgccgataaaaagcctattgtaaagaaggaaaattctcagaccgataattctatcagaactgatgatcagtgtgttgtaaatactggtttgcaacttgtgattgcaaacgcgggaagtgatcagtcaacggtagatgatggggtttcatcggaagtacttgaggagaaacgagctaaaattcagcagttggcacaattgcaagttgagcttgaacggatgaattccgaaaatcaacgtttaaaagggatgcttactcaagttagcaacagttattctgcacttcagatgcatcttgttacactcatgcaacaacaacttaattcaagaactgaaaatacacatccccatgaggttgttggcgcaaattctgatgaagaaaagaaaaaagcgaataatgggaccatagttccaagacaattcatggagctaggccctagtggttccaaagttgacccaatggacgaaccatctcattctcg

SEQ ID NO: 10157 - DNA, 791 bp, Lycopersicon esculentum
  Predicted polypeptide sequence is orthologous to G184, G186, G916
aaacatgttgctctctggttccatgccaagtgctgatgggctaatgaatacaaatttcctagcaagagcaatgcttccatgttcatcaaacatggcaactatttcagcttcagccccatttcctactgtcacattagacctcacagcccaaaatccaaacgcagcattgcctaattatcatcaaagaatcaaccaagcaaatcctcaattccaattccctttaccagctgggctaaatcacccgaatttcgccgcttcaatgtcagcaccacaaatgcctcacgttttggggcagcctttgtataaccaatcgaaattttcgggtttacaaatttctcaggaaaacattcatcatcaccacccatcaatttctcatgacacactctccgccgccacggctgctatcaccgccgatcctaacttcaccgccgcccttgcggctgccatctcctccatcatcggtggttctcatccgaacaacggcaacagtcccatgtccggtccctcaagcaataataataacactagtagtttcccagggaactaattaaataaaatattattttgttttgtaaaatttgctattgtagtctttcttcattcatttttttaaaaaatttgttaggacattaggggatgaaattggaatgaatttacatgttcatatcttttttctttgtattattaccggggaggaaagagtataggagaaaaaaaacgttattttcattcttttattctgattttggttatacgaaacaaaatgaatgcaatgtactatgtgattgctt

SEQ ID NO: 10158 - DNA, 792 bp, Lycopersicon esculentum
  Predicted polypeptide sequence is orthologous to G184, G186, G916
caatggcgaaagtatgggcagaaaatggctaagggaaacccgtgccctcgagcttattaccggtgcaccatggcagctggttgtccagttcggaagcaagttcaaagatgtgcagaggacagaacaatcttgatcacaacttatgaaggtactcacaaccatccgttgcctccggcagccatagcgatggcctcgacaacttcctcagcagcgaaaatgttgctctcgggctctatgccaagtgcagatgggctaatgaattccaatttcttcgcgagaactctccttccttgctcttccagcatggccacaatttcagcctcggccccgttccctactgttacattggacctaactcaatccccgaacccgttgcaattcccaagaccccctaaccaattccaaatcccattttcaaatccacctcacaacaacatcctagcaaatccagctgcacttttgcctcagatatttggacaggctttgtataaccaatccaaattctctggcctccaatcatctcaagatttagaaggacaacaacacccttcaacgatgccatcctcgattaatccatccaaccacaatcctgtagctgacacggtgaacgccttaaccagtgatcctaatttcaccgcagcattagcagcagccatcacttcacttattggcaatccggggcaaccaaacaatggtaccaacaacaccatcgccaccaccacaacgccagccaacaacaataacaacagtgtcacaagcaatggcaataacaacaacaatggcagcaaccat

SEQ ID NO: 10159 - DNA, 795 bp, Lycopersicon esculentum
  Predicted polypeptide sequence is orthologous to G192
ctctctcttaagccaaaagtcagcgccttcttttgttctctctgcatttcctctctctaaccaaaaagtcaaggccgtagccaagaaattaacaaaatggaagaggattgggatctacatgcggtggtcagaggctgcgccgctagttccaccgccgccgctgctgccgccaccaccacagccaccactaattcttgttgcagcagcttccaaccaagacaagatggcaacttttttagttttcaagatccatttgtcccaagatttgataaccccataagtgattttgaagagttgcataatctttacaagcctttcttccctaaagcacaacaaatacctctttctcctcaaaataatactaataatatacccatttcacctctctctgttcttggaggactacaagatctatcaccccaacaaacactaaaacaacaacaacatattcatcagctaaacagtacaagattaacacaacccaaacaatctcctctctctgcatatggttccacaactactagtgcttcacatgttcaaagcccaagacctaaaagaagaaaaaatcaatttgaagaaggtatgtcaagtaccctgctgaaggtttatccttctgacatgtggtcttggagaaaatatggacaaaaacccatcaaaggctctccatatccaagggggatattacaggtgtagtacttcaaagggttgtttgggcccgaaacaagtggagcgaaatagatccgacccgaatatgttcattgtaacttacacagcagagcacaatcaccctatgcc

SEQ ID NO: 10160 - DNA, 980 bp, Lycopersicon esculentum
  Predicted polypeptide sequence is orthologous to G194
ggagttcggacccacgcgtccggaaaaaatggaaagctacaaagacattaaaatggaagatcatcatccaatgtatttcattgacaacaacggttttggagttactaataaccactcattcatctcagattacagcattaacccatcatctctgggtttcatggagttattgggttttcatcaagacttttgttcagtttttgagttacctaaagaagaaaatcactatcctgctgtttgtgtatctgaagaagaactaaagccgccatcatcatcatctgtagcagcagctgagaaacaaaaaagtagtactactactgtagttgctacaggtaacgtattgaatacgccatctacccctaattgctcctccatttcctctgaaggacatggagatgctgatggggaagtagaaaatcatgaccaaaaaaacacaaacgctaaacaacagttgaaagcgaagaaaacagtgagtcagaagaaacagaaagagccgagatttgcgtttatgacaaaaagtgaggttgattttcttgaagatggttatagatggagaaaatacggtcaaaaagctgtcaaaaacagtcctttcccaaggaactattatcgctgcacaaatgcaacatgtaacgtcaagaagagagttgagcgatgtttcagtgacccaagcattgtggtgactacctacgaaggaaaacatactcatccaagtcccatgaatacgatgatctcccgtcctaactgctatccaataaatccagtactcccttcacttggaacctacactctgccaatgcagttcaacgccaatcagtcctttcaacgacaacttaacgagttctaatttagccatcaatcatcagcttgatcatgctgcttttgttgctcaaggaagcgtttttgcagtactaacgaaattctggaagaccaggagaatgatctacagaatcttaatgccttccgcgggtgctaaaacatga

SEQ ID NO: 10161 - DNA, 580 bp, Lycopersicon esculentum
  Predicted polypeptide sequence is orthologous to G197, G255, G664
cttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaa

SEQ ID NO: 10162 - DNA, 704 bp, Lycopersicon esculentum
  Predicted polypeptide sequence is orthologous to G197, G255, G664
caattatatacgtgctcatggggaaggttgctggcgttctcttcctaaagctgcaggattgtcaagatgtggaaagagttgcagattgagatggataaattatttaaggcctgatctcaaaagagggaattttacagaagaagaagatgaattgataatcaaacttcatagtttgcttggaaacaaatggtcagttatagccggaagattacctggaagaacggataacgaaatcaagaactattggaatacacatattaaacgaaaactcattagtcgtggcattgatcctcaaactcaccgtccactcaacaacaacgccactaactcccacaccaccaccaatatcaccaccgcagtcacaaccaaaaacatcaacttggatttcacaaacgttgaccaaaaacaacccaatattatgattgccacgtcatcgtcatatgatgaaacaaaatgcaacagtggtacaactgaggaaacaaagccactagaaattattattccaaaaataccctcacaagttatgattaatcttgaactttcaattgggttgccgttacatactgatcatatttcttcaccagagtcaacggcctcatacaacttcttgaccaccgtagcaccgccgccaactgcggcggtaccggcggcggagatgatggcgaagactgtttgtttgtgttggcaaatggatatcatggtgg

SEQ ID NO: 10163 - DNA, 1152 bp, Lycopersicon esculentum; identical to SEQ ID NO: 1971
  Predicted polypeptide sequence is orthologous to G197, G255, G664

SEQ ID NO: 10164 - DNA, 547 bp, Lycopersicon esculentum
  Predicted polypeptide sequence is orthologous to G202
caaaactctttctccattctccccactatccataaaaaaaaaaatctttttttccctcttaccttcaatacccagaaatcaagattcttcagtaagagggagttgggtgataaagacaaacacccatctcaaaaaaaatctcatctttcaatttgtacacttgtctttttccaaccccatatcttgtttatcacctggtttgtttagattcttttgtcaatctttaagttgagataaaaaggagagatctttattatctttttttttttgttttgtttttctttcctttttgatggtttaagttatagtctttttattagttctaagtagtaatccaagtggtaacttgttatgattcaggttcatctgttaaccaagttggagttggagtcataaagattagatcttgttggggttttaaggaagatgaggatcgggggattttagtagcttagtttggttggcttaaaagggttttgattcatcaggttccttaacccccaaataaggaaggatgaaggaagaaagattcaattggtttgcttag

SEQ ID NO: 10165 - DNA, 741 bp, Lycopersicon esculentum
  Predicted polypeptide sequence is orthologous to G206
ccaagtgaaaaatcaaaacaaagtatagagagagaaaaaataaaatggggagatctccttgctgtgagaaattggggttgaaaagaggtccatggagcaaagaagaagattatttactcatcaattacattaaaaagaatggtcatcctaattggcgtgcacttccaaaacttgcaggtctattaaggtgcggaaaaagttgtaggcttcgatggactaattacttgagacctgatattaagcgaggcaattttactcatcaagaagaagatacaattatcaagttgcatcaagttcttggaaacagttggtctgctattgcagcaagattacccggaagaacagataacgaaataaaaaacatttggcatactcgtctgaagaaaaaaaggaatgaatctcaacttaaagaaacccaatcggagcctgaaaatactaatgtagatgtacatttggaggaggccaacaattctaatgataaacattccgaaatatcgaatcttaaaataaacatcgaaatccaacaacaaccaagtccatcatcgtcagtatcatcatcaagtgaagattcatgttcaaatacaactgcaacgagttcagagtcgagaaatcaaataatgtccgataatttgttagaaattgatgacgatatttggtcccgagtagtatggggcacagtcgatgacaattatggtgatttgtcattaatggaggatattacccacattattctagctttga

SEQ ID NO: 10166 - DNA, 534 bp, Lycopersicon esculentum
  Predicted polypeptide sequence is orthologous to G207, G227, G242
ttttagtgctgcacccaaatcaggagagaaacagttttttactccagagttcttatcagttctgcaagatatgattagaaaggaagttaagagttacatgtctgggtttgaacaaaatggtctctgcatgcagactgatgcaataaggaatgcagtcattaagcgtattggcatcagcaagattgagtaatccatctatgattactgttgaactgttctatagtcatcaacaatggctgccgctgctcagcgaaatgacaccggagaagaaacaatggaagatcggagcagtcttcctcccccttttttttattgcttaattacttccttagaattccaatcaaaaaaaataattttgcagtaatgtacagatgaatgagaggatgagagaagaaaactaaatttaaaaatgcccgaaaagatgaaaaaattgagaaaaatctcattctcttgtctaatgtcgcatgatgatctcgcttcgatagcgttgcaagaacaggctcatgaaaattaatctatgaattaggaaatttt

SEQ ID NO: 10167 - DNA, 727 bp, Lycopersicon esculentum
  Predicted polypeptide sequence is orthologous to G207, G227, G230, G242
tatggatcgggttaaaggtccatggagccctgaagaagatgagcttttacagcaacttgttcagaaacatggcccgagaaattggtctctaataagcaaatcgattccggggagatccggaaaatcttgccgcttgcggtggtgtaatcagttatctccacaggtggagcatcgggcttttacgcctgaagaagatgagactattattcgggctcatgcccgattcggtaacaaatgggctactatagcccgacttcttaatgggcggactgataacgctattaagaatcactggaactctaccttgaagaggaagtgttcatcgcttagtgccgatgaagggaacgaactcgccgatcaactttttgagaatcagcagccgccgttgaagagatctgttagtgccggatccgctatgccggttactggttttcatttcagtccgggtagcccgtcgggttctgatagcgattcgagccttcatgttacgtcgtcgtcccaatctcaagtgtttaagcctgttgccagaaccggcggcgtatttccgccgtcgattgatatttcatctccgcctgttgatcctcccacttctctaagcctttcgcttcctggtgttgacttggctgaatcctctaatcgttcggccgattcgactcagtcgaaaatccttttcagtggctgcttcccacgatgcagatttcttcacggcaacaccacgggccgctcg

SEQ ID NO: 10168 - DNA, 802 bp, Lycopersicon esculentum
  Predicted polypeptide sequence is orthologous to G207, G227, G230, G242
ccgcctcccaccaccgtctaatttgtaaatatattcgccggaaacttctctatccacgctttctctatatctatcataccctttttcttaattaatcggttgctattcctttgatggcagcgattacgcagagaaaagattcggatcggatcaaaggtccatggagtcctgaagaggacgagttgttgcagacgcttgttgagaaacatggacctagaaactggactttgataagcaaatcggtgccgggtcgatctggtaaatcctgtcgtctccggtggtgtaatcagctttcacctcaagtggaacatcgtgcttttactcctgaagaagatgatacgatcatcagggctcatgccaagtttggtaataaatgggcgactattgcccgtttgttatcgggtcggactgataacgctataaagaaccattggaactctactcttaaacgtaagtgtccttccatgtccgaagatttaagctttgaaacccctcaaccgcctttgaaaagatcgtctagtgttggtccctgtaccaatttttcttctgttatgaatccgggtagtccgtctggatccgacttgagtgattctagtcctttcgggttttccccatcgcatgtttacagacctgttccccgtaccggcgggattttcccctctcctcctccctctcggggtaagcagatcgaaattccctcatctgtacccgaccccacacatctctctgcctttcgttacccggatccggatccggatcatcgaaaagccacccagtcccctaatcacaccactaccacgcc

SEQ ID NO: 10169 - DNA, 2735 bp, Lycopersicon esculentum
  Predicted polypeptide sequence is orthologous to G214, G680
aacatggctttcttcgaaggtttaggcatcatgcggttcgttttgtagtgttacattatcaggttcttttgtacaacaccacggatagactatatttgatagtaactgatgttgtggggagaatcggaagaagatttgttctgtatcccctgtttgtccctgaggatttgaagcagagatagctagctttggttcctttattttgatggacccttattcctcaggggaggaacttgttgttaagacaaggaaaccttatacaatcactaagcaacgagagcgatggacggaggaggagcacaataggttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaggtcactcatcacaggtgggagcaaaagatgggaaatattcgacaactttttcttccatctgtgaggaaaggaacttatttgacctggagaaagaaccgattactgagaaacctggcggaaacgagaagctgggcaatgtaaaagaaacccagaacaagaaaaactgctcccaagggttaactaaggaaggtgcttctgcagcctctatgtcttcaggaaagtccttgcaagcacatgtggcacctacagatgtgtgtgcctttagtgagtctgtgtctgtcaccaaaggagtggttaacaatgataacgcaaataaatcttttctcattgttgaatccaaagaacatcaacagtcagaaatactcgatatcagacagtcctttcaaggtaacagctcctgtaacacctttgacggggggaaatcttgccagtcgagtgaaaagttggcacaaggtgagaaaaaacatccatcgtttcagccaaaccatttgggggaattctcaagaaatgatatgcaagtgctacacaactatccaagacatgtgccagtgcatattcttgatggaacaaatggttctcaaatagccccagatatgtttaatcatgaatctacgagtcagcagataaatggggtcccggggctcccaaatttgtattctaaccctgcttcatccaccacatctgagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatcggaggagagtgaaggtaggaagctaaaaactgggttaacggccactgatactgagcaaggagctgcagttactaaaattaatgagccaaacgcagaaaagggcgggaagcaggtagatcgctcttcctgtggatccaacacaccttcaagtagtgaaattgagacagatgctttggagaaggatgagaaaggtaaagaagagccccaagaatctaatattaaccttctagctggagaggctgcgaatcggcgttatagaaatttcatcagtccaaccgaatcttggaaagaagtctccgaagagggacggatagctttccaggctcttttcaccagagaagtgttgcctcaaagtttttctccttcacttgatctgaaaaataagggaaagatcattcttgaaaagttgaagcaaaagccagacgagaaagttcaatgtggaccgcagttagatcttaatgatatggcatccaatatctgttccagtcaccaaacaatggaagacaatgtgttattaattggcaacaaagaagatgtagaaacatgcctaccaatgatagaacttggacaagtaaggttgaaagctcgccgtactggatttaagccttacaagaggtgctcattggaggcaaatgatagcagggtgacaagttctaactgtcaggatgaagaaaaaagctcgaaaagacttcggttggaaggagaagcttctacttagtgttgtatcaatgtgcaattctacgagggaacctgtgttgttgcacggagagctctattctatcctgttattatcttttcccagttacgttgtctagttctaatgtacacgaaacttgtcgtgtaggtgtgtaccatattatttttatgttctcttttaattggacttgtatgcaagggactttgaagtatgaacctaaatgtggatgtcttcaacaatcatagcaaaaaaaaaaaaaaaa

SEQ ID NO: 10170 - DNA, 1992 bp, Lycopersicon esculentum
  Predicted polypeptide sequence is orthologous to G217
ggattccgaaatatcttctcgtcggagcggaaaaacgccgccgcggcctgaatctactctaccggagaccgtcatttctcgccggcgtatagatttcagctcatttacaggcaaaatctgaggtatacttatccaaaaccctagatttctcggagtctcccttgggagactgaaatagttagcaaacatgaggattatgataaagggaggagtatggaagaacacggaggatgagattctaaaggcggcggtgatgaagtatgggaagaatcagtgggctcgtatttcttctttacttgttcgtaaatctgctaagcagtgtaaagctcgctggtatgaatggctcgatccttcaattaagaagactgaatggactagagaggaggatgaaaaactacttcaccttgcaaaactcatgcctacccaatggaggacaattgcgccaatcgttggccgtacaccatcacaatgccttgaacgttatgagaagcttctcgatgcagcatgtactaaggatgagaactatgatcctaatgatgatccaagaaaattgaagcccggagagattgatcctaacccggaatcaaagcctgctcgtcctgatcctgttgatatggatgaggacgagaaagaaatgctttctgaagcacgggctaggttggccaacacaagaggcaagaaggctaaaaggaaagccagagaaaagcagcttgaagaggcgcggaggcttgcttctttacagaagaggagagaactgaaggctgctggaatagatgtccgtcaaaggaagagaaaaaggagaggtattgattacaatgctgaaattccctttgaaaagaagcctcctccaggtttctatgatgtcactgaggaagaccgtccagttgatcaacctaagtttccaactaccattgaggaactagaaggtgaaaggagagtcgataaggaagctcgcctaaggaagcaggatattgcgaggaacaaaattgcagagagacaggatgcccctacatccatattgcatgcgaacaaacttaatgatccagaagcagtgaggaagaggtcgaaactgaatcttccagcaccacagattccagatcatgaattggaggccatagcaaagataggtattgccagtgatctaattgggggagatgaactgtccgaagggaatgctgcaacgcgtgctcttcttgcaaattatgcccagacaccacaacatgctatgactcctatgcgaacacctcaaagaaccccttcaactaagcaagacgccattatgatggaagcagaaaatcaacgaagattgactcaatctcaaacaccattacttggaggagataatcctttgttgcacccctcagatttctcgggtgtcactcctaagaaaagggaggttcaaactccaaacccacttttaactccttcagcgactcctggagccacgagccttactcctagaattggcatgacaccttcgagagattcttatgggatgacacccaaaggaactcctatgagggacgagctacgcattaatgaagaaatggatatgcatagtaatgctaaactggggcaatttaattcaaaaaaagaattgctttctggtttgaaaagccttcctcagcccaagaatgagtaccagattgtcatccaacaacctcctgaagaaaatgaagaaccagaagagaagatcgaagaagacatgtctgataggattgccagggagaaggctgaagaagaagcaaagcgacaagcattactccgtaaaaggtcaaaagtattgcaaagggagctccctagacctcccattgcttctctagaactaataaagagttccttgatgagagctgatgaggacaagagctcctttgttcctcctacactaattgagcaggctgatgaaatgattagaaaggaacttgtgtccttgctagaacatgataataccaagtaccctctagatgagaagccaaaaaaaaaaaaaaaaaa

SEQ ID NO: 10171 - DNA, 714 bp, Lycopersicon esculentum
  Predicted polypeptide sequence is orthologous to G229
taataataataatgggaagaacaccttgttgtgaaaaagtgggcatcaagagaggcagatggactgcagaagaagatcaaattctcactaattatattatttctaatggagaaggctcttggaggtcgttacctaaaaatgccggattattgagatgcggaaagagttgtagactacgatggattaattatttgaggtctgatctcaagagagggaacattacttctcaagaggaagatataattataaagttacatgcaactttgggtaacagatggtctcttatagcagaacatttatcaggtagaacagacaatgagataaaaaactattggaactctcatctaagtcgaaaagttgatagcttaaggataccaagcgatgagaagttacctaaagccgtagttgatttggctaaaaaaggtataccgaagccaattaaaaaatcatcgattagtcgaccaaaaaataaaaagtcaaacttattagaaaaagaagcattgtgttgtacaaatatgccagcttgtgatagtgccatggaattaatgcaagaagatctagcaaagatagaggtgccaaattcttgggcaggacctatagaggccaagggaagccttagttcagatagtgatatcgaatggccaagactcgaggagattatgccagacgtggtgattgatgatgaagataagaacacaatttcatattgaattg

SEQ ID NO: 10172 - DNA, 1072 bp, Lycopersicon esculentum
  Predicted polypeptide sequence is orthologous to G233, G241
cacaaaccaaaaaaaaaaaaacactactacttctaaagaacaccaatattcaattcattaaacataaaaaaaataaaaaaattcatcaaagtttttttaaaaaaatggttagagctccttgttgtgagaagatggggttaaagaaagggccatggactcccgaagaagatcaaattctcatctcttacattcaatcaaatggtcatggcaattggagagccctccctaaattagccggattattgcgatgtggaaaaagttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattttgaggggttaatttggttgttttcaaaacttgaagtagtggaatgccaactaatttagtggtgtttttttttttgggatcttttgggagtcgacaagtttgaaaattcttgtttgtttattgactttaaagttcttgagaggaccaacaaaaaaaaaaaaaaaa

SEQ ID NO: 10173 - DNA, 605 bp, Lycopersicon esculentum
  Predicted polypeptide sequence is orthologous to G233, G241
gcacgaggagacttctaataatttctctcacccacaaaaatttggagaaaaaaaaagaagttaaaaagttattttttttagtctgtttcaaaaaaatgattgagaaaaaaaaatgggcagagcaccttgttgtgagaaaatgagcttgaagaaagggccatgggatcacgaagaagaccaaattctcatctcttatattaacaaaaatggccatggcaattggcgcgcgctccctagacaagctggattattgagatgtggaaaaagttgcagattgaggtggatgaattatttgagtccacatattaagaggggaaatttcaccaaagaagaagaagataatatcatcaatttacatgaaattcttggcaatagatggtcagcaatagcagcaagattaccgggaagaacggataatgaaataaaaaatatttggcacacccacttgaagaaaaggctaaaaaattgtcagtcttctcgaaacttcaaaagacacaattaaattaatcaaataaataattgcatgcatgctcctaactcaccaaaaatatcgtctagcgagacgtcaatcatgacaaccaattcatcatcaagtggtactttcg

SEQ ID NO: 10174 - DNA, 679 bp, Lycopersicon esculentum
  Predicted polypeptide sequence is orthologous to G233, G241
acccagaatgtaatatattaaacatcttaaatcacattacattctatgtcatcaatcatctccaagtaagagattgaatatgatgatataagataaatcaaacttcattgggagttctttttcccttctaattttttctttttaccaattataatcataatgatctagatcaaaggaggaaagaaattcatgagatataaaaggtgaaggtggacatatgagtccacaataatcaattgaaggagctacaaaatcaattttagtatccacttcaaatggttgtgtccaaaaacttccacttgtaatatcctccaaattagctaattcttcttgaaaaatgtcttgttgataatcaatagaggataagtcttcacttgatgaccattctgaattttccaatattacattttcatgcatagtattattattattattattatcaccaattgcattttgattttccacattactctttcttttagtaatatcactttcactcttcttattattgcatttcttgcttccttcacttgagttataatcagcgcgcttcttcactgttgtgtgccaatgattctttatctcgttatctgatcttcctggcaagtgacttgcaatcgttgaccacttatttccaagttgagcatggaggttcaagatgatttcatcttcttctttt

SEQ ID NO: 10175 - DNA, 713 bp, Lycopersicon esculentum
  Predicted polypeptide sequence is orthologous to G233, G241
gttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattttgaggggttaatttggttgttttcaaaacttgaagtagtggaatgccaactaatttagtggtg

SEQ ID NO: 10176 - DNA, 1032 bp, Lycopersicon esculentum
  Predicted polypeptide sequence is orthologous to G233, G241
aaaagatgggtagagctccttgttgtgagaaaatgggattgaagaaaggtccatggactcctcaagaagacaatattctcatatcttacattcaaaataatggacattccaattggcgtgcccttcctaaacttgctggactattgagatgcggaaagagttgcagattgcgatggactaattatttgcgtccagatataaagagaggaaatttcaccaaagaagaagaagacactataatcaagcttcatgaaaatcttggcaatagatggtccgcaatagcagcaagattaccaggacgaacagataatgaaataaaaaacatttggcacaccaacttgaagaaaaaactcaagaattatcagccttgtcaaaattccaaaagacactccaagactagtcatgtttccaacaagggtcctacaacttctgaatcctccaataactctgatcttagtacaagtactaaacaacacattaagattgcacctaactcaccacaactttcatctagtgaaatgtcaagtgtgacgttagttgttgatgataatcagatggtgattataaaggaagaaaaaatcgagtcatcatcgtcggagtattttccaaagatcgatgagagtttctgggcagatgaattatcgacggagaataatatgattattggtcatgatcaagaaatacaagtgagggaagaaaatgtagacatatttactactagttcaaaaatggaggaggacatggacttttggtacaatgttttcataaagacaggggatttgccagaattaccagaattttgaggggtctattttgattattatgtaaattttgagattaattagtggtatttctagctaatagttttttcttttttcttttaggaatttttggagttggcaagtttgaaatttcatgtttgtttaatcttgactattatttagagtggaccccaaaaaaataaaaaaataattccaaaaaaaaaaaaaaaaaaaaaaaaaaaaaaaaaaaaaaaaaaaaaaaaaaaaaaaa

SEQ ID NO: 10177 - DNA, 681 bp, Lycopersicon esculentum
  Predicted polypeptide sequence is orthologous to G249, G1322
gcaccaggaggaaagggccttggactatggaagaagatttaattctcattaactacattgctaatcatggtgaaggtgtttggaactctctagctaaatctgctggtctcaaacgtactggaaaaagttgtagactccgatggctaaattatcttcgacctgatgtcaggaggggtaatattacacctgaagaacaacttttgattatggaactacatgctaagtggggaaacaagtggtcaaaaattgcgaagcatttgcctggaagaacggataacgagataaaaaactactggaggactaggattcagaagcacattaagcaaggagagaacatgaatggacaaggaagttcagagcaaaatattgatcatcaagaaggaagtagtagtcaaatatcatcagttggtcaagcagataacatagagacttactctccaacttcatacaatggaaatttggacactaattttcaagcctcaaattttctcaatgaaacaaatgacaacatgtggagcatggaggatatctggtcaatgcaattgcttaatggagattaaatcaagtatgtttggaatatttaatttgagtaattaattaaaacttagattgaaaccattagtaacgtattatgaatattaagctgttagatattacagctagcctatattatatagtgct

SEQ ID NO: 10178 - DNA, 833 bp, Lycopersicon esculentum
  Predicted polypeptide sequence is orthologous to G256, G666, G668, G932
atcggccgaattgacacaactcttgaacaaaatttcctataaagagagtaaagcaatacctaaaaacgaaagatacatccttttattttcattgatcttcaagtcataaaaagaagaaaaagatcattttgttcctagatatcgatcgatcgtgtaggtagaatgggaaggccaccttgctgcgataaaataggggtgaaaaaaggaccatggacaccagaagaagatatcatcttggtttcatacattcaacaacatggtcctggtaactggagagctgttcccagtaatactggtttgcttagatgcagcaaaagctgtaggctcagatggactaattatctccggcccggaattaaacgtggaaacttcactgaacatgaagaaaaaatgattatccatcttcaagctcttctaggcaacagatgggctgcgattgcttcgtatctcccacaaaggacagataacgatataaaaaattactggaatactcatctgaggaaaaagctgaagaaacttcaagggaatgatgagaatagtactcaagaaggagaaagctcatcatcatcacaatccaatttctcaaagggacagtgggagaggaggcttcaaacagatatccacatggctagaaaagccctttgtgaggctttatcacttgacaaatctgattcatctgctaatccaattccagctcaacaacccgttacaggatccagctcttatgcttccagtgcggaaaacatttctaggttacttcaaaattggatgaaaaattcccccaaatcatctgaattaagtcgatcaaattctgagacaactcaaagctcgtt

SEQ ID NO: 10179 - DNA, 1354 bp, Lycopersicon esculentum
  Predicted polypeptide sequence is orthologous to G256, G666, G668, G932
aaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtggaatggggttgatggaagcatttgagtcactatttggtttggaatcatttgaatcatcaagttcagatgagttgtctcaaacaacaactcctgaggctattaaaattgaaataaagaaggaagaaaatgaacatgatgttgaagtgccactatctattatcttagagaattggttgcttgatgaaaatacactcaatattcaaccaaaaaatgacttgactaccttgatatcttttgatgaaactccacaacttttctacaagtttttttttttgttgattcttttgatggaataattttgaaaaaattgtatgtttttgattgatttccccattgattgtttttattttgatgtggcgattttaacaagtcatgtatatttagccattattattatatttagactatatatagctcaatcaagacttaatctagagtggttttatcatatgactaagttgtatcctttttaaatttcgttttatagatttcaattattgtactaagttagggaattttatatctctttcaatacaaaattttgttttattttaaaaaaaaaaaaaaaaaaaaaaaa

SEQ ID NO: 10180 - DNA, 2019 bp, Lycopersicon esculentum
  Predicted polypeptide sequence is orthologous to G261
gatccaaaaaccattgagaagaagtctttgagaaaagggtcaaagtaaacttcatctttctatgtgcttcttcttgttaaggactattcttgattttttcttacaggaaagttcggaaatttctgagttttagagggtgaaacggctatcttttgaattcaagctagcatttgtttgagcacttgtgggaactcatgatgggccgcaatctcttttaacaattctttagcaaatttgtgtgttttgaaagctatccagagctgggacttgaatggaaatgtgtatttgctaagaatttgtatgatcaggtgggagctgcttcaattgaatttatcgaaggaaatcaaggtgataacacttttggttggttgtatctgtatgttgggaatctgataagttgatcttccctgtcagtaaggatttgtcacttgtagttgagcttcgccttgtgagtttcatttcaaggggttgtgatttggatttgaatttaccatggatgaagctccttgcagcgtcaatgcactgcctccgtttattgcaaagatatatgaaatggtggatgatccttccactgatccaatagtctcatggagtttaaacaataaaagttttattgttcgtaatcctcctgattttgcaagagatttgttgcccagatactttaagcacaataatttttccagctttatccgacagctgaatacttacggattcaagaaaatagatcccgaacaatgggaattcgcaaatgaggattttcttagaggtcagccacaccttttgaagaatatctatagacggaaacctgttcacagtcattctgtacagaatattcatagcctctcatcatctgcattgaccgaatcggaaagacaagggtataaggaagatattgaaaagttgaagcatgagaacgaatcacttcatttagttctacacaggcataaacaggatcatcaaggacttgaaatgcaaatgcaggtccttaaccaacgtgtccaacaagtgaaagaccggcaaaagaacgtgctgtctactttagctcgaaccataaataaaccaggattagctttgagtctcatgccacaactggaaatgaatgaaaggaagagaaggttgccaggaaacagttttctttacaatgaaataggcctggaagataatcaagcgagttcttctgaaaatacgactagggaaaatatggaccatacttctctttcgactctcaacaaggaagtgctagatcagttggaatcttctttgaccttttgggagtatacactgcgtgacattgatcaaactagaatgagacggagctcttcaatagacttggatgaatctatcagttgtgccgatagccctgctatatcttacccacaactaactgttgatgttggatctaaggtttctgatattgacatgaactctgagcctaatggaaacactactcctgatgttactccgccagaaaaccgagtagagactgctagtcacaatgtgccaacaggagtaaatgatgtattctgggaacaattccttactgagaaccctggttctactgatgtaaagccggagagagaagatatggagagcaaaataagtgaatccaaaacagttgaggatgggaaattttggtggaacaggaagactgtaattagccttacagaacagttgggacatcttactccagcagagtgaatgtaatgtggcagggtatgtactatttttgatagtaaatgtttatttgcctgtttcttgttgtaaatttagagaaagtgatttgtctgagtacatagaattttggtatattaaccttctttttttttgtttttgcatgacatgatgtagtgaatgatagagtcgatcagtcttaatgctagtctggcacaatttcatgtattatgtagttatattctttccagccttgcctgtccatgttgccgatttgtgttacataagatgagagtaatttttctagcactatgttaatgcaatccttttgctaaaaaaaaaaaaaaa

SEQ ID NO: 10181 - DNA, 501 bp, Lycopersicon esculentum
  Predicted polypeptide sequence is orthologous to G261
agaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttaaaacgtcaacttaagccatctg

SEQ ID NO: 10182 - DNA, 784 bp, Lycopersicon esculentum
  Predicted polypeptide sequence is orthologous to G263
agagcaagaaaagatagttatggtcgtgttgttgttggtgaagattggcaaagttgtagccaatggaagattctaagattatcatcaatcgtcctaaaaataatcttgttcattctctagtctttcttttcggtttctattgttgggattgggaatttcttactgcccttttgcttttcagttattgctccttctaattaatttcttttaaatttgtaaaattcttataggatcttgtcaattaataagtaaaatccccaaaaggggaaatttgggtagatttagagaaagaggggatgtcgcaaagaacagcgccggcgccgtttctgttgaagacgtatcagttggtggatgatgcgaccactgacgatgtcatatcttggaatgaaatcggcacaacctttgtggtgtggaaaactgctgaatttgcaaaggatttgcttcccaaatacttcaagcacaataatttctccagcttcgttcgacagcttaacacctatggttttcgaaagattgtgcctgacaaatgggaattcgccaatgagaatttcaaaagaggacagaaagagctcctcacagctatacgccgtcggaagaccgtgacatcaatcccagctggtggaaagtctgtggcagccgggacttcagcatctccggacaattctggggatgacatagggttcagttctacctcgtcccagactccaagaaccgggatctgtggacactccgggaaagttgtcccagttcacggacttgtcggatgagaatgagagctaaagaa

SEQ ID NO: 10183 - DNA, 765 bp, Lycopersicon esculentum
  Predicted polypeptide sequence is orthologous to G264
gaagccttttgcctttaaaagttcattcgtcgtccgtcgccggcgtatttctctcagttcaataaaatggatgtgatttcagcggcggtggcggccggcggcggtggaggtccggcgccgttcttgtcgaagacatatgagatggtggatgattcgcaaactgatgacatcgtatcatggactccgactggtcacagcttcgtcgtttggaatcctccagaattcgctcgaattcttcttcctacttatttcaaacacaacaatttctccagtttcattcgacagctcaatacttacggcttccggaagattgatccagaaagatgggaatttgccaatgaggaattcttgaaggaccagaagcatctacttaagaacatccatcgtagaaaacccattcacagtcatagtcaccctccaggttccacagttgatccagaaagagctgcatttgaggaagagattgataaacttacacgtgagaagtctggactcgaggctaatgtctcaaggttcagacagcaacaatctgctgcaaaactccagctagaagaactgactgggcgggttggcagtatagagcaaagacaagagagtttactgatatttgttgagaaggcaattcaaaatcctgactttgttgagcgtcttgctcagaaactcgagtccatggatatttctgcatttagtaagaagagacgattgcctcaaatcgatagcactcaaccagtccaagaaagtatgtcgggtggacaaccataacag

SEQ ID NO: 10184 - DNA, 482 bp, Lycopersicon esculentum
  Predicted polypeptide sequence is orthologous to G268
agctgatcagtacttggatcagattcaaaagatgctccctgaaattgcatttggccatcatgtccgagttgctttagatattggctgtggtgttgcgagctttggtgcttatttactatccaggaatgtgctcaccctgtctgtggctccaaaagacgttcatgaaaaccagattcagtttgctcttgaacgtggcgtgcctgcaatggttgctgcaattgcgacacatcgtttacgtcatccaagtcaggcttttgaactaatccattgttcaagatgtaggatcaattggactcgtgatgatgggattttactactggaggttaacaggttgctccgtgctggtggatattttgtttgggctgcacaacctgtttataagcatgaagcagccctggaagaacaatgggaagagatggttaatcttactactcgtctttgctggaatcttgtgaagaaggaaggttacatagctatatggc

SEQ ID NO: 10185 - DNA, 641 bp, Lycopersicon esculentum
  Predicted polypeptide sequence is orthologous to G270
caacagtgggatttatgaggcaaatattgctaaaagccctgaaggaaaaatggcagcctgtacatactttagctgcctcaggagagttttaccttctcacctctttgttgaagcatgttgttgatattaatgttccagataaggatggattgacagctatccataaagcaattcttggcaagaagcaggctatttttaactttcttttaagagaatctgcaaatccatttatacttgacaaagatggagccaccttgatgcactatgctgttcgaacggcatccactcacatgataaaaatccttctcttgtataatgttgatataaacctccaagatcatgatggatggacacctttgcatctagctgttcaatcccgtagaaccgatatagtgaggcttttgttaattaagggagctgacaagactctaaagaacagggatggtctaaccccacttgacatatgcctccattctggtcgagatataaggacgtatgagcttatcaaattgttgaaacaacttcccaaggtttcattagttggcttgacctaaaaatgcagctgctaaccacgaaattggcggattggtagttccagctttgagtttggactctgtgtgagttatttctacaacacactg

SEQ ID NO: 10186 - DNA, 2199 bp, Lycopersicon esculentum
  Predicted polypeptide sequence is orthologous to G274
gatttaaggaattgttggaatattttcatgccattgggctgcaatggcgggcaaaaactcaggggataataggactaggacttctgtatcaatatttataatagctggtctatgctgcttcttctatttacttggagcatggcaaagaagtggttttgggaaaggagatagtatagcagtggctgtcaccaagactgctggtgagaattgcgatgtactaccaaatctcaattttgaaactcgtcatgctggcgaagcaggtggtactgatgagtcggaagaagtcgaggaacttaagccatgtgatcctcagtacactgattatacaccatgtcaagatcaaaagcgtgctatgactttcccaagggaaaatatgaactaccgagaaaggcattgtccacctcaagaagagaagttacattgccttattccagcacctaagggatatgttaccccatttccgtggccaaaaagtcgggattatgttccctatgccaatgctccatataagagcttgactgttgagaaagctattcagaattgggttcaatatgagggtaatgtgtttaggttcccaggaggagggacacaattccctcaaggagcagataagtatattgatcagcttgcttcagtcgtcccaatcgagaatgggacagttcggactgctttggacactggttgtggggttgcaagttggggtgcttatctttggaaaaggaatgtcatagcaatgtcatttgccccaagagactcacatgaagctcaggttcagtttgctctggaaaggggtgtgcctgctgttattggtgtactaggaacaatcaaaatgccatatccatctaaagcctttgatatggcccattgttctcgttgtctaatcccatggggagctgctgatggaatcctcatgatggaagttgaccgagttcttagacctggaggctactgggtgctttctggacctcctatcaactggaaggtcaattttaaggcctggcaacgccccaaggaggatcttgaggaagaacaaaggaagattgaagaggctgctaaacttctttgctgggagaagatatctgagaagggagagactgctatttggcagaaaagaaaggatagtgcctcatgccgttctgcacaagaaaattctgcagccaaagtttgtaaaccttctgatccagatagtgtctggtacaactaaatggaaatgtgcataacaccaaacaatggtaatggtggagacgagagtctaaagccattccctgagagactttatgctgttcctccaagaattgccaatggattagtttctggagtgtctgttgagaaatatcaagaagacagcaagaaatggaagaaacacgtaagtgcttataagaagatcaacaaactcctggacactggaaggtaccgcaacattatggacatgaatgctggactaggaggttttgcagcagcacttcacgatcccaagttttgggttatgaatgttatgccaacaatagctgagaagaatactttgggagttgtattcgaacggggactgattggtatctatcatgactggtgtgaagcattttctacatacccaaggacatatgatctcattcatgctaatggccttttcagtttatataaggacaagtgtgactttcaagacattctcttagagatggaccgtattttgcgtccagaaggagctgtcattctaagagacaatgtagatgtactgatcaaggtgaagaagataataggaggcatgaggtggaacttcaaattgatggatcatgaggacggtccccttgttcccgaaaaaatactggttgctgtcgaacaatattggactctgggtgataccaactccacatcctcacaatgagatgccaccgaagatgttgtctgaccatatgaactcgtatggatcaggaagaccaacatcttatgaatacaaaatccatggttatgcaagacgtttcacccctaggaattttgatcgagcagggtcccttgacaggtgactccacggcacatctttagtctcgatggatccataaattataccagatgatttagcgtttataactgtcttcattttcttctctgttccatgtctcgttagataatgactctaaaaactgagctacatgggattattatgaagctttttgaaagtcctttgtaaaaaaaaaaaaaaaa

SEQ ID NO: 10187 - DNA, 2259 bp, Lycopersicon esculentum
  Predicted polypeptide sequence is orthologous to G274
ggtctagtgaggactgaggaaccttcacttcagatttctcacttgggagcttctggtgttgccgcaagcacataatggcgtccaagtatcatggaccaatcaacagaacacggcgaccgatctctatattaattgtaattggtctttgttgtttctgttatctaataggaatttggcagaaaagtggatccggaaagggagataaattagcactacaagtgactgagcaaactgctgactgcaatgtttttccacaaaccactctggattttgagtcacaccataattatgtggaaacggttgaaacttcagaactaacagttaaaagattcaaatcatgtgaagctaaatacactgactatactccctgccatgaacaagaccgagctatgaaattcccaagggaagatatgatatatagagaaaggcattgccctccagatgatgaaaagcttcgttgtctgattctagcacccaaaggatacacaactccatttccatggcccaaaagccgtgattatgcctactatgctaatgttccttacaaacacttgacagttgagaaggcagtccagaactgggtgcagtttcagggaaacgttttcaaatttccgggaggaggtacaatgttccctagaggagcagatgcatatattgatgaacttgcttccgtggttccaattggaagtggcatgatacgaactgctcttgacactggttgtggggttgctagctggggtgcttacttgctgaagaggaatattctggcgatgtcatttgcacctaaggacaatcatgaagcacaagtgcaatttgctttggagcgaggtgtacctgctgttattggagttcttggttccataagccttccattcccatcaagatcatttgacatgtctcattgttctcggtgtctgattccctgggcatcaaaagagggtatgtacatgatggaagttgatcgagttctgagacctggtggatactggatactgtctggtcctccactcaattggaagacctatcacagagtctggaacaggaccaaggagaattgtagagccgagcaaagaaggatcgaagagcatgctgagcttctttgctgggagaagaagtacgaaaaaggtgatgtggctatatggaggaaaaacataaatggaaagtcatgcagaagagcatccgccaacatatgtcaaacaaaggatgctgataatgtctggtataagaaaatggatgcatgcataaccccctaccccgacgtgaagaattctgatgaagtagctggaggagaattgaagaagtttcctgctaggctttttgcagttcccccacgtatagctaatgacttggtttctggggtaacagttgaatcttatgaagaggataataagctttggaagaaacacgtcacttcttacaagaggagcattagcctacttggcaccactagataccacaacataatggacatgaatgccggacttggaggatttgcagcagcactagactctcctaaactgtgggtgatgaacgttgtgccaactattgctgaaaacactcttggtgtcgtatacgagaggggcttaattggcatataccatgactggtgtgaaggcttctctacatacccgagaacgtatgaccttcttcatgctaatcgcttgttcactctgtaccaggacaagtgtgaatttgaagatattctcctagaaatggaccgtgttctgcgtcctgaaggcgcggtcattcttcgagatggagttgaagtcttgaacaaggttaggaaaatcgccgcgggcttgagatgggacactaaattattagatcatgaagatggacccttggtacctgagaaaatctttgttgctgtcaaacaatatttcgttgaaggcgatgaagaccaaagcacgccaaatgacgattgagtgatgccaatattcgattacatcgagagaaacctgagaattctgaattgggaaggtaagatctccaggcagagatatgaaggttttttttcttctcaaatatggcatacaacaagtagtgcaagttcccatgtagagcaattttagttatttttcctttaatgtgtgatttttggagatcttttttctccaaataatgaagcaaagcaagagttcattagagtgatatgtatgtttgggagcaaatttaatagttgtttccactaattacagagttgaattttgaacaattgtaatccctatttttttttttagcaaaaaaaaaaaaaaaaaa

SEQ ID NO: 10188 - DNA, 2467 bp, Lycopersicon esculentum
  Predicted polypeptide sequence is orthologous to G274
gaccacagaaacaaaaacaaaacgaaaaaaactgagaattgtaaagagagacacagagagttgtaaatttgatgtatatgcttgtagatatccttgaaaaaaattaaaaaaattaggggttttgcagtgtttctgttcttgatttaatttgaaaggcatatctgagttgtggacttacaaagcaaaaataaagcaggaaagccagtaaaaggaagtattgattttttttttcatgccactggacagcaatggcaaacaaaagcatgggggacaataggaccaggacttctgtgtcaatatttattgtagctggtctctgtttcttcttctatttgcttggatcatggcagagaagtggcgtcgggaagggagatagtatagctttggcagtcaccaggagtggtgagaactgcaatatcctaccaaatctcaattttgagactcgtcatggtggccaagcaggtagtattgatgattcaggaacggaagtcaaaaaatttaagccatgccgtcctcgttacactgatcatacaccatgtcaagatcaaaagcgtgctatgcacctcccaagggaaaatatgatctatcgagaaaggcattgtccgcctccagaaaagaagttgaattgccttattccagcacctaaggggtatgtcgccccatttccatggccaaagagtcgggattacgttccatatgtgaatgccccctataagagcttgacagtcgagaaggccattcagaactggattcagtatgaaggtaatgtgtttaggttccctggaggagggacacagtttcctcaaggagcagataaatatattgatcagcttgcttctgtaatcccaattcaaaatggaactgttcggactgctctggacactggttgcggggttgcaagttggggtgcttatctttggaaaaggaatgtcatcgcaatgtcatttgctccacgagactcacatgaagctcaagttcagtttgctcttgaaaggggtgtacctgctgtaattggcgtcctaggaacagtcaaaatgccatatccatctagggcctttgatatggctcattgttctcgctgtctaatcccatggggagctgctgatggaatcctcatgatggaagttgatagagttcttcgacctggtggctactgggtgctttctggccctccgatcaattggaagactaattacaaggcctggcaacgccccatggaggaccttcaggaagaacaaaggaaaattgaagagattgccaaacttctttgctgggagaagaaatctgagaagggtgagactgctatttggcagaaaaggatggatgccgactcatgccgttctacgcaagaagagtctgaagctacactttgtaaatcgacagatccagatgatgtctggtacaacaaaatggaagcatgcataacaccaagcaaaggcaatggtgatgatgaaggtctaaaaccattccctgagagactttttgctgttcctccaagaattgctaatggactagtttctggagtccccgttgaggcatatctggaagacaacaggaaatggaagaagcatgttagtgcttataagaaaattaacaaactcatagacacaggaaggtaccgtaatatcatggacatgaattctggacttggaggttttgctgcagctcttcaatctcccaagttgtgggttatgaatgttatgcctacgatagccaagaaaaataccttgggagtcatttatgaacgtgggcttatcggaatttatcatgactggtgtgaagcgttctctacatacccaaggacttatgatctcattcatgctcatggtcttttcagtttatacaaggacaagtgcaactttgaagacattctcttagagatggaccgtattttgcggccagaaggcgctgttattctgagagatgatatagatgttctaattaaggtaaagaagataataggaggtataagatgggactccaaattgatagatcatgaagacggtccccttgttcccgaaaaaatactggtagcagtaaaacaatactggactgtgggggatgataattccacatccacacgataagatgccagtgaagacagtgatggtttaatggatcccaaggaccaattcttccataatcgaagttcagtgagtagcttattacagaaccttcaacacaagaaatttttggtcgatgagacgaggctatatggtgtctgtgtgtttaaccttttctattgatggatccatacattatattgtatgatattatgctttgtaaaacttgcattcatttatttttctttcttctctttgaagccccacactacatgatggatcttttctgaaacttttgatgtattcttaggagcattttcatctctgatgaaaaaaacagatgttgtaatgtgttcaattcaagtggggagaaaccacttagctttcctgaaaaaaaaaaaaaa

SEQ ID NO: 10189 - DNA, 660 bp, Lycopersicon esculentum
  Predicted polypeptide sequence is orthologous to G275, G837
tgacagacttgagagtctgggttatgaatgtagttccgatcgactcacctgacacacttccaattatatatgaccgtggcttgtttggcatttaccacgactggtgtgagtccttcagcacatacccaagatcctatgatcttcttcatgcagatcatctattctccgatattaagagaaggtgcacgatagaatcagtatttgcagaagttgacaggattctgaggccagaaggtaagttgatcgtgcgggacaatgctgaaactattcttgagatagagaatatggctaggtcagtgaaatggaagtgaagatgtcttactcaaagaatggtgaaggattactatttgttcaaaaatcattttggcgtccaatcaagaacagatagtcaagtcagccattgcataagcagagaagaaaattttccacaattagatacaaatctgatgttccttttatagtttagtttacttccactaaattaatagagaataccatcatgatatagctatcaaccggtaagtacgatttattgttttatgtactgagttttcatcattttggccattctctgtataattacctcaactttgtgtttcatataatgggaaagtatcattgtgaactccaacagcccagtacatgtatgttctgtgctgt

SEQ ID NO: 10190 - DNA, 717 bp, Lycopersicon esculentum
  Predicted polypeptide sequence is orthologous to G275, G837
gctatggaggatttgcagctgctttaagagacttgaatgtgtgggttatgaacgttgtctcagtagatgctccagatacactaccaattatttatgaaagaggtctttttggaatttatcatgactggtgtgaatccttcagcacttaccccagatcgtacgatcttgtccatgcagaccatctcttctccaagattaaaacaaagtgtggtttaccggcaatagttgctgaagttgaccgcattttgagaccaggagggaagctcattgtgcgtgacaaagaggagactataactgagttagaaagtatgctcaagtctatgcaatatgaaatcaatatgacctattccaaggacaaggaaggattgttgtattgccagaaaacaatgtggcgaccaaaggacgttgagacactaacttatgccattgcttagctgccttgcatgtgaaggatgctggttgtgttccgttcaagaggctttcatgccacggtgactagataattttctgattaaattcttgtaactttattcttgtcaggctatcgcgtaccatttccttagcaaattagtagtatcatcattaaatatttgtggatagtaaatgccttgaggttctgtattttgtaatatggaggaggtgaacgatggtaaatctcaaaagcaccacaatcatattcgttttcacattgaattgggcacaggccaatacttcctt

SEQ ID NO: 10191 - DNA, 1731 bp, Lycopersicon esculentum
  Predicted polypeptide sequence is orthologous to G278, G1290
atggatagtagaactgctttttcggattccaatgatattagtggaagcagtagtatatgctgcatgaacgaatcggaaacttcactggcagacgtcaattccctcaaacgtctatcagaaacactagagtctatcttcgatgcgtctgcgccggatttcgacttcttcgctgatgctaagcttctggctccaggcggtaaggaaattccggtgcatcggtgcattttgtcggcgaggagtcctttttttaagaatgtattctgtgggaaagatagcagcacgaagctggaactcaaagagctgatgaaagagtatgaggtgagttttgatgccgtggtcagtgtgctcgcctatttgtatagtggaaaagttaggcctgcatctaaagatgtgtgtgtttgtgtggacaatgagtgcttgcatgtagcttgtaggccagctgtggccttcatggttcaggttttgtacgcatcctttacctttcagatctctcaattggtcgacaagtttcagagacacctattggatattcttgacaaagctgtagcagatgatgtaatgatggttttatccgttgcaaacatttgcggtaaagcatgtgaaagattactttcaagatgcattgatattattgtcaagtctaatgttgatatcataacccttgataagtccttgcctcatgacattgtaaaacaaatcactgattcacgtgctgaacttggtctgcaagggcctgaaagcaatggttttcctgataaacatgttaagaggatacatagagcattggactctgatgatgttgaattactaaggatgttgcttaaagaggggcatactactcttgatgatgcatatgctctccactatgctgtagcatattgcgatgcaaagactacagcagaacttttagatctttcacttgctgatgttaatcatcaaaatcctagaggacacacggtacttcatgttgctgccatgaggaaagaacctaaaattatagtgtcccttttaaccaaaggagctagaccttctgatctgacatccgatggcaaaaaagcacttcaaattgctaagaggctcactaggcttgtagattttaccaagtctacagaggaaggaaaatctgctccaaaggatcggttatgcattgagattctggagcaagcagaaagaagagatccactactaggagaagcttcattatctcttgctatggcaggcgatgatttgcgtatgaagctgttataccttgaaaatagagttggtctggctaaactcctttttcccatggaagcaaaagttgcaatggacattgcacaagttgatggcacgtctgaattacccctggctagcatgaggaagaagatagctgatgcacagaggacaacagtggatttgaacgaggctcctttcaagatgaaagaggagcacttgaatcggcttagggctctctctagaactgtggaacttggaaaacggttctttccacgttgttcagaagttctaaataagatcatggatgctgatgacttgtctgagatagcttacatggggaatgatacagtagaagagcgtcaactgaagaagcaaaggtacatggaacttcaagaaattttgtctaaagcattcacggaggataaagaagaatttgctaagactaacatgtcctcatcttgttcctctacatctaagggagtagataagcccaataatctcccatttaggaaatag

SEQ ID NO: 10192 - DNA, 512 bp, Lycopersicon esculentum
  Predicted polypeptide sequence is orthologous to G280
gtttcaatggctactgaatttgtcaacaagattcatcctgaatacccggagatgatttatgaagcccttgatgcattgcaacaaaaagaaggctcaaacaagtcatcaatatcaaagtacattgaatctaagtatggaaacatgaatgatgcacactcaaagttgataacttaccatttggatagaatgaaacaaactggtgaacttattttcctaaaaaacaactacattaaacctggtccagatgcaccccctaagcggggccgcggccgaccacctaaacccaaacctatattgccacaaggaacagatattgcagctccaaagccaagaggtcgcccgaaaaaagaccccaatgcaccacctactcccaagaaaccaaaaccaacaagtgtccctagggacttagctcctgtttcgaaaaccggaaggcctagaggtaggcctaggaagattaggccggagccaccacaaaatgggttagagtgaagctgaaaatccgcagacttggt

SEQ ID NO: 10193 - DNA, 745 bp, Lycopersicon esculentum
  Predicted polypeptide sequence is orthologous to G280
gctgaagaacataatctaactttgcctagttatcctgatatgattatggaagctatagatgcgttgaatgaagaagaagggtcgaataaatcagctatatggaagcaaattgaagcgactcatggtacactaccaccagcgcatggtacactccttgcacatcatttgaatcaaatgaagcaagctgggcaattagttatgttgaagaacaactacatgaagccaaatccaaacgcgccgccgcgccgtggtagaggccgtccgccgaagccgaaaagttcagttccggtaccggatgggtatcctagaccacgtggaaggccaccgaaggagcgggatccgtacgcgccgataacggtacctatgaagaagacgagtgagggtagctctgggggaagtgggaagaagcgtggaaggccaaggaagtatccgatgacggaggatacgccggtggtgaagccaattggtgctccgagaggaagaggaaggccgccgaaggtgaaaactccggtagctgcaactgtaggggcttaattgaagaaagacgaattaaattagggacttgtatggcaaaatatgctaacttgttgtttttcactttttatctgttttgaattttcatgtttagtccctgtagttttgttttaattacaatttgtaggaagaattgtgtgactttgtgagtgatttttatcatgtaattgggccaatgtaaatccaaattgagggctttttatttatatat

SEQ ID NO: 10194 - DNA, 785 bp, Lycopersicon esculentum
  Predicted polypeptide sequence is orthologous to G280
gcatctctagaacacacacacacactctctctctatccatggctactcaaagcttcaaccagttcccttcataccctgagatgatttatgaagctcttgatgaactaaatcaagaagggggtgcaaacaagtcatcaataagcaagtacattgaaacaaagtatggagatctgaatgaagatctttcaaagatgctacctttacatttggacaacatgaagcaaaatggagatctgattttcctcaagaacaattacatcaaacctggtccagatgttccagcaaagaggggtcgtggtaggccaccaaaacccaaagctccattgcctcctggtgctgttgaatctgttgaacctgcatcaccaaggccaagagggcgcccaagaaaagaccctaatgcaccaacctagttccaagaagccaaagccagaatctgttgctggaggtcccaattcaacaaatcttggttctactactggaaggcctaggggtaggcctaggaaagttaggccacagcctgctcatgatgatgatgatgatgatattgaggaatgctgaaaacttttaagacttgttattggactcttgctgatggtgatgactctaatgacttagttgtcttaatatcctctttttttttaagtgttagtagtattatcttatgtaatagtttcagtttgagttgccctagtgtgactagggggtcatggtttcaaagttaagactgcgtagaatagactaattgtcgttatgcgactagggtcatggtttacagtgtgcaatag

SEQ ID NO: 10195 - DNA, 494 bp, Lycopersicon esculentum
  Predicted polypeptide sequence is orthologous to G291
acgtatcgtcggcggcgatggctcagcaaacctgtgagttagagaacaacatcttaacaatcgacgcgccgtcggggtcgataccggaaaactccgcgtcggacgctatattccactacgacgatgcggaacagacgaagtttcaacgggagaagccgtgggcgagtgaccctcactacttcaagcgtgtgaagatctctgctcttgctcttctcaagatgggtgttcacgcgcgttccggaggtacaattgaggtcatgggactcatgcagggtaagactgacggcgatgccatcattgtaatggacgcttttgccctccccgttgaaggcactgaaactagggttaatgctcaagctgatgcgtatgaatatatggtcgaatattcacagaccaacaagcaggctggtcgtttggaaaatgtggacgggtggtaccattcccatactggttatggatgctggctctctggcattgatgtatctacccgaatg

SEQ ID NO: 10196 - DNA, 626 bp, Lycopersicon esculentum
  Predicted polypeptide sequence is orthologous to G291
tgaccccatctcggagtaccagaccattcctttgaacaaaatcgaagactttggagtacattgcaagcagtattattcattggatattacatattttaagtcttctctcgattgtcgtctcttggacctactatggaacaagtattgggtgaacacactttcatcatctcctttgcttggaaatggagactatgttgctggacagatatctgatcttgctgaaaagttggagcatgctgaaaatcagctgtctaattcacgttatgcatccttaatggcaccccctcaaaggaagaaggaggaagaatctcagcttgctaagattacacgtgatagtgctaagattactgtcgaacaagttcatggcttaatgtcgcaggtaattaaagacattcttttcaatagtgttggtaagtcaagcaagtcacagacggaatcctcaggtcccgagcccatgatcgaaagctgagaagttcatattactatcaaattggatgtagaccaatttggtgcaatttctaggtttctttttgcagttgactatatacatctttgactctatttgtgcagcctacaaagaggtgatagtttacgatgattggctctcttagatatcatgacttttg

SEQ ID NO: 10197 - DNA, 1462 bp, Lycopersicon esculentum
  Predicted polypeptide sequence is orthologous to G291
gttcccaatggacgctctgaattcttacgcatcgtcggcggcgatggcgcaacaaacatgggagttagaaaacaacatcgtgacgacggacgcgccatcggggtcggcaccggaaaactctgcgtcggatgcaatattccactatgacgatgcggcacagactaagttccagcgggagaagccgtggacgagtgaccctcactacttcaagcgcgtgaagatctctgctcttgctcttctaaagatggttgttcacgcgcgttctggaggtacaattgaggtaatgggactaatgcaaggtaagacggatggagatgctattattgttatggacgcttttgcccttccagttgaaggaactgaaactagggttaatgctcaagctgatgcgtatgaatacatggttgaatattcacagaccaacaagcaggctggtcggctggagaatgtggtcggatggtatcattctcatcctggctatggatgctggctctctggcattgatgtaactacacaaatgcttaaccagcagtatcaggagccctttcttgcagttgttattgatccaacaagaactgtttctgctggaaaagttgagattggtgcctttcgaacatatcctgaaggatataagcctccagatgaccctatctcagagtaccagaccattcctttgaacaaaattgaagacttcggagtacattgcaagcagtattattcattggatattacctatttcaagtcctctctcgattgccatctcttggacctactatggaacaagtattgggtgaacacactttcttcttctcctttgcttgaaaatggagactatgttgctggacagatatctgatcttgctgaaaagatggagcaagctgaaaatcacctgtcccattcacgttttgggcacttagtggcagcccctcaaaggaagaaggaggaagaatctcagcttgctaagattacacgtgatagtgctaagattactgtcgagcaagttcatggcttaatgtcgcaggttattaaagacattcttttcaatagcgtttgtaagtcaggcaagtcgcagactgaaccctctgatccagagccgatggtcgaaacctgaatagtttcatcctattactccagatttagatttgtctctaggtttctttttgcagttaactaaacatacagctttgagtcattatatgtaggtccgaagggtgaaagtttaagatggccacccctgatataaattatcattgctgtttaatgttttgaagattttgccaaatctttcactagttcttttccttgtcttcttttcttttgttatttagagaagtctgtaaatcatgaaccatccttttatatgaatggtacaacctctatcttgtattagtacgacattttctattttagaaattattaatagattcagtaactttactatttaaaaaaaaaaaaaaaaaaa

SEQ ID NO: 10198 - DNA, 2145 bp, Lycopersicon esculentum
  Predicted polypeptide sequence is orthologous to G307, G308, G309
ccagcacttgtcattcttacccaatcttgaaccccatctcttaaaagatgaagagagatcgagatcgagatcgagaaagagagaaaagagcattctctaatggtgctgtttcttcagggaaaagtaagatttgggaagaagatgaagaagaaaaaccagatgctggaatggatgagcttttagctgttttgggttataaagtgaagtcgtctgatatggcggatgttgctcaaaaacttgaacagcttgagatggctatgggtacaacgatggaagatggtattactcatctttctactgataccgttcataaaaacccatctgatatggctggttgggtacaaagtatgttatcttcgatttcgacaaactttgatatgtgtaatcaggaaaacgatgtgcttgtatctggttgtggttcttcttcttctataatcgatttctcacaaaatcatcgaacaagtaccatttctgatgatgatttaagagctatacctggtggtgctgttttcaattcggatagtaataaaagacacagatcaacaacttctagtttttcaactacatcctcatctatggtgacagattcatcagcaacgagacctgttgtactagttgattcacaagaaactggggttcgtcttgttcatactttaatggcgtgtgctgaagctgtacaacaagaaaatttaactttagcggatcaacttgttagacatattggtattcttgcggtttcacaatctggtgctatgagaaaagttgctacttactttgctgaagcattagcaagaagaatctacaaaatttatccacaagattcaatggaatcatcatatacagatgttttacaaatgcatttctatgaaacttgcccttatctcaaattcgctcattttactgctaatcaagccattcttgaagcgtttacaggttgtaacaaagttcatgtaattgatttcagcttaaaacagggtatgcaatggcctgcacttatgcaagctttagctttacgccccggtggacctccggcatttagactcaccggaatcggacctccacagccggataacacagatgccttgcaacaagttggatggaagttggctcagttagcggaaactattggggttgaatttgaattcaggggatttgttgctaattcgttagcagatcttgatgcgactatacttgatataaggccaagtgaaactgaagcagtagctataaactctgtttttgagcttcatcgattgttatcccggccgggagcaattgaaaaagtgttgaactctattaaacagattaacccgaagattgttactcttgttgagcaagaagcgaatcataacgcaggggtttttattgatagatttaacgaagctttgcattattactcaaccatgtttgattcgttagaaagctctgggtcttcgtcttcagcttcaccaactgggattcttcctcaacctccggtgaacaatcaagatttggtgatgtcggaggtttatttagggagacagatttgtaacgtggtggcttgtgaaggttcagatcgagttgaacgacatgaaacactgaatcaatggagggttaggatgaactcatctgggttcgatccggttcatctgggttcaaatgcgttcaaacaagcttccatgcttttagctctgttcgccggcggcgatggttacagggtggaagaaaacgatgggtgtcttatgttggggtggcatacacggccacttatagctacctccgcctggaagctattgccggactccggcaccggcgccggagaagtcgagttgtaaactcgggtgggtgggtggaagagacaatgagagagatgtgcctaaaagggtcaaatcaatgttttttactttttaacctttttatttataagtcagcctctttatttactttttaaccactttttacattttgttctagtttattttattttattttatcctatggtttattttgtggttggttagattttttttcctccactcattttgtatgtcaaggtgtatctagagagtgatttggtgtttggggaaaaaaaaaaactttcattttatattttggctgattgggagttgtgaaataaataatttattttctaaaaaaaaaaaaaaa

SEQ ID NO: 10199 - DNA, 2084 bp, Lycopersicon esculentum
  Predicted polypeptide sequence is orthologous to G312
ggggggctactctgttagtccactcaaaacttgctcaccaatttcttcttataactgttgttgttgaggtaatgtgtgagtagtgtagcttagtaagatttggtgtggagaatggcctatatgtgtacggacagtgggaatctaatggcaattgctcagcaagtcataaagcaaaagcagcagcaggagcagctccaacagcaagagcaacagcagcagcagcaacaacaattcttgggtgttaatcctttgtgtctcagcccatggacttccaatcaccagaccttaactaatagccccactttaggatatggacttaccgggtcgggttttgcagacccatttcaggtcgccggaggaacagatagcgccgagccgggatttcagttccctaacttggaacatcattcgaccgggtttaggtttgctgatttcggcggtggaccgggtggtgagtttgactcagatgagtggatggagagcttgataggcggcggagattctaccggaagctctaatcttcaatctggttgcgaagcctggcagacgagttccgaattcactaccctctacggagatccgttcccgagttgtccgaatcgactcagtatcggttctgctcctccgcctccaccttcttccgatctcaatggggtcattttttcggaaacccagaaaaatctaagcccactacaaccacagacatctccatgggtcgcaccatcttcatctcctcctccaattgttcaacccgcgagcaaagaatccaaggtggtatcagttgatgtgcagccatgtagttcccctgaaagtttttcgtcaaaaccattgttgaaatccttggtggaatgtgcaagactcgctgaatcagagcctgaaaatgtagtaaaatcactgattcgactaagggaatcagtttcccaacaaggagatccaatggagcgagttgggttctatttcttagaagctctttacaataggctttcgtcgtgtcaagcagagagaactccgtcaatctttggtactgcgccggaggagctcactttgtcatacaaagcctttaatgatgcatgtccctactcaaagtttgctcacttaacggctaatcaggcgattcttgaagcaactgaaaaagcaacgaggattcacattgtagattttggaattgttcatggtatccaatgggcagcttttttacaagctttagcaactagatcagctggtaaaccagtcagtgttagaatctctggcattccatcagtggtattgggtaactctccgtcagcttcacttttagctacagggaatcgtcttcgtgacttcgcgaagcttctggatcttaacttcgaattcgaaccaatattgactccagttcaggaacttaacgggtctagttttcgagttgatccagatgaaatcttagctgtgaacttcatgttgcagctgtacaatttactggacgaaacaaatgttggtgtaaaaactgcactgagtttagccaaatcattgaatccaagcattgtgacattgggtgagtatgaggtgaatttgaatgatgttggattcctgcagcgatttaagaacgcactgaaatactactcaactattttcgagtcattggatccgagcttgacccgagactccgctgagagagtacaagtggaaagactgatacttggccggagaattgccggagcggtgggcctagacgatggcggaaccagaagagaatgtatggaagataaagaacattggaaagaattaatggaaggggctggttttaaaccagtaacacttagccattatgcaatgagtcaagcaaaaattcttctttggaactataattatagttcatcatttggattaattgattctgcccctgggtttctctccttggcttggaaagataatccccttttgactgtttcttcatggcactaattgtgttctacatcagttctgttaggtactttcttctaagtgcttaaatttaaatttcattgctctctgtagattaaaaagttagtatagaaagatgatatttttgagcaagtttaactttgaattccaaaaaaaaaaaaaaa

SEQ ID NO: 10200 - DNA, 658 bp, Lycopersicon esculentum
  Predicted polypeptide sequence is orthologous to G324
cagaaagacacaagtggcattactgacagagaagagatcagttcctacagtttctaccaggcagttgatggtcagcaccttatcctccatccactgaacatgaagtgccttctgcattactacggtggctacggtggtcttcctaacagaatcagtggaaagattttacaaatggagtccgtgacgcaatcggaggccatgagaaggcgttaccgcttcctaagtcatttttctttgacaacaacatttcagctttgtgaaattgatctcagcaagataatgcccatggatgcactttctccctttatggaggaaatcagaagtagggaaaaacaaaggacgtggctagctaggaaggaacggcgtgaacaagttaaagctgaagccattggcatgtacttagagcctttgccttttagcttttcagaaccttctttcacagaacaacctactttcactagcaatgacttcgaagctttgggaagtacgagtgttactgtaacatcatcaagctcccctgtgcctggaggcaggcaactgttctccaatgttgcaaggcttggttttgctgctggatgtgatcctccagcgctgaaaatggatgagtctgcacgtggttcttctgttgcagctggaacgaggagtcctggaatcctgt

SEQ ID NO: 10201 - DNA, 703 bp, Lycopersicon esculentum
  Predicted polypeptide sequence is orthologous to G324
gagaagaacccagatggttagtggaaaccacttgctcaattttcagtatgatcccatttctcgtccacaatctaggttgcctcctcctaggagatacgtcaagaggaagccttacaacaaagacttgtttcttcaagcaaattacaagtttgttctgttggattcaggcaattacacgcctgactcgatggatccagacaaaatgttacagtgggaggatattgtttgtgtgagatattccactccatttcatgtgcaatgccccatatgcttagaggatcctctttgtcctcagataacttcgtgtggtcatatcttctgttttccctgtgttatgcaatattttatgatctccgaagaagatgaccataaaaataatttcaagaagaaatgccctttgtgttttatgatgatatcttcacaggatttgtacaccattcaaattgagaacgttaaacaacatcgtgtcagtgatgtaattgaatttttactcttaacccgtcacaaggattcatttactttatctttgaaaaataatgatggcattgttggtagagaggaggttcaaaagttattctctaaattcatatttacgtccgatgtcgacctttctgttcgagaggcaatgtctgatcttgatagttggttagctagaactgattcaggcttaattgatgacttggagaaacttcccctttgtctg

SEQ ID NO: 10202 - DNA, 675 bp, Lycopersicon esculentum
  Predicted polypeptide sequence is orthologous to G328, G2436, G2443
gagaacagtaacaattgggcaagggtgtgtgacagttgccattccgcaacatgtaccgtttactgtcgggcggattccgcctatttgtgtgcgggctgtgatgcccgcattcatacagcaagtctcatggcttctcgccacgagcgtgtatgggtttgcgaagcctgcgagcgtgcccctgcagcctttctttgcaaagcggatgctgcctcgctttgtgcctcttgcgacgctgacattcactctgcaaaccccttggcacgtcgtcaccaccgtgtcccaattatgcccattccaggaaccatttatggtcctccagctgttcacaccattaccggtggttctatgatgattggtgggaccacaggggaaggcaccgaggatgatggattcttgagtttgaatcaagatgcagatgatacaaccatagatgaagaagatgaagatgaagcagcttcatggttgttgttgaatcctcctgttaagaataacaataagaataacaactatgggatgttgtttggtggagaagtagtggatgattacttggatcttgcagagtatggaggggacagtcaatttaacgaccagtacagtgttaatcagcagcaacaacattactctgttcctcagaagagctatgttgaagatagtgttgtgccagttcagaaacga

SEQ ID NO: 10203 - DNA, 738 bp, Lycopersicon esculentum
  Predicted polypeptide sequence is orthologous to G346
caaacccttattccatttttttctctttcaatttctcccttttgctctctgtgtgtgaaaaaaacaatgaaaatggaggatttggacccaactgcatgtttcatggtggatgatgaccttctcaacttctctttggaagatgaaactgttgaagaagatgatgaaaaatcaactattactagcaaagacccactttcttattcttcttcgtcttcaacaaaccctcttgttagccttcttccccaccctgagtgtgtagaggaagagttggaatggctgtcaaacaaagatgcatttccagcgatagagtttggcattctttcggagaacccgggtatggtatttgatcaccatagcccggtttcagtgctggagaatagtagcagcactagtcacagcagtggcaatggtgttgttagtggaaatgcttatacgagctgctgcgtcaacttaaaagttccggttaattaccctgttcgtgcacggagcaagagaagacgtaaaagacggagaggtggatttgctgacatgccaagcgagcattgtctgccggtgacacaaccgagtttcaagaacgttaagcagcgtgagccattgctttctttaccaatgaattcagctaagagtgctgctagcattgggaggaggtgccaacactgtggagccgataagaccccacaatggcgggcaggccctctggggccaaaaacactgtgtaatgcttgtggtgtgcgctat

SEQ ID NO: 10204 - DNA, 638 bp, Lycopersicon esculentum
  Predicted polypeptide sequence is orthologous to G346
cttgttgaaaattttatagaaaaaatttctttctatatttttactttttttttttttgaaaagaattttatgaaaatggaaactatgtactcaaaaacttgttttatggtagatgataatattcttaatttctctttagatgatgatgaagaaaaatatcaaacttcttcatcttcttttgaatcatcaaacacccttggatttcgtcaagatgatcacaacccttcatttcctgattatgtagaggaagaattggaatggctttcaaataaagatgcatttccagcagtagaatttgacctattctctgatcatgtcatatttgatcaccacagcccaaattcagtactggaaaacaacaacaacaattgcaacgtaaatctcaaggacaacgcgttcacaagccacgcctctagcctcctacaagtacccatgaaccaccccgttggtacgcgaagcaagagaaggcgaagaatcgccttgcagtgtgacaactcatgtgtatggggtaaccaagtgaagttaacaacactagtactaagcaaggactaacattgctcaaaatatcaatggctaaagctaaaagaggtactagcattggtaggacgtgccagcattgtgggggtcgataagacccc

SEQ ID NO: 10205 - DNA, 1156 bp, Lycopersicon esculentum
  Predicted polypeptide sequence is orthologous to G347
caatatttaacaagaagaaaaaaggagatgtaagaaaaatatccaaaaaccaatcttttgaaatcttgaatttacccaatttctgtcggaattttcgctcagatttccatttgaattccaacccattttcagataatctcaagtacccttcactgtatttttttttttcgtgtgtggggatatatatatatatatatatattataatagaggggtaccctatcttccagatttgttcattgactggaagaataaatttacctcacagatcggcagaaattagctcttctaactcagacgactcgacattcaaacagattgaaagatatgcagagtcagttgatgtgcagtgggtgcaggacaatgcttctttatcccagaggagcttctaatgtctgctgtgcagtgtgcaatgcactcacccctgtcccaccacctggaatggaaatggctcaattgatatgtggaggctgtcgtacattacttatgcatccacgtggagcaaacagtgtgagatgctcctgctgtcatacggtgaaccttgtcccaggtccaaaccagtttgctcatgtctactgcgggaactgccgtatgatgctgatgtatccatgtggagctccatcggttaaatgtgcagtatgccattatattaccaatgttaatgcaggagatggaagagcccatgcacctttgaaccctcctaacggcactgctactcctgcttcaggatcctcttcaactgccaaggctcgttcacaaaatcaaactgttgtcgtccaaaacccaatgtctgttgatgagagtggcaagttggtgagtaatgtagttgttggtgtaacaacaacatcatagctcatcagctaaacttgctgttcgtggacaacaattgagagttttgctcgcaacaattggaaagatgagaataaagacagccgctgcatataaatatggtagtgtttagtgttaatactacaaccatacccctgtttttcttttgtaacattttgatattatgattgtggggtgattgaagctactataacaagtgttgtgactatttggagtctgtaattgatgactacgcgttagatttgtggcgtgatatgcccaaagtcataagtgaagaatgttattatttaaaaaaaaaaaaaaaaaaa

SEQ ID NO: 10206 - DNA, 1205 bp, Lycopersicon esculentum
  Predicted polypeptide sequence is orthologous to G351, G545
ctcaattttactctctctctctgtatatctttgtacttttattctcgatgtcgattgaagctttgaagtcacccatggcggcgaagctgtcacccacggtggcggagctaccaccgcttgaagagattgatgatgattcacataatttggattcgtgggcgaaaggtaaacgatcgaaacgaccacgtattgaaaatccaccaactagagatcagtatttagcgctctgtttactcatgctcgctaacgatgacggtactggattcgggaaaggaaaaggaaacggaaccggttcgattggtgttgaacaaacggagaaaaaaccggccgagttgaagccggtttttattgaagagaaaacagagcaattactgaagccggttgttgataaagaaaaaacagagcaattactgaagccggttgttgttaaagaaaaaacagagcaattattcaggtgtagcgagtgtcctaaagtttttacttcttatcaagcacttggtgggcataaagcaagtcaccgtaaaattaacgttcccgccaccggagacgatgatagcaatccgtcgacgtctacttccactagcggcggcggcgttaatatctctgctctgaatccgagtggccgttctcacgtgtgctctatttgtcaaaaggcttttccaactggacaagctttgggtggacacaaacgccgccactacgaaggaaaactcggcggtaacaatcgttatatcggcggtggcggagaaggcggaggcgttcatagtggaagcgttgtgactacatcagacggcggaagcggcaacggcggcggcggcgcgtcgactccgattgcgcgtgactttgacctaaacatgcctgcctcgccgggatggcaattggatctgacaatcgactgcggaggtagaactcaacatccgattgaacaagaagtggaaagtccaatgcctgctaagaagccgcgtttatttttcgagtgaaaatttgattgaattctgttttaagtcaaattagttaattggttttacatgtgatgatattattttaatatatacattttagggaaaaaaagtaaaaacattgataagtactactttttattattattattattatgtatagaagcaaacagtaggttattcattggttttacattttctactatttcaatacaatattcttttttatttaaaaaaaaaaaaaaa

SEQ ID NO: 10207 - DNA, 628 bp, Lycopersicon esculentum
  Predicted polypeptide sequence is orthologous to G351, G545
gagtacttagctctgtgtctactcatgctcgcacgcagcaataacaataacagtaacagtaacgtttctattactggtgacaatttgtacaagtgttcagtttgtggtaagtgttttggatcttatcaagctttaggaggacacaaagctagtcatcgtagtaacagagataaagtctgcgaacaatctgtgatcgtcacgtcaggtaatgtggttagtggaaggactcatgagtgtaccatttgccacaagacttttccaagtggacaagctttgggtggtcacaaaaggcgacactatgaagggaagatgacgtcatcatcatcgtcgaacggtgtggggtcggtcaacaactttgacttgaatattccggtgttaccagataattggccgggttttgcctcgggcgaagatgaggtggaaagtcctcatccaactaagaaattaaaacaatttccttcacttgaattatttcaaacaacaataggacacactttgtaaaagtgattacttgattatttcattcatttgatttattcttttaaaaaaattactattattattttgcctttgattgtgtttgttgcactaacaaatattgttgacacacaaacaatagttattgcgc

SEQ ID NO: 10208 - DNA, 903 bp, Lycopersicon esculentum
  Predicted polypeptide sequence is orthologous to G353, G354, G2839
cggccggggaaaaatatttcatattcttttcttcctcttaccccccaaaaaaataaaaaaaaatctcaaaaattgcaaaaaaaaatcatggtggttttaccaatgaaaagagaaagagaaggagaattcgatataacaaccatggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaagctttaggtggacatatgaaaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttgtgatcaatcaataatattggatcagatcgcgaatctacgataggagttctacgagttcaaagttatcaatccaatcatttacatatgctgaactcgctgattcaaaattctgaattcatatcgatatatttttgcacatatatatctaaaacatctagatgtttcattattttaatttttttcttctaattctatttttttttcttatgtattttgcactagatatggatttatttattcgtttatatgagggaatataggaccttagccctaatagatgtaatatatagtaccatatttagtgta

SEQ ID NO: 10209 - DNA, 685 bp, Lycopersicon esculentum
  Predicted polypeptide sequence is orthologous to G353, G354, G2839
attatcgaaagcatcttatttgtatcaactcttcataatgataaaaattagagaagacaagggtgaagtggaagcacaagcaatggctaactgcttaatgcttttatcatccatagatcgagatcgtcgtaattcatttgaatgtaaaacctgcaaaagacgcttctcatctttccaagcgcttggtggccatcgaacgagtcataaatcaacgattgatatcggaaaatttcttcacggtaaaatatccaaaaaacgcaaggtacatgaatgtttaatttgtggaatggagttttctatgggtcaggctttaggtggacatatgaggcgtcaccgtgccccagtaaatgaaattgaacattcggccaaaaggataccagttttgaagaaatcgaatagcaacgagagaatattttgcgtggatcttaatttaactcctgatgagaatgatgactttcacttttggcctatgccacctgtacctccattcttatcctcttaggacttggctagaactataaatatcattcattttaattcttgtgggtagattcacaaattttgttatctatttaccttaattgatcggatttctttattgatgagtatatttattcacaataaattttattacatgcatgttcgatacgttaaagattattttgtggtaatatatagagatctt

SEQ ID NO: 10210 - DNA, 894 bp, Lycopersicon esculentum
  Predicted polypeptide sequence is orthologous to G355
cggccgggaagcatggtatcaacgcagagtggtcattacggccgggaagcagtggtatcaacccagagtgccattacggccgggaagcatggtatcaacgcagagtggccattacggccggggaacaccaaccaaagtgtatcatattctttccaacttctaacttcaaaaaatctttctttcaaagtagttctaaatttgatatacaatttgtaaaaatcttcaataatatgacatctatgaaaagaagcagagaagagaatatgcaaattgaagcagaggccatggctcactgcgccttaatgcttttgtctcgtttcaacaacaacacttgttcatcgtcatcatcagatcatcatcatcatattaatgattttgaatgcaagacttgcaataaacgcttcccatctttccaagccttaggcggtcaccgtgcaagtcataataaaaagccacgattaatgggagagtttcttgttgaaaccaacaaaaagaataataagatacataaatgttctatttgtggtgtggagttttctttaggtcaagcattgggagggcacatgcggcgtcatcgcgatgaaattaataaaacgataataccagtgttgaccaagtccaatagcagcaagaggattttttgtttggacttaaacttaacccctcgtgatgataatgttgttgatttcaagttatcgccaattgcatcccctgttctgagaatctttatttaaattcttttccttatacaattaggaaatatgctaccaatttattaattctttactgagatatccatgtcaacataaattgctatgatgaattcttttgttattcgaaagaaaaaaaaaaaaaaaaaagatgtcggccgcttcggcccagtcgactctagac

SEQ ID NO: 10211 - DNA, 755 bp, Lycopersicon esculentum
  Predicted polypeptide sequence is orthologous to G361, G362, G370, G1995, G2826, G2838
gcttcttttacacatggagaaaaccaaagataaagaaactcaagatttcatgaatgttgaatctttttctcaacttcctttcatgagaccaacgaaagaaaaagccgcgattaggctttttggtaaagaattactaggtactactattcgtcatgaagatcaatcaattgagattcatgatagtgttggagatactacagaaatcaacaataacaacagaaaatttgaatgccaatattgttgtaggaacttcccaacatcacaagccctaggaggacatcaaaacgcacataaaagagaacgtcaacatgctaagagagctcaatatgcaaaatatcagtacaacgcttattttaattcagcgttgtacaatactagtagtacaagtagtactactagtggtggtttgtatgtgaataataacggccatagccattattattcacaacaaattaatcgcgatataaatgaaaatcaccgttcattgtcagcgttatggagagtacctcatgttcatcatagtagtattagtagtagtagtaattcttactctcctaataatgtttctaattttgttaggccaatagtttataataatgttaatggagatttgaagaagattaacacaaagagtagctcaatttctttaaccagatttgggtatgaattgaaggaaggagtacatcaagatcatgtaagttttagatctacacttgtaaagagtacaatccaagctatagtatcgactctgtttc

SEQ ID NO: 10212 - DNA, 777 bp, Lycopersicon esculentum
  Predicted polypeptide sequence is orthologous to G363
cttctttctgttatcttttgtaattctgcctcaccatatttagtaaaaaactaaaaacacacacacaaaggaggagaagaacaacaagtcttgtcatatcattgaaaaattcatcaataaaattaaaaaagagaaaaaagcatgaagccaccgaatttcaatcttgaatcggaagacgagtccgaagtcagcagcagccaagttgcctccaacacttctgcccaagaaatttctcctgatccttacaaggataacacgaccaattcgtcctgtctgacaaactctctcaatcttcagcaggagtcgaaagccgttacacttgacttgactcttggcttcaacagcggtgctgataccgagtcgaagggcaatcccgaggctggcagtgaagtagtgcctcatcctccagctgcacaagtatcgaggatattctcgtgcaacttttgtaggcgcaagttttatagttcacaagctttgggaggacatcaaaatgcacataagagggagagaactctagcaaagagggcgatgcggatgggaatgctatcagagaggtacgctagcttggcatcgctcccccttcacggatccccatatcgatcacttggcatcgaagctcatgcctccgtacatcaacgtgcctctcaacaacaagaaaggcatatgcatgctattagaggcggggcaagattcgaacagagctatttcggggtggcagtatacatggaggatgatgacatggagatgttttggcccgggagcttcccgtcagttgac

SEQ ID NO: 10213 - DNA, 730 bp, Lycopersicon esculentum
  Predicted polypeptide sequence is orthologous to G378
cttgaaatcttttgaaaaaaatgaaggcagaaagactttttattttcgtccttccttgttggaagaaatagaatggagttcccttcagaataagcagttgatttatgtaaatcagaaaaaggccaagtcttttgttgttgatcgttcaaaagaatccatggaaatggaattctacgcatacccatctcgtgttttccctcttacctcttctatttgttcgttttgtataagggatttggttgatagggctaaagatttcattagcgttgcggtttctgcaatcattggcagcgtcttatctgcagtcttcaccttcttctttgcattagtgggcactttattaggagcattgactggagctttgattggccaggagacggagagtggatttgtcagaggtgctgcagttggtgccatctctggtgctgttttctctctcgaagtctttgagtcatctctgttactatggcagtcggatgaatctggaataacatgtcttgtttacttgattgatgtactcacaagcctgttaagtggtcgattggttcgtgagaggattggcccagcaatgctaagtgcagtccagagtcagatgggagctgttgaacttgcatatgacgaggtccctaacatttttgatacccggtgtggctaaaggcttgcatggagattcggttgaaaagatccccaagattgtaatcacaaaaggtaacaacttggatggttctgg

SEQ ID NO: 10214 - DNA, 2609 bp, Lycopersicon esculentum
  Predicted polypeptide sequence is orthologous to G380
gattgtcccctctctttagtccaccaggtggtgactttagatctgttgcttcatctgctgatgttttggaggtctgcttagcggtgaagtttgagacactgctgtcactacaatactatctttgtcttttggagattgtgaatatagagttataggcctaatgcaagggcaacggagtgcaatcggatccctgccagaaactttgggttttactcatggttcaacatcgagtgatggtggtatagatcagcagatatgttggaataatttgcgaaatcctgcacaaaatcggctaccagattatatggtaccttctaatgagacaaccataccatttcttagtcatgcaaaccaagaaaggcagagtgtaattggatggaatttaggagaatccagctcctccaatacacaaaatagtgttagtcgtagtgaaaatactacaatgagtgcccgtcctgggccttctcacttctctgctgaacagcattatgggtcttccaatattctttcattgggtgatgttgaaataaatttgaataaccagttagctaacaacactttattttctcaagcttctacgtctagcactgttccaaatgaactaagtagaagtgctggacatgaggggcgtgatggcgatgaagatgatgatgatgactgcgaagtgatggagtgcaccccaacattcaagtctaatggacctggaaaagaacggatgtcaaccgccagtacttcttctgatccccttgctgggacttctgcaactaatgggtttctgagggatgaaagtgatggcagaccaggctgtacactggatggtcgacgcatggcttgtaagagaaaagcagttgaaggacatctgggacaatcttcgggaagtggaagtccagattatcttctaaacagcttatggcgttctatacctgctccaaataatctgactgcaggtgctaatagctctgcatcaacagaaagtagaagaaacatcaatttgccagcgcagataaatccaagacttgggctcactatgggtggcaccactatggaaggtccggttgcattgcctgcttcaaggagagcagaaagttaccgtagaaatttcaggcttaggatcaatggctctcatcagcaagttcctattcctggcaatacgtttcctactgtgggtaatgatagaaatgttaccatgtctgactgggacgcattgaggctgccttctaatcagtctttggattcgaggtctgtttctgctgcagataatgtaagtccccgaagccagccagttgtggggccggttccttctctgcgacgaaatgcacagaggtgggattcatctagttcaagagctggcagtccatcaagttattctgtttttcttgagaggaattctgcagcctatgaacaaccaagctcaagaagtgtgcccagaaacatttcgcagcatccaatgttcatacccgctagtgacttgagaaatttgaaccaaaatcctgtcaactggggtttagctggtggaaatatttccattgctggaaatgttgcatcttcttctcggagtggtcctagctcagtagccccttcctcttctcctggttgggtggaacaaagaaatcctcagcaatatcctcgacgactctcagaatatgttcgtagatctatgttgtcttcagctgtcagtgaacctggaagtcacaatggtaacactccgccacatttgagttctgctacctcacaggagatggggctttctggccatcccgggcatcgtccatcaagttcaaggtcagcattgttgttggagagacaactcgatggtgcaatgggagttccatattcctggaggactttggctgctgccggtgaaggaagaggcaggctagtttccgagattcgcaatgtgttggatctaatgcgcaggggagagagcttaagatttgaggacgttatgatcctcgatcagtcagggttctttgggatggtggatattcaggatcgccatcgtgatatgcgtcttgatgttgataacatgtcctatgaggaactactggcgcttgaggagcgcatagggaatgtctgcaccgggctaactgaagaaaccattttgaatcgtctgaagcaacggaaacatgttagcattagaacagaagaaaccaatgatgctgagccatgctgtatttgtcaggaagaatacaaggatggtgaggatcttgggaagctggattgtggccatgattttcatgccgactgcgttaaacaatggctcatgcagaagaatttgtgcccaatttgcaaaacaacaggactcaatacttcaggaaaacaatgatccatggaagtttgatgtaccagttggaccatggaaggttgacacaaagcgtgtctacgcgtttggtccatgagttcattctgagtgagaaagatctatgtatttttctcattaattttattctgacctctgcttagagggagttattttagagatagaagaagcactagctacaattagggtcattaggcaagagttatacattatttggttgtttggaaatttacattcttactttccaatttattgatacctttgaatattttgaaaaaaaaaaaaaaaa

SEQ ID NO: 10215 - DNA, 702 bp, Lycopersicon esculentum
  Predicted polypeptide sequence is orthologous to G385
catctcttcttctactttctcaggattgctctcctcaactcttttttttgtaatttcattctaattttgcacatttttccaccttaggtgtaataactagtcatctaaacggtagatattaactttttagattgagtttaatttttagtgttgaagaacatgatttgagtgatcaagctcagatccatgcttaaattgagtgaatttaagatttctctgttttgtgtttttgtgaatatgaacaaaacacaccgtttctcctcatcttcatgtagagatgcttcagatccaatatcacataaatgaatctttgcatgtcagctcagataccattgttgatgtcttcgccagctatcctactctagttagcttgtttagcaacataatcgtagctgatggaagactaaacagaattttgcaaatcaatggcaccgggtggacgtatcttcaagcagactacacttacaggggaaactattcaagctactgaataaccagatgaatcgaataacattacccctgttgttgttacagaatcaggaaatgtcgtggcaagactagaggaaaaggtcttgaaaaaatgaagaagtctatgagaggcaagatgaagatcgagatatcagttggtaaagggaagtccaactaaaccaactcaatcagaaaaaactatccaatgagttgggcgtaattgcccggaaattt

SEQ ID NO: 10216 - DNA, 2934 bp, Lycopersicon esculentum
  Predicted polypeptide sequence is orthologous to G390, G391, G438
ggaacaaaagaaaaagataaagcctttgtttcagagaatcttagttctctgtatagatatatatacatatatatgtaaagctgctaaggaagtagtttcagggaatatatctacttgggggtgttttgaaaatcttgatttttttttctggggtttggatttgagggaaaatggctatggtggctcaacagcatagggagagtagtagtggtagtattactaaacatcttgatagtagtggaaagtatgttcgatatacggctgagcaagttgaggctttggagagggtttatgcagagtgtcctaagcctagctcgttgcgtcgacagcaattgatccgtgaatgtcatattctgtcgaatatcgagcctaagcagatcaaagtttggtttcagaacagaaggtgtcgagagaagcaaaggaaagagtcttctcgattgcagactgtgaacagaaagttgtctgcgatgaataaactgttgatggaggagaatgaccgcttgcagaaacaagtctcgcagcttgtatgtgaaaatggctatatgcggcaacaattgcaaagtgtatcggcggccactactgatgtaagttgtgaatcagtggtaaccactcctcagcattcccttagagatgctaacaaccctgctggactactaccaattgcagaagaaaccttggcagagttcctttctaaggctacaggaactgctgtcgattgggtcccgatgcctgggatgaagcctggtccggattcagttgggatttttgccatctcacacagttgcagtggagtggcagcccgagcatgtggtcttgttagtttagagccaacaaagattgctgatatcctcaaagatcgaccttcttggttccgcgactgccggaatgttgaagttatcacaatgtttcctgctggaaatggtggtacagttgagcttttgtatacccagatatatgctcccacaactctggctcccgcgcgtgatttttggacgctgagatacacaacaaccctagacaatggtagtctcgtggtttgtgaaagatccctatctggtaatgggcctggcccaaatcctactgctgcttcccagtttgtaagagctcaaatgcttccatctggatatctgatccgaccgtgtgatggtggaggatcaatcatacatattgttgatcacctgaatcttgaggcatggagtgcccctgagattttgcgtccactctatgaatcgtcgaaagttgtggcacagaaaatgactattgcagcactgcgatatgcaaggcaactagctcaagagactagcgacgaggtagtatatggtctaggaaggcaacctgctgttcttcgaacatttagccagagattatgcagagggttcaatgatgccatcaatggattcggtgacgatggctggtcaatgttaagttcagatggtgctgaagatgtcatagttgctgtcaattcaaggaagaacctcgcaaccacctccattcctctttccccgcttggtggcgtcctttgtgccaaagcatcaatgctactccagaatgtcccccctgccgtactggttcggtttctgagggagcaccgttcagagtgggcagactttaatgttgatgcttttgtagcttctgcattgaagtcttgtccgtatacatatcctgggatgaggcctaccagatttaccggtagccagataataatgccacttggccacacaattgagcatgaagaaatgcttgaagttattagacttgaagggcactctattggacaggaagatgcttttatgccaagagatattcaccttttacagatgtgtagtggcactgatgagaatgcagttggagcctgttctgaactagtttttgcccctattgatgagatgtttccagatgatgcacctttgcttccctccggatttcgcgttattcctctcgaatcaaaatcaggtgatgcccaggatacgttgaacgcacatagaacattagatctagcatcaagtcttgaagtgggcccagcaacaaactcgactactggagatgcagcttcttgttacagtgcacgatctgtactgacaatcgctttccaatttccatttgaggacaatcttcaggacaatgtggctaccatggcccgacagtatgttcgcagtgtggtttcgtctgtccaacgagttgccatggcaatatctcctacgggaatgaatcctacactgggggccaagctttctccaggctcaccagaagctgtaacattgtcgcattggatctgccagagctatagttatcacatgggaacagagttacttcgagctgattctagtggcgatgaatcagtactaaagaatctctggcaacaccaggatgcaattttgtgctgctcattgaagtcgctgccagttttcatttttgctaataaggccggactcgacatgctggagacaacattagttgcattacaggacatttctctagataagatatttgatgaatccggaaggaaagtgttgctctcagaatttgccaagattatggaacagggtttcgcgtgtttgcctggtggtatctgcatgtcaacaatgggacgacatatttcatatgaacaagctatcgcgtggaaagtgtttgcgtcgtctgaagaaaatgctgtccactgtttggccttttcgtttatcaactggtcattcgtgtaatgctatcatattttttttttctttttcgacctttctcacagaatactgatagccaggaacacagttgaatgaggggacaaacgaaattttttgtaatatgtaaaattcccagtttcttctgcattaatttaattagactggaaggtgtatttcatttcttgatttcttgatactcttgtgtaaatctttttagtgcagttttgtttttgttttttttcgagtcaaaaaaaaaaaaaaa

SEQ ID NO: 10217 - DNA, 904 bp, Lycopersicon esculentum
  Predicted polypeptide sequence is orthologous to G390, G391, G438
caagctttttttttttttttttttttttttttgcaaaaagaaaagaagtgttgttgatctaagtttgcattaatgagttcctacattgatgtgcaaaataatatcagacaaaagaccaattgataaacataaaacatatacaatgggcatcttcttcttcattcaatactttccaagctactgctctctcataggatattggccttcccatacttgacaaacagataccaccttgaagacatgcaaaaccctgctgcattatctgtggaagctcagagtagagaacctttcttccattgtcatcgaaaatcttttccagactaatatcttgaagggctactaagggggtttctagcatgtcaagtccagcctcattcgcgaatgtgaaaactggcagtgccttcatagagcaacacatcagagcatctgagtgatcccaaatttctttcaggatggattcacttcctccgctagcagatttgagcagctccacgcctaagaagaatctataactttggcaaatccaacgggcaagagtctgggcttcaggtgtgccaggtggagatcttagaccagggagagaaccaatacgagatggagagagagccaaagcaaccctctgaacagatgatatgatactgcggacatattgacgtgccatagcagctatgctttcttgaagatgaatctcaaatgcaaattgaaatgctattgtcataaccgattttgcgctaccagaattcttggaatgatccccagttggtcgacttccagctggtccaacctcagagttgatgcagatcagtgtgcggtttggactagatgcatccgccttggatcagaggatgatacgaaacagagggaggagaggagcatcatcagcaatgaggcatcaataggagca

SEQ ID NO: 10218 - DNA, 521 bp, Lycopersicon esculentum
  Predicted polypeptide sequence is orthologous to G390, G391, G438
agacacagactttttctgcctttcatctttttgaaatttatagaatatttatggtgcattgaaaagtttattagcatctgaaggtgcaattttttgttttagaagtccccgtcatttgaatactgtcatggatatgtggattaatttcttaccttattcttacagtttagtattgctactacttataatgcagggttctcctagtgctgttcagatttgagatttagcttttaactcttgaaactagaactggtgtgacatggccacctggtgaagttgaaggatgtagttacaaccatcattcagtcttgacaattgcattccagtttgttttttagaataactatcgagaaaatatcactgctacggctcgcaaatatgtatgaagcattgtcggctcggttcagagagttgctatggctattgcaccctctcaactctgctcgcagttgacaccaaaatctttccctggctcaccttaaactgtcactttggggagatgaatttgcaggttttataag

SEQ ID NO: 10219 - DNA, 604 bp, Lycopersicon esculentum
  misc_feature (545)..(545): n is a, c, g, or t
  Predicted polypeptide sequence is orthologous to G390, G391, G438
ctcagggggtcgccaacctgctgttttgagggcactaagtcagagattatgcaggggatttaatgatgctgttaatggatttgttgatgatggttggactattacggatagtgatggtgtagaggatgtaacaattgctataaactcatcttcaagcaaattccttggttcacagtacaacaccttgtcaatactccctacatttggaggagttttgtgtgccagggcatcaatgcttcttcagaatgttccccctgctttgcttgtacgtttccttagggagcaccgttccgaatgggcagattatggggttgatgcttattcttctgcatctcttaaagccagtccatatgctgtcccttgtgccagaccaggtggtttcccaagtagccaggtcattttacccctagctcagactgtggagcacgaggagtttcttgaggtagtacgtctagagggtcctgctttctcaccagaggacattgctttatcgcgggatatgtacttgttacagttatgcagcggagttgatgagaatgctgcangtgcctgtgctcagcttgtttttgcacctattgatgaatcttttggtgatgatgctcca

SEQ ID NO: 10220 - DNA, 729 bp, Lycopersicon esculentum
  Predicted polypeptide sequence is orthologous to G390, G391, G438
cttgattcaccacatttctctcaagcatcagcaggcctccttcaatggctacgtacgtcggattttcaatctgaagcatcaacaatttctcattctttcagtttgctctttcttgtacttcgaacttccaactgggtgcatacaggaggagacctgttccaggttgattctcaagctagtgatgctgttctgaaagaactgtggcaccatagtgacgcaataatatgttgctctgtaaaaatgaatggacaaacaccaagtgaagagaaagaaggagaagctctttgtacagatggtagcgagatatcaaatattgagactgaaatgaagtgaagaataaaacgtctctacaagaattgattggtgtagtatcctcttgcctatctgaaggtaaagaggtagttaaatagtgttcatgctattttctcattacttgaataggtagtcgtgcataaattacttgaacatgtagtcttgcataacaagtcgtcaggtagtccacaaaaacaggtgcttgcatatcccgcagtagcagatttttcactaattgttgttggaattcttcccttgaaaatattttggaggaaatccctttgataggcagaccatttcaagtgggccaaccgatgaacgtaaggtcgctgatccaaatatacaagatttggtttgaatgggagggtatggaaagaatggtcataaagaaaacggtaagaaactcatgttttagtg

SEQ ID NO: 10221 - DNA, 708 bp, Lycopersicon esculentum
  Predicted polypeptide sequence is orthologous to G390, G391, G438
cttcaatgaggctcttaatggtatagctgatgagggctggtcaatgctggatagtgatggaatggatgatgttaccatccttgtgaactcttctcctgacaagttgatgggcttaaaccttccttttgcgaatggattttcacctatgagcaacgcggttatgtgtgcaaaagcatcaatgcttctacagaatgtgcctccggctattcttctcaggttcctacgtgaacatcgatctgaatgggcagacaacaatatagatgcttatgctgctgcagccattaaagttggtccctgcagcttacctggggctcgagttggtaacttcgggggtcaagtgatacttccactcgctcacactgttgagcatgaagagttgctggaggtcattaagttggaaggtcattctcctgaggacgcgataatgccacgagatatgtttctattgcaactatgcagtggaatggatgaaaatgctgttggaacttgtgccgaactcgtgtttgctcctattgatgcctcttttgctgatgatgcaccattgcttccgtctgggtttcgcattatttcactcgagtctggaaggaagcgtccagtccaaatcgtacccttgatcttacttctgctcttgagactggcccagcggaaaacaaagcagccaatgatcttcacactagtggtggctcatcaagatctgtcatgacaatt

SEQ ID NO: 10222 - DNA, 722 bp, Lycopersicon esculentum
  Predicted polypeptide sequence is orthologous to G390, G391, G438
tcaagtgatacttccactggcacacactgttgaacatgaagagttgctggaggtcattaagttggaaggagtttgccattccccagaagacgttataatgccaagagatatgtttctattgcaattgtgcagtggaatggatgaaaatgctgttggtacctgtgctgaactcgtttttgctccaatagatgcctcatttgccgatgatacaccactccttccttctgggtttcgcattattcctttagactctgctaaggaagcctccagtccaaatcgcacccttgatcttacttctgctcttgaaactgggccagtaggaagtaaggtggctaatgatctcaagtcaactggtggcacatcaaaatctattatgacaattgctttccagtttgcatttgaaagccacatgcaagagaatgttgcatcaatggctagaaaatatgtacgaagcttcatttcatctgttcaaagggtcgcattagcactttctccatctaacttcggttccctgggaggccttcgtctgccgctggggactcctgaagcacatacactggctcggtggatctgccaaagttacaggcgatttctgggtgtggagcttccaaattgagtagtgaaggaagtgagtctctcctggatagcctatggcatcactcagatgctattatctgctgctctgctaaggctttgccagttttcacattttgcaaccaggg

SEQ ID NO: 10223 - DNA, 613 bp, Lycopersicon esculentum
  Predicted polypeptide sequence is orthologous to G394
ttcagaacagaagagccaggtaggactaatcactaatgatatttttttgttgttggagaaaacataaaattgatgggaacgttttttcgaattacagaacaaaactgaagcaaacagaggtagactgtgaattcctaaaaaaatgctgcgagacactgacagatgaaaacagaaggcttcacaaggaattgcaggaactaaaggctctaaaaatagcacaacctttgtacatgcagttaccagcggcaaccttaaccatgtgtccttcatgcgaaaggatcggcggcggtgttggagaaactccgtcgaaaaatgcttttactattgctcaaaagcctcacttgtacagtccattcaacaatccgtcggcagcttgttaatgataaatgccatatataaaatcatgtttagaaaaaagccgccactttttttggttaaaaggcttgtatgactagtgcagttgtatgtgtagagtaattagaattaaggtcactaatcaatatttttaatttgtttctttattatggtccatagtataagtctgtaaatcattaagcaaatatatacatatggatgaattattattatttatataagacaatctattgatctt

SEQ ID NO: 10224 - DNA, 1472 bp, Lycopersicon esculentum
  Predicted polypeptide sequence is orthologous to G409
gagtcgcaaaataaacttacaaaacagcacatatatatagagacaaaatcacataatacgccctcgccggaatcttattttcactgtcgccggccgttaaaactttttttttctagttcggaggtcaaataattaacctccgatcggaagaagtagttattctaactgcttctatttaatctgaaaacgggaaaacccctgagctggttaaggtggatttcgtgatgggattttgtatttgtcctttggaaactcctgctagattactgtggagtactagtttcttccgccacaagcttatgctcttctaaaacttagtcaactctcttttttcatacacatccctgctaaaaaagaagaactctgtgctggagtttttgttttcctttttctgtttcgccggaaacatataaataatcttctgtgtgtaaataggcgattttccagatagttgaaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggcctaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttacaggggaaagtggttggaggagcagggggaaatgaaaaatctgacatcttggaggtggatgctatgacgatccttcaagtgaaggtgaaggctggggaccggttgagcagtggcagtggtgggagcgcggtggtagatgagcatagttcacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaattgaattttagaatattatattacagtttttcttatctacgcgcgctttgtatgatgaaataagtgtcgtaattccaacttcttatttaaacatctattaatatgcttttgcagcttttattctcttgatttagcaaaaaaaaaaaaaaaaaaaa

SEQ ID NO: 10225 - DNA, 644 bp, Lycopersicon esculentum
  Predicted polypeptide sequence is orthologous to G409
aactcttttttttttcttggataatggcactgacccttcttcattctccccttaattatcacataaaaattttccaaatttcaagattcaatcaaaaaaccccatttcccactgcttaaacaaaccccacatagtttttttgttttcacaattcttgcaccttagagaacttaagggttgaaagtaaaataaatatggaagttggaagggttattaatgaaaaactttctcattgtctctggatgtccaattcttccccatcttttcatggttctgtatcaatggttaatttcgaagatgttggtcgaggagaagtgtctaaagagaggtcatttttcccaggaattgacaaagaagaaactagcaatgatgattatgatagctgttatcatcagccagagaagaagagaagacttttgcctaatcaagttcagtttcttgagaagagttttgaggtagataacaagcttgaaccagagaggaaagttcaattggctaatgaacttggcttgcagcctagacaaattgctatttggtttcaaaataggcgcgctcgatacaaaactaaagtacttgagaaggattatgatgctttgaaagctaactttgataagcttaaagctgattatgacacccttttcaaa

SEQ ID NO: 10226 - DNA, 804 bp, Lycopersicon esculentum
  Predicted polypeptide sequence is orthologous to G409
aatggctttatacttccaaatgaaattcttcctcctacttctaattggatatctaattcttcctccattttccatggctctgtatcgatggtaaatttcgatcaagatcgagtacagaagtctaaaaagaggtcatttttagcacaacttgatcaagacgacagtagtagcaatgatgacaattacaattatcatcaccaaagtgaaaagaaaagacgattgttaccaaaacaagttgagtatcttgagaaaagtttcgaggtagaaaacaagcttgaacctgaaaggaaagtacaattagctaaagaaactggattgcagcctagacaagttgctatttggtttcaaaatcgacgagcacgatgcaaaacgaaacaaattgagaaggattatgatgtccttaaagctagctttgatgaattgaagactcaatatgattgtctcttcaaagagaatggaagcttgagaaatgaggtacatttactcaaagagaagttgatcaacagagtaaaagggaaggaaattttagaatttattagtccacttgatcatgtagaacctcaaaatccttctattggagttgattcaaatttagcaatggtgaagtgcaagcaagaagatgcaaaaagtgatgttcttgattcggacagtccgcgttttactgacggagattacacttcatatttggagcctgctgattcttccaatgtatttcagacagaacactctaatttttctcgagaaatgacacattatgcttccccaaacttgaagacatcatcatcacgatgatttacctggtaa

SEQ ID NO: 10227 - DNA, 3644 bp, Lycopersicon esculentum
  Predicted polypeptide sequence is orthologous to G409
gattcgatcagttttttattttttatttaatttgaaagaaaaacacaaaaagttgaaaaaggcaaagagaaagagcaacaatatacgtcaccccaccgactgattgggactttgttttcatctctctatttttatatttaccaatttatcaccaactgctttgaactgaattctagaaaaatttgcaatactaaattttctgtagatctgtatcttgaagagatacatatatatttgtatatttatatatttatgtatatatatgtataaaattaagacgagttaatagttttaagaacatatatatatttgtatttattttttcttattcttattctaagaatatatgtttatacgtaaatacattgaaaacaaagagatatatttataagctttgaacttgagaaaagtgtttgatttatgataacttaaaatttaatgcttgtattatatactactatgaaatagatacacgttaattaatataaaaagagtgtaaaataacgatacacaaatgtatttgtatgtcaagtgaatgcatgtatgatatttaacattaaaaatgtgaaacttgaatatattttaatatgagatatttctccaaagtatgtataacttgcgctcaaaatatgaagttatgattttaatttttcagttttgcattcacatataattgaaaatcgtgatttaaaaatttaaattttcgtaaagtatgatttgcaatattattttttaaaaaacttttattttgtgaaatataacactagactcataagtttatataatttataaaagaagatatcttttaaatttttgtaagaaattataatgcacgatatgatctataatttggtaattataaaataaaaaaaatttaatattttcataacttatgtgaaaagatacacaatttatttttttttaaaaaaaattatctaaactatttcaactttataggaattttgattttatattatgattttatatagttggttaaaatatgattttatatagcaggttaaaatggtccctttaattaataacactcactaggtgaccaaagcttaaaattatttttggttataagtagtctgttggcaaagagaaagtaatcaaaaacacttcagtcacatctcttctctgctccaacacaccctctttgctctgctttattcccaaaaaaaaaaaaatcaacaaaatttctgtttttggttctggaacttggctatctttttttttttggttcataatcatatccttgtattgaatttgtaagcaagggtgatgtagtttatggtgatcggcagtaggtgctctcacacttcccacatcactgaaatcataatcacaagcttctttcgccacaagctatagatctttactaattccatatagtatatagttttaatacaagaatacaatatatatatatatattaaagggggtatttatcaagaaccccaaattcttaattacataacgaaacgagcggatatgggtgtttcttgaaaagatctctgttttataatttaaaaaaatttgtctgtagaattcgaagctatgatggctccagggattctctatggtggttcttctaatttcgatggcgtttttactcaaaaacagagagacgtgttttcttcatctactgcaccgaaagggcatcttggttccctttttgcccctgcctcttcttcttctaatttcttgggtacatctattttcttacaccgttgactttgtatgttttttatttggttaattttggtttagatagaatcttatctgtttgtatgaatttgtgataatattgaattgaattactattatgttcatttggttgattggcctgagatagttgttatcacatccatctatgtgatgaattgaatttgtatagcatattgtaaagaaaaagttgggtttgatgagcttgagctaaggttaaacaggatctctatgtcgtgtgaaagtagtaatgtctatgtacactctgttctcccgagattttatttagtggatttcactgggtatgttgttttaaatagtaaaagaaagtaaagatacaagagtaactgatggtgtatagaaatgatgttttgataaggagaatactagaaagtcttagctagttttaaatggaactgaattttagtcaaaattgataacttggtagtaatttgttctgtgggtgtttttatctatcaggatccagttctatggtgagttttcgcggtgttaatggagggaagagatcattctttgattcgttcgatcaggatgacaatgaagctgatgaattgggggaatatcttcatcaagcggagaagaagaggcgacttactgacaaccaagttcagtttcttgagaagagttttggggaagagaacaaacttgaaccagaaagaaaagttcagcttgctaaagaacttggtctgcagcctcgccaaattgcaatttggtttcagaatcgtcgtgcgcgatggaagactaagcagctcgagaaagattatgatgaattgaggaatagatacgatactctgaaatcaaattacaataatcttctcaaggaaaaagaagatcttcgaactgaagtaaggaccttgcatcatatttggtacttcattaaatgtaatttcattttcttgagcttgtcgactatgcttgtgtttgatggttcaatccttgttcaggttttccgtctcaccggtaagctgtttatcaaagagaaaggaaatgggcaattggatttgcgcgatgaacacaaacactccaatgcattggcaaaagaaaccgtggttgatccaatgtccaatgtaccagctctggttgttaagcaccagcaggaagatttaagctctgctaagagtgatgttttcgactcagaaagcccacgttacaccagtagaatgcattcctcagtcgtagatcaggatgattctgctcgcgcatttgaaactgatcagtcggattcatctcaggatgatgatgaaaacttcagcaagaatatgctttctactgccaacctacttggcaaagacgcggatgatgattatcccgcgacatcatcaaatttgagttactttggatttccagttgaagaccaaggttttggtttctggacttattaagttaaaaaaaatgtttgtatttgattagtagtaatgcagaatactatttaatgtgtcctagtaatatgtcatatatttggagacattgtatagaaagcacatttctgtaataaataaagtccaatgtatgggtccaagaatagtaatgagttctggtcacaaaacagtttggaactatggctattgcgctttgcatacctgttgtgtaggctctagctggtgctttatatgttgtgaaattacgttattgaattcactattagtgatcacaattctattataccatgaccaattctataggcaaaaggtccaaatccgcgctctagcatgtagtatgagaaaatgtcctttaactttgctatctgttaaaagtttaacttatttatgtttggctcatattgactttggtcactaatgaatcaaggtgcagataattaggaggatgctccataataaataggagtgagcataaatcaccgtattactgaattgaaaggtaattgtctatgtaaa

SEQ ID NO: 10228 - DNA, 535 bp, Lycopersicon esculentum
  misc_feature (523)..(523): n is a, c, g, or t
  misc_feature (530)..(530): n is a, c, g, or t
  Predicted polypeptide sequence is orthologous to G418, G965
gttggaagaggtaaattgaagaagaataacaacaaagcagcagccaataaccctagtggtggcgctaacaatgaagcttcttcaaaagatgttcctactttgtccgctgctgatagaattgaacatcagagaaggaaggtcaaacttttatctatgcttgatgaggtagataggaggtacaatcattactgtgaacaaatgcagatggttgtgaattcgtttgatttagtgatgggtttcggggcagcagttccttatacagcactagcacagaaggcaatgtcgagacatttcaggtgtttaaaggatgcaataggagcacagttgaagcagagttgtgagttattaggagagaaagatgcaggaacttcgggattgactaaaggagaaactccgaggcttaagatgcttgaacaaagtttgaggcaacaaagggcgtttcaccaaatgggaatgatggaacaagaggcttggagaccacaaagaggcttaccggaacgttctgtcaatattttaagagctnggctttntgagc

SEQ ID NO: 10229 - DNA, 1907 bp, Lycopersicon esculentum
  Predicted polypeptide sequence is orthologous to G419
tcaacatgaaactatgttggcaacaacaacaactagtcatcaagattcatggcatcatgataataacaggacattacttgttgatgatccatctatgagatgtgttttcccttgtgaaggaaatgaaaggccaagtcaaggactttcattatctctttgttcatcaaatccatcaagtattggtttacaatcttttgagcttagacatcaagatttgcaacaaggactaatacatgatggatttttgggtaaatctacaagtatacaacaagggtattttcatcattatcatcaagttagggactccaaatatctaggtccagctcaggagttgctcagtgagttctgtagtcttggaataaagaagaataatgatcattcttcttcaaaactacttctaaagcaacatgacactactgctactacttcaaaaaagcaacttttacagtctcttgaccttttggaacttcaaaaaagaaaaacaaaattgcttcaaatgcttgaagaggtggatagaaggtacaagcattattgtgatcaaatgaagggtgttgtatcatcatttgaagcagtggctggaaatggagcagcaacagtttactcagccttagcatcaagagctatgtcaaggcattttagatgtttaagagatggtattgtggcacaaattaaggccacaaaaatggctatgggagaaaaggacagtactactactcttattcctggctcaacaagaggtgaaacaccaaggctcagacttcttgatcaaactttaaggcaacaaaaggctttccaacaaatgaatatgatggagactcatccttggagaccgcaacgcggtctcccggaaagatcagtctccgtcctccgcgcgtggctctttgaacactttctccacccgtacccaagtgatgttgataaacacattttagctcgccaaactggtctttcaagaagccaggtgtctaattggttcattaatgcaagggtaaggctatggaagccaatggtggaagaaatgtacttagaagaaacaaaagaagaagaagaagaaaatgttggatctcaagatggatcaaaagccctaattgatgagatgacaattaataaccatcaatcatcacacattgtacaaaagccaaatcttgtaagaattgagtctgaatgcatatcttccatcataaatcatcaccctcatgataaaaatgatcaaaactatggagttattagaggtggagatcaatcgtttggcgcgattgagctagatttttcaacaaatattgcttatgctactaatggtagtgatcatcaccatcatcatcatggtggtggtggtggaagtgggggtgtttctttaacattgggattacaacaacatggtggatcatcaatggggttaactacattttcatcacaaccctctcatcataatcataatcatcaaagttcacttttttatccaagagatgatcatgatcaagttcaatattcatcacttttggatagtgaaaatcagaatttgccatataggaacttgatgggagcacaacttcttcatgatttggctggttaaaaaaaaaagtgatcatattcttcattttggaccttattatatactctaattttattatatattggtgatgaatcatatcatgataggtggatggatattataagtagtaatagctagtagttgcaacaatatatggggtatatatagataattaaatgaagtgattttgaatcatacaattattgaaaattctacattttggaatttcattttaggtattttgggtgatgatgacatgaattttgtttctatagttggtaattcttgtgatagtttttggtgattttgttatgcatccaaataattgccatgtgattgaaaaaaaaaaaaaaaa

SEQ ID NO: 10230 - DNA, 660 bp, Lycopersicon esculentum
  Predicted polypeptide sequence is orthologous to G427
gttgtttctttattatctcattttcgttctctattctatgaaatgattgcaatatataagttgtgaacaaaagcttcaataataacaacaatcatggagtttcatgatcacttttctcaagaattaggtctacaacaacaacaacaacaacacaacgtcgatgacgacgtttcggatcaatcgatgaatttctccgtaaagctaagtcaacaatatagggacgaggtcaataacaacgagcacaacaacaacaacaacaatagtaacgtttgggatcagagtgaaaaatacaaagcggatattttaaaccatcatttatcggaacaacttctttctgcacacgtggcttgcctgagaatcgcgactccggtggaccagttaccgaggatcgacgagcagttgacggagtcacagaatttggtggcaaagtactatgttgttggtcaaagtcaacggtctcttgatgataaagaacttgatcaatttatggcaaattatgttctattgctctcttcttttaaagagcaactacaacaacatgttcgtgtccatgcaatggaagctgtcatggcttgttgggatcttgatcaatctctacaaactttaacaggggtagcatcaggagaaggtacaggtgccaccatgtcagatgatgatgaa

SEQ ID NO: 10231 - DNA, 760 bp, Lycopersicon esculentum
  misc_feature (737)..(737): n is a, c, g, or t
  Predicted polypeptide sequence is orthologous to G427
ctagtggatattagagaggaaattcttcgaaagagaagggcaggaaagctccctggcgataccacctctgttttgaaagcttggtggcaatcacattcaaagtggccataccccactgaggaagataaggcaaaactggtagaagaaacaggtcttcaactaaagcagataaataattggtttatcaaccaaaggaaaaggaactggcacagtaatccttcctcttctacagctttgaagagcaaacgcaaaaggtgaatctgaaaatactactcatcatgtcagagaagttgttagcaagcttccttggatgagctacgtacctagtgtccagctactatctctacgtagtatatagaaagatggactcattcagttaaagcaacaggtcaattatttcgcaactgcaggacaactacaactattacagacagatcctacttgatcaaaagatggattgatatgatgatgtgttgaggaaaggctagttatttacgtaatagtctgatggggagggtgtacggtgactaatatatgtcaatcgcagtcatctataatttaatcacaaattagttgggatcgactgcatctgtcatctgtatcagttttgtgtgcacttgaatagttggaaacttcagtgactcaatcatgcagcttgcagaaatcactaccacatttttgtttggggttagaatatggggtgtacagttgaataatctcagttttatcaatacttntcttgtcggtatgtaagaattaa

SEQ ID NO: 10232 - DNA, 1575 bp, Lycopersicon esculentum
  Predicted polypeptide sequence is orthologous to G427
gctttatctatgatctcattaccgacgtttctcttcttgcttccctttcatagtaataattccactcatccttctttctcttttttcaataaatcccaaaatataaatttcttttattttttttttctgtttatgtgataaaaattagagttttctgcagaaagttatgttgtttcagatcccaatatatatttaaaacttccaatatagtaaagctttattgattttttttcatcaaaaatatacatcaaatcagaagaaaaaaaagattctctttattttttctctttcatctgcagtggtggtggtgctagaggttaaaaaaaaataaaaaattgacacagatttgatttatatatagatccatgttgtgaagattattaagaaagtatgcaacaagaagaaggaggattagggctaatgggttcaagtaatacgagtggtttaggtggcggtgatatttcatctatgatgatttcttctgaggatcatcataatcgaaatttgaatcattacaatcaattgaaaagtgaaattgctacacatcctttgtatgaacagctactttcagcacatgtagcgtgtcttcgagtacgtacgccgatcgatcagttgccattaattgatgctcagctcacgcaatctcataatttattgagatcttatgcttcttctcagcagcagcaacaacaacactcgctttctcatcatgaaagacaagagctcgataattttttggcacagtatttgttagttttgtgttcgtttaaagagcagcttcagcagcatgtcagagtccatgctgttgaagctgttatggcctgccgtgaaattgagcagaatttacagcttcttacaggagcaacccttggagagggaacaggtgctacaatgtctgatgatgaagatgaattacaaatggatttttcattagatgtatctggaggtgatgcacatgacttaatgggaatgggatttggtcttcctactgaatctgaaaggtctttaatggagagggtcagacaagaactcaaaattgagctcaaacagggatttagatcaagaattgaagatgtgagggaggagatattgagaaagagaagggcagggaagttgcctggtgacaccactactgttctaaagaattggtggcaacaacactcaaaatggccttatccaactgaggatgataaggcaaaactagtggaagaaacaggattacagctgaagcaaatcaataactggttcatcaatcaaagaaaacgcaattggcatagcaattcacagtctgtgacatctctaaagtccaaacgcaagagataagaaaacgaacgatcaaaatgaagcaacacatatataggtatgatgatggtgatatgaagaattctgaactgtcaatcgtgatctctatgacatgggaaaaatgttaggtaattcgcgtagattaggacggattgtaatatatatggtactcagaattggtatacatgtattgacattttcagtattatacaaactaacagtacttttgagctctggagtattacattttttcttgtaatactggtaaaaaaa

SEQ ID NO: 10233 - DNA, 1820 bp, Lycopersicon esculentum
  Predicted polypeptide sequence is orthologous to G427
attctctttctctctttactttttcttctttgtgtaccaaaaagaaaataaaaataaaaatgaacagagagcattgaacaaacactctatcaaaaagccatagctatggagtttcaggaccacttttctcaagaaatggttcttcatcaacagcagcagcagcagcagcagcagcaaaacgcggtattgcgttccatgctacctgaatctcctcatcacgacgctcgaaaatcacctccgacttggctcaatacttctctccttcgtcaacaacacagtcagtttggtaacgcatcctcaccttcctcggctgcagctgcagctgccgtagccggagggaataatttccttcatctccagacatctaactccgactcgtcaaactctaaccagtggctctcacctactgcggcggctggaggtggaagtaacggcggtggaagtgggcataatgatgagttatcagagtcgatgaattttgcgaagaagatgagtcaacagcatagtggaggaggagaagaaaacaataataataataataataataataataataataatgaagaggagaactcatgggagagagagaaatgtaaagcggatatattgaatcatcctttatacgatcagctactgtcggcacacgtttcatgcctgagaattgcgacgccggtggatcaattaccgaggattgacgctcagctagctcaatcgcaaaacgtggtagccaaatactctgtacttggacaaggtcaaccgcctctagatgataaagacctcgatcaatttatgacacattatgttctgttgctctcttcctttaaagaacaactgcaacaacatgtccgcgtccatgcaatggaagctgtcatggcttgctgggagctagaacaatctctacaaagcttaacaggggtagcaccaggtgaaggtacaggagcaaccatgtctgatgatgatgatgaccaggctgatagtgacacaaactttttggatggaggttttgatggaccagatagcatgggatttggtcctcttgtacctactgaaagtgaaaggtccctgatggagcgtgttaggcaagaactcaagcatgaactcaaacagggttataaggaaaaaattgttgacattagagaggaaattttacgcaaaagaagagcaggaaaactgcctggtgatactacatctgtgttgaaagcttggtggcaatcacattctaagtggccttatccaactgaggaagacaaagcacgattagtgcaagaaacaggtttacaactgaagcagataaacaattggtttattaaccaaaggaaaaggaactggcacagcaatccatcaacgtcttcttctcagaaaagccaaacgcaagagtgcaggtgaaatcaagcagtaaaaaaaagacatgatgaagaagaaaatgaaatttttgtgttctagcaaagcataaagattcatcacaaaacaaaaaacatgaatggctagaatttgggaaattgaattaatgagtttttggctgtgtgaagtaattgaccacagaaagttcccaagctgacctggttgactaagatatgctttagaaaaaaagagagtatagatacttgtgaaagtaatactagcactttcttatttttatgaggttaattttctatgttttaagccaaatattttaggacaacaggtttcagtttttataatttttgttttgtatcaagtattttggtggctatgttgtaattttgaattctagtgttactcatttttgtgaatagaagttgtagattataattaaaaaaaaaaaaaaaaaaaaaaaaaaa

SEQ ID NO: 10234 - DNA, 1198 bp, Lycopersicon esculentum
  Predicted polypeptide sequence is orthologous to G428, G1594
gctgttttgatgatggatgaattgagcaaacttcattctgctattgtttgttcacacagtagacgacaacaagaggttgaggttgaggctgaggccgggccgacaattattaataacactactactagttttgctgctgttcatcatcattattgtcaattagaagcagcggttgctgctgatcataatcatcatcaaaataatactaaatccaccaccaatatgtcagatcttattaaagctcagattgctaatcatcctctttatcccaacttactttctgcttaccttcaatgtcgtaaggttggagcaccgcaagaaatgacatcaattctcgatgaaattagcaaagagaacaacttaatatccagctcacgtcacagtagtgaaattggagctgatccagaacttgatgagtttatggaatcatattgtgcggtactagtgaaatacaaagaggagttttcaaaaccgtttgatgaagctacaagtttcttgagtaacatagagtcacagctcagttccctatgcaaagataatttaatcacttccacaagtttcaacaattatatatctgatgaagcaggtggttcctcagacgaggatctaggctgtgaggagatggaagcagcggatagtcaagaatctcctgctaactgtgaaggcgataatgagctaaaagaaatgctgatgcgcaaatatagtggctatcttagcagtttgagaaaggaatttctgaagaagaggaagaaaggcaaattacctaaggaagcaagaattgtattgctggactggtggaagaatcactatcgatggccttatcccacggaagaagagaaaaataggttatcggagatgacagggctagaccagaagcagataaacaactggttcattaaccaaaggaagcgacactggcgcccatcggaagacatgaaatttgctctaatggaaggtgtaagtgctggatcgatgtattttgatggatctggaggtactggaaatattggcacttgaaaatgacaaaacaaaaaaaaaatggaacctcctgctagctaacacgtagtgtatagtgtgacagaaagtatgtgttttgaagtttataaatcaacaattggtaatcatatactctcgtctctcttcctatttttagagctaacaaacgagtttgaaattttaaaaaaaaaaaaaaaaaaaa

SEQ ID NO: 10235 - DNA, 1149 bp, Lycopersicon esculentum
  Predicted polypeptide sequence is orthologous to G428, G1594
cgagtttagttctctccctttttaaaaaagaaaaaagaaaaaagaaaaacacaacacccacttgaaatatcaaacaaattcctgatttgattattttgtattttttttagatatatggatgatgaaataatgtatggttttaattccacaagagatgattatgccgataaagctttgatgtcaccggagaatttgatgatgcaaactgagtacaacaatttccacaactataccaactcctccatcatgtttggatccgatcctattcaattatcatcggaacaaacgcttcaaaataatatttatcgtggaaattgttgtggaggcagtggaagtggtggtgataacaataataataatgatgaagatggttcaaatattatcaaggctaaaatcctctcacatccttattatcctaaattactcaacgcttatattgattgccaaaaggttggagcaccagcgagtatagtaaatctgctagaagagataaggcaacaaaatgattttcgtaaaccaaacgctacttgtttatgtataggagctgatcctgaacttgatgagtttatggaaacgtattgtgatatattgttgaagtataagtccgatctgtctaggccttttgatgaagcaacaaccttcctcaacaatattgaaatgcaattaggtaatctttgcaaagatgatgatgaggaggaggaggaagagttaagttgtggtgatgcatcatcatcaatgagaagaagtgaggataatgaactgaaagataggctgttacgtaagtttggaagtcatttaagtagtctcaagttggaattttcaaagaaaaagaagaaagggaagctaccaaaagaggcaagggaaatgttacttgcatggtggtatgatcactttagatggccttattctacggaggctgataagaattcactagcagaatcaacaggacttgatccaaagcagatcaacaattggtttataaatcaaaggaagagacattggaaaccatctgagaatatgcaattagctgttatggataatctaagtgctcaattcttctcatcagatgttgattgagtttcgaatactgctctcatcatttctctttttattatataaattgtatatttttcaaaaaaaaaaaaaaaa

SEQ ID NO: 10236 - DNA, 1570 bp, Lycopersicon esculentum
  Predicted polypeptide sequence is orthologous to G431
aaagaaaaaaggaatattgtgtgtttgcttttttttctgactagtagtattgctaactatgtattccattaaggatttgctgtgaaaaagcctgatatcagtaagcataaaactcgggagatcacttacacacacacacaccctcctaaaaaagagaagagagatttactgttaaacagaggtttttttccatttctttttttttttcagtgtgtgtgtgagagaaagagatgattttcataggcacaaacaaatagaaaggaacaaaatttagagtgaagaagaaagtgtgtgagagaataatggagggtggttctagtggaaatactagtacatcttgtttaatgatgatgggatatggagatcatgaaaacaacaacaacaacaatggaaatggtaatggaaatggaaatggaaatgtaacaatttgtgctcctccaatgatgatgatgatgcctcctcctcctccttctttaactaacaataacaatgcagaaacaagcaacaacaacatcctttttcttcctttcatggacaacaacaacaacaataatcctcaagaagacaacaactcttcttcttcttccatcaagtcaaagattatggctcatcctcactaccatcgtctcttgactgcttatctcaattgtcaaaagataggagctccgccagaagtggtggcaaggctagaggaaatatgtgccacgtcagcaacaatgggccgtagcagtagtagtagtggtggtggaatcattggagaagatcctgcactagatcagttcatggaggcttattgtgagatgctgacaaaatatgaacaagaactctcaaaacccttcaaggaagccatggtttttctttcaagaattgagtgtcagttcaaagctttaactcttgcacctaattcttctcatgaatctgctttgggcgaggcaatggatagaaatggatcatctgatgaagaggttgacgtgaataacagtttcatcgacccccaggctgaggatagagagctcaaaggtcaattgttgcgtaagtacagcggttacttgggaagccttaagcaggagttcatgaagaagaggaagaaaggcaagctgcctaaggaagcaaggcaacaattggtggattggtggcttagacatattaaatggccatatccatcggaatctcagaagcttgcactagctgaatcaacgggattggaccagaagcaaataaacaactggtttatcaatcaaagaaagaggcattggaaaccatcagaagatatgcagtttgttgtgatggatgctgctcatccacattactatatggataatgttcttgctaaccatttcccaatggatatgacaccctctctcctctgaattaagatttgtcattattaatatcaaggatgtttaattaatttgcatattacttgtgtgcatgtagtagtacaagctattgtgacacaatcaactttttattagaccaaatatataaagtgcttgtaatagatctttctattatcatctttaattatggaattaaatagtttgtacttgctaaaaaaaaaaaaaaaaaa

SEQ ID NO: 10237 - DNA, 1405 bp, Lycopersicon esculentum
  Predicted polypeptide sequence is orthologous to G440, G864, G1421, G1750
tttggctttatacctctaattatattgttctaattatatggtagaaagatctacttcccgccaaaaacaacaaagaaagtaatctctttttctttgttcactcatcaacttgtttctcaaatcatttgtatcactgcaactttttccacacttaaaaactttttatacaataatattggtcactattcactcacttcaaccagttcttgattgttttagtactcctttttgagcttatgatgatttttttttgtgctctttgaaaaaaatatcttttaaatcgaactgtaactttaagtttttggtataccatgacggaaaattcagttccggtgattaaattcactcaacacatagtaactacaaacaagcatgttttttctgagcataacgaaaaatccaattcagagttacaaagagttgtgaggattatacttacagatgccgatgctacagattcttccgatgatgaaggccggaatactgtacggagagtgaagaggcacgtgacggagatcaaccttatgccgtcaaccaaatcgatcggcgacagaaaacgaagatcggtgtctccggattctgacgtcactcgtcggaaaaagtttagaggcgttcgtcaaagaccgtggggtcgttgggctgcagagattcgggacccgacccggggaaaacgggtgtggttgggtacttatgacaccccagaagaagcagctgtcgtttacgataaagctgcagttaagctcaaaggtcctgacgccgttaccaattttccggtatcaacaacggcggaggtaacggtgacggttacggaaaccgaaaccgagtctgttgccgacggtggagataaaagcgaaaacgatgtcgctttgtcacccacctcagttctctgtgacaatgattttgcgccgtttgacaatctagggttctgcgaagtggatgcttttggtttcgacgttgattcacttttccggctgccggattttgctatgacggagaaatactacggcgatgaattcggcgaatttgactttgacgattttgcccttgaagctcgatagtgtacgaggggctatttcgtccatttttgcaaatgggttcactggttagttgactagtgacgtggcatttttggcgggaatatatatatagtgattagcagtctctattcatacgaagactttgtgagagatttttgtttttatttttctgttaattgtgggtgaatattgtaatatgaaaaattttgtatggtgaaattgaattaattaacgatgaagataaggagagtgaagggggatgtgtgtattttatgattgaggtgtgtttttgtgattctgaaaaaataatttattattttacgttggaaatataaagtcaaaattctattgaaaaaaaaaaaaaaaaa

SEQ ID NO: 10238 - DNA, 717 bp, Lycopersicon esculentum
  Predicted polypeptide sequence is orthologous to G446
gcctgtgtcgacctccactttgacaaagcatgataattcttttatgttgcctgatacaattggtcatggattagctccaataggccaggatttgtgggatcatcagttgaatgatgttaagtgcttttcccagacaaaccttcaggttccactagacataactaacatgcagttcctacctgattcttatggttttaaggacctgtcagaggagagccataaccaaagtgatatatatagctgtcttaactttgatagtaacagcgggagcacagtgattgataattctgtttcgagcacagtgttagatgagttctgcaatttgaagcatactgatttccagaatccttcagattttctattaggcaacatcagttctagtcaagatgttcaatctcaaattacatcagccagtctggcagattctcagaatttctctgtacaagaatttgctgacaactcgggtggtgcatcatcaagcaatgtaaattttgatgaatgcaatcttttgcagaatagctcatggcagcaagttgctccacgtgtgcggacatatacaaagattcaaaagacagggatctgtagggaagaatcaattgatgtcctctggtttcaaaaattatgaagaggctgcggtctgaaattgaaagaatgtttggacttgaggggcttctgaatgacactcgaggctcgagctgggaagttggtatatgtgga

SEQ ID NO: 10239 - DNA, 515 bp, Lycopersicon esculentum
  Predicted polypeptide sequence is orthologous to G447
tgtctacttttctcaaaatgatgtccaattgcagcagacgactaacccgatgtcattcagttctcaagcgatcgtatttagagatagtcaagatggagaagttcaaggtgaccccagacatagtgttgcttttggagcaaacatggacaatcagttaggaatatccatgatgcctgattctttgatcacaaatagcttggtggggtcaaggaaagatgtatcaaataatatctcatcaggtggaggcatgctttccagctatgagaatcccaaggatgcacagcctgaactatcatcctcaatggtctcccaatcatttggagttcctgatatggccttcaattcaattgattctaccataaatgaaggcagcttcatgaatagaggtgcctgggccccaccacctcaaatgcctcgaatgcggacgtttaccaaggtacacaagcgtggtgctgttggaagatcaatcgacatcgcacgttactcaggctatgaagagcttaaacaagatttag

SEQ ID NO: 10240 - DNA, 977 bp, Lycopersicon esculentum
  Predicted polypeptide sequence is orthologous to G450, G456
gaccaaaagatatttcatttcaccaaactatctaaaaagggggaaaatgtcatcggagacagccaaatcagcgaacggtttgacggaaacaaataattccggccttaatttcaatgaaactgagctaactctcggcttacccggcgaatcgcggaagcaaatctccggtgcaaaacgtggaaattccgacggtatggaattaagcctaggaagctcaacttccggtgaacgccgccgtgatatctgcgaagttaatcactcgaaaaacgaaatctctaccggaaacaaacctccagcaaaggcacaagtaattggatggccgccggtgagatcatacagaaaaaacgtgatagaaaagtgcaaatacgtgaaggtagcagttgacggagctccttacttgagaaaagtagatctggagatgtacgacagttaccagaagttgttgaatgctttagaaaacatgtttacttgcctaacaatctgtaattctcaaagtgaaagcaagcttatggaccttacaaatggtgtagaatatgtacctacttatgaagataaagatggagactggatgcttgtaggagatgttccatggaaaatgtttgttgatacgtgtaagagaattagattgatgaagagcacggaggctataggattagctccaagaacacctgggagatcgtcgagttgaagctaaataaagaagcttaataactgcatgtacagataccaactggcttgagtgaataagtttttttatttttaccttttgcgttctttaattataggataagtaatatataattaggcaattacttagaagtgtattttgtgctacgatgcttcccgtgtgagtgaagacgattgattttattaatactgtatttgtatttttatttgtatgtttttgtcgttacgattgtagatctcaatatgaataaagccacttggggaaaaaaaaccaaaaaaaaaaaaaaaaa

SEQ ID NO: 10241 - DNA, 720 bp, Lycopersicon esculentum
  misc_feature (431)..(431): n is a, c, g, or t
  misc_feature (561)..(561): n is a, c, g, or t
  misc_feature (621)..(621): n is a, c, g, or t
  misc_feature (662)..(662): n is a, c, g, or t
  misc_feature (685)..(685): n is a, c, g, or t
  Predicted polypeptide sequence is orthologous to G450, G456
ttttaagcaacttaaactaaattattattagacaaacgatttatcgagttgtattaaataagaaatattatagcactaaataaattacatttacagaaataaatatgctacactcattattaatacatacaagcactttataatagcagcattaatacataacacactattcaattcgaataaacatttactataatcgatgaaattttgattgatgaaattcatttaaaaaggttaacgttgatttcatccatttctgttcttgcacttctccatagcccttggtgctagtcctattgcttcagttcctttcatgatgcgcaagcgtttgcaagaatcaacaaacatcccccatgggacatctccaacaagcatccaatcaccatctttgtcttcataggtaggaacataatcagaactattcaaaaggnccatcagtttcccctcatgcatgaaatctttcattccttggacaatagtgaaggaattgaacatcttggttaaggcatcaaataattcttgataactcttgtacatgtttaagtccactttcctaaggtnaggtgcaccatccatgctcaccttcaccaaaatattatcattcctctcgatcaagctttngagaagtcaaaatattctttcgaaaggacctttcgggcggncaacccacaacttgtgccttggnagctggggtttttgggtgttgaattcttgatggtg

SEQ ID NO: 10242 - DNA, 723 bp, Lycopersicon esculentum
  Predicted polypeptide sequence is orthologous to G450, G456
gagtatgacaagcgtgttgggtgcggagtgtgacaaaatccgattggattatgaagcggagacggagctgaggctcggattgcccggagctaatgggaatgaactggaatcgagtaataagaacaatggcaaaagggtcttttcagaaactgttgatttgaaattaaacctttctaattcaaaggattccacattaatggataatattaatattaatcaagttgataacatgaaggagaagaagaataatattgttgtgccaagctctaatgatcctgctaagccaccagccaaggcacaagttgtgggttggccaccagtgagatcattcaggaagaatgtaatgactgttcagaaaaacaccaccggcgccggcgaaatctccggcaccggcaccggcgcagcctttgtgaaagttagtgttgacggtgcaccatacttacgtaaagtggacttgaagatgtacaaaagttaccaacaactctctgatgcacttggcaaaatgtttagctcttttactattggaaattgtgggactcaaggatttaaggatttcatgaatgagagcaaattgatagacctcttgaatggttcagactatgtaccaacttatgaagacaaagatggtgattggatgcttgttggtgatgtaccttgggagatgtttgttgattcatgcaaacgtttacggataatgaaaggatcagaagctattgggctagc

SEQ ID NO: 10243 - DNA, 651 bp, Lycopersicon esculentum
  Predicted polypeptide sequence is orthologous to G450, G456
gagtttgatttttgatggatttgaaagaaactgagttgtgtttgggactacctggtggtggtggtggcggaggtgaattaattcgcgataataataataataataacaaggttaatgggaaaagagggttttctgagactgttgatttgaagctcaattttcatcaagctagtgatgatatttcttgtgctatggagaataataagatgaagagcagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgctgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctccttaacagttctgaatatgtaccaacctatgaagataaagatggagattggatgcttgttggagatgtacctctggagatgtttggtgattcatgcaagcgtt

SEQ ID NO: 10244 - DNA, 741 bp, Lycopersicon esculentum
  Predicted polypeptide sequence is orthologous to G450, G456
agcactatccatacattattaatcccaaaactttgtgtgagtacatctctctctctattttcaatttccataaaccattgcccatatagtattattaatttgtatagtggagaagaaaaacaagtaatggacttgaaaactgagttatgtttggggctgcctggtggtggaggagatcacaatattaagaaaagaggattttctcaaactgttgatctcaaactcaacctccatcataatgataatattccttctatgaacatcaacaatcctccaaaggataattcctccaacaagccaccaactaaggctcaagtggtggggtggccaccagtaagatctttcagaaagaacatgttgtctcaaaaagggaataataataataataataatgaagaaattagtgagaaggatgaaaaaacaatagcatttgtgaaggtttccatggatggtgcaccttaccttcgtaaggtagatttaaagatgtacaagagttaccaacaactctctcattctttgaccaacatgtttagctccttcactatgggtaattatgggtcccaaggaatgatagattttatgaatgagaggaaactgatggatgtccctcatagttctgactatgtaccaacctatgaaagataagatggggattggatgcttggtggagatgtaccttggcaaatgttgttgattcatgcaaagcgttacgcataaatgaaggatcagaagctattggac

SEQ ID NO: 10245 - DNA, 929 bp, Lycopersicon esculentum
  Predicted polypeptide sequence is orthologous to G451
cggccggggacctttttcttgaaatacacaacttcttctgagatagtaaataaaggagcaatcttgatcaagaaagtgtttaaagaatttctgtgtgtgtgttttgagatttgaggatttcatttggtgttttgggtatttcaagattcaatttttaattttttttggaggaaagaaagaaaatgacaagtatagtgggcaatcagaaagatctgaatttcaaagccactgagctgagattaggtttgcctggtacagaaaatcaagaatctgaccaagaaatatcaaattccaagaataacaacaaaagggctttacctgaatcaactcatgatgaggaagattgtgaatctaagtcaagttctggtcatgtcaaaaccccaccacctgttgccaaggcacaaatcgggggttggccaccagtgagatctaacaggaaaaacatcatccaaccaaagaaaacagaatctgaatctggaacgtatgtcaaagttagcatggatggtgccccttatctaaaaaaaattgatctgaaaatgtataaatgttatcaagaactactaaaagccttagaaaacatgttcaaactcaccataggtgaatactcagaaagagaaggctataaaggctctgaatttgcccctgcttatgaagacaaagatggtgatttgatgcttgttggtgatgttccttgggaaatgtttatgtcttcttgtaagaggctgagaataatgaaaggatcagaagcaagaggcttgggatgtggagtttaacttataaattataaaaattcccaaatagaatattatgatgatgaagaagttttttttcctctttttacagtaaaagagtctttttttcaccttaggttcttgattaaaatgaccttaaatattgtaatcaaaatagttttttctctggacagacat

SEQ ID NO: 10246 - DNA, 772 bp, Lycopersicon esculentum
  Predicted polypeptide sequence is orthologous to G451
tatcagttttggagaaggaaacttgaattgcaatccaattttgtgaaaaagaaaaatggagtgtgttttggctcatgagaaagatttgaatctcaaggcaacagagcttagattgggtttaccagggaggacagatgaagaatctgacaaagaaattgtatttcatttcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttgaaatgttcttatcatcatgtaagaggctaaggataatgaaaggatcagaagcaagaggattaggatgtggagtttgagaagaagaataatacaagattatgaattcttctctgttttaaacaggaaaaaaaaagggggtctttttgagcttggggttgtcgaattgcaaagaagctggaaaatttgttttacactgattgggaaagtgcaaacagaagaaa

SEQ ID NO: 10247 - DNA, 724 bp, Lycopersicon esculentum
  Predicted polypeptide sequence is orthologous to G451
attcaaatcaatcattctttctaaatcatgagaatttacgagaaggatatcaatgatcttgaggcaactgagctaagattaggtttgcctgggataataaacgatgaatcttcaacatcaactagtacttctaaaaatagcagaaaaagaccttcatctagtagtgtaaatgaaaatgaacaacaagactcagctcctgcaccaaaagcacaagttgttggttggccaccagttcgatcatacaggaaaaatcatgtgtctaaattatcagaatctgataataattcctcaggaatgtatttaaaagttagcatggatggagcaccttatttgaggaaaattgatcttcaggtttacaaaagttatcaagagctactcaaggctttacaaagcatgttcaagtgcactattggagtgtattcagaaagagaaggatataatggatctgattatgcaccaacatatgaagacaaggatggtgattggatgcttgttggtgatgtaccatgggagatgtttataagttcttgcaaaaggcttagaattatcaaaggatctgaagctaaaggtctagcatgtctataaaaacatggaaatatatataaacatacatacaaatctgctagggatgaacaagtttcagttttgtaaactatctcgatcttctattagtttcacgggatatatagatctagatctacatgtacaaatagttttatccttc

SEQ ID NO: 10248 - DNA, 208 bp, Lycopersicon esculentum
  Predicted polypeptide sequence is orthologous to G451
ggttcgatcctatcgaaagaacattttagaagcgagctatgttaaagtgagcatggatggtgcggcttatttaaggaaaattgatcttaatacttacaaaagttatccacaattactcaaggctttagagaacatgttcaagtgctctattgatgtatattcagaaacagatggatacaacggatgtaattatataccaacttacgaa

SEQ ID NO: 10249 - DNA, 461 bp, Lycopersicon esculentum
  Predicted polypeptide sequence is orthologous to G461, G462
ttgatttgagtactcataagggttatgatcaacttgttatggctcttgaaaaactctttgattgctatggaattggagaagcattggaggatgcagataagtcagagttcgttccaatctatgaagacaaagatggagattggatgcttgtcggcgatgttccatggataatgttcagtgaatcatgcaaaaggctaaggatcatgaagagatcagaggcaaaagtgatagggcttggagcaagagactttctcaagggaatgtctcaagagaaatagagtggatgattcaagctatatttttacattaatatataattgtaattgtaatcttaggtgtgataagacaccctagacttaaaatcaatttctgatttgatttcctcttaattagcttaattattgtagtaatcagtaccttatttgctcttaaatgacaattttcgtatgtataataaggct

SEQ ID NO: 10250 - DNA, 683 bp, Lycopersicon esculentum
  Predicted polypeptide sequence is orthologous to G464
gttgatggctcaatttgtactctgtcaaaggaagataataatggggtgttgctatcatctgaggcttcttcatcataccctgatgagactcaacttgaattgggtcttggactgagtcttggggcttctgctgatgttgcccttcctaaggctaaaactggtgcaaggggtggttatgctaaaatcttgacacccaaaaaagatttcccttctttgggttctaattcatcatcttcatgttcatcttcttctgttattaaaccgaataatgcttcttgtggcactaagagaaacgctgattctatttctcctcctcgttcgagtgtcagtcaggttgttggatggcctcctataagaacttataggatgaacaccctggttaaccagacaaaactaccacccccagaagaattttctgtgacaaacgagaaatgcaaaagtaaaaatactatcgctaatgctgggagcagcaagatcaacaactttgcaaaggaaaaagggctcgtcaaggcttctctatttgtgaaggtcaatatggatggagttacaattggaaggaaggtagatctgaatgcacataatagctatgagaacttggcacagactctagacaacatgttcttaagacccagcacgactgtttgtgcaagatcatcaaatgtacaggagctaggtgtcatgtc

SEQ ID NO: 10251 - DNA, 595 bp, Lycopersicon esculentum
  Predicted polypeptide sequence is orthologous to G464
cagtaggattttaactgctaaagattttcctaatggattttcagctaagagatccattaatgttggtgtttctggtactaaaagagctgctgattttgctggttctacaactgaggttggatctcctcctactggtgcaagtcaggttgtgggatggccacccataagggcatacagaatgaacagcttggttaatcaatcaaaggttctaaatgctgatgatgagaagggagttggcgggaacgataagaaggagcactcgaagaagaagatcaatcatgggaacactaaggatgatgcagcatcggttaaagaaaaggggcatcttggttttgtgaaggtgaatatggatggtttgcctattggaagaaaggtggatttgaatgctcatacttgctatgaatcgttagccgaaaccttggaggatatgttctttaaatctaccaaaagcggtgaaaaggaacaagcaactaagtcttttaagctcttggatggatcatctgaatttgtgctcacatatgaggataaagaaggagactggatgcttgttggagaagttccattcgggatggttctcaacactgtgaaaaggcta

SEQ ID NO: 10252 - DNA, 720 bp, Lycopersicon esculentum
  Predicted polypeptide sequence is orthologous to G464
tgcttctacaagtgccagtcaggttgtgggatggccaccaatatggacttacaggatgaatagttttaatcaatcaaagattacaaatgctgatcatcaacaagaagaaaatgtgaacaaagaaactgagagttcaaacaagaaaattaatcatggaattaataataccaagaataatgatgtagattttgtaaaggtgaatatggatggattgccaattggaagaaaagtgaatttgagttctcatatttgctatgaaactttagccaaaatcttggaggagatgttcttcaaatcaaccaaaactactaattgtggagaaaaagaacaagtaacaaagtcatgtaagctcttggatggatcatcagagtttgttctcacatatgaggataaagatggagattggatgcttgtaggagatgttccatgggggatgtttttgagcaatgtgaaaagactaagaatcatgaggactactgaggccaaaggactttgtatgtagaaacatggagagacacaaagcaaattgatctagtttacttaattagcaaattatcaaatgagaacacaacttggaaaaactatataagaaaatagtacaagtagagaagcaaagagtacacattttggggagtactttttatagtttcaatttttgttatgcattttttttgtctatgtaagccttatcaagtactagttctaaaacccctatataat

SEQ ID NO: 10253 - DNA, 483 bp, Lycopersicon esculentum
  Predicted polypeptide sequence is orthologous to G470
ggaattttgtggtatggttcggaagatttttatctacacgaaagatgaggtgcagcggatgaaccctgggactctcaattcaaaaggcgaggacaattcttctgttgcagaaggctctgatgctaaagaagtgaagaatctacagcttcacattgattccagtccggaagattcttagataatagagaagtcctccttaattgaggtttattaaaatctgtggaaaatactatatccacccagctgttggcatttttagggattctggaaggtggttacccacatcaaagtcccttttagcttccggatggctggtctccccattgatgcagcttctgtaatttgcagtttcgaccctttttggcgccaaattatgatgacttatctatatacagaatacatgaattatcagcctggtcacagtcttgctttcgcttatttccttatgtacatacccagttttaacagttcttctggcagctc

SEQ ID NO: 10254 - DNA, 480 bp, Lycopersicon esculentum
  Predicted polypeptide sequence is orthologous to G470
atcttggtgtccttgctacagcttggcatgctattcagacgaaaacactgttcacagtatattataaaccaaggacgagccctgctgactttatagttccatatgatcagtatatggagtctctgaaaaacaattactccatcgggatgaggtttaaaatgaggtttgaaggtgaagaagctccagaacagaggtttactggaactatagttggcattgaaaatgctgacctcaaaaggtggcctgagtcaaaatggagatgcctgaaggttcgatgggatgaaacttctgctattcctaggccagaccgagtttcaccctggaaagtagagccagctcttagccctcctgcacttaatccacttccaataccaaggcagaaaaggccgcgatcaaatgttctgccctcgtctcctgattcttctgtacttactagggaaggttcatccaaagtagttgtagacacttcacaagccagtg

SEQ ID NO: 10255 - DNA, 767 bp, Lycopersicon esculentum
  Predicted polypeptide sequence is orthologous to G470
aggctctgtaacttcaattttgagtgttgattgctgtttctagggtctctttggttaccagttttgcatgcttttgagctgaggaagagtttagtgctttttttctggtgaattttggagaaggaagttttattttgtgcttgttttatgaattgattagtgtggatatgagagatctgtgttgagaattagtgtacggaaatggctgcttcggaggtgtcgattcaaggttacagcgagccgagtgatggttctaggccggtttcagagactggtaggagtagttccggtgtcggaatagttgatgctgatacggcgttgtacacggagctttggcgttcatgtgccggtccacttgtgacggtaccgcgagagggtgagctggtgtactatttccctcaaggacatatcgagcaggttgaagcatcaactaatcaagtggctgaccagcagatgcctttgtataatcttccatctaagattctatgccgtgttgtgaatgtcctgttaaaggctgaaccagatactgatgaggtgtatgcacaagtgactttgatgccggagccaaatcaagatgagaatgcagtgaagaaggaacctatgcgccctcctccaccacgatttcatgtacactctttttgtaagactctaacagcctctgataccagcactcacggtggattttccgtcttgagacgacatgctgatgaatgccctccccaactggacatgtctcggcagctcccacacaggagtgggtggccaaa

SEQ ID NO: 10256 - DNA, 636 bp, Lycopersicon esculentum
  Predicted polypeptide sequence is orthologous to G475
agttggcccaataggttctcctcacagggatggaaactaacaaatgggaagggaagagaagcattactgaagctgaaaaggaagaggatgaacatggaagtgttgaagaggatagcaaaagaaaaagggtattgactctctggtaggaagctagttggtgaagggtcggcacatccttcttgccaggtcgatcagtgcactgcagatatggcagatgccaagccataccatcgccgccacaaggtgtgtgagttccattcaaagtctccaatagtacttattagtggactccagaagcgattctgtcagcaatgtagcaggtaagtaacccctaatttctgatgattatccgtgccttccgagttgtatagtggagatatcttggaaactaattatgtgcactcatcaaacagtttttcttagatttaagtcatgaggaacattaatcaaaacatcaattagccaataaacaaagaagaaggtaatttaagcttgagtgttgattcattttgtgcaacatatgggaatcctaatatcaagaaccaataccaataacacaggcaaaaactaatacatagagacacgaaagtacaacagcaacaatcaattttatacaatatcctatgcatatcattt

SEQ ID NO: 10257 - DNA, 2019 bp, Lycopersicon esculentum
  Predicted polypeptide sequence is orthologous to G477
cttttgtaaatgactgggtttttgaattgctaatttatatctggttgtgtgttatggaggaagactaaaacactagtacatttttgggtgttaatagggtttaaaaaaaaatggagtcatggagctatttttcaggggggaagggttttgtatcagaggaatcagtttctgttaatgatggaatgaggagagtgaaaaatggagttatgggttgggaattgaagacccaaagtagctatggaatgtgtacaactgataatcaaggatttcatgagttgggttctccaaatctgatgagaaaacctatgtttactgaccaaatgagagatggctttgctagtagtaagcactggggtggaggtggtgggagtatagttggtgcattttctggggaagataaatctagttctaaactatcaagctcagctgtggattcaatttccagagactcatcactgattgatttgaaacttggaagatttcctgatcatcatgtagatggaaatattttcaaatctgccaagactttgtcaagctctacttctgctgagtcaattcttcctgctaaaagaatgagagcaggaggtttgaactcccacaaaccattttgccaggttcaaggttgtggcaaggatctcagcccctgtaaggactatcacaagaggcataaagtgtgcgaggttcactcaaagactgctaaagttatcgtaaatggcatcgagcagcggttttgccagcaatgtagcaggttccatctactggctgagtttgatgatggcaaacgtagctgcaggaaacgtcttgctggtcataatgagcggcgaaggaagccccctcatactggtaccagatttcgtggaacttcttttgcaacgtcaccctttgcatgccaagacatacttagtagccgctatctgcatcagcctaaatatgagatgagtgactggtgtaagaatgtaaaagttgaagatggtgttgattatagccctcaacttgccatgccctttacaaatggacagttacaaccaaaatctcattttacatcatatcatgccaagaaagggtgtcattctttccatgatggactacctgctgtaacaacaagcagaattaacaagagtaccaactcatctctgcatgatatgcgaggatcagattttgtttccccttctctgttccacaccacctcaactggttctgaagtcttgcatgcattggacacatcttccattcaggggctatcagggatatcaaattccagcaatgctctctctcttctgtcatctcaatcacagggatcgtcaaatcattccactgttttttccacttctcgccccctcattcaaccaaacaataattacaatgtgactcaagcatctaaaaatgttctgggacttggtcctcaggcttcggcaggtagaatgtccaatacattcaattcatctgggatcaattctgcagaaggcactggaccagatgatatttcctaacaacacttgtggtatcaatcgtgtcattcaaggatcagatttggtgaactctaagaatcaactttcttgtgaagatggacctactattgatttgctccagttgtcatcacaacttcagcgtgtggagcaccaaaggttttccgttcaagtgaagcaagacggcaatgcttttcccggtctcagaatcacttgagcagatgcaaatgtctggattaaattcataatcggtgggcgttgaactactgtagtgtgcagcaactcaatcaagaagcacacacctttcgcagctttacagaggtggaagtatcagggagtaagtttttggaatcttgatgttcactgcttgtttgctccttttttgtttttattttcctcatggtgctgtctcattcaataataatgttttttctttctctttgacaattgacaataatcatgacttgtaagtctcagttaatctgtgtagtactaaatatgcacccttttttatggaatagatgctcaagtgtttcacaaaaaaaaaaaaaaa

SEQ ID NO: 10258 - DNA, 706 bp, Lycopersicon esculentum
  Predicted polypeptide sequence is orthologous to G477
ggttgaattgtctgtcgacacggtttcgagaaatagaagtattgtaaaggaatggaatttgaaccctttttgtgatgttgataaaagcatttgtggttttagtcaagaagtaactgaaaacacaaaaccttctacacaattcaacagacgtttcaccaactctacgttggacggttgaaccaaatcatcatgtatacgttaaagggcgtgatcataatcttgagaaatctcccagagttagtgttgtaaaaagcttgacaccgactgagttatattcatctgacgtagctgagcaagatgtggtcgttcaagttcctgattgtgaggctgtttcatttggaatccagagagatcacggacatgatcaaagatcaaactctataaattccaagaactgtctttctctggaaggtgggcctaccatggatttagtgcaattgtcttcgcacctacaaagggtcgagcagcagaaaaactccgtccaagtgaagcaggaaaatgatatcttttgttcctttacttccacctgaggcttataagagctacaagtctgaagggtcaacatccgcaatgaagaatcggaagataatatgaggagattaaactaattcacaagtgacctttccaacaagtcaaaaggcaaaggcagattaaataaatgattgatatcggtacatcttttgttagtgtcagccatagcttttct

SEQ ID NO: 10259 - DNA, 1221 bp, Lycopersicon esculentum; identical to SEQ ID NO: 2205
  Predicted polypeptide sequence is orthologous to G489, G714

SEQ ID NO: 10260 - DNA, 1304 bp, Lycopersicon esculentum
  Predicted polypeptide sequence is orthologous to G502, G519
ggcacgagcaaagcaggagcaggagcagcaacaaacagagagaagaaaacagaggaagataagaggaaaatttatcgaattcgaatcgagagaaaaggggaagtgaagttgcgaagagtgagaatttcaaaggaaatgaacaaaggagcaaacggaaatcagcaattggagttaccggcgggattcagattccatccgacagacgacgaattggtgcagcactatctctgcaggaaatgcgccggacagtcgattgctgtatcaattatagctgaaattgatctttacaagtttgatccatggcagttgcctgagaaggctttgtacggtgaaaaagagtggtattttttctcaccaagggatagaaaatatccgaacggttcacggccgaaccgagcagcaggaaccggttattggaaggcaaccggagctgataaaccggtgggaaaacccaaaaccttagggataaagaaggcacttgtgttctatgccggaaaagcacccagaggtataaaaacaaattggattatgcacgagtaccgcctcgccaacgtggaccgctctgctggcaagaacaataacttgaggcttgatgattgggtattgtgtcgaatatacaacaagaaaggcacacttgagaagcattacaatgtggacaacaaggaaactacaagctttggagaatttgatgaagaaataaaaccaaaaatattgcccacacaattagcaccgatgccaccacggcctcgatcgacaccagcaaacgactacttttatttcgagtcatcagagtcgatgactagaatgcacacgacaaactcgagctctggctcagagcatgtcttgtcgccatgtgacaaggaggttcagagcgcgcccaaatgggacgaagaccacagaaacacccttgattttcagctaaactatttggatggtttactaaatgaaccatttgaaacccaaatgcagcagcaaatttgcaactttgaccagttcaacaatttccaagacatgttcctatacatgcaaaaaccttactaaaattgtataaattcattggatctaaattgagtgtgatccatgacattttctttgttctttggtggtgtaggtcaactttttattaagtagtttagagaagtacaaaatgctagtcaaatttggtgggctacagcacaaatgagccttgataagcatagccaaagagtcgtatagaagggcttattattattgtaaggtatgtaaaaacaaatgaaaatttgttaatatcaagttatcattcttcaaaaaaaaaaaaaaaaaaa

SEQ ID NO: 10261 - DNA, 920 bp, Lycopersicon esculentum
  Predicted polypeptide sequence is orthologous to G502, G519
gtaattacaaaaacaaattaaatcaattctttttcttgaagacaaagtaatggtggaattgcaatttcctgctggatttcgattccatccaactgatgaagagcttgtgatgcattatttatgtcgaaaatgcgacgcacagccaattgctgttccgattatagctgaaattgatctctacaagtacaatccatgggatctacctgatttggctttgtatggtgagaaagagtggtatttcttttcgccgagagatcggaagtatccgaacggttcacggccgaaccgagctgcggggagtggatactggaaggcgacgggtgcggataagccgattggtcgtccaaagtcgatgggaattaagaaagctttggtgttttacgcaggaaaagctccgaagggagaaaaaaacaaattggattatgcacgaatatcgacttgctcatgttgatcgatctgctcgtaacaaaaacaacagcctaagactcgatgattgggttttatgtcgaatctacaataagaaaggtacaattgagaagaatcaactgaatatccgaaaaatgaacggtgaaatgtcgccggcggtgagtgaaggtgatgtaaagcctgagatcgtgccgatttcagtttcaacaaacccatcttcgacgtcttatcacgtttacaatgacttcacgtactttaattcaccagattctcttacgaaacttcacgccgattccagctgctcggagcacgtaccttcgccggagttcacatatgagaaggaagttcagagtgagccgaagccgaaaccgagtgagtgggaaaaaactgcccttgattttccatttaattacacagatgccactgcttctgagttgcagagttgttatgagatgtcaccgctacaagatatattcatgtatctgcaaaagccg

SEQ ID NO: 10262 - DNA, 806 bp, Lycopersicon esculentum
  Predicted polypeptide sequence is orthologous to G502, G519
agctgctggaactggatattggaaggctactggtgcggataagccgattggaaatccgaaagcggtgggaattaagaaagcattggtgttttattctggtaaagcacctaaaggagagaaaactaattggatcatgcatgaatatcgtctagctgatgttgatcgatctgctcggaagaataacaatagcttaaggctggacgattgggttctatgtagaatttacaacaaaaagggatcgattgagaagaacaggaaaatgaacactacctgctacatggataaagttggatctccagaagatcggaagccggagattctaccaccgctacctccacatcctcagccgcagcaattgcacaacgatttcttctacctgccgtccgattcagttccgaagatgcactccgattcaagctgctcggaacacgtgctctcacccgaattcacatgtgaaagagaagtgcagagtgagccgaaactgacagattgggagaaagctaccctcgatcttccatttaattacatggatgccactaccggcgccacaacggtggataatagcttgttaggttctcagtttcagagcagttatcagatgtcgccgctgcaggatatgttcatgcacctgcacaagcctttttgagtggggccaccaatggattattttcagccgcaagtgtcaaacgagactttaacgtccgtgactttgcacgtgccgccgtagtagaataataggagtagcatcttctgcgttcacattggcaaattgtgaaacacatttgtacatgtagtagatgatgggg

SEQ ID NO: 10263 - DNA, 1423 bp, Lycopersicon esculentum
  Predicted polypeptide sequence is orthologous to G504, G1425
ctaaattccttcttgtttatcattttctctcttcccaaaaaaaaaatcccaaaatttaatcataatacaattcgaatttatcaacctcgtactacgtacatatttttgttggtacgtaaaatactgaattcaggtcaactcaaacatcgtaaattgtgatttctttatggaaagtacggattcatcaaccgggacacgtcatcagcctcaactcccaccggggtttcgattccacccgacggacgaagaactcatcgtccactacctcaaaaaacgagtcgccggcgctccgattccggtggatattattggtgaaattgatctttataagtttgatccatgggaactccctgctaaggcaatattcggagagcaagaatggttcttttttagtccaagagatagaaaatatcctaacggggcgaggccaaatcgggctgcaacatcgggttattggaaggctaccggaaccgacaagccggtttttacttccggtggaacacaaaaggttggggtaaaaaaggcgctcgttttttacggcggtaaaccaccaaaaggggtaaaaactaattggatcatgcatgaatacagagttgtagaaaataaaacaaataacaagccacttggttgtgataatattgttgccaacaaaaaaggatctttgaggctagatgattgggttttatgtcgaatttacaagaagaataacacacaaaggtccatagatgatttgcatgatatgttgggatcgataccacaaaatgtaccaaattcaatattacaaggaataaagccttcaaactatggtacaatattgctcgaaaatgaatcgaatatgtacgatggaattatgaataacacgaacgatattatcaacaataataatagatccattccacaaatatcgtcaaagagaacgatgcatggaggtttgtattggaataacgacgaagcaacaacaacaacaacaactattgataggaaccattctccaaatacaaaaaggttccttgttgagaacaacgaggacgatggacttaacatgaataatatttcgcgaattacaaatcatgaacaaagtagctccattgccaatttcctgagccagtttcctcaaaatccttcgattcaacaacaacaacaacaacaagaagaagtattgggatctcttaatgatggggtcgtctttcgacaaccttataatcaagttactggcatgaattggtactcttaaagatataaaaaggcaaaaaatagttagccctgtaaaatcaatcgatcaatcaatcatagatatattatatatggatttcgttatattttacttttagttagaattaatatatagaatatcttctatctcacattaacaaataagaacatttataacaaaaaaaaaaaaaaaaaaaaaaaaaaaaaaaaa

SEQ ID NO: 10264 - DNA, 781 bp, Lycopersicon esculentum
  Predicted polypeptide sequence is orthologous to G504, G1425
tttataatcaggtcgctctgattaaatatatttgaaaatttttatcaaataatattgtggtcatggagagtaccgattcatcaaccggctctcatcatcaaccacaattgccacctggatttcgatttcatccaactgatgaagagcttgtggttcattatcttaagaaaagagttgcctctgttcctcttcctgtttctattattgctgaagttgatctttacaaatttgatccttgggaactacctgctaaggcgacatttggagaacaagaatggtatttcttcagtccaagagatagaaaatatcctaacggggcgcgcccaaatagggcggcaacttccggttattggaaggctaccggaaccgacaagccggtgctcaccgccggcgggacccaaaaagtaggtgtcaaaaaggcattggtgttttatggtggcaaaccacccaaaggggtgaagacaaattggattatgcatgaatataggcttgctgataataaaacaaataataagccccctggttgtgaccttgccaataaaaaatcactaaggctagatgattgggttttatgtaggatttacaagaagaataatactcaaaggccaattgatcatgaaagagatgatttgaatattggatatgatgatgggatcatcatcaattcatccatcatgtataccaaattcaatgtcaatgccaaatatatttggtcaaccaaaaataccacaactaaaatcttcaaattttggcactacattaattcatgatcaaaatgacc

SEQ ID NO: 10265 - DNA, 2257 bp, Lycopersicon esculentum
  Predicted polypeptide sequence is orthologous to G521, G2887
gacttctagctctcctccgccttccccttcgcttcccccaccaccccatcatcgttttttcgccttctccggttcggtcggtatctgggtttttgattgtgcaccagatgtctgttggctccagcaagaagcaccatttctttgtttggagcgcattccttttcatgaaccgcagaaggttgtggtgctcagggaagatactgtttcggcattggacttgacagcagttgagattttttttgttttaggggtcggttggaggctctggtgtgttgtgcagatagctcgtttagtctagatttcgtcaggcgcaccccttttgggctgctttgaatttagttcctttttttttttgggatcatttgatggcaaggcttccgcctgggtttcgttttcaccctactgatgttgagctgattatgtactatctcaaacgtaagatcacaggaaaaaaacttcattttgaaggcataacggaactcaacatctacaagttctccccatgggaccttccagacaaatgttgctataaaagtaaagatctagagtggtacttcttttgcccaagggagagaaagtatgcaagtggagccagaatgaatcgcgctactgatactggatactggaaaactactgggaaagatagacctgttacttactgtgagaagattgttggatcagttaaaacacttgtttttcacctaggtcatcccccgcgagggaaaagaactgattgggtaattcatgaatataagtttgaagataaagaatcaattgatgcaggatttgctcaggattcatatgtgctttgtaaagtattccagaagagtgggccaggtccaaaaaatggtgcacagtacggagcaccttttaaggaggaagattgggaagatgacaagattcctgctgagccttgtacttcagatgtttttccagctccacctggtaggactgataaacccagcggctcaaatgcaatcagaatggttgacccaagaagcacatctgactggacttcaagtgaacagagtccatctcctattcaaccttctgttcaaaaactgcctttggatgagccagatgacgaggagttacctggtgaaccaaatctgtccaatgtatcttctatcaattggaggccttcagatcagctaaaagcgaaaccgtctaatactttttctgctctgcctatactacctgaggagcagagttgttcagtagataccggcctggtcaaccctggtccaggtccatccaatgctcagatgtgtactaatgagatggctcttgatgatatagacgacgagatgattggtctatttgccccattcacggaagatacttcattgctttctggtggcagtgagcctaatcagaagctagataactttcaccaagaagtaaatgctccacctgctgcttgtactgatgggaatgatatatttgacggccttggagacatcgaattctgggcaggagtagggcagctggaacccgatctcactgcaagtggtggagctaatcatagtcttaaccctgtgatcctgccacaagaagcaccacaagacgctgcctatatggagctcaatgatcttgatatccctttaaatcaccctgctgaaaccattggaactggacaactggtgccgggctatttctgtacgccatataactccaacaatggcatgcagcagctttgttttggaagcaattccttgggcatagttcaagatttcggcgaacatcatctcccggcgcttcctgaaagttacactcaacaagtgaatcatcctgacatggcttacaattttctgaataacccaaatcagggttataatgctgcgactaatttcagtgttagctcttacaagcaaccagaggaccgtaggctcgatacccaaaacctggaaagaggtagatctcatttttctgatgacaattctgcttggtggtaaagcattcatgttagatctgattgtctacgcaaatgcgattgtggacagcaaaatgagatataggatataaatattgtgactggtcgtcagaccatgtaatcttatgtagccatgtggcctgtcttggctgttagagggtaggggaaaagattccttttctctgtattttctattttaggtgatttgatcttacaatgtagacgctgtgccgcatctatgatgaggttacataaacctctaatttatggtcagtggggctgcaggtactcgctgcagtctttgatggaaaaaaaaaaaaaaaa

SEQ ID NO: 10266 - DNA, 729 bp, Lycopersicon esculentum
  Predicted polypeptide sequence is orthologous to G521, G2887
tccgccttctccttcgtttgccatcttcggttttgtattgcacaccagatgtctgttagcatcaaccagaagcatcactattttgtttgggctgcgttgaatcgaagaagacattggtgctctgggaagatattgtttaggcattggacttgactcttgtgtgactttcttttgttagaatttgcttcactgagacctactagtgctgtggtcttttcattttatttgtctgtgcggttttttactatttccaatggcgaagcttccaccagggtttcgctttcaccctactgatgttgagctgataatgtactatctaaagcggaagatcatggtgaaaaagatcctttttgaagtcatatcagaactcaacatttataagttctccccatcagatcttccagacaaatgttgctacaaaagtaaagatcttgaatggtatttcttttgcccaagtgagagaaagtatgcaagtggattcaagatgaatcgcactactgatattggattctggaaaattactggcagggatagacgtgttctttatgatgaaaagtttgttggatctgttaagactttggtttttcaccaaggtaaagcaccacgagtgcagagaactgattgggttattcacgagtatagatttgaagtaaagatacggcagatgcaggattttcgctggacgcgtacgggctttgcaaagtatttaagaaaagcgggacaggtccc

SEQ ID NO: 10267 - DNA, 656 bp, Lycopersicon esculentum
  Predicted polypeptide sequence is orthologous to G525
gaacggttaggtaattaacgacctgattattttttaaaaaaaagatcataaaaaagggtgtgtaggttgtttttgatgatgatggagaatttttctgcaagtgttaagatggatgatcaacagcagatggaacttccgccgggatttcgctttcatcctacagatgaagagctaattactcattatttgtctaagaaagtggttgatatgaatttctctgctattgctattggagatgttgacatgaacaaaattgaaccttgggagcttccatggaaggcgaaaattggggaaaaagaatggtactttttttgtgtgagagacaagaagtatccaactggtttgaggacaaacagggcaactgctgcaggttactggaaagctacaggaaaagacaaggagatttttagaggaagatctcttgttgggatgaagaaaactttggttttttacagaggaagggctccaagaggtgaaaaaacaaattgggtaactcatgaatatagattagaaggaagattatcactaaacaatcttcctaaaacagtaaagaatgattgggtgatttgcagagtatttcaaaaaacaactggtggaaaaaaaattcacatttcagggcttgtgagagctaattctgatgaaaatgaaatggtcaa

SEQ ID NO: 10268 - DNA, 1042 bp, Lycopersicon esculentum
  Predicted polypeptide sequence is orthologous to G536
tagaatacagaaccatcaatggcgtctccacgtgaagagaacgtgtacatggcgaagcttgctgagcaagctgaacgctatgaggagatggtagaattcatggagaaggtcgtcgcggccttgaacggtgaggaacttaccgtcgaggaacgcaaccttctctccgtcgcatacaaaaacgtgatcggagctaggagagcatcgtggcgtataatttcatcgatcgagcagaaagaggagagtcgtggtaacgaagatcacgttgcctccattaagaaatacagatctcagatcgagaatgagctgacttcgatctgtaacggcatcctcaagttgcttgattccaaactcattgggtcagctgctaccggagactccaaggttttctatttgaaaatgaagggagattactaccggtacttggctgagttcaaaaccggaaccgagagaaaagaagctgcagagaatactctttcggcctacaagtctgctcaggatatcgctaatggcgaattggccccaacacatccaatccgattgggtctagctctcaatttctcagtgttttactatgagatattgaattctcctgatcgtgcttgtaatctcgccaaacaggcctttgatgaggcaattgcggagcttgacaccctgggagaggagtcctacaaggatagcactttgattatgcaacttctgcgtgataacctcactttgtggacctcggatatgcaggatgatggaactgatgagatcaaagaaccatcaaaagctgataatgagtagtaacatcgtgagtgaaacttctttgcttagaattgacaaccgatgatgtaattttactcattgatcaaaattggctgtttgtagtccttatcctgtgatttgtaatacctattacctaaaggcgctgtttcttgccatttgttgttttcatcaaagattaccttttgtctacgtatttctcttgtatttggatgctctgatgaagctctcttatttcgtggaaatgaatatttattttcacaaaaaaaaaaaaaaa

SEQ ID NO: 10269 - DNA, 1081 bp, Lycopersicon esculentum
  Predicted polypeptide sequence is orthologous to G536
ttgagaagaatcgatttctcattcgcctaaattttctctctacttcatccatggcggctctaatccctgaaaatctcagccgtgaacagtgtctttacttagcaaaactcgctgaacaagccgagcgctatgaagaaatggttcagttcatggacaaactggttctcaactccacgccggccggcgaactcactgttgaggaacggaatctcctctctgtcgcttacaaaaacgtgatcggatctcttcgtgctgcctggcgtattgtttcctctattgaacagaaggaggaatcgcggaagaacgaagaacatgtgcatcttgttaaggagtatagaggtaaagtcgagaatgaactttcgcaggtttgtgctggtatactcaagttgcttgagtcaaatcttgttccctctgctactaccagtgaatcgaaggtgttttaccttaagatgaaaggtgattattaccggtatcttgctgagtttaagattggtgatgagaggaagcaggctgctgaagacactatgaattcttataaggctgctcaggaaattgcactgacagatctgcctccaacacatcccataaggcttggtcttgcactcaacttctctgtcttttactttgagatacttaactcatctgacaaagcttgcagtatggcaaaacaggcatttgaggaagcgatagctgagctggacactttaggtgaagaatcatacaaggatagcaccctcataatgcaactcctacgagacaatctcacactttggacctcagatgctcagttggatgaatcttgattggcatggtctctatttaggaatgggctataaatgttgtttgctttgttgtgctgacttattgtataagaaaagacagcttcggttgacctatgttatgtttgataatttgacttgtggtggtttggtacttggaaatctagttgttagattatttatctcttatgtactgtgtattagaaaaaacttaaattaatgcttgtgtctttgagaatgatgtttcaaaaggtatcatcatgaaaatgggatacaaatcttttgtgaaaaaaaaaaaaaaa

SEQ ID NO: 10270 - DNA, 765 bp, Lycopersicon esculentum
  Predicted polypeptide sequence is orthologous to G536
gagtttcttcttcttcgttagagacatcaatcaccaggtaactttatagacaacaaaaatggccgattcacgtgaagaaaatgtgtacatggccaagctggctgaacaggctgagaggtatgaggaaatggttgagtttatggagaaggttgcaaaggtagatgttgaagagctgactgtggaagaaaggaatcttctttctgtggcttacaagaatgtcattggtgcaagaagggcttcgtggaggataatatcttcaattgagcagaaagaggagagccgtggaaatgaagaccatgttagcagcattaaagaatatagagccaaaattgaggctgagctcagcaagatatgtgatgggattttgagccttctcgaatcccatttagtaccatcagcctcaacagccgagtccaaagtgttttacttgaagatgaaaggtgattaccataggtacttggctgagtttaagacaggggcagagaggaaagaagctgcagagaacactttattagcctacaagtctgctcaggatattgcattggctgaactggctcctactcacccaatcaggctgggacttgcccttaacttttcggtgttctattatgaaattcttaactcacctgatcgtgcttgtaaccttgcaaaacaggcctttgatgatgccatcgcagagctggatacactggggtgaggatcttacaaggacagtacattgattatgcagcttctccgagacaatctcacactttggacttctga

SEQ ID NO: 10271 - DNA, 583 bp, Lycopersicon esculentum
  Predicted polypeptide sequence is orthologous to G536
ggggaaatgaggaacatgttaaatgtataaaggagtatagatctaagattgaatctgaactttcggatatttgtgatggaattctcaagctccttgattctaatctcattccttcagcttctaatggcgattctaaggtgttttaccttaaaatgaagggtgattatcatcgttatttggctgaatttaagaccggagctgaacgtaaggaagctgctgagagcacactctccgcctacaaagctgctcaggatattgcaaatactgaacttgccccaacacatccaatccgacttggactggctctcaacttctcagtgttttattatgagattttgaactctcctgaccgtgcttgcaatcttgctaaacaagcatttgatgaagcaattgccgagttggacacactgggagaagaatcttacaaggatagcactttgatcatgcaacttcttcgtgacaatctcactctctggacctctgatatgcaagatgatggtgccgatgaaattaaggaaaccaaaaacgacaatgaacaacagtgagggaactggtcctcaaattatcatttggcttctttctt

SEQ ID NO: 10272 - DNA, 761 bp, Lycopersicon esculentum
  Predicted polypeptide sequence is orthologous to G536
gaaaaaagggaaaaaaaaaagaaattctccggcggaaattaccggcgattgacgatggccttgcctgaaaatttaaccagagagcagtgtttgtacttggcgaagctagctgagcaagctgaacgatatgaggagatggtgaagttcatggacaagctcgtaatcgggtcgggttcatcggagttgacggtggaagagagaaatcttctttcggtggcgtataagaacgttatcggttcacttcgagcagcgtggaggattgtatcgtcaattgagcagaaggaggagggtaggaagaacgatgagcatgtggttctagtgaaggattacagatctaaagttgaatctgagcttagtgatgtttgtgctggaattctgaagattttggatcagtatttgattccttcagcttctgctggtgaatccaaggtgttttatttgaagatgaaaggggattattatcgttatttagctgaattcaaagttggaaatgaacgcaaggaagctgctgaggatactatgcttgcctacaaagctgctcaggacatcgctgttgcggagcttgccccaacacatccgatacgacttgggttggctctcaacttctcggtgttctactatgagattctgaatgcatcagaaaaagcatgcagcatggctaagcaggcatttgaggaagctattgctgaactggacactttggggtgagaatccctataggatagcacacttatcatgcagttggtaagggaccatctcac

SEQ ID NO: 10273 - DNA, 672 bp, Lycopersicon esculentum
  Predicted polypeptide sequence is orthologous to G536
aatattaaaagccacatttatttatcaccaaatatagtggaaattttaaccatacatctccaatttatttttgtggaggctagatacatatgatataacatcaattaattttgttcaaccaactttgggagtttgtacaacaatgtccaataaatttacaaaaagacgaactctattgcatctcaaatcttctgtaaaagctgaaccattcagtagagtttcaacatttgttaattttggattttccttttgaattatttgctttgcaaacttagctggtgttccaagaagttctggccaactttcctttgtcacacctggacaaaaagattgagacacatcatgtacttgcaatacatttaagccatcgctaacttcgatttccaaatcttgagcagtgagagattgaaagcatgatgatacaagaattatcaagaaagcaaccaacttcaccatagacttatttgcctccatataattcagctttgtttttaagaatctaaaggcaacatctggtgattccaaggttttttacctgaaaatgaaaggagattaccaccgctatttggctgagttcaagaccggtgctgaacgtaaggaagccgctgagagtactctcacagcctacaaagctgctcaggatatcgcatctgctgaacttgccccacacat

SEQ ID NO: 10274 - DNA, 1104 bp, Lycopersicon esculentum
  Predicted polypeptide sequence is orthologous to G536
tttcatcttgctttcttcttccgtcaagagaaccaggtgtaatttcacatacaacaaaaatggctgactcttcgcgtgaagaaaatgtgtatttggctaagctggctgagcaggctgagcgatacgaggaaatgattgagtttatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaatactattaaagaatacagaagcaaaattgaggctgaacttagcaagatttgtgatgggattttgagcctccttgagtccaatttaataccatcggcctcaacagctgagtccaaagttttttacttgaagatgaaaggtgactaccataggtacctggctgagtttaaaacagggacagagaggaaagaagcagctgagaacactttgttggcttacaagtctgctcaggatattgctttggctgaactggctcctactcacccaatcaggctgggacttgcccttaacttttccgttttctattatgaaattctcaactcacctgatcgtgcttgtaaccttgcgaaacaggcatttgatgaagccatctcagagttggatacactgggtgaggaatcttacaaggacagtacattgatcatgcaacttctccgagacaatctcactctttggacttctgacaatgcggatgatgttggggatgacatcaaggaagcttcaaaacctgagtcaggcgaggggcagcagtgatgagagagtagcatagtcctgtagtcttttcttataggggatgttggtggagaggatatagcaagatcgtgaatttagatctccgatggttgtgtcactgttgaaacggttcaatataaaacatgtcttagtgttggtaagaatgtctggttgagtcgattgcgtagtgctatgatcattagagttgaattggttgcattacttgcttgtgttgataacttttctcgtaattttttgtctcatttgcatgtttgtgtgattg

SEQ ID NO: 10275 - DNA, 1258 bp, Lycopersicon esculentum
  Predicted polypeptide sequence is orthologous to G536
agggagagaatagagcaaaatctctctctgttttcactacaaaaaatctttgatttcaatttgagagagatcggaaatggcttcttccaaagaacgtgagaacttcgtctacgtcgctaagctcgctgagcaagccgaacgctacgatgaaatggttgaagcgatgaaaaatgtcgcaaacatggatgttgaattgactgtggaggaaaggaatcttctttctgttggttataagaatgtggtaggttctaggagagcatcttggaggatcttgtcctctattgagcagaaggaagaatctagaggaaacgagcaaaatgtcaagcgaatcaaggagtacctgcaaaaggtggagtcggagctcaccaacatttgcaatgatattatggtggtcattgatcagcatctaattccgtcatgctctgcaggcgaatcaactgtgttttaccacaagatgaagggagactattatcgttatcttgcagaatttaaagctggcaatgacaagaaggaggttgctgagctttcattgaaagcatatcaggcagctacaactgctgcggaggcggaattagcacccactcatcccattcgtctgggactggctttaaatttctctgttttctactatgagatcatgaattcacctgaaagggcatgccatcttgcaaaacaggccttcgatgaagcaatatctgagctggatagcctgaatgaggattcctacaaagacagcaccttgattatgcaacttctaagggacaacctcaccttgtggacttctgatcttccagaggatgctgaagatgcccaaaagggagatgccacaaacaaagctggtggaggtgaagatgcagagtgaatgggcctaatagttagaactactatgtgtatttggaggtgtgacgacaaggatacgccaagggggatgttagtttgttaagtcttagtagatacttctattatgggtctgtcgtgtcagattcttcacttgttaattggttgtctgcaactcagtgtgtaatttgtatccctgtgctatttccgttctccgtatagtgagttgtttcagtctttagataattgctggtctataggtggttttatttttcagatgactgccgcagccaaatggaggatatcagctatttgcttgtcctctcacccttattatctcaatatcactaaatttccattattttctcttttttcatttagtttggagctgagcatatatgctactctatgttggtgcaaa

SEQ ID NO: 10276 - DNA, 1112 bp, Lycopersicon esculentum
  Predicted polypeptide sequence is orthologous to G536
tggatgggttccttgcttggaattcgagacggtacacaaatccgtgctcaaacaaaagaagaaagaagataaaaatctccatttttttttttcaactcaaagagaagatcggaaaatggcttcatccaaagaacgtgaaagcttggtatacatcgccaggcttgctgagcaagctgaacgctacgatgagatggttgatgcaatgaagaatgttgcgaatctggatgttgaactgacagtggaggagaggaatttgttatctgttggttataagaatgtggttggatctaggagagcgtcatggaggatcttgtcttccatcgagcagaaggaagatgctagaggaaatgagcagaatgtgaagcggatccaggggtaccgccaaaaagtagagtcagagctcaccgacatttgcaataatatcatgactgtgattgatgagcatctgattccgtcatgtactgctggtgaatcaactgtgttttactacaaaatgaaaggagattattatcgatatcttgcagagttcaaaacaggtgatgacaagaaagaagtttctgatctgtctttaaaagcatatcagacggctacaactactgcagaagctgaattaccaattacccatcccatccggttgggtttggctttaaatttctctgttttctactatgagataatgaactctcctgaaagggcttgccaattggctaagcaggtttttgatgaagcaatatctgagctggatagcctcaatgaggacaactacaaagatggtaccttaattctgcagcttcttagggacaatctcaccttgtggacgtctgacattccagaggatggagaagaggctccaaagggagatgctgcaaacaaagtgggtgcaggcgaggatgcggagtgatgatccaaacgagtagaatgtaccatgcgtatttgattaaagaggccggtgaaacatctggtggattgtttgtcaagtgctaatagataattgtaaggcacaccaacaaatgaatagatacttgtttattggatccgtcttgctgaagattgttttcacattaattgatgaatgcatatcatttgatttgcatccccattgttcttttctc

SEQ ID NO: 10277 - DNA, 989 bp, Lycopersicon esculentum
  Predicted polypeptide sequence is orthologous to G536
agagagagagaggagagaaatggagaaggaaagagaaaaacaggtttacttggctaggctggctgagcaagctgagagatatgatgaaatggttgaagcaatgaaggcgattgctaagatggatgtcgaactgactgttgaagagaggaatttggtgtcggttgggtataagaatgtaatcggagcaagaagggcttcatggcggatcttgtcttcgattgaacagaaggaggagagtaagggtcatgagcagaatgttaagagaataaagacttacagacagagagttgaagacgagcttacaaaaatatgcagcgacattttgtcagtgatcgatgagcacctcgttccttcgtccactactggagaatctactgtcttctactacaagatgaagggagattactatcgctatttagcagagttcaaagcaggggatgatcgtaaagaggcgtctgaacagtctcttaaagcttatgaggctgctactgccactgctagttcagatcttgctccgactcatccaatcagacttggactcgcattgaatttctcagttttctactatgagattctgaattcacccgagagggcatgccacttggctaagcaggcatttgatgaagctattgccgaacttgatagcctcagtgaagaatcctacaaggacagcacccttatcatgcagcttctaagggataatctcactttgtggacatcagatcttgaagagggaggtgagcattctaagggtgatgagcgccagggagagaactagttgaagttcaagaggtgtcggtgaatcattgtgatgctggctcctcaagagacatgttagcttgtggaaagtctttgttttcatataatgttcagggattcatgcctattggctttgtactttcttcctccatatacataaacattcccagagtacttctcattttcagtaaaaaaaaaaattgctgctaaaaaaaaaaaaaaaaaaaaaa

SEQ ID NO: 10278 - DNA, 1026 bp, Lycopersicon esculentum
  Predicted polypeptide sequence is orthologous to G536
ctctcacttcctctctctagaaaaacaaaaacctctctccctctttctctctctaacatcaatggcgtcgccacgcgaggaaaacgtgtacatggcgaagcttgccgagcaagctgagcgttacgaggagatggtagagttcatggaaaaagttgtcgctgccgccgatggtgcagaggagttaaccgttgaagaacgaaatctcctctccgttgcgtataagaatgtgatcggagcacggagagcttcatggaggatcatttcctccattgagcagaaagaggagagccgtggtaacgaagatcatgttgcttctattaaggaatacagatctaagatcgagtctgaacttacctcgatctgtaatggaattcttaagctgcttgattctaagctcattggctctgctgctaccggtgactctaaggtgttttacttgaaaatgaagggagattatcatcgttacttggctgagtttaagaccggtgctgagcgaaaagaagctgctgagaatactctctccgcttacaaagctgctcaggatattgcaaatgctgagcttgctcctacacatccaatccgattgggacttgctctcaatttctctgtgttttactacgagattttgaattctcctgatcgtgcctgtaatctcgccaaacaggcctttgatgaggcaattgccgagttggacacattgggcgaagagtcctacaaggatagcactctgatcatgcagcttcttcgtgataacctcactttatggacctctgatatgcaggatgatggaactgatgagatcaaagaagctacacctaaaccagatgataatgaatgagcagcagtaaaaactggtgaaatttctttaggattgaaatatgctatgttgtaacttctttttcatttgtctggattcaactctttttcatttgtctggattcaactctttgttagttctagatcttgtgatttgtaatacctaaaatcaaccgtttcttgttaattgttaaaaaaaaaaaaaaaaaa

SEQ ID NO: 10279 - DNA, 858 bp, Lycopersicon esculentum
  Predicted polypeptide sequence is orthologous to G536
gaattcatggagaaggtctccaactcccttggctcggaagaactaaccgtggaggagagaaaccttctctccgtcgcgtataagaatgtgatcggagcgcgtagggcatcatggcgtatcatttcatcggtcgagcaaaaggaagagtctagaggaaatgaggaacatgttaactctatccgcgagtacagatctaagattgagaatgagctctctaagatctgtgatggcattctcaaattgcttgattctaagcttattccttcagcaacatctggtgattccaaggttttttacctgaaaatgaaaggagattaccaccgctatttggctgagttcaagaccggtgctgaacgtaaggaggccgctgagagtactctcacaggctacaaagctgctcaggatatcgcatctgctgaacttgccccaacacatcccatccgacttggactggctctcaacttctctgtgttttattatgagatcttgaactctcctgaccgcgcttgcaatcttgccaaacaggcctttgatgaagcaattgctgagttggatacattgggagaggagtcttacaaggatagcactttgatcatgcaacttcttcgtgacaatctcactctctggacctccgatatgcaggatgatggtgctgatgaaatcaaggaagatcccaaacctgaagagaaaaattgaggggaattgaaaccctctaatttgcttttcacttctcccctagttgtttttattgggagaagctgattatcataatttccttgctagtattatgattttccattaagaggttctcttcttattggcaacaaacaacttttatattgatgttttaaaagttcc

SEQ ID NO: 10280 - DNA, 1252 bp, Lycopersicon esculentum
  Predicted polypeptide sequence is orthologous to G549
caacatggacccagatgctttctcggcgagtttgttcaagtgggacccaagaggtgcaatgccaccaccaagccggttattagaaccggtggcgccaccacaacctcctccatctctaccaccaccaccacctcctcagccgctcccaacatcatcctactccatacggagtacgagggagctcggaggactagaggagttatttcaagcgtacggcatacgctactacaccgccgctaagatagcggagttagggttcactgtgaacacgttattggacatgaaagatgaagaacttgatgatatgatgaatagcctctcgcagatatttcggtgggacctactcgtcggagagaggtacggtatcaaagcggcgattagagctgaatggcggaggctggaggaggaggaagcacggcgccgcggacacattttgtccgacggtggaacgaatgtccttgacgctctatcacaagaaggattatcggaggaaccagtgcagcagcagcacgagagagaagcggcaggaagtggtggtggaggtacatgggaagtggctgccggtggtggtggtaggatgaaacaaaggaggaggaagaaggcggggagggagagaagaggggaagaggatgaggaaacggaggaattaggagaagaagatgaagaaaatatgaaccaaggaggtggaggtggaggaataagcgagagacaaagggagcatccgtttatcgtgacggagcctggtgaagtagcacgtggcaaaaagaacggcttggattatctgttccatctctacgaacaatgccgtgatttcttgatccaagttcagactattgctaaggaacgaggtgaaaaatgccctacgaaggtgacgaatcaggtgttcaggtacgcgaagaaggcaggggcaagctacataaacaagcccaaaatgagacattatgtgcattgctatgcacttcactgccttgatgaggatgcttccaatgctctgagaagagctttcaaggagcggggagagaatgttggggcatggagacaggcgtgttacaagccattggtggctatagcggctcgacaaggctgggatatcgatgcaatcttcaatgcacatcctcgactagccatttggtatgtccccaccaagctccgacagctgtgccattctgaaagaagcaacgcagctgcagctgcttctagctccgtctctggtggtgttgctgatcacctgccacatttctaattgtgcttc

SEQ ID NO: 10281 - DNA, 723 bp, Lycopersicon esculentum
  Predicted polypeptide sequence is orthologous to G550
atcggccgaattgagaacgccaacagggctttgcttctaaaaccgtatctctcgtagaaaaaaaaatccacttttgaaacgtcgtcaactcgccggcggcgacttcgtcggatactaaacgagaatccccagaataatagagtgtttctacagtttcccttttcgtttttttgaatacccttttcgttttagtctggaaaatgacttgtgattcaaagatcaagctgtttggcaagatactcccggtggtcgtctccggcgttggtaggggtttgtctggtagtgatggtgttatatatgatggaaatagaaatgggtctgatcttgatcgatgtttagagggaagtaaagcaagcagtgtagagaaggatgaaggaagtgagtatgaaaagcaagaagctgaaaaggataatataactggagagctcagtgaagctaaatctgaggagggagaccaaaatcagatgatagaagaatcagaaaatcctaagactccatcagaatcagagagcagtcctaaatcttcaactgaggaagaccctcaagcagtaaaatcatccaagactgagaatgaaccgactaatgtgacaaattccgagcagaacaatctgaagaagccagacaaaatcctcccatgccctcgttgcaatagtttggatacaaaattctgttactataataacaacaatgtcaaccagcctcgtcatttctgcaggagctgcc

SEQ ID NO: 10282 - DNA, 800 bp, Lycopersicon esculentum
  Predicted polypeptide sequence is orthologous to G550
gaaaaggttaaaggcgtatacatacagtttgtataatatgacagaccccgcaattaaactcttcggcaggacaattcagttgccggatattccggattcttctggagctcagggagatgattctttgccgggagacaataacggagaagaagacgaagaagctgataaggatgactttggaggaaacctggatgatgacgaggaagagatggaaattttgactggcaaggagttgcaggatcagaattcagaaccaactaaaactgatagtataaaggagctgcctgttgataacgactgttcaacaagaccttcaaaaagtgaagaagagcaaggagaagcaagtaattcgcaagagaaaatcctcaaaaagccagacaagataattccatgtcctcggtgcaacagcatggaaaccaaattttgttatttcaacaattacaatgtgaaccagcctagacacttctgcaagagttgccagagatattggacagctggtgggaccatgaggaatgtgcctgtaggtgctggtcgtcggaaaaacaagaactctattccacattaccgtcaaatatctgtctctgaaacactttcgaatgcacaaacagattatccaaatggaatacaacagcctattcttgcatttggctcccctacacctctctgtgaatcaatggcttcagttttgaatattgctgacaaaacaatgcataattgctcacaaaatgggttccacaaaccacagggagcccggggttccagttagttacgtagttggaaataatggagatgaccattcc

SEQ ID NO: 10283 - DNA, 919 bp, Lycopersicon esculentum
  Predicted polypeptide sequence is orthologous to G557
aattccgtacttttcccttaatttagtgtttttttcaagtgtagagaaaaatgcaagagcaagcgacgagttctattgccgctagttcactaccttcaagtagtgagagatcatctagttcagctttacatcatgaactcaaagaaggtatggagagtgatgatgagatcagaagagtgccggagatgggcggagaagcgacggggacaacgtcagcttctggaagagatggagtatcggccgccggtcaagctcaaccatcagctgggactcaaaggaagagaggaagaagcccagctgacaaagaaaacaaaaggttaaaaagattgttgagaaatagagtatcagcacaacaagcaagggagaggaagaaagcatatttgatagatctggaagcaagggtgaaggaattggaaacaaagaatgcagaacttgaagagaggttgtctactttgcaaaatgagaaccaaatgcttagacatatactgaagaacacaacagcaggtgcacaggaagggaggaagtagacatatgatcgatcttatgtcgatatgtcagcattcttgtttagatcctatgtaggcactgaagagaaattctcttctggatttgagaatgcatgctagtttcgggtggattgttctgatttgatgcattgcatacttgctactcttaaccgttgtcggttatatattatcagcagagagtgaaggattgtggctaagctattcttaaagtcaccagcctttggtaagttgcatggactaatcttggatgatatatgctacaattacctataacctttgctagcgttccctagtgagttgaaatctttattaaaaaccaaatcgatgtactgataagactcggtgtaaaagaatttgtgcaattgaaaaccaattaggtacattcaaaaaaa

SEQ ID NO: 10284 - DNA, 1642 bp, Lycopersicon esculentum
  Predicted polypeptide sequence is orthologous to G558, G578, G629, G1198, G1806
atgttatttgtgtgaacattttgtcatatcataatacatgggcaacaataacagttgacagcaagcagtcaacttctttgagtacttagttgtatttcttttgtcattttgcttctctgcctttatccttctttatagctatggagattatttttttaactctctttactcttttagtttaaaggtttctttaaatacctaagaaggtcagtaattgcttctaatttgcaaggagagtatcttcactgtactgatgaacaggcagaaattctgatttacaggccatgaacatgacttctccaacaactcaatttgcccccacaagaaggatgggcatatatgaaccatttcaccagatgagcgtgtgggaagacgcgtttagaggtgacattatgcctagtgctgatgcatgtatggtttcacacccaaacgataggccagatgacaagtcggggtatacatccggtgaacaacatatgccctctggctctggagataatcaagggccgaggagttcttcagacaaggtacaacgacgtttagcgcaaaatcgtgaagctgctcgtaaaagccgtatgcggaaaaaggcctatgtacagcagctggaaaccagccgtttgaagctggcacaactcgaattggagctcgagagagctagacagcagggattatacatgttaggttcaaatagcaatatgggactattaggaacaattaatccaggaatagctgcattcgagatagaatacagtcactgggtggaagagcaacaaaaaaagaacgcagaattgcggagtatattgcagtctcctgtaagcgatatggagcttcagttgctagtagaaaatgtcttaagccactatttcaatctctttcgcatgaaagctgatgccgccaaagctgacgtgttttacttaatgtctggggtgtggagaacttccgtcgagcgctttttcctctggattggaggattcaagccatcagaactcataaatgtggtgatgccacaactcgagcccttggccgatcagcaaatcattaaagtgtgtaatctgcgacactgttgccagcaagctgaagatgctctcacacagggaatggataaacttcagcagactctggctcagagcatcctaaatacgaacacgggagctggaaattacacttcccaaatggtttcttctatggaaaatttagaagcattggagagctttgttaaccaggcagatcaccttcgacagcaaacactacaacaaatgtctattattttgacaacacaccaagcagctaggggcttgcttgcttttggggagtatgttcaacgtcttcgtgctctgagttcactctgggcagcgcgtcctcgtgaacctacctaaatgatctgttcatcagacaactgggatagatgagcttaactagattatgtttgaatgctcgagctgtaaatgggaatgtacgttatcatagttttgcttgcttaggcggatttagctatttactagtatttgaaatacatatttgaaatttgtgtaaatatatttggatgttgtatataggctataaagcaatgaaataattttgttggatgtttttgaagatttatgtgaggctagaaaacttataactaaaaaaaaaaaaaaaa

SEQ ID NO: 10285 - DNA, 719 bp, Lycopersicon esculentum
  Predicted polypeptide sequence is orthologous to G558, G578, G629, G1198, G1806
ttgaagtcacaagctataatttgattaagcataaaactttctaaaaatatctattacacttcttaaaaatccctaaactttttccttgtaaaactaaaaacacaggtacattattggttcctaagtcacaaagtaaaattttggcattctataaacctaaggagaaagaaaacaaattctgcacttccacaagcacatacaataccactttatacataagagtaactttgctggatctcatataccggccagtgtatcgaagtagtatatctgagtttcagtagaatatcgcaatgcatgtcatacttattgctctcgtggtctggcaagccaaagagagctgagagctcgaagacgtgagaagtattcacttattgcaagaagagcacgggctgattgtctggttgtcaatatgcgatgcatttgttgcaatgtctgttgacgcaggttgtccgcctgacggagaaaaccttcaagagtccctaatttccccatagccattgccatctgacccatataattagctacatctcctgatgacccttcagtagcaggagatccgttagctaatgtctctgccaaggattgctgcaacgcctccataccttgtgaaagggcatcttctgcttgatgggatgactgctgcaagttgtaaatgccagctaactgttgctcggtcagaggctccaactgattgactagaagcttaagaaagtccg

SEQ ID NO: 10286 - DNA, 741 bp, Lycopersicon esculentum
  Predicted polypeptide sequence is orthologous to G558, G578, G629, G1198, G1806
gattttagcaactttcacctgcttctcatctgggtacttccggcactgcttgatttattgatttggtgattctaaacttcagttgatttctcactgattcactgaaaagctgagggacacagaagggctaaagaaattgaagggggaaaaaaccccaacagaaaattacaagatttgatgattctattgtcttattttagctttctggcaaagcttgagccttttgctatagacccttttcgtttcttgaactaagatactacatctgatttgtgttccaatttcaattgattatccacaaagttggctatagtccacgatggctgatatcagtcctagtacatcaacagatgccgatactgaagataagaacaggttcctaaatcaacaacttgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggaacagggaatatttatttcaggttcaggagatcaatcgcagtcgatgagtggaaatggagccttggcatttgatgtagaatatgcccgatggttggaagagcagaaccgacgaattaatgaattaaggggagctgttaattctatggcttggtgatgctgaacttcgca

SEQ ID NO: 10287 - DNA, 684 bp, Lycopersicon esculentum
  Predicted polypeptide sequence is orthologous to G558, G578, G629, G1198, G1806
gatggatgcaatgggtgatagcgaaggccataggattgtgagctctactgcgttgtggaggggtgaccgccggccagcccaaattgtccaggtatcgcagttggagcaggacattgaacgagcacctcaacagggagaaagtgggcccgtagcatttgatacagattatattcgatggttagaagaacacgacaaacacatcaatgagttaaggaacgctgtcaaatcacatgcacgtgatcctgaactgcgaagaattgcggataatgtcactgcacattacgatgaggtctttaggatgaaaggaaatgcagccaaggcggacgtagtccatgtcttgtcaggcatgtggaaaacccctgctgagcgttgttgtatgtggattggtggtttccgcccctcgttactgcttaagcttctagtcaatcagttagatcctctgagtgagcaacaagtagctgactttaacaacttgcagctgtcatcccatcatgctgaagttgctctctcacaaggtatggaggcgctgcagctatcattgggggagacattagccatgggatctccatttactgaatcagggaatgtagctactacttatatgtgtcaaatggcaatggctatggggaaattaatgactcttgaagattttctccgtcaggcggacagcctgcgtcaactagt

SEQ ID NO: 10288 - DNA, 713 bp, Lycopersicon esculentum
  Predicted polypeptide sequence is orthologous to G558, G578, G629, G1198, G1806
cctttcttctttgtataatttcataattcagttttaattattttgaaaaactccaatttgtagaagagtttctttgtacttatgaacagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaagtcgggatatacttctagtgaccaacttataccatctggctctgaggataatcaagcaggaaagagtatttcagacaaggtaccaacggcgtctagcacagaatcgtgaagctgcacgtaaaagccgtatgaggaaaaaggcttatgttcagcagcttgaaaaaagcaatttgaagctagcacaacttgaaatggaacttgagagagctcgacagcagggacctatacattttaggttcaaatgggtaatatggggctaagttcaacaattaatccaggaatagctgcatttgaaatggaatatagtctctgggttgaagagcaaccaaaaaagacggtagagttgaggaacatattgcaatcccatgtaagcgaatggagcttcagttgctggtagaaacccgtctaaaccactactacatctattccgaatcaaagctgatgctgcgaaagctga

SEQ ID NO: 10289 - DNA, 1363 bp, Lycopersicon esculentum
  Predicted polypeptide sequence is orthologous to G558, G578, G629, G1198, G1806
gaattccgggcttttagagttttgaagtgggaaaaaaaaggtttcttgaagacttagctgttgttggctttaagtcggaaggcaatgaattcttcaacatatactcaatttgttgcttctaaaaggatgggtatatgtgatccaatccatcagattggcatgtggggagatttcaaaggtagcagtttcccagatagcttgattcttgaagtcgagaattgcctcgagaatgagatgcctattatggagaaaagactagagaatgagatagaggaaccatcacaagtgacagttggaacgtctaacagatatgaacctgaaacaactaaacgtattgataaggtgcgtagacgccttgcacaaaaccgcgaggctgctcgtaaaagtcgtttacggaagaaggcctatgtccagcagttggaaaatagtaaactgaagctgcttcagctggaacaagaactagaacgtaatagacaacagggtttgtatgtaggtgatggtttagatgctagtcagataggttgctctggaaccgcaaattcaggaatagcttcttttgaaatggagtacggccattgggtggaagagcaagatagacaaacagatgatttaaggaatgctctgaactcccaaatgggtgaaatagaattgcgcattcttgtcgaggattgcttgaatcactattttgatctctttcgcttgaaagctacagccgcaaatgccgatgttctctaccttatgtctggcacatggaagacatcagctgagcgcttcttcttgtggattggggggtttcgcccctccgaacttctaaaggttctcacgccacatgtggaaccattgtcagatcaacaaatccaggaggttagcaacctcacccagtcttgtcagcaggcagaagatgcgttgtcccaaggaatggtaaaactccatcagattcttgctgaggctgttgcagctggtacactaggagaaggagttatccttccacagatgactgctaccattgagaagttggaagctctagttagatttgtaaatcaggcagatcatctccgccaagaaacccttctacagatgtcctgcatactggctccgcaccaatcagctcagggtctccttgccttaggagattactttaaacgtcttcgtgctcttagctcactttgggctggacgtctttctgaacctgcttaaagaggtaagaaagaacctgtgggttttcaactttgccaatcaaagctgtgtgagctaagtaacaagtatgagttggcgctcatttgaaatgtgtatataagttctggtatgctgtaattgaaacattttcttttgttatcacattggttttgatgattgtaaatca

SEQ ID NO: 10290 - DNA, 2119 bp, Lycopersicon esculentum
  Predicted polypeptide sequence is orthologous to G559
ggtcctccctgtccgaatttatagtgtttccattctcacacagatttgcctctttgtttatcgtctctcttctccacaagcttttcccttttctctctcgcatgtgataaagctgcttccttctgcttctgcttcccttttcacatttttcccttctctgcacatctaatttcaaagctaatcgaaaccgtagggaattgatctgggataagcttgtttggtgtttgcggaatctacagggtctcagcaaggggtttcatgttctgaggaaaagcaacttggattgtgattttatggttttcctgctataatgttcttgctttgaccggggaaaagtatcattacttgttgatttttggttttctgttggtacggttcttgttggagtatatatatatgtgtgggatgttgggtttgttcctgtgctgttaacatttggaatttgaagggttggggttttttctgtttggatttggagggtttgtatggataaggataagtcttcttcaagccatataggaggttcgttgcctccatcagggagatactcattattttcacctcccggtagtagctccaatgtaaagtcagaacaacctggattagcaaatttacctcccttaggacctggaaatgcttcagaatcaggtcattttggtcatggtttgtcggcagattcaagcctgtttagtcttgatataagccgaatgtctgatagcccaccaagaaaatttggtcataggcgtgcccactcagaaattcttactcttcctgatgatattagctttgatagtgatcttggcgttgttggactagatggaccgtctctgtcagatgagactgaggaggacatcttgtcaatgtaccttgacatggataagttcaattcttcaactctgtcttctgaattccaagtgggtgagtcttcttcagctgctccaggttcatcacaaacaacagcaatggcttcaggaacaaataaatttgctcctactgttagtgagaagccaagagttagacatcagcatagccagtccatggatggttcaactacaatcaagccagagatgctcatgtcaggagtggaagagccttcttcagctgaaactaagaaagccacgtcagctgctaagcttgctgaacttgctcttattgatcctaaacgtgccaagcggatttgggccaacaggcagtcagctgcaagatcaaaggaaaggaaaatgagatatatagcagagcttgagagaaaagttcagactctgcaaacggaagcaactactttatctactcagttgaccctattgcagagagatacaaacggcctgaatgctgaaaacagtgaacttaaactgcgtttacaaacaatggaacaacaggttcacttgcaagatgcgttgaatgatgctttaaaggaggagatacagcatctgaaagtgctaactgggcaaggcatagcaaatggtggacctatgatgaacttcccagcaacctttggaggcaatcagcagttctactctaacaaccaggcaatgcatacattgttggctgcacaacaacttcaacagctccagctacattctcataagcaacaacaccagtttcagcaacatcagctacaccagtttcagcagcaacagttgcagcaccaacaacagcaacagcaacctcttatgcagcagcagcagcagcaggatcaactttcacaagccggagatgtgatgtcaagaggttctctgtcatctcctcaaaatgaaaacgcttctgatgttagttctgtagcaaaggattgaacagctgatggccagagagacaggagatggtgtatgttttaaaaatcatcatgtgttttcccatctagcagctcatttttgtgtttcaaaatcatcacgtgttgaaacaacatctagctcaggttctcttgctttcagttagctccttcatctgcattttagtacttttgtagggtcatttgacttttagttgaaattgttcaaatcccattctatgcatatgtcattttgtcaactatcaacatgattttcttcatgttaccaatattgttggtggtagtttttttggacatcaatcacttatatctcttttgaaaaaaaaaaaaaaa

SEQ ID NO: 10291 - DNA, 1853 bp, Lycopersicon esculentum
  Predicted polypeptide sequence is orthologous to G561, G562
ctttttttgaagttccttttagagagagaaaacatacacagagaatgcacaaacactgaaacttttcactactaaaatttgcctctctctttctgctactctcttctacagttttttgaagggttgcttttctgaagctagttgggacaacactcttatcagtgactataaaaggaaattctgattgcacctctaatttagtacgacatcgacttggttcctattacatgggaaatagtgaggatgggaaatcctgtaagcttgagaagccatcctcgcctgcagcggaccagagcaatcgccatgtctatccagattgggcagccatgcaggcatattatggtcctcgagtagctgttcctgcatatttcaattcagcagttgcacctggtcatacccctcacccttatatgtgggggccacagcctatggtaccaccttatggtaccccttatgcagcaatatatgctcatggtggggtttatgcacatcctggagttccaattggatctcatcctccaggtcatgtgatggcgacatctcctgttgtcagccaagccatggatggtgcttctttgagtttagatgcgtctgcgaagtcctcgggaaattctgatagaggattgatgtctaaactgaaggaatttgaggggctggcaatgtcacttggaaatggcagcactgacaatgttgagggtggaacagacaatggacattctcaaagtggggaaactgaaggttcaactgatggaagtgacacaaacggagctggggtcagtgagagaactaagaaaaggagctgtgagacaactcctgataactctggtgatgataagagccactcacaaagatttcaacctactggggaagtaaatgatgatgctgagaaggcaatcgttgttgcagcgaaaatgacgggaacagtactttctccttgcatgacaactttggaaatgagaaatcctgctagtgcacatatgaaatctagcccaactaatggtggttcaccactcagccctgcactgcctaatgaaacctggttacagaatgagcgtgagctgaagcgggagaaaaggaaacagtctaatcgggaatctgcaaggcgatcaagattgagaaaacaggctgaagctgaagaattggcaatacgagttcaggctttaacaggagagaacttgacactcagatccgagattaacaaattaatggagaactcggagaaactgaagctagacaatgccactttaatggagagactgaaaaatgaacagcttggacagacagaagaagtaagtttaggtaagattgatgataagagactgcaacctgtaggcacagtaaacctgctagcacgagtgaacaactcaggttcctcggatacaacgaacgaggatggtgaagtttatgagaacaacagctctggagcaaagcttcatcaactacttgataccagccccagaactgatgcagtagcagctgggtgatcccctaaatttaatttgagatgttaaaacttagtctgattgtgtaattttggcgtaattttaagtccaaaattgctactaactacgggagaggaacaggtgaataggattacgagatttctaattttacctacctaattgtagtttacaggtcagtagaaccgatgtgtgctcttttttctgttttgcatttctgagttgaatgaatgtggctataatagcgtatgtaaagtttaatgttcgacatactaaagacttgatttgaggaaatactatagaaccgaaatgttttcggtttggacgatgaaagtgaacttcatatttgataaataaatgtggtatgtttatgatgttaaaaaaaaaaaaaaa

SEQ ID NO: 10292 - DNA, 750 bp, Lycopersicon esculentum
  Predicted polypeptide sequence is orthologous to G565
gctactccattacttaaatccaccgctaaaacctcctcttcctacattggggctctactgtctgaatctcccgcagatatcgcctcaaaatgcaagatccgtccaatccaaactccaagcagctcaatcagacgccaccattttccgctacattcaggccatcgcaccaccgcagagctcactccgaggtgaacttccggctgcctgaggatctagatctggtatctgacccattcgatgcgtctgccggaagttttgaggagatcggatccgaggatgatttcttctccacttacatggacattgaaaaactaggctctggatccaaccctacagatgttccagggttcaacaatgccggcgctggaagtagtggactggtagctgactgtggtgatggagaaaggaatttcaccaggcctcgacacaggcatagcaattcagtggatagttccagcttgttattaagtgagagtattgaagctaagaaagctatggctcctgataagcttgctgaactttggaccattgatccaaaacgcgccaaaaggattttggcaaatcggcagtctgcttctcgttcgaaagagagaaaggcccgttacattactgaacttgagagaaagggtcagacccttcaacagaagcaccactctttctgctcaataacccttttcagcgggatacaaccccagttactaatgaaaatacagagctcaagctccgtttgcaagctatggcacaacaagc

SEQ ID NO: 10293 - DNA, 525 bp, Lycopersicon esculentum
  Predicted polypeptide sequence is orthologous to G571
gcaaaatcgttgggtggtttccctcagtccaatttatttttggttgaataccttcttcttcttccgtttcttaatcaataacaacaccaatctcggtttatctgtctttatttttattatataaactactcattcatcatgtaaacgagctctcacaagcttgatttacacctcaaaagaagagaaaaaaagacgaatggattcttctaaccatcaaatttctttcatcaatcaacaccagttttttcacgatcctcgtcaacaacaacaaatggaaaatcataagaatcatcagatctcttttggattatcgtcagctaatcctgggaacttcataaacaaagagaataatggtggagcttatgatttaggtgaactagatcaagcactatttctatatcttgatggacaagatccttcctcttcatcaattcaagatcatagacagaataattatggaatgaggccaccaactctcaacatttttccatcacaaccaatgcatattgagccatcttcaacaaa

SEQ ID NO: 10294 - DNA, 549 bp, Lycopersicon esculentum
  Predicted polypeptide sequence is orthologous to G583
ggcctgcttccactcccaatcgtccgactccggtgaacggagtcggagaaacgatgccgtttttcaatcaagaatcactacagcaaaggcttcaggctttaattgacggtgctcgtgaatcatgggcatatgctattttctggcaatcgtcagttgttgattttgcgagccaaactgtattgggttggggagatgggtattataaaggagaagaagataagaataaacggagagggtcgtctagttcagcagctaattttgttgctgagcaagagcatagaaagaaggtgcttcgggagctgaattcattaatatccggtgtacaagcttccgccggaaacggaactgatgatgcagtggatgaggaagtgacggatactgaatggttttttctgatttcaatgacccaatcgtttgttaacggtaacgggcttccgggcttggcgatgtacagttcaagcccaatttgggttactggaacagagaaattagctgcttctcaatgtgaacgggccaggcaagcccaaggtttcgggcttcagacgattg

SEQ ID NO: 10295 - DNA, 736 bp, Lycopersicon esculentum
  Predicted polypeptide sequence is orthologous to G583
gcagtagctcctcctccggtagacgttaaccaggtgcctttaggcctacaacagatgcttcaatatgttgtcaaaagccaaccagaatggtgggcttatgctattttctggcagacctctaatgacgacgagggaaaaaactttttagcttggggagacggatatttccaaggagatggtgtagttattaacaacaaaggcggcggcggtagcagcagcagcttaaagtcacaggctcagtccgagagaaaaaaagttattaaaggaattcaagctttaatggatggtaatggagatactgatctagtggatgatggtgatgtaactgacactgagtggttctacgtgatgtcgctggcccgttctttctctgccggagatggatctgttaccggtaaagcttttggaagtgatgattttttgtggataacaggtccggaccaatttcagcttcattacagctgtgaaagggctaaagaagctcagatccatgggattcagactctggttagtattccaacttcaaatgcgcgtgtttgaattaggctccactcaattaatcaaacagaatttgagcttagttcaacaggtgaagtctctgttcctctgttgtccccctattcaatttgtagaaaaacaattagttttgccgatattggccttgtcaccggcttgcaacaagatgacgatgactataaattaagagaaacagcagaaaccgcaccctgttgtagcc

SEQ ID NO: 10296 - DNA, 740 bp, Lycopersicon esculentum
  Predicted polypeptide sequence is orthologous to G583
gctgtgtttatggaatgactgaatacagcttgcccaccatgaatttgtggaacaatagtactagcgatgataacgtttctatgatggaagcttttatgtcttctgatctttctttttgggctactaataattctacttctgctgctgtggttggtgtcaattcaaatcttcctcatgctagtagtaatactccctctgtttttgcaccatcttcttctacatctgcatctactttatccgcagctgcgactgtggatgcttccaaatctatgccgtttttcaaccaagaaacccttcagcagcgtcttcaagctcttattgatggtgctagagagacgtggacttatgctatcttttggcaatcgtcggttgttgatttctcaagtccgtctgtgttgggttggggagatggttattacaaaggggaagaagataaagcaaaaaggaaattatcggtgtcatcacctgcttatattgctgagcaggagcatcggaagaaggttctacgggagctgaattcgttgatttccggggcaccacccggaacggatgatgcggttgatgaagaagttaccgacaccgaatggttctttcttatctccatgacccaatcgtttgttaatggaagtgggcttcctggtcaggcgttgtatagttccagcccgatttgggtcgccggaactgagaaattggcagcttcacactgtgaacgtgtgaggcaagcacaagggttcgggctt

SEQ ID NO: 10297 - DNA, 205 bp, Lycopersicon esculentum
  Predicted polypeptide sequence is orthologous to G584
tttttttttttttttttttttaagcaaatcaatcaattccttaatgtacaagaacagttgttgagtggatcaaaattgttgcagaatacttggaagcaaagttggaaagcatgtatcaatgatgaaatgtgagtctttgttgaagaaaatttggggatatttgtagggtggggggccagggcaggggagggtgctgaaccagtgg

SEQ ID NO: 10298 - DNA, 1325 bp, Lycopersicon esculentum
  Predicted polypeptide sequence is orthologous to G584, G1136
agtggaaatggtcagagttgttacaatcagcaacaacagaagaatcctcctcagcaacaaacacaaggattcttcacgagggagttgaatttttcggaattcggtttcgatggaagtagtaataggaatggaaattcatcggtttcttgcaagcctgaatcaggagaaatcttgaattttggtgatagtactaaaaaaagtgcttccagtgccaatgtgaacttgtttacaggtcagtcccaattttggggcctgggggaggagaataataacaagaaccaagaaaagatcagctacttcaggggaagcaatgaagaaggaatgctttcatttgtttcaggtacagtttgcttcttcgggcatgaagtcaggtggaggcggaggcaagactctgaacattcagatctcgaggcttcagtggtgaaagaagctgatagtagtagagtggtagagcctgaaaagaggccaaggaagcgaggtagaaagccagcgaatggacgggaggagccattgaatcacgtcgaggcagagaggcaaaggagggagaaattgaaccaaagattcttctctcttagagctgttgtaccaaatgtgtctaagatggacaaggcatcactccttggagatgctatttcctatataaacgagttgaaatcgaagcttcaaaatacagagtcagataaagaagacttgaagagccaaatagaagatttaaagaaagaatcaaggcgccccggtcctcctccaccaccaaatcaagatctcaagatgtctagccacactggaggcaagattgtagacgtggatatagacgttaagatcatcggatgggatgcaatgattcgtatacaatgtaataaaaagaatcatccagcgaaggctaatggcagcgctcatggaattagacctagacgtgcatcatgccagtgtttcagttgtcaacgatttgatgatccaacaagccacagtgaaaatgggtagcagacattacactgaagagcagcttagggtagcgttgacatcgaaaattgctgaaacacactaaaccccttagaaaatagatagaaatcgtcgagggccatgtttaaattaaaatctctggtttctgctagctctaagtaatgtttttgtaatgaagtttgagatattaagacggaagactatcttcgtgttattttttcaacttgtacctcggtggttgttgaaaatattcttgtacataaatgttaagcccgattaactcaacttaatcgggctttagttcatgtaattaaagataaatttgcctccgaaacaaaaaaaaaaaaaaaaaaaaaaaaaaaaaa

SEQ ID NO: 10299 - DNA, 673 bp, Lycopersicon esculentum
  Predicted polypeptide sequence is orthologous to G585
gaaaccgtgttatttcagagagaaggcgaagagaaaagataaatgagagatttatgcatcttgcatcgatgctgccaactagtagcaaggttgacaaaatatcactactcgatgagacaatagaatacatgaaagagcttgaaaggagagttcaggagctggaggcgagatcagcaagacgatcaaatgatactgcagagcagacatctgataattgtggcactagcaaattcaatgacatcaggggatcactaccgaacaaaaggaaggcatgtgatatggatgaaatagaacctgaaagctccaatggattactgaaatgtagttcagctgatagtattgtcatcaatatgatcgataaggaagtctcgatcaagatgagttgtctttggagcgagagcttgttgcttaaaattatggaggcactgactgacctacatatggattgccatacagttcagtcttccaaccttgatgggattctatccattgctatcgaatccaagtcaaccggatcgaaaacactagcagtcggaacaattagagaagcacttcagagagtagtatggaaatcttgaagattagtcagtcaaggttggtcaattaagcccatatgaaaaagaacttggtcagtcctgtccttagtggatagttaaagcttgggtatagtatt

SEQ ID NO: 10300 - DNA, 626 bp, Lycopersicon esculentum
  Predicted polypeptide sequence is orthologous to G585
cctttctagaggttgattactccgttattttgaagaagcctaattatgtctccaacgatgcaaaaaatgacacgaatatcggtagccaaaagcctgatcataatgcacttgaaaatgatgcttatccagttgaaataaattcacctcatgatagttcaaatggttttgtcgccaatcaagaggcagaagattcactgatggtggtagacggtattggggaaacttcacaagctcaaagctggaggttcatggatgataatatcagtaatggtgcgaataattccttgaattccagtgactgcatctctcaaaacaatgcaaattgtgaaaagttgtcccctctttcgagtggagagaaggaaactaagccttgcccactagaccgtcaagagaacgatcagaagaaaccgcatcttttagatcaccaaggagatgatgctcaatatcaagctgtcctttctactcttttaaagagttctgaccaattaactttgggaccacattttagaaatatgaataaaaagtcaagttttgctagttggaaaaccgatattcagatgccgagatttggaactgcacaaaaactattgaagaaggtacttcttgaagttcctagaatgcatgct

SEQ ID NO: 10301 - DNA, 705 bp, Lycopersicon esculentum
  Predicted polypeptide sequence is orthologous to G590
caaaattaacttgatctgctcaacactgaacttgattttgctggactataatggccaacaacaatgtttattatcacaatgctaatttttctttgactgatcctgatcctgaaccagatgatatttctgtgtttcttcgtcatattctacttccttcttcgtcttcgtcttcatcttcatctaattttatggccctgaagagtaatgaaatgcaatattcctcatcattacctcatcttatgcctaataataatcaacagggtaatttgtcatccatgatgaattcatcagcttgcggcattttctcgtcttcctatggggtttgtaatggtgcaactactgtttcttcctcatctgttgggaccatagattacgatccggatgagtatgaatgtgaaagtgaggatggtacagaggatttgggggcggaagcttcagttcaaccgccatctcgtaacacttccaagagaagcagagcagctgaagtgcacaatttgtctgaaaagaggagaagaagcaggattaatgagaagatgaaagcattgcaaaaacttattccaaattcaaataagactgacaaggcttcaatgcttgatgaagccattgagtatcttaagcagcttcagctccaagtacagatgttgacaatgagaaacgggttaaacatgtatcctcttggcctgccacgaatgctacaacaaaatc

SEQ ID NO: 10302 - DNA, 761 bp, Lycopersicon esculentum
  Predicted polypeptide sequence is orthologous to G590
gattttatgctgccgagttcaaggaaggcgttgagaatgtgtttgcttctgctggcctcggggaatgtgacggtatgaattcagctaataggagagagtttttggaagatgataaggttgataacttcggttttagtagcgaggaatgtgatggacttgacatgccatctgatccgactcatccacgttcttcaaagaggagtagatctgctgaagttcataatttgtccgagaagaggaggaggagtaggatcaatgagaaactgaaagcattgcagaacctaattccgaattctaacaaaactgacaaggcatctatgcttgatgaagccattgaatatctgaagcaacttcaactgcaagttcagatgcttaccttgaggaatggattgagtttatacccaggatatgttcccgggtctttgcagtcggtgcaacttccatctggtaatgaatttgatgggagaagttttatgctgagtgcaaatggaggagctacacttcctgtgaatcgagaaatgccacaaactgcatttgaaatttccaatcagaatccgtcaggcaaaccaacaataacctcacataacacagaaaacgctgtagctttagaaactacaattcagaatcattatggacttcttaaccatttagcatcttctaaggacatgtgccgagacaatacactatcaagattgcatttagatatgagttgctctggaaacaattcatcatcaggagtgtcgtcttaaccaaatttcaca

SEQ ID NO: 10303 - DNA, 1652 bp, Lycopersicon esculentum
  Predicted polypeptide sequence is orthologous to G591, G793
ctcattttccgttcctcttaaagctcaataaacctatacgccggcaaactccggcatggcggacaacccaccggaggtatatgctgccgatgattttctcgagcaaattctggcgattccctcttatgctagcctgccggtaactgatttaaccgccggtgcctcatcggagaattcaacatctggtgtctctcagctccagcagcagccgttgttcccattggggttaagtttggataatggctttgctgacgccaacaacactggaggttttcaagtgaagactgaaagagaagcaatgaacatggggaatttgtatccaggtctagaacatttgcaatctcatgctgtttgcctaagtgttcctcaagttcaccaagtccagccttttcaaggccaccctacatcaagcgcaatagtaacaataccacaccaacctgcaattcgtcctagggttcgggcacaaagaggacaggccactgatccacatagtattgctgagcggttaaggagagaaaggatatcagaacgaataaaggctttacaggaacttgtccccagctgcaataagaccgacagggcagcaatgcttgatgagattctggactatgtgaagttcttaaggcttcaagttaaggtactgagcatgagtaggttgggaggaactagcgcggcggcacaagttgttgctgatattccattgcagtctgttgagggagacacctgtgaaagtcattccaaccagcacgtctgggagaagtggtctgattctgaaacagagcaagaggtagcaaagctcatggaggaagatgttggaacagccatgcagtaccttcaatccaaatcactctgcatcatgcctatttcacttgctgcacttatctatccgactcagcaaagtgacaaccaatcaatggtcaagccagaacaagcggccccattgtagacttctaaattactgcaggtgcaatcaagaactcctaatttcttttaggcccatccgtctatatatccttacctattttctcttgaatcaccctctgaaatccttggtaatgcaatcaaactcagatgacacaatttttgcttttagctcaatcattggcccctttatcaactttcttgagttcagtcacaccttgaacaatggcaacacttaagaaagcaaccaatccatctatctatatcattgtagggaggagtgtatatttttttttccaaactctctgttattagctgcttgtttccccctcactcttgtgggttggttgtgactccttgtatcttttttatagtggatagctagcgatgtattataaaagaaaattgtcccagcttgcatttggtggactgtgcggggagaaagaaaccaagtttgtttgaagacaaagccattagtatacagaaactaaagatggaatgtttagggcttttctttttttggtgtaaccatagcttaatggatgatttagaatcaacttatgatgtactagattccttgtgagaagattaaggattaggagcttcttcatttctttatttctgttcttttgctcatctggatgtatatatgggggattacacaccctttgtgtagtttgttattaatacacaaaaatgttacctgttccaaaaaaaaaaaaaaaaaaaaa

SEQ ID NO: 10304 - DNA, 773 bp, Lycopersicon esculentum
  Predicted polypeptide sequence is orthologous to G591, G793
ttcagttcctcaaaacccttaacttcttctcgccgggaaaaaaattaatttcgccggataaatctccggcatggcagcaaaccaaccggaaggctatgccgacgatttcctcgagcaaattctcgctattcctccctactctggcttgccggttgctgatgttggcactccatcagagacgacgtcgtttacctcggcgtctgccgtatctcatcttaactctgccgctgctgctggcctacagcaacctttgtttccgctgggattaagcttggataacggccgtgatgacgtcggcgatgcaggtccttatgcagtgaagcatgaaagagatggaatgaatatcggaaatctatatgcaggtctagaacacttgcaatctcatgcagttcgtcactctgtgccttctgttcaccatgtccagccttttcaaggcccaccaacaacgagcacaacagtaactgtgccacacccaccttcaattcgtcctagggttcgagctcggaggggacaagccacagatccacatagcattgctgagaggctgagaagagagaggatatcagaaagaataaaggctttgcaggaactggtacccagctgcaataagacagatagggccgcaatgcttgatgagattctggactatgtgaagttcttaaggcttcaagttaaggtactgagcatgagtaggctgggaggagccagtgcagtggcacaacttgttgctgacatccattacaatctgtgggagggggacagtggtgaaagta

SEQ ID NO: 10305 - DNA, 621 bp, Lycopersicon esculentum
  Predicted polypeptide sequence is orthologous to G591, G793
gaagaattagagcattgcaagagttggttcccagtgtcaataagactgatagagctgtaatgcttgatgaaattgtagattatatcaaattcctacggctgcaagtgaaggtgttgagcatgagtaggttaggaggagctggtgcagtagcaccacttgttacagacattccaatatcatcagtagaggaagagagcagtgaaggtggaaataataaccaaccagcttgggaaaagtggtcaagtgatggcacagaaaggcaagtggctaaactcatggaagaaaatgttggtgctgcaatgcaatttcttcagtctaaagcactatgtataatgcctatttctcttgcatcagcaatttatcactctcagccaccagatacatcaagtcttgttaagccagaaacaaatcctccttcatagatgaacacccttatagaaaaaggtgacataacatgctaatgaccttaaagaattttcttgcagtggatggttcctacttttatctattcaagtaatatttagcttttttgttgaaaaaacagggttcttttttaaaaatatttatgtataaagtaaaccattttctatcatttatatattttgagtagtttttgttctt

SEQ ID NO: 10306 - DNA, 504 bp, Lycopersicon esculentum
  Predicted polypeptide sequence is orthologous to G594, G1496
ttacagttgtttgcaaacatgttacaaatgagtgttcttgaaagacaaagagcagtgttggaacgtatttataatcattctaagcagcagctttcttctctagtacctcaacaagaacttgctcatttgattaccggctgcgttcaggggaattttaacatgtttggcgggggagattctaattttgttaattttcaagaaatggctcgtccctctttctccacaatatcgaattcatcgattacaacagtgtctccgccaccagagaaagaaagtgacttaagtagtatgatagctccaagggaaaatgttgtttctaccaagaagagaaaagcagagtttattgaggaagaggattgtgagaaaagcccggggaatgattcaaaggagaattcgaagacgtctgaggttcaaaaacctgattacattcatgtaagggcacgtcgtggccaagctactgatagccatagtttagcagaaagagctagaagggagaaaatcagt

SEQ ID NO: 10307 - DNA, 724 bp, Lycopersicon esculentum
  misc_feature (622)..(622): n is a, c, g, or t
  misc_feature (633)..(633): n is a, c, g, or t
  Predicted polypeptide sequence is orthologous to G597
attctagatcacagaattgcaataaaatacactctaaagttggaagatggctaatatgagtaagtgattactagatagaacaaaaaaagccaaaccatgtcctatgactgatgaaatacaagaaattaaatcaacaagacagaaaatgcagaacaactacgcatcagcaaatcgacgtttctcaccagttcttgaacttgaggtaagaagtgtctgtgaaccttatttctgcacaactacgattacaccgattaaaattacaacaatcctcacttggagtcttcttcagtgaactagtcgatgacacggagttcaattggtcagaaaagagagcgttaataactcatttccaaggcatgcttgagattccttgcaggttatcgttggtgcatactggacccctctgatttatggggctgcctggtccaccagatgattcactataagtgcctcgtgatggtgggctattggcccctgtcaaaccaccaccaacaccaagattggcattcaacggagcaggtaaaacctcaaaatggtttgatgtttttggctctttccgaccatctgcaatgaagctacctacgataacctggactggtgatgcggctgttagaacacccgncacacaaccgnctaaaatccgtccatcagatccagctaatgatacacttaatccacctgttctgctttgttgaccaccaatgtcagacagcataaatgaacc

SEQ ID NO: 10308 - DNA, 808 bp, Lycopersicon esculentum
  Predicted polypeptide sequence is orthologous to G597
cagaacttggtatcatcagatgctgctccgaccccctactaccctatcatgccgtcgatgccatctccacctccggcggcggagatttatcaagttcccacccctggctttaccgttcctcttcccgatctatcaggggtagcactccctaattcaattgaaccggttaagaggaagcggggaaggcctaggaagtatgctccagatggttctgccaactccgggatggtctctcctccatcggcggcgcagtctgccggtggattttcgcctacggagggaggagatgtaccgttgcggaaaaagggtaggggcagacctcctggttctgggaggaaacaacaattgggtgatttaggatctgcaagtgctgggactggattcaaaccacatattatcacagtacaagcaggggaggatgtatgggcaaaactaatgtcattctctcaaagtacctctcaagctgtctgcatcatgtcagctaatggctccatatctaatgtgacacttcagcaagcagcactgtctgttggaaatgtagcatatgagggtcagtttgagatcctgtctctgtctggtcactttctaccatcagaatctggtggcgagcgcatcaggacaggtggtttgggtgtgttactagctggagcagatggccaggcactaggtggtggtgtggcaggagttcttactgctgcatcggctgtacaggttattgtaggcacttttggtatgcaagggcaaaagcagttgaaattggataattctgatggttttggcgtgccatccctggtgcatccccctggat

SEQ ID NO: 10309 - DNA, 314 bp, Lycopersicon esculentum
  Predicted polypeptide sequence is orthologous to G600, G2768
agcgcgcattctcccaccaaagattccatctccttcacaatctgcagcttcaaggggtgagccgttgccaccaccaccacctcctccacctgttaaggaggaaaattctaaagcccaggagattgcagaagagggtaagaatggcagtgcttctcagcaaatgttggaaagaggaagaactttgaaggttgcagatgtttctgaagctacacacgagtccgtcagtgttaaagaacctgtatccccggggagtgctccattggctgatgaagaggttcagcaaaagcctgtagttgtggaggcaggaaaaaaaa

SEQ ID NO: 10310 - DNA, 744 bp, Lycopersicon esculentum
  Predicted polypeptide sequence is orthologous to G605, G1944
ggagcagtttgcaaagcattaatatctgctgaaaaaaatggagtcaagggaagctatagctccagaagctccatcaaactatcatatggtatctagaacagaatctactcctataccacctggtacattggcggtgattccccctccggtggctaccgcctttccaattagctcagagaagaagaaaaggggacgtcctaggaagtatgggcctgatggagcagttgcaaggacaatttcacctacgcctatttcagcagacttcttgtcgaagaaagtgagtgttgcccgtcctgaatcggagaaaaaggctcgaaacaaagtgggagctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcagggggaactctaacttatgagggtcgatttgaaatcctttctttgtctggatcctttactccaacagagtttggggggttctcgtactactagcagaaccggaggaatgagcatttctttgggcagtccggatggaccgtgtgtcgggagaacacttgcaggactgctaatagctgctagtcctgtccaggttgtagtggggaagttttctaccaagcaactac

SEQ ID NO: 10311 - DNA, 774 bp, Lycopersicon esculentum
  Predicted polypeptide sequence is orthologous to G611
gggacactataaaggaaactgtgaagcatgcatcctactccaaaaatttaccagaatggaaacccctagagaaagaactatatttaaaggggatagagatatttgggagaaatagttgcctaattgctagaaacttacttcctggcttgaaaacttgtatggaggtatcctcttacatggataacagagcagcggcgcaacgtggaggctcctcaagcttattttcggaggataatgggaaagctgacatggattacatggagctagatattccgacgaaatcacgttttcttcgtagaagaggcagaacacgcaaactgaaatattcctcaaagtcttctgggcatccctcaatctggagaagaatggccgatggaaagaatcaatcatgtatacaatataatccatgtggatgccagccgatgtgtggaaagcattgtccttgtttgcagaatggtacttgctgtgaaaagtattgtggctgctcaaaaagctgtaaaaatcgtttccgtggatgtcactgtgcaaaaagtcaatgcagaagcagacaatgtccatgttttgctgctggacgtgaatgtgatcctgatgtctgccgcaattgttgggttagctgtggtgatggctcattgggtgagccttctagcaaggagaaggtcaatgtggtaacatgaggctcctcctaaggcagcacaaggattctgctgtcaaatctgagttgctggatggggagccttcctgaagaaacctgttacaaaatgattacctgggaga

SEQ ID NO: 10312 - DNA, 2873 bp, Lycopersicon esculentum
  Predicted polypeptide sequence is orthologous to G618, G2057
gaattcggcacgagcaaaaaacagtatcttttatcatatatttgatttgctctctgcaaactctattttgaataattaaataactagaattgttagatgaaagggaatgatgggttaggggtatttgttttgatttaaagttatggaatttgggaagttgaatggcagagagtttgagatttcagtgtaaacgatcaaaaactggaaagagaaattgcaaacaagggtttgagtctggatcctcagaggaatcagcagcaacattatcatctcaatcaaaatcaaaaccaaaatcaagattcagttggcaaagaagaagaagaaaatcaacaacaatcagaaaacgaacctcagctttatcttcatcctcacaaccagcaacaacagccatttttcaatcaacatcacttgatttatggaaggttagattcacagcaattgcttccaccacagccaacaccgaagaaacgttcgtatttgccttcgacgtcttcattggggcaaaacgtcgaacatgcagcagcattgcgtgggaaaatggcagaaacgtcaagattgggtataaggaatactgtaggagagattgtagaagtacaaggaggtcacattgtgaggtctacggggcggaaagaccgccacagcaaggtttgcacagccaaaggccccagagatcgccgtgtgcgtctctctgctcatactgctattcagttttacgatgtgcaagaccgccttggttatgatagacctagtaaagctgtggattggcttatcaaaaaggcaaaacccgccattgatgagctagctgagttacctgcctggaaacctacaattggtactgcatctgctgctgctgctactaacaccaatcttgaacaggaacaggctcaaaaacagcaagaagataacaactttgcatttcaacaaggaaatgttagtttgtttgataatgttgctggcccttcaagtaaaagagcaatcgaaagtaatactgctagctttctgcctccatctttagaatctgatgctattgctgatactatcaaatcttttttcccaatgggttcttcaacctcagctaactcttcagctatgcagttccatagcttccaagaaccccatatgttatcaagagccaatagccagaaccaagatttgagtctctctttacagtttcaagatcctattttgcttcaccatcaaaaccagcaagctcaacaccataaccaaactaaccataagggaacaaagagcaagtgcagggtcaagcaccagcccactttggaggaaacaccccacttggttttgacacctctggctggtctatgcatcagagacttcgttcttggagtgacagtagagaaattggccctggtggtagtggtggagcagtaacaggacctggtgggtacttgttcaattcgccaccagcaccggccgtgctgcagcagctattcggtcaaaatcagtttttttctcagaggggaccccttcagtccagtaacacatcttcggttcgcgcatggatggatccgtcagcgatagcaattgcctcaggtgatccaagtaatcaccatcaagctgcattatcaatgtatccatcaacaattcctggctatggatttgcctctgaagtaggcggattctctgggtttcgtattcctgctcgaatccaaggtgaagaagaggagcacgatggcatttccgataagccatcctctgcttcctctgattctcgccattgaattagctccaaaaagtttgatctttctcaatccctgacagggaaatgctctacttgaatgcaattagaacttacagaagtaatgctgtcaaaagagcctggagatggagaatgagagacagaaccaagatttgagtctctctttacagtttcaagatcctattttgcttcaccatcaaaaccagcaagctcaacaccataaccaaactaaccataagggaacaaagagcaagtgcagggtcaagcaccagcccactttggaggaaacaccccacttggttttgacacctctggctggtctatgcatcagagacttcgttcttggagtgacagtagagaaattggccctggtggtagtggtggagcagtaacaggacctggtgggtacttgttcaattcgccaccagcaccggccgtgctgcagcagctattcggtcaaaatcagtttttttctcagaggggaccccttcagtccagtaacacatcttcggttcgcgcatggatggatccgtcagcgatagcaattgcctcaggtgatccaagtaatcaccatcaagctgcattatcaatgtatccatcaacaattcctggctatggatttgcctctgaagtaggcggattctctgggtttcgtattcctgctcgaatccaaggtgaagaagaggagcacgatggcatttccgataagccatcctctgcttcctctgattctcgccattgaattagctccaaaaagtttgatctttctcaatccctgacagggaaatgctctacttgaatgcaattagaacttacagaagtaatgctgtcaaaagagcctggagatggagaatgagagagttcaaaatagagtctgattcaatggcatacaccgagtcgaaaagaatcctgatccttgtttcaggttcttcgatccggtctaatataattagttattcaccgttcttgattttccagttcttgtgtaattgagcttttctagctcaacaagctacattaggagtgttatgtgtttggccagacttgtcatattgctgctgtttgctttatttcatgattttggagactttcaacctagaattggtaatgttttgttagttatttttaagtcttgaaaaaaaaaaaaaaaaaa

SEQ ID NO: 10313 - DNA, 717 bp, Lycopersicon esculentum
  Predicted polypeptide sequence is orthologous to G629
tgccactgagttaactcgccattcttctcttctttagacaagcctgataaggaaagctgattcttaacaatgtgttgggcatcaaaggttttcttttgttctccttcaaaatgcacataggtaaggtacttattcatagtacaattatttggcatatattgtagttacacacgtgcttgtgtacttgttctactaaaatgttgttatgactttgtaagctaggttaaatatcacagaacatggtgcatctttcatttggagcatgaacttgtgtttcactcttggtcaagttatgtgtaaaaggtattctgacattcatgtcagctagtttgcaggtttttacagataatagagcagaggcaatgaaactgccgtaacaatgtctggtactcttttctaaaagtagtatgccatgctctcaagtataactagaagtgcttgtagactgtgcctcaacaaaatgtgaaatctctgtcgtgtgtgaaatcatttcagctacctagtgttctttagttgaggcttcatgcttgcttcagttagaaggtggttcaccttgaggtgtatccttgtcaattacataattatgtattttacccattggtttttctctatcgggagattgtttttaaggaaagaacacgatttgttgtacaatttacgcaagctatatttgcagaacatggtcagtcatttatgatgacgtgcttaattattctc

SEQ ID NO: 10314 - DNA, 592 bp, Lycopersicon esculentum
  Predicted polypeptide sequence is orthologous to G636
gatggccgaaagaagaaatcgaagcatggataagtctccgaacctgtttagatctaaaataccaagaaaatggaccgaaaggaccactgtgggaagaaatttcatctggaatgagaaagataggatacaacaggaatgcaaagagatgcaaggaaaaatgggagaacatcaacaagtacttcaagaaggtaaaagaaagcaacaaaaaaagaccagaagattccaaaacttgcccatatttccaccagctggaagcactgtacaaagaaaaagccaagctcgaacctgtaccacacaacactaccttcggattaacaccccaaaacaatcctcctcctcctcctcctcccatcatggctcaacccgagcaacaatggccaattcctcaaaatcaacttcaccagcaaaatcgtgatcatcatcacgataatgaaagcgacagcatggatcacgatttggaagaggacgaggatgaggacgaacaagatgaaggtaatggctatgaaataataatcacaaataaacaacaatcatcatcaatggcggctaccccagtaacaacaacaacttctgctgctgcagtttaaagcac

SEQ ID NO: 10315 - DNA, 513 bp, Lycopersicon esculentum
  Predicted polypeptide sequence is orthologous to G636
gagtaggaaagtttaagctcacaactgatatagtttcaacaaattacagaattgaattcaacggaaaccgccatggtttccttacaaaacattcatgtggaactacaggttttcatagtccacactgatcccctattatatcttgttacaatgtgatcaaagcagcttattgtgaggtctgcaaacaacagaacaaaccccaccaaattcatcatcacaagcaacaacttcccctgatgctggtgtttcgtgttatcgtcccacagcttacaacaccaaaactcggtgaacgtaaactcttgacaaatgagatatagcaaacaaacctaatcctagcaataattcatgaaattgaacaagcccctagttcatttctcactcactagaacctagcaacaaatttctcatctaacacaaacaagaacattaaaacacatttatacgatatattaacaacaataacgataacaataacaataacaataatcatatcttcaacgtccgtcgtcgtct

SEQ ID NO: 10316 - DNA, 725 bp, Lycopersicon esculentum
  Predicted polypeptide sequence is orthologous to G636
aacattgacaaacaagagattgatagtgctggtgagaattcaaactcgtttcaaacgaattcatcttctcgatggcctaaagccgaagtggaagccttaatcaagctaagaacaaacgtcgacttgcaataccaagacaacggctcatcaaaagggcctctttgggaagacatctcatgtggtatgaagaagcttggatacgatagaaacgcgaagagatgtaaagagaaatgggagaacataaacaagtactatagaagagttaaagaaagccaaaagaaaaggccagaagattcaaaaacatgtccatattttcatcaattggattccatctatcaaaacaagtccaagaaacaattgcccattatggaaactccgggttcgaatatgaaggccggagagatactaatgcaaataatcaaccaacaacagcaacaacaagcattagaaagaacagaatgttgaacaaaagtttgttcaagaacaaagtaatgcaaataatagattgatggacaagaaggtttttctattttactttgtggttagtgtaccatttttgacaagtgggacaaaatcaattatgtgctttggaaatgtgggattattgtgtgaggggaggaactttttcattcacaaagttagttttactataaatgcacacacaaagaaagtggcatattttctttttttctagttaggtatatttaatcatttggttgttagta

SEQ ID NO: 10317 - DNA, 361 bp, Lycopersicon esculentum
  Predicted polypeptide sequence is orthologous to G636
tttttttttttttttttttcttgatctaatcactccattgtttccatcaaacttctttgtagatcttcttggtggttcgccagtttcttcactaatgacttgaaaaatcttccccattcatctttccctctcttccttttatgaaatttacccatagtattatccattttgttaaccatggcttcattgagagccaattcaggaaaagtgacattgtggttggttggcaaattatcagcagattcagatgcaattccacgaatacaaatagcttctaactctccgaatactactctacgtttattagtttcttctaaactatacaattcctcatcttcttcttgtttgtttttctcaattg

SEQ ID NO: 10318 - DNA, 782 bp, Lycopersicon esculentum
  Predicted polypeptide sequence is orthologous to G652, G1335
ggcgattggcggccaatcggccgaattgacggtgactttcccaagataacacaatcaaagggttttagggtttctttttctttgtgagcgaaaaaaatggctgatgagggttgtgagaggctcaagggaactgtcaagtggtttagtgaccagaaggggtttgggttcatcacccccgccgatggctctgaagatctgtttgtacaccagtctggtatcagatctgaaggattcaaaagcctagctgaaggtgaggatgttgagtatcagattgagtctggctcaaatggtagggctaaggcttccgatgttactggacctaatgaagcggctgttaaaggaggttcccgcagcggtggaggacgtgatggaggtggttacggcggaggcggtggttacggtggaggcggaggttacggtggtggccgaggaggaaatcgtggttatggaggtggtgacagtggctacggaggaggtagccaaggtggtggcggctacggaggcggtggaggctatggaggaggtggcggaggcggcggaggctgcttcaaatgtggggaatctgggcatttcgctagagaatgtccacaggatggtggcagtggcggaggcggtggaggtagatattctggtggtggaggtggtaggtactccggtggcggcggcggcggcggcggaggctgctacaaatgcggcgaagaaggtcatttcgcccgcgagtgcaccagcggcggccattgatcgttatctctatgtttgtttttgctgtttttatgtttccg

SEQ ID NO: 10319 - DNA, 848 bp, Lycopersicon esculentum
  Predicted polypeptide sequence is orthologous to G653
tttttctcccattcatcattctctctttggctcattctcccaaaaaaaaacattctcttcatccgccattaacgctcgccgcatcacaagcttcgctccatcaacagcaccattttttttgatcttccaatagtcaaagaggttggaggatcaaatctaggagttgaaatcatgtcgtttacagggactcaacaaaaatgtaaggcttgtgaaaaaactgtttacccagttgagcttttgtcagctgatgggattagttatcacaaatcttgtttcaagtgtactcattgtaaaggaactctcaagttgagcagttactcctcaatggaaggtgttctgtattgcaagcctcattttgagcagctctacaaggagtctggcaacttcaataaaaactttcaatcccctgtgaagtcagctgaaaagttaactccaatgctgacaaaatctccaagcaaagctgccggcatgttttctgggacacaggaaaaatgtgccacctgtggtaaaacggcttatccacttgagaaggtgacagtggagaaccaaagttatcacaagtcgtgtttcaagtgttctcatggtgggtgctctttaaatccttcgaattatgctgccctagatgggatattgtactgcaaacctcatttttcacagcttttcaaggagaaaggcagctacaatcatttaatcaagtctgcttcaatgaagcgtccagcagcaactgttccagattcttaaactatatctccatcaactattttatccagggagcttgtcttttaatatttgtttcctcccttcttttccgtatatctccaattggggtgccatttttgtttactgtg

SEQ ID NO: 10320 - DNA, 564 bp, Lycopersicon esculentum
  Predicted polypeptide sequence is orthologous to G653
ttacgagcagccgcctttgtaaagctatacgcagaagtcccatcacatcatcctctttgcgagcaaaaactcccatctccaggtatacctcaaaacttatcctatttttgtttccttttttctggttgtaatttcaaccttttcttccttctatgctactgtaatttgatcatgaattatctaggcattggaacaaaaatgatttgctaatattactctgataaaattatattctttttcttagaaatagggcaaaagttcacaatgttttgccaagttctttctatcggaagtgtgtcagtttttatggaatattttttatattcgcactgaagcccagttatatatggactcatacataataaggctccattggtacggaagtactctaccaaagatttgaaccaagacccctgtttacaaggaaagcaatcccgtccacaacatcgcatcttgcttataagtttttgccgtgagtatatgtaaatatatgtgtataggcattttttcttttacaaaatacatagtaatattttagtacaaggattgtagtttattactaaa

SEQ ID NO: 10321 - DNA, 825 bp, Lycopersicon esculentum
  Predicted polypeptide sequence is orthologous to G663
atgaacagtacatctatgtcttcattgggagtgagaaaaggttcatggactgatgaagaagattttcttctaagaaaatgtattgataagtatggtgaaggaaaatggcatcttgttcccataagagctggtctgaatagatgtcggaaaagttgtagattgaggtggctgaattatctaaggccacatatcaagagaggtgactttgaacaagatgaagtggatctcattttgaggcttcataagctcttaggcaacagatggtcacttattgctggtagacttcccggaaggacagctaacgatgtgaaaaactattggaacactaatcttctaaggaagttaaatactactaaaattgttcctcgcgaaaagattaacaataagtgtggagaaattagtactaagattgaaattataaaacctcaacgacgcaagtatttctcaagcacaatgaagaatgttacaaacaataatgtaattttggacgaggaggaacattgcaaggaaataataagtgagaaacaaactccagatgcatcgatggacaacgtagatccatggtggataaatttactggaaaattgcaatgacgatattgaagaagatgaagaggttgtaattaattatgaaaaaacactaacaagtttgttacatgaagaaatatcaccaccattaaatattggtgaaggtaactccatgcaacaaggacaaataagtcatgaaaattggggtgaattttctcttaatttaccacccatgcaacaaggagtacaaaatgatgatttttctgctgaaattgacttatggaatctacttgattaa

SEQ ID NO: 10322 - DNA, 490 bp, Lycopersicon esculentum
  Predicted polypeptide sequence is orthologous to G663
taatgaatactcctatgtgtgcatcgttgggagttaggaaaggttcatggactgaacaagaagattctcttttaagagattgcattcaaaaatatggtgaaggaaagtggcatcttgttcctgctagagctggtttaaatcgatgtcgaaagagttgcagactaaggtggctaaactatctaaggccacatatcaagagaggtgactttgctccagatgaagtggatctcatcttgagacttcacaaactcttaggcaataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatga

SEQ ID NO: 10323 - DNA, 499 bp, Lycopersicon esculentum
  Predicted polypeptide sequence is orthologous to G715, G1646
tggaaaacagccctcagcaatcggcggcgaatgcagcggcggcggctgcagcggctcagtccgctgggtacccgactcagccaccttaccaccatctccttcagcaacagcagcagcagttacaggtgttttggacctaccaacgcaaggaaatcgaacaggttaacgattttaagaaccatcaacttccccttgcccgaatcaagaagatcatgaaagctgacgaagatgtccgtatgatctccgctgaagcacccattttgtttgccaaggcatgtgagcttttcattctggaactcactattcgttcctggcttcacgctgaggagaacaagcgacggactctgcagaagaatgacatcgctgcggccattacgcggactgatatttttgatttccttgttgacattgttcccagggatgagatcaaggaagagggtgctggtctggggcccggaattgtgggttccacagcaagtggtgttccgtactattatcc

SEQ ID NO: 10324 - DNA, 614 bp, Lycopersicon esculentum
  Predicted polypeptide sequence is orthologous to G715, G1646
caacaaccctcaccaatctccgactgaggccgctgcggcggccgcagcagcggcagcggcggctcagtcagccacgtatccgtcgcagactccataccaccatctccttcagcagcaacagcagcagctacagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccagttctgttcgcgaaagcttgtgagcttttcattctggagctcaccatccgttcgtggcttcacgctgagggaaaacaagcgcaggactttacagaagaatgacatcgctgcggcgattactcgtactgatatttttgattttctggttgacatcgttcctagggatgaaattaaggatgagggtgttgggcttggacccggaattgtgggttctactgctagtggtgtgccgtactattaccctccgatgggccagccggctccgggtggagtgatgcttggtaggcctgctgttcctggggttgatccatcaatgtatgtgcaccctccaccgtcacaggcgtggcaa

SEQ ID NO: 10325 - DNA, 749 bp, Lycopersicon esculentum
  Predicted polypeptide sequence is orthologous to G718
agaataattaaacttgcatatttattaggctgagtcgtcggcaagcatttgtttgtgccatttgtggggttaatgaaccatttaatgtttggttatttatttggtttcattgattaggtgatgaaacaagtagctgaaaatgatgttgtggagttaacagatgggagaaacatttgttgtcttggactggaagggattgagctctgtttctgtatttgaatagttatccttgtctccttatagtcttaatcagcttcgtactagttactggaatcatacagctctgtcaaagagattcaagtcttaattactcttttgcattccatgagtctgggaatttggtaaagccatctcgtagtttctttcccaagatggagtggaatgtgaagtgggactggggaaatctggtaatgtttggttcaaaggcctctgaaagtccaaaagaactacaattaacagattggggagttgaagaagagggagaacttgatgggggatcttttaatttgtcaagtggtggtagtggcacgggtggctatggttctgatctgaagtgtggttcttccatcaaaagctcaatatcagcttctactgactcttcaccaaaggatggctttaaagtatccaactttgcttttgagacatttaatgcctctcctgaggatcctagtaagaaattggaatcctccaaagccgaggtctctagaaatcaccacccatggaggcttcagtaggctctgttgaaccag

SEQ ID NO: 10326 - DNA, 2143 bp, Lycopersicon esculentum
  Predicted polypeptide sequence is orthologous to G720
gacccacctaactataatcaacaaacgacccttaaaagaagaagaaaaaacaagaacagatgagctaagtcttcttcatttcccaagagatacaggattgaatagttaatgactgattaaaaagtgaccgagttggagggactaaaaaggatgcctttttagaaatgatttgcattgagaatgaattattgggttggaaagatttcccaaaggggcttaaagtcctacttcttgatgaagatagcaactctgctgctgagatgaaatcaaggcttgagaaaatggactacatagtctactcgttctgcaacgagagcgaagctttgactgcaatctcaagcaaatccgagggctttcatgttgccattgtggaggtaagtgcaggcaacagtgatggggttctacggtttcttgaaagtgccaaagatctaccaactataatgacatcaaatatacattctcttagtaccatgatgaaatgtattgcgctaggcgcagttgagttccttcagaaaccattgtcagatgataaactcaaaaatatatggcagcatgtagttcacaaggcattcaatactagaaaggatgtgtccaaatcacttgagccggtaaaagattctgtcctctcgatgctgcagttacaactagaaatgggtgaagcagatgacaaaagttcaaatggaacagaacctcccactgcagtagcggaaagcaatactgaacagtcatcgggctgtgataaataccctgctccctcaaccccacaattgaaacaaggagtgcgatccgtcgatgatggtgactgccatgatcatactatcttctcaactgaccaagacagtggggaacatgatgctgacactaaatccgtcgaaactacttataacaattcacttgctgagaataatgtccaaacaagtcctactgtacagcaaggagatattattttgaaagaggataatgtttcatctcctgatctaaagacggagactgatatcgctaccacttcacgaagtaacgactgccctgacaatagcattatgcattctgctgaacctagtaaagcatctggtcctcatagttcaaatgggactaaatccaataggaagaagataaaggtagattggacacctgaactacacaagaagtttgttcaagcagtagagcaactcggtatagatcaagccattccttctcgaatactggacctgatgaaagtagagggcttaacgagacataacgtagctagccatctccagaaatacagaatgcatcgaaagcaaattttgccaaaggaagtagaaagaagatggcctaatccgcaaccaatagattcagtccaaagaagttactatcctcataaacctatcatgacattcccacaatatcattctaatcatgttgccccaggtggtcagttctatcctgcttgggtaacaccagcaagttatccgaacggtttacaagtgtggggttcaccttactatccgggatggaaacctgcagagacttggcactggacgcctcgtccagagctgcatgctgatacatggggctcccctatcatgtcaccgtcgcttggatcatatccaccatatcctcagaatgctggagtgtaccggccacatggaacacataacagatatagcatgctagagaagtcgtttgatcttcacccggcggatgaggtgattgataaagtagtaaaagaggcaataaccaaaccatggttaccacttcctttgggcctaaaagctccttcaacggagagcgttcttgacgaactttctagacaagggatctcaaccattccttcacaaatcaacgactcccgttgtcggagatgagatgacatgtcattctaattttttttgggtcccatagttggtgcatgtcaaaaaaaaataataatctccaattacttgatggacatatgtaccatgacattacccagtgacccgagtgacccacgcgtatggcattgactcgacggtcaaaatcgagttgttgtaaataatggacccaaatatgggttttcccttttttgttggcccaattttagatgtttgggccgatgagtgtgctccattaatttctttggaaaataatgaataaaccattcttagctaaaaaaaaaaaaaaa

SEQ ID NO: 10327 - DNA, 765 bp, Lycopersicon esculentum
  Predicted polypeptide sequence is orthologous to G720
atatgctgcagcatgtcctctatttttctttgaaaaaatttcttgtgactaactaaaaagtgtacagttttttggtgattaataaatttgttcatgtgtgcagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgaataatatccagcttcttc

SEQ ID NO: 10328 - DNA, 1695 bp, Lycopersicon esculentum
  Predicted polypeptide sequence is orthologous to G735
gagatttagcaattcaacaactctctgtctcaaagtctcatctctctctaactaagggagagagagaatggatactgtgttttcagtggatgagattgccgatcaattatggtcatcgccgccaccgatgaggttatctcatgacttggattcttcttccgccacttcgtcctctaaaatgatgaacaggagctcgtcggagtgggcttttcagcgtttccttcaggaggctgcagcagctgaaactacttcctcgtcttcttcacagcagatcaagcttaatcataatttaattcctgatcaatcgaagcctgtgtcatcgtttgtctctgaacctccgattgattccgatgaacatcaggctttcctcaaaagacgcctggatttggcatgtgccgccttcgctttgaatcgtgtatgttatatttcttaattgattttaattggataggttcgtttcctttcaactgctaaattcaatgattggacgcaatcgctaagtgatttggtattcctttctttttcttggatttaatcaaaccgtaagtaccaatttatccctaggcaagctatataaaatctcaagattcggcttctttgccacccgaaaaaggatcactggcagctaatgcatcactctgtggatctcaacttcctccaaaaggatctgggcaagaattggcaaaagttcaagataaggatgctggtgacccaattggaatacctcccttgcctgcattgcagaagaaacctggtatccaggtaaggtcaacgacaagcggttcatccggagagcaatcagaagatgatgaagctgaaggagaagcagaaacaactcaatcaactgatccaactgatgtgaaacgtgtgaggagaatgctatccaatagagaatcagctagacgctcgagaagaagaaaacaagcccatctgacagaactagagacgcaggtctctcaagtaagagtagaaaactcctctttattgaaacgcttgactgacataagccagaagtacaatgaagcagcagttgacaatagagtattgaaagccgatgttgagacattgagagcaaaggtgaagatggctgaagaaactgttaaaagagttactgggttgaatcctctattccaagctatgtctgagatatcgacagtaatgatgccatctttcactagtagtcctttcgactcatcagcagacgctgctgtccctgaacatgatgacctgaactatccagcgcctgaaaatggtcatatgcccaaccatgattgtagaatgcaaaacggtatgttagatatccctcctataggaaatgtacatcagagctccgcaacagaggcaattgaagccaacacaattgacagaccatcttcaatgcagcgagaggctaggttggagcatctgcagaagcgcatctgcggagaagcaagtacttgtggaaaccaaggcaagggagagaagtagaatgacttaatgagcagaagttacggcaaggaagatttcacagagatctgtaaatcttacatatcaaattactttgaaataattaatctttttagtatatcgagtctatctgaagaaaaaaaaaagcaaaaaagaacaagactattgtgtgtgccaatgctttttcggttacactgttatatcaatttgattatctgtttgctggccaaaaaaaaaaaaaaaaaaaaa

SEQ ID NO: 10329 - DNA, 790 bp, Lycopersicon esculentum
  Predicted polypeptide sequence is orthologous to G735
gcagatccagctgatacaaaacgcgtaaggagaatgctttcaaatagagaatcagccagacgttcaaggagaagaaagcaagcccatcttacagaacttgagacacaggtatctcaactgagagtagaaaactcctccctactgaaacgtctgactgacataagccagaaatacaatgaatcagctgttgataatcgtgtcctaaaagcagatgttgagacattgagagcaaaggtgaagatggcagaagaaacagttaaaagagttacagggctaaatcctttattccaagctatgtctgagatgtcctcaatggcaatgccatccttctctggcagtccttcggacacatcaacagacactgctgtgcctgtgccagatgattctcaacatcattactaccaacaaccgccaaataatcatatgccaacccatgatcctagaattcaaaatggtatggttgatgttcctacaataggaactgtacagcagaatcctgcagctgcagcagttggtgggaataagatgggtagaacagcttcaatgcagcgcgtagccagcttggagcatctgcagaagcgcataccgtggagaagtgagttcctgtggaacccaaggtcggggagagcaataaacactgtcaaagcccccagctgcactgaatcagattttgcacttgcatgttgataaaattatactgtttttaaccatttgtggcaggaaaaatgcccattctttgtatggcaacgccttcttggatgatactaatggattgacatccctttgctat

SEQ ID NO: 10330 - DNA, 470 bp, Lycopersicon esculentum
  Predicted polypeptide sequence is orthologous to G740
gtggaaggacgggacatttggctagggaccgtgatcgcaacagtggaggtggaggaggtggcagaggcgggtgttataactgtggtgctgctggacatttagctagggattgtgaccgtagtagtggtggtggtggtggaggaggaggagcaagtggtggtgtctgttacacttgcggtgggtatggccatatggctcgagattgcccgagtgctggacgtgttggcggccgtggtggaggaggtagtggggcttgttattcatgcggtgcacaaggacacttggctagagactgtcccggtggtggtggtagtaattttgggagatctgggggtggtagtggaggaagcaagtgttacaactgtggagaggcgggccactttgctagagaatgcactagccaatccgtgaactgatcatgtaaatgatctttctctttattccctacaccctcttagtactcattttct

SEQ ID NO: 10331 - DNA, 803 bp, Lycopersicon esculentum
  Predicted polypeptide sequence is orthologous to G740
ccaggatcaaacaatacggaagccatgcaatcacaaactagaagattacctgtgatgacagcatcagatgcctccgcttcagaccgcccagggaaagcgtaacaatgggccctatcgtttgtctgcccattgcccctaccatgttgtgatgtagtggccccagtttgcccattacctctgccgttttggtgaccaccattacctcgaccaccacgtcctccagaataacggcctctaccatgaccacctctacctctagctattgggggtctataacttggtccaggacaatttatcctaatatgtccaatctccccacatccataacattctctggagtcactcataggccccttggagaagtgttgaccggtctgaggtggacccccaactacagtctgtagtgaagactgaatgggtcgagccgagtaacctccggaaccttgtcctctagagtaagaacccttaaactcacctccctttcgaaacctctttgatgttgatgtcgtggtgaagtcgtctggcttcactccttccacttctatcacaaagtctaccacttcttggaaggattttgccgttgccgctacctgtaaggccgaaatccgcaattctgacctcaaccccttcacaaaccggagaatccgctcttgaggactgaaacagagttgagtggcatatccggatagtgcacggaacttagcctcataagcattaaccgacatcctaccttgctctaggctcaggaactcatctcttttccctatccctcaagtccggggatatacttctcccataacaac

SEQ ID NO: 10332 - DNA, 617 bp, Lycopersicon esculentum
  Predicted polypeptide sequence is orthologous to G748, G1900
cctttagggaagcattcaagggacggtgagttgcttaaaccaaacaaccctgagggtcaaaagaactcagaggggtctgttttagtaccaaaaacattgcgaatagatgatcctgatgaagctgcaaagagttctatatggtcaacactgggaatcaagtacgactctgttagcaggggagggcttttcaagtccttgcaaccgaaaaacagtgagaaggatcaccctaccactacctccccgtctttgcaggctaatcctgcagccttctctaggtccctcagcttccaggagagagtataaagtctgaggtacttagttgttaaccaacttatcttccggcagatggatgttgatcttccagccttatggatattcaattacgcttaatcgtatgtaccagggctgagaatctcaagatcccacaagtgcttcaactgaaactgggaaagctattgtcaaaattagtgtttatccttcccttgtaacatatttttgcttggtcagtgtgtgttttccatgtacataaactttatacagctgacagtagaaagtggaagagagaaatgtttagatgtatatcatgtacccgtcaaagttttaatctggaaggcggg

SEQ ID NO: 10333 - DNA, 2113 bp, Lycopersicon esculentum
  Predicted polypeptide sequence is orthologous to G760
ggaccaaagttcaaaaatgtcttttttccaagtccattaaaccctaaatctcacaataccccaaattcctaaatttaatctcaattttctttttatctgtgtttagtataaggtcttagataattttaatttttttttttgtgaattttttgaattttttttagtgtggttgatggaatcgagaggatcatcgaaattgttggcgccggggttcagatttcatccgacggatgaagaattggttaggtactatctccgccggaaaatctatggaaggacgtttaagtctgatcttatatcggagattgatatttacaaggttgaaccatgggatcttcctggcatgtcaaggctgaagacaagagatttggagtggtatttctttagtgttcttgataagaagtatggcaatggagcaagaaccaaccgagcaacagaaaaaggctactggaagacaaccggaaaggatagggctgtccatcgtaataagtctcaggttgttgggatgaagaagactttagtttatcacagtggtcgtgctccaaagggtcagagaactaattgggtgatgcatgagtacagattgattgatgaggcattagataaagctggaattcctcaggatgcatttgttttatgcagagtcttccagaagagtggtgcagggccgaagaatggggaacagtatggggcaccttttatagaggaggaatgggaggatgatgagttacaagttccttcgaaggatgagactactgaggattttgtatttggtgatgatatatattttgatgcaaatgaacttgaccagattcttgggaccgacaaagctgtggctggtgcttcttttccttcggattattcttatggtgaaaatggaagtacggaggagacaaataactcctctgatgcacagcaacctgacgagcttaaaccaattgatctagctgttcaaaagaattttaatgctgagcaagtcaatcatgaatatattggtgaatcaagcaagaacatgaactctgaagatggggattacttgcttaatgaaccaattgtaaatgggactgatgacctccaatttaatgatgaagctttcctcgaagctaatgatctttcaaatcccgttcaggctgacagctctggtttcgacatgcttgaggaataccttacttactttgatgcaaatgacgactttcagaatatgagttttgatccttcagttttctttggaaatgatgatcaaatttctgatcaagcactgctgcctcagaaggacgttggggaggtaactcagcaacctattgcgcccaatgaagggtttagtgaagataagaatggtattgcatcgtcctccaaactggtaccaactaaatttgaatcagattatcagtatccatttataaagcaggcaagccagatgttgggcaatattcacgctcctccagcatttgcttcagagttccctacaaaagatgcaattctccgtctgaactcattctctcggtcagctagttcagttcaggtcactgctggcaatgggacgagatggccattgggcaagcatgtgtattacaacattatcctatctcttggcctatcacggggtagtagtgatgactcttccatggattcatttcataagattcatccaggaaagactacttcgacgatttccagaggctggttctgttatctattcttttcgttcctaatgcttttgatgagcctcagaattggaaccataatctgtgccagttaaggtttcagcactcactaaaggataacttgatcaccaaagctcaaggtggatatgttatcatacatactctggtctattatttcatctcaattaagactttgatacattagatttttttttgtgttggaccaagatgaaatcgatagttcttcactactattgtgagattacattgaattatatttttgtgttggaccaagttaaaatcgatagttcttcactactattgtacataggataagttgacatcgttggtgaaatagcttctgtggagtagttcatataggagtctgatgtatatcatatattatcgtaagtaggaagagttttgcccactcaaaaaaaaaaaaaaaa

SEQ ID NO: 10334 - DNA, 477 bp, Lycopersicon esculentum
  Predicted polypeptide sequence is orthologous to G760
aatccacgtcactggatttattcgaataacaaacatgactgtgagcagcaatgggatggacgggttggtgggcaagcatgggaattacaacgttatcctatctttaggcttatcacagcatggtgatagctccgctcacttggaatcagaagctagttttctccctgggaagacaatttcgacagtgtcctggtgctggttctattatctgttcctttgggtcctccttctttccacaaccttcaaaatcgggaccttcattcgtgctgcgtaaggcctcaagaatctagagagctcaatttttacttttgaaagtcatggcaggatatcttgatctctgactgaagtgaacattattatatatgatacacaacctataccaggaatatttagtgtcttagacattcaagtgagttgatgcagtttctgactcctgaacaaattttaaaattcaatgatgtatcacagtgcagcttg

SEQ ID NO: 10335 - DNA, 740 bp, Lycopersicon esculentum
  Predicted polypeptide sequence is orthologous to G760
aattacaacacctcttcatcttctctctctaactcctaaatcttaccaaaattctgaatttttcgttgctgtatcaactttaggcggttatactgaagaatttcttgttaaattgttagttttttcacaaaatttggttcaaaattgtccatttttgttaactttgactgatggaatcaaaagggtcggcgaaatggatggcgccggggttcagatttcatccgacggatgaggagttggtcaggtactatctccggcggaaggttattggtaaacctttgagatttgatgctatttctgagatcgatatttataaagttgaaccatgggatcttccgggtatgtcgaggttgaaaacaagagatttggaatggtacttcttcagtgtgcttgataggaagcatggtaatggagcaaaaaccaatcgggcgacagaacgaggctactggaagacaactggaaaggacagagctgtccatcataagtctaaggttgtcggtatgaagaagactctagtttttcatagtggtcgggccccaaaaggtgagaggactaattgggtcatgcatgagtacaaactaattgatgaagagttgcaaaaagctggaattgttcaggatgcacttgtgttatgtagagtcttccagaagagtggcgcagggccaaaagatgggtgaaaagtatggggctccttttgttgaggaggaaatggaggatgatgagttagaaattgttcccaa

SEQ ID NO: 10336 - DNA, 1464 bp, Lycopersicon esculentum
  Predicted polypeptide sequence is orthologous to G772, G776
gggggtattctcaaaaaagttaaatttacattcttggctttttgggtggttgagaaatggaacaagaaggatcgaaaggggctgtaacggtggcaccaacgtctttagcaccgggattcaggtttcatcctaccgatgaggaattagttaggtactatctacgccgaaaggtctgtggaaagccattcagatttcaagctgttactgaaattgatgtgtacaaatctgaaccttgtgaccttgcaggatattcatcggtgaagagcagagatatggagtggtacttcttcagccctgtggataagaagtattgtaatggatctcggcttaaccgagctactggtcaaggatattggaaagctactgggaaagatcgtcatatcagccataagtctcaggccattgggatgaagaagactctcgttttccatagtggtcgagctcccgatggcaagagaactaattgggtaatgcatgagtacaggcttgcggacaaagagttggagaaggctggaatcgtgcaggattcctttgttctatgtagaatcttccaaaaaagcggtttgggaccaccaactggtgacagatatgcaccatttatcgaggaggaatgggatgacgattcagccgtgcttcctggaggagagacagaggatgacgcagtgaatggtgttgatgcacgagttgagagcaacgatcttgaccaggatgctccgcccaagattgcttgcgataatgagaacgtgattgaacttcgaagtcttccatttgcttgcaagagggagagatcagaagaacctgaacttctctctttaagccaaaacaagaaaccgaagcatgatgttccaagctctagccgtgcaaatggttctgaagactcaactattactagtaaagatccggagaatatgatgacgacaaaagattaccctctagctctcttaggattcccgttgttagagtccttcgagcccaaggatccccaaccttctaatcccctcacatttgattcctccaatcttgaaaaatccgtccctccaggctacctgaagttcatcagcaatctagagacggagatcctaaatgtctccatggagagggagacgctaaagattgaagtaatgagagctcaagccatgatcaacgttcttcaatcgcggattgatctcttgaccaaagagaacgaagacatgagaaaacttgtccgaggtggttagacaataacagcatttcgattcggtttaggtttgtactaccttcaggaagagcaagatatagtaaaaagatgtttgaagacatttctgtagttcttgttgtaacctggatcatatgtacctttttaggtatctgcagaatttttttctattgcattagtttaaactttgaagtcttagactgttatcttaatgatattgttgtttaataacaatagtcgggtcatgttgtgcaaaaaaaaaaaaaaaa

SEQ ID NO: 10337 - DNA, 635 bp, Lycopersicon esculentum
  Predicted polypeptide sequence is orthologous to G772, G776
ctggagttgtgcaggatgcctttgtactctgtcggatcttccagaaaagtggattagggcctcctaatggcgacagatacgcaccatttattgaggaggaatgggatgacgacacagcccctctggttgccggaggagtgacagagaatgacgtggccaatggtaatcaagcacgagtcgagggaaatgagtttgaccaggatgtgcgtggtaaggctccttgcgtaagtgagaacctgtttgagcctcgagctctttcgtttgtttgcaagagggaaaggtcagaggatctcgaactactctctttatctcaaagcaaaagatccaagcatgatgatcctagctctagccatgcaaatggttctgaagattcaaccactagccaacaggatccaccaacaaagacgatggcgacaacttactcccctactctcttaacatttcccttgttagatgaaccaaaagaagctccacctactaactcctttaattttgactcttccaatcttgaaaaatctgttcctccaggttacttgaagttcattagcaatttagagaaccagatactaaacgtctccatggaaagggagactgcgaagattgaagtgatgagagcttcagctatgaatcacatt

SEQ ID NO: 10338 - DNA, 740 bp, Lycopersicon esculentum
  Predicted polypeptide sequence is orthologous to G773, G1412
aaaatttcaaaaaaaaatctatatttttcttctctctctacattttgcttacttgtgagaaggaaaaaaaatgggtgttcaggaaatggatcctcttacacagctaagcttaccacccgggttccggttttacccgactgatgaaaaacttttagttcaatatttatgccgtaaagttgctggtcatgatttttctctgcaaattattgctgaaattgatttgtacaaattcgatccatgggttcttccaagtaaggcgattttcggagaaaaagaatggtatttcttcagtccaagagatcggaagtatccgaatggatctagaccaaacagagtagctgggtctggttattggaaagcaactggaactgataaagttattactacagacggtagaaaagtcggaatcaaaaaggctttagtgttttacattggtaaagcacctaaaggaactaaaacaaattggattatgcacgaatacaggctcagtgaacctacaacgaaaactggaagttcaaggctcgacaattgggttctatgtaggatttataaaaaaaattcaggtggacaaaaatcgagttgttctgatttacagaacaaggatataagtcatgcttcatcatcgtcatcatcatctcagtttgatgatatgctggaatctctaccggcaattgaagatcgttatttctcattgccaagggtgaattctataaggaactttcaacaaaatgacaagacca

SEQ ID NO: 10339 - DNA, 1567 bp, Lycopersicon esculentum
  Predicted polypeptide sequence is orthologous to G773, G1412
agttttttattaattaaaaaaaaaattatgggtgttcaagaaaaagatccacttttgcaattaagtttaccaccaggatttagattttatccaactgatgaagagcttttagttcaatatttatgtaagaaagttgctggacatgattttcctctacaaattattggtgaaattgatttatacaaatttgatccttgggttttacctagtaaggcgacatttggtgaaaaagaatggtatttcttcagtccgagggataggaagtatccgaatggatctagaccgaatcgagtagcaggttcgggttattggaaagcaacggggacggataaggtgataacttcgcaaggaagaaaagttggaattaagaaagctcttgtgttttatgtgggtaaagctccaaaaggatccaagacgaattggattatgcatgaatatagactttttgaatcttcaaggaaaaataatggaagttcaaagctagatgaatgggtgctttgtcgaatttataagaagaattcaagtggaccaaaacctctgatgtctggtttacacagcagtaatgaatacagccatggttcgtcgacttcgtcatcatcccaattcgatgatatgctcgaatcattaccagaaatggacgatcgattctccaatttaccgaggttgaactctctcaaggccgagaaattcaacctcgatcgtctggattcagccaatttcgattgggcaattctcgctgggctcaaaccaatgccggaattgggcccagcaaatcaagctccaggcgttcagggtcaggctcaggggcatgtcaataaccacattcacagcgacaacaacaatatgaattttctcaacgatgtttacgcccatcctccaaatttccgaggcaacacaaaggttgaaagtattaatctagacgaagaagttgaaagcgggaaaagaaatcaacggattgaccaatcgagttacttccaacagagtctcaatggattttcccaagcgtatacaaacaatgtggatcaattcgggatccaatgtccgaatcagacgttaaatctcgggttcaagcagtagaggatactggaaagtaagaaaagttgtagctcgaaatctgaatgccagtatactgtgtatatatacagaaggcctggatttagatttccttggcccaacggattcgaagaaagagcaagtacagtatcatgccaaggaaattaagtccttcgagggcacgtctgggcagacgtcgtggacgttatttgcaagttcttgcaattgtgtctgaagtcattaggctgagtggcacttcttatttgcaagttgtgtttgaagtcattaggccgaaggcacgtctgcgtggacgataaaataatgtacacaaacaggagatatatgcaggggcgtgtatattcttttaggaaactgggcttttagtttgttttattttatgatacatttccagatttggatgtattttgtaatttttacatttctgtgtagcaagttagaagatatatagaaagatacttttaaaatactttttataaaaaaaaaaaaaaaaaaa

SEQ ID NO: 10340 - DNA, 691 bp, Lycopersicon esculentum
  Predicted polypeptide sequence is orthologous to G778
cttatatctacccttattccatctattatcttctctccaacaccaaaattttgagagaataataataataataataataataatatattgttgttttgattcattcatcaccaagaagaacacctccctcttatttaccttcgatatgaatcagtgtgtaccgagttgggacctcgatgactctaccgttcctagaaaaaatcttatacaaactcaatccaattcattagccgttgatgtcccctcgtatatactctctattactctttcacaataattattacttttattttatatttactgactcaaaattctgaattcgcagattagattatgaagtagcggagctaacgtgggaaaatgggcagttagcaatgcatgggttagggcctccacgggctaataataagcccatatcgagctacggtggcacccttgaatctatagtgaaccaagccacccgttgcaacgacgacgttcctcttcatctccacgggaagtccaccgtggacaggaacaaacagagtggagatgaggtggttccttggttcaacaaccacaacgcggttgcttacgctcctccggcaaccggtttagtcgcaatgactaaggatgcgttgggtgccgtgttcgaggaacacctcaaattcggacaccaacgatccgtgcacgtgccagggattgacggctc

SEQ ID NO: 10341 - DNA, 638 bp, Lycopersicon esculentum
  Predicted polypeptide sequence is orthologous to G782
tgtatgcatccacctctgcagccctatcctttcttcggcaatcataatcctgcagttgttccaaacccttcatcttttgttcaatacatgactcccaatacattgattgaacagcaaccgactcagtatatgtctccaattatacaaccaggtagtatgaccaggcaagaatccaggaacaagtcatcagatcaaggagagagcagaattgagaaaagtgaagattccaatgaagtggcaacagatttagagcttaagacacctggatctacatccgagcaggacctttcatctggacaaaagaaatccagaaagttgccaaggaaggataacagcttcacggatggaagttcctcaagtaaatgttcatcatcccatagtgtacatgctgtttcttcaaatagtgtagttaggggaacaaagactggtgattgacgtttgaaaccgtgtaggaaccaggttataaccattttaattacttttcctttctagcttcttctgctccatctgttgtataaaaagggttacagatagagagtcagggagctgttgctaatgcaatgggtttccaatttggatatttctcatgtatcactaacagttctaaggggtcgtcacatgggagactagaaagcgtg

SEQ ID NO: 10342 - DNA, 783 bp, Lycopersicon esculentum
  Predicted polypeptide sequence is orthologous to G783
ctttctatctgtttcacatttattgctcttatcctttcaatctttcttatctttaagccctatttctgatgtgcttgaaatgatttcttttggggttgcgcttttaacaaaattttattaggttttttttatttttgcgtaggcagagagcagaagtcatggggcttcttttacgaattttttgttcttgctttggtgaagaattgggaactaaaggttttttcttatcaataaatagttgattatagaaaaatggggatcaaatgctgttatttactacccagtcttccgaaacaaagagtgtttctgcttagttcgcttgaattttacttacctcaatttaggagttccgctgtttaatagcatagcataggaaatagatggtgaagtaatgagaaatcggctaagtataccgtgttaatgctgaaaatttgttacttcaaatgaacttagcttgattgttcatcatttgacaaacttttggacaatccttacttgcacctttttttcccttggacagacaatagtttttctcatcaaaggctacaccgtggactcgaataagagatggatacagaaaatcctgctccaatagttgaaaaggatactacagatgcggagacatcattggatagctctcatctcaggaagaagattcagaagaaagttccaaaaagaattcacaaagctgagagagagaaaatgaagagagagcatttaaatgagctttttcttggtttggctgatgctctttgactatctgagcagatgaatggaaaagcc

SEQ ID NO: 10343 - DNA, 2139 bp, Lycopersicon esculentum
  Predicted polypeptide sequence is orthologous to G789, G1494
gatgatcaagaaattcactttttcttgatatagaaaaatcattttttttaaaacccccttttgactattaagtattgaatttgatgattttgagattgccttttactgtgtgcctaaacatactgttttttttcttgatatgcagtagttttagccatgaatccatatcttcctgaatggaatattgagactgaacttcctgctccacatcaaaagaagcctatggggtaaataatatatgtgtttgattacataaccaaagtaaactaaatttgttttttaaacaatgatcttgaattggtttcaattggatggtcttttctgtagatttgatcatgagctagtggagttgttgtggcgaaacggggaggtagtattacatagccaaacacataaaaaacagccaggttatgatcctaatgaatgcagacagtttaacaaacatgatcaaccaacaataagagttgctggaaatcagactaatttgattcaagatgatgaaactgtcgcgtggctaaactgccctatcgatgattcgtttgacaaagaattttgttcccctttcttatctgatatttcaacaaatcctcacctgggggaggagcctgataagtcaattaggcaatcagaggacaataacaaggttttcaagtttgatcctttagagatcaaccatgttcttccgcaatcacatcattctggtttcgatccaaatccaatgccacctccaagatttcacaactttggatcagcgcaacagaaacatcatatagtagggggggatcagaaaggtgttaactttcctccaccgataaggtcatccaatgtgcagcttggtggcaaagaagctagaagcaatctgatgctgcaagatattaaagaggggtctgtgatgacagttggttcaagccactgtggcagcaatcaagttgatactagccggttttcaagtagtgcaaatagagggctgtctgcagcaatgatcactgattataccggaaaaatcagtccacaaagtgatacaatggaccgagacacatttgaaccagctaatacatcttcgtcttcaggaagatcgggtagtagttatgcaagagcatgcaatcaatctacagcgaccaatagccagggccacaaaaggaagagtagagatggtgaagaaccagaatgccagagtaaagctgatgagctagaatcagctggaggaaacaagtcagcccaaaaatctggaactgcccgaaggagccgtgctgcagaagtgcataatctctctgaaaggagacggagggatagaatcaatgagaaaatgaaggccttgcaagagcttcttcctcactctactaagacagacaaagcatcaatgctggatgaggctattgaatacttgaaatcacttcagatgcaactgcagatgatgtggatgggaagtggcatggcatcaatgatgttccctggtgtccaacactacatttccagaatgggaatggggatgggtccgccttcggtgccttccatgcacaatgctatgcatttagctaggcttcctttggttgatccagcaatccctttgacacaagctgcccctaataatcaagcagctgcaatgtgccagaattcaatgttgaatcaagttaactatcaacgccatttgcagaatcccaattttccagatcaatatgctagttacatggggttccatccacttcaaggcgcttctcagcctataaacatttttggcttaggttcacatacagcacagcaaactcagcagttaccgcatccaactaatagtaatgcacctgccacttgaagagttatcactgaggatactatcagtgtaaaattaggacagtgaaattgcttcattttgcgtaatgtttatcatggtactagactctagcaatcactactggaagatcttaagattttgggagctaacgttcaaatatgtaagagacaacgacaccatcataatgaaatacatgaacttcattgtatgagactcttcttcatatagcaaagctacaagttttattctgtaggagcacattagtagttggcatatgtaacttactgtatatgaaaaaatttactgaggaataagaattcattaagtctttacacaaaaaaaaaaaaaaa

SEQ ID NO: 10344 - DNA, 563 bp, Lycopersicon esculentum
  Predicted polypeptide sequence is orthologous to G791
gagaaattaaggagagagaaactgaatgaaaagttcatggaattggcggtgcttcttgagcccagcaggcctccaaaaacagacaagagtgccattcttgttgatgctgttcgcgtggtgacacagttacgtggtgaggctcaaaaattgaaagactcaaatttggatctacaagaaaagataaaggagttgaaggttgagaaaaatgagcttcgagatgaaaagcagaggctgaagtccgagaaagagaagctagagcaacaactaaagactatgagtgcacaacctagcttcctgcctcctgccatgcctggtgcttttgcttctccagttcaagctgcaggaaccaagctggtgccaatcataagttaccctggagttgccatgtggcaattcatgcctcctgctgcaatagatacctcgcaggatcacgtgctccgccctccagttgcttaaatttgctgctaaaacctatgataattgacttaactccgatatgttgttctagttaaacgctctttagctgtgttagtttattcgtcgagtccttttggtgtatttgg

SEQ ID NO: 10345 - DNA, 627 bp, Lycopersicon esculentum
  Predicted polypeptide sequence is orthologous to G791
ttccacttctccttctcctcctcattttcctccttttttcctcttccacctaacacccaactggaattgggataccctacaatcttcaactgaaattttccggcaccggtactcctcacgtcggagaaaatggcggaaacagaggaagacggatcaaattggctcatagaattagggttaatggaagaccttccttctcttgaacccaatgctcaatggccctccaacgctttttcccttccaaataatctcagttctggattagaagattcctatggcaactcagatagtttgaaggaatgcggctccaaaaagagggtgagatctggagcatgtgcatctgattcaaaagcacatagggagaaaatgcgcagggacaagctgaatgacaggtttcaagaattaagttctattctggaaccaggaaagcagccaaaaatggataaatctgttatcctaggtgatgcggttcgtatggtggtgcagttgagagatgaagctcagaagctgaaagagtcgaacaacaacttgcaggagaaggttattgaattgaaggctgagaaaaatgaactccgagatgagaaacaaaagctcaaagcagagaaagacaaactcgagcagcatctg

SEQ ID NO: 10346 - DNA, 662 bp, Lycopersicon esculentum
  misc_feature (658)..(658): n is a, c, g, or t
  Predicted polypeptide sequence is orthologous to G791
ggaaatttgaagaagggaattaggtcatggaggtcgattctagtgggaatcctaattggttatttgattatgagttgatgacggatattacttctgctgcatctgttaccgtcgctgagtttcagtctccggctactattgatttcagctggcctgctcaaacgatctatgcttcttctaatctcattactgaaacagattacacatttgcggattcagaagttagcaaggaggcaagctcacgaaagcggttaaaaagtgaatgttgcagctctccgagatctaaggcatgcagagagaaattgcggagggacagactgaatgagaggttcctcgcattgagctctgtccttgatcctggaaggccaccaaaaactgagaaagttgcaattctaagtgatgctcaaaggatgctgattgagctgcgaactgaaacccagaagctgaaggagtcaaatgaggagctgcaagagaagataaaagaacttaaggcagagaagaatgagctccgagatgaaaagcaaaggctaaaggaagaaaaggataatttggagcagcaggttaaaagcttagcttctaaagcaggatttctctcccatccttctgccatgggagctgcatttactgcacaaggacaagttgctgcaggcaacaaatngatg

SEQ ID NO: 10347 - DNA, 764 bp, Lycopersicon esculentum
  Predicted polypeptide sequence is orthologous to G791
attcaaacagcaattggaaaccctcattggagaatttaccgggagaattatttttttcatcttctggccggcgactgatcggagatggtttcaccgtagagtaccaattggctttatgattacggattcgaagatagttgcgtccctgattcgaatttctcagcttctgcatctgggtttaactggtctgtgcagaatttgaatggttcaaggaatgttagttctgaaatcgatgggtcaattggtgaatcagattaccccaaggaaagtggttctaagaaacgggcaagggttgaatcatgtgctccaacaagttccaaagcttgcagagagaaactgcgaagagataggctgaatgacaagttcatggaattgggtgcactccttgagcctggaagaccccctaaaacagacaaatccgctattcttgttgatgctgttcgcttggtgacccagttacgtgatgaagctcaaaagttgaaagactcaaacttgaatctgcaagaaaagatcaaggagttaaaggttgagaaaaccgagcttcgagatgaaaaacacaggctgaaagctgaaaaggagaagctagagcaacaactaaagactacaagtgcacgccctagttacttgcctcctgctataccttctgcatttgctgctcatggtcaatttccaggaagcaagctggtgccaatcatgagttaccctggtgtcgcgatgtggcaattcatgcctcctgctgctgttgatcctttacaggaccacgt

SEQ ID NO: 10348 - DNA, 355 bp, Lycopersicon esculentum
  misc_feature (345)..(345): n is a, c, g, or t
  Predicted polypeptide sequence is orthologous to G791
tttttttttttttctcttgaacataagggaggtattcatgtaaacttcaacgagatttacatattagtgtacataatcagttgatcaactacctcattatagtatatgtaccaatctgctcatattaggagaacaaaatgtcaacaaacgtcaacaaaattgttgacataggaaacaaacatttgcataattctggtaacaagaagtcaccacaatttaagcaactggaggacggagagaatgatcttctgaggtatcaactgcagcaggaggcacaaactgccacatagggattccagggtagccaatatatggcatcattttgcttgcaaagacttgatgtgnggctgagaaa

SEQ ID NO: 10349 - DNA, 834 bp, Lycopersicon esculentum
  Predicted polypeptide sequence is orthologous to G801
atcggccgaattgagagcaaaacggcgccgttttactcgattctaccaccggctccggtggtggagttgctaatagtaatggtgctttgacggtgaagaaaccgccggcgaaggaccgacatagtaaagttgatggaagagggagacgtataaggatgccaattgtttgtgctgctagggtttttcagctaactcgtgaactaggtcataaatccgatggacaaacaattgaatggctgttgcgtcaagctgaaccttcgattattgctgctactggtactggtactatacctgctagtttctctactgtttcagtttcgttacgaaattcgatttcttctgttactgcttctgctccggttgatcataagttgccgtcgccgtcgccgtcgttgttacatccgttgatttctccggcgccgtttttgcttggtaagcgtttacgttctgaggatgatgataatggaagtggagataaggatgtggttcctagtgctggattttgggcagttcctgctaggccggattttggacaagtttggagtttcgctgcaccgtcgccggagatttcacattccgctgcagcagcgatgaatacgcagccatcgaggtttcttcagcagcagatggaagaggcatcagctggtagagttgggaattactttcctatagctcaagggcatctgaatttgctagcttctctatctggttcgggttctggaccgagaagggacgacgatggacaatgaagtatttgctgtttatgatatgtataaattgagtattgttgttgttgtttgttcgtattgttaattgttagggattaggtagtgt

SEQ ID NO: 10350 - DNA, 683 bp, Lycopersicon esculentum
  Predicted polypeptide sequence is orthologous to G802
cttttcctaaaaacttccaattggttaaagttttcaaatatcaaacaaatctttgtttgttgttacgccatggaatttagagagtcaaatagcaaaaacaaccaagatggtgggagtaatagcaataataatagtaatgaaaataatagcaatgtgatttctactaaaattgttaagaagccatcgaaagaccgtcacaccaaggtggatggtcgagggcggcgcattcgaatgccggctttatgcgccgccagggtttttcagctaaccaaagaattgggtcataagtcggatggcgaaaccatagagtggctattgcaacaagctgaaccgtcgattatagctgcgacgggaacaggtacaattccggctaatttctcaactcttaatgtctctttacgcagcagcgggactacaatttcagctccgccgtcgaaatctgcgccgcttttcattcacggcggtgctgccactatgctgggtttccaccaccagattccgggcaacagttttgggcaagacccagatgagaatttcatgaagaagaggtatagagaagatacaactgcagcatcaacttcaccatcgtcatcatcagctaaaccggaaagaaccggagttcaaggtcacgaaccggatcaagaatcgaaacccgggtcatcgaatccctctagctacatacc

SEQ ID NO: 10351 - DNA, 766 bp, Lycopersicon esculentum
  Predicted polypeptide sequence is orthologous to G802
ggcaatagtaaacaacaaactaccaccaataacaccacaccttctccacctctacaccaccagcaacagcatcagtaccagctactctctcagcaccatcaccaccagcagcagcagcagcttcaacaacaacatgggagatcatctgtaccttttatgacctctatttctatacagcctaatgcacaagctccaattactaattctgctactaatgcttctccttctacttcatctcctactccaccgcagccacctcatctagtggacgcttctcttgcaattgccactagatcggacaccttagttgacccaaataagaaatctcagctggcaatacaacaaacacaacctgtgcagccgcagcagccaccaccgaagcgacaaacaaaggatcggcaccccaaagttgacgggagagggcggcgcatccgaatgccagccgcatgtgcagctagggtttttcaattgaccagagaattaggccataagtccgacggagaaacaatcgaatggctattacagcaagccgagccagccatcatagctgccactggcaccggcaccatcccagccaacttctcaacgctaaacatatcccttccgtagcagcggctctactctctcagctcctccttctaagtcagctcctcattcttttcacagcgctttagctttagccgctgctcatcaaacccctcatccttttgaagaaggattctcgcaatgctaggggtttcatcatatactcacctcctgacgcaaa

SEQ ID NO: 10352 - DNA, 480 bp, Lycopersicon esculentum
  Predicted polypeptide sequence is orthologous to G805
atgccaagtggattgcaatttatgaattttcccacttcagttgcgcttttgcctagtcaacaactaggcggcggcagtagcggtggtggcggtggtaataatggattgggagaaggtcaattaggcatgtttgccggactaaatccatatagaggtggtggcggtgtatccgaatctcaggcgagtgggtcccattcgcatcacggcggtggaacagatgatcggcacgatacaacgagccatcattcatagcttatagactgttgattgaattgatcatcaaattcatccattctttcccaacttgtgttttgtaagtttggatgtttaaagttccttattttttcttcttacttttttttttttgttgttgttaaatttgttctgaacattctttttttctttcttcaccttttttattgggggattaatttgccttaccagtttgaaaagggcacagttttaacaaaaaaaaaaata

SEQ ID NO: 10353 - DNA, 483 bp, Lycopersicon esculentum
  Predicted polypeptide sequence is orthologous to G807
tttctgggaccagattctctctgcaacccctgcaagccctctcactggggatacagatgagattggttccttagtcgtggaagaggatctccttggagttcaggagagtgattgggataaattaaagcatatgcataatcttactgaacagatggggttactatcatcggctgcccaaatttgatgattgcatgtatttttttgaaagcttgcactgacgcagggtattctgaattattgtgctactgccttgagcacgactgctgaagtgtggtgaacttctagaggatgtagagcaatgaactccccccatgtggtaatattttgtcaggtggatactctgaactggtttgcattaagaagctcctcttgaaagactgttcttacctactaataatgatgatgctctgtgtagccggtagcgaaaaggcgatcttaaaagactagtttgatgtattttattcggaatttttgtgtgtacat

SEQ ID NO: 10354 - DNA, 658 bp, Lycopersicon esculentum
  Predicted polypeptide sequence is orthologous to G811
accacgactgccactgcccctaaccttccgccaccgtgaacctccgcccagctcagtggagctccaccgcgttgacatcggaacgatatatatatatatgggatggaggctaacaatattattgctccgttcgtgatgaaaacttatcaaatggtgaatgatccgaagattgatggacttatagcctggggaacagctaataacagtttcatagttgttgaacctttggatttttctcaacgaattttgcctgtttactttaagcacaacaatttctccagctttgttcgtcagctcaatacttatggattcagaaaagtggatccagataagtgggaatttgcaaatgaatggtttctgagagggcaaacgcatttgttgaagaacatagtgaggaaaaagcacagtagaaattcgtgttctcagaagcaggatgagagtgaagatgaagaaattttgactgaaatttctagattaaagcaggaacaaaaagcattagagcatgaagttgagaatatgactagaagattagaagctacagagaaaaggccacagcaaatgatggcttttttgtgtaaagttgttgatgatcctgagattctgcccagaattttaatggagaaagagagatctaaaaggctaagtttaacaaatcgtg

SEQ ID NO: 10355 - DNA, 519 bp, Lycopersicon esculentum
  Predicted polypeptide sequence is orthologous to G831, G1202
gattttactcacgagggagcgtcggcgcgtaagcgcgtcagccaattccccccaccccaactcatcaccttgcccaagaaatttcattcatcacataaaaacagagagctaatttcaaagttcatcaacttaatttttcttgctctgtttttcgattttgagttttgtttgctctgttttttttttaaaaaaaattgtgcaaaaatggtgatattagccgatttgacacactccattacatcaattatcaagaaatctaatctttactacgtggctgcaacaattgttctctgttgcactttctatgtaatcggattttggccgcaaggtggtgatgtaaccagccgtcaattatcttcaacagccaccattttacccaccctcccatgcaacccatcaatcaaaaacacaaatcccaattcccgttcatcgattcccatcgacttcaccgcccaccacaccgctgatgaacttgtaccactctcatcatcggcgcgtgtaaaccactacccatcgtgt

SEQ ID NO: 10356 - DNA, 810 bp, Lycopersicon esculentum
  Predicted polypeptide sequence is orthologous to G831, G1202
ttccaatttcctttgcacctaaagatacacatgaagctcaagttcaatttgccctcgagcgaggagttccagcattgattggcatattagctactaatcggctaccttatcctgcaagggcatttgacatggcacattgttctcgctgtctcatcccttggggaaaatatgatggtctttatttaattgaggttgatcgaattttacgtcctggtggatactggattctctcgggaccacccgttaactggcaagatcattggaggggctggaacagaacagcggacgatttgaaagcagagcaagatcaaattgaaaatgttgcaagaagcctatgctggaaaaaagtaactcagagaggtgatctagcaatttggcagaagcctacgaatcatgtgcattgcaaaattaaccgaaaggtcttcaggaagccacctttttgccaggaacaagatcccgacaaagcatggtacaccaagatagatgcttgtttgagtccacttccagaagtgtccagtgttaaagatgtcgctggagggccactggagaattggccggaaagattaaccgcggtccctcctaggattgctagttctagtatagagggagttactgcagagggcttctctgaagatacagaattgtggaagaagagagtcgcccactacaaggcattggacagtcagttagcagaacgtggaaggtaccgtaacatacttgacatgaatgcttgggctgggaagatttgcagctgcacttgttgatgatccagtttgggtcatgaacatcatccccgctgaagctgaagtc

SEQ ID NO: 10357 - DNA, 740 bp, Lycopersicon esculentum
  Predicted polypeptide sequence is orthologous to G831, G1202
agcgtaccttttgtcaaggaatatcctagctatatcatttgcaccaagagatacacatgaagcacaggttcaatttgctcttgagcgtggtgttcctgctttgattggagttattgcttcgaaaagactcccttatccgtctagagcttttgacatggctcattgctctcgttgccttattccttggggcgaatatgatggcacgtacttgattgaagttgacagagtcctaaggcctggcggatattggattctttcaggtccaccgattcattggaggaaatactggaaaggctgggaaagaacgaaacaagacctaaatgcggaacaaacaaaaatcgagaaagtggctaggagcttgtgttggaaaaagtttgttgagaaggatgacattgctatatggcagaagccatacaatcatttacaatgcaaggaattgcgaaaggcgtccaagaatccaccaatgtgtcctgctcaagatcctgataaagcctggtatacagatattgaaacatgtttaacttccttgcctgaagtttcgagtgaagaaaaggtagctggtggacagttggaaaaatggcctaaaagattacacgcgataccaccaaggattagcagaggaactgtaaatggggtcacgtctgacaccttcacgaggactcacagctatggaaacgaagagtttcgtactaccaaacagtgaataatcaactttcggcacccaggagataccgaaatct

SEQ ID NO: 10358 - DNA, 1722 bp, Lycopersicon esculentum
  Predicted polypeptide sequence is orthologous to G839, G1196
atggagagcggccatgagagttttgctacatcttctaatgtatcaaatgagtgcagtagtccccaggaaccaggaccaaatgttgatcatttgagtaatttatgtggtagtcttgagaaactcctgcttaatcctgaatatgactatagtgatgcagaaattgtcgttgaggggattaatgttggcgttaatcgctgtatattggctgcacgaagtcagtttttccatgaaaagtttaaggagaagaatgagaattccttgaaaaatgaaaagcctaaatatttgctgaaggatttggtgtgtgtttcctcaattggctatgaagtattcatggtcctcctgaattatttatatacaggaaagattaagtcgtctccttcagaagtttcgagttgtgttgataatgcttgtgctcatgatgcttgccgccctgccattaattatgcagtggaactcatgtatgcttcgtccacttttcagataaaagaactcgttatgttcgtagagcgctatctcgacaactttgttgataaggctactcctgaggatgtaattcctatacttttagttgcctttcaccgcaagtctaatcaacttcttgaacactgcatccagagagtggcacgatctgatctagacaatgctactcttgagaaagaactccctcatgaagttttgactgacataaaatcaaggcgcctcaagtctcgacaagggactgaacaggagtcattagactccttgagtgaaaagagaattaggaggattctgaaggctctggagtctgatgacattgaattgctaacactactcctggaagagtcaaacgtcactttaaatgatgcttgtgctcttcattatgcagctgcctattgcaactccaaggttgtgaacgaggtacttgagctgggtttaggcgctgatgtcaatcttcagaactcccgaggatataatgtcctacatgttgcagctagacgaaaggagccatcaataataatgggactacttgcaaaaggagcatccgtcttggatactacacgtgatggacatacagccctatccatatgccgtagattgactcggttaaaggattacaatgatccaccgaagcaaggaaaggttactaataaagaccggttatgcattgatgttttggagagagagatgattaggaatcctatgattgggagcatgtgttcttcatcattggtgttggctgatgaattactcatgaggttgcttttatttgaaaatagagtggcattggcacggatgttatttcctcaggaagccatgctagctatggaaatagcacatgctgattcaaccgcagagtttactggcctttcagcaacaaatggcttatgcaaaaatccgggaggggttgacttgaacaaattaccgtctgagcaagtgaaaagactccaagatcggctgggcgcactactgaaaacagtggacacaggtcgacgttttttcccaaactgctcggaagtattagatagattactggaggatgacaaactagattccttgatgttagaaagtggcacccctgaggaacaaagatcaaagaaaatgcgatacacagagctcaaggatgaagttatggaggcattcaagaaagacaaagctgaaaagaactgggcgggcttctctacgtcttcctcctcttcatgttctccaaagaccaatgtcagtcacaagaatagaaaaaagtag

SEQ ID NO: 10359 - DNA, 1746 bp, Lycopersicon esculentum
  Predicted polypeptide sequence is orthologous to G839, G1196
atggcaagttctgctgaaccatcatcttctataagctttacttcaacttccaacacgtcgaatgggtccattggcataggccaaaacacatgtgcctgtggtggatctgagacagggagtagttatgaaatcatcagcttaagtaaactcagtaataatttagagcaactattgttagattccagctctgagtttagtgatgctgagattgttgttgagggtgtttcactcggtgttcatcgttgtatattagctgcgaggagtagtttttttagggatctttttaggaaaagaaacggaaattgtggaaaggaaggtaagccaagttactctatgattgatatattgccttgtggtaaggttggatatgaggctttccttactttcttaagctatttgtactcgggaaaattgaagcatttccctccagaggcatcaacgtgtgtcaacagtttatgttcccatgactcttgcagaccagcaatcaactttcatgttgagttgatgtatgcctcttttgtctttcaggttccagagctggtgtcactttttctgcgacacctattcagttttgttggcaaggctcttgtggaagatgttatcccaatacttggagttgctttccattgccaaatgagtgagcttctcactcattgcgttgatagagtagcgcgatcagatcttgaaagcacatgtattgagaaggaggttccctttaaagttgcagagagtattaagttatcgcggctgaaatgtcagggtgatgaaagtatggttctaaccgtggatccgttgcatgaaaagagaaaaaataggatatacaaggcattggattcggatgatgttgaacttgtcaagcttttacttaatgagtctgacataagtttagatggagcctacgctcttcattatgctgttgcatattgtgaccccaaggttgttgctgaggttcttggactgggtgttgctaatgtcaaccttcggaatgcacgtggttacactgtgcttcacattgctgccatgcgtaaggaaccctcaatcattgtatcacttttaactaagggagctcatgcatcagaaattacattggatgggcagagtgctgttagtctctgtaggaggctgactaggcctaaggagtaccatgcaaaaacagaacaagggcaggaagcaaacaaagatcgggtatgtattgatgttttggagagagagatgcgtcgcaacccaatgactggagatgcattattttcttcccccatgttggccgatgatctgccgatgaaactgctctacctggaaaacagagtggcatttgcacgattattgttccctcttgaagccaaactagccatggaaattgcaactgctgaaacaacagctgaattcgcggatcatttggcatctaaagcttcatctggaattttgagggaggttgatctgaatgagacacccataatgcagaaagaaagactctcgaagacagttgagctgggcaaatgctactttcctcattgctccgaagttctggataagtttatggaggatgacttaccagacttatttttccttgaaaagggcactccagaggaacaaaagatcaagcggaggcgatttaaggagctcaaagatgatgttcaaagggcatttaataaagacaaggctggacttcaccgctctggctcgtcttcctcatcatcttccacaacttttaacgacggtgcaagtgtcaaagctaggaacctatga

SEQ ID NO: 10360 - DNA, 483 bp, Lycopersicon esculentum
  misc_feature (297)..(311): n is a, c, g, or t
  Predicted polypeptide sequence is orthologous to G849
cttcttcttcttcttcatttttagcatttgttttttatggcttgaaaattcataattctcatacaaaattcatagatttctactcagattggtgaaatcagtgacattggtttattgcatcgggtgatcacttgttggcatgcttctgaagatatggtgtataagaagaagttagattttggtttcaatggctttcaagttccagttatacctaaagctcctagatcagttagaaggagacgttcctgtaaaaaattggatgatgatcaaatttgtgcatttgaattattggcggcnnnnnnnnnnnnnnntttactggagagcgaaagctctacttccagtaatgcagcagaagggaaaaatgaaattgctgatggcagggatggtattaaaagcgaacaagtggaagaaggtaaagctgtgaaatcagagtgccttgaccaggggagttgtgtagaaagcgactatttacccgacactgca

SEQ ID NO: 10361 - DNA, 678 bp, Lycopersicon esculentum
  Predicted polypeptide sequence is orthologous to G849
gctataatggaatttgggattacaatgcttcagcagaccctctagagactgatatgtgcaagtacagcgagaataaccatccatcagagctatcgcctacaaatcctattgattcatcaaccgatgtatctattccagattctagagccttggtgatagtcccttcagttaatgcagaggcacttgctatggttccgctgaaccataaaagtaaacgttctgaactttcacaacgtagaatacggagaccattctcagttgcagaagtagaagcactagttgaagctgtggagcatcttggaactggaaggtggcgtgatgttaaaatgcgtgctttcgataatgctgatcatcgaacttatgttgacttgaaggataaatggaagacattagtacatacagcaagcattgccccgcaacaacgaagaggcgagcccgttccccaggaacttctggacagagtcttagctgctcatgcttactggtctcaacaacaggggaaacatcacgctgaacttctaaaaactccagatgcaaaagcacagaaagttagcgcttgaaggaattcgtcgaattgtcaatgatgtaaagaaactattatattagggtaacacgaagagcacgacgaggaaactgtataaaaggattcgttctgtttctcgtcaactcggttagact

SEQ ID NO: 10362 - DNA, 687 bp, Lycopersicon esculentum
  Predicted polypeptide sequence is orthologous to G849
catttctatccaaaaacaaatccatttagaaggaaaaaaaaactaaaatcaaattcaacataaattaattttcatctattttttgtgcaaattttcgttgtttgattaccaaattctcgaagaatctgtacagaatcacatccagatctctctcatcagcttgaagtgatattggtgtcaacggctcattgtacatgatcatcacatattggcatgctatctgagttatgtcgtcgaagaagagagtaaggcatggtttcagtggctttgaatttcctgttataccaaaagctcctagatcagttagaaggagacactcgcacaaaaatataaacaatgatcaaatttgtgcatttgaattactggcgactgttgctggtgaactattacaggagagcgaaagttctgcttgtagtagtgcagtgataggaaaagataagctctccgattgcagggaagttgtgaaacgtgagcaactcaaagaagataaagctgtgaaatcagagtgctttgaccaggggagttgtgttgaaagcgcttatctaccggaacctgcagtgcaagagccaaatctcaagtatagtttgggataacctaatcgtatagagaatacattttcgcactgaagtagaagcgcatcctctaatcttgaggatgtctatgaacagagaactgatacaggtactc

SEQ ID NO: 10363 - DNA, 2086 bp, Lycopersicon esculentum
  Predicted polypeptide sequence is orthologous to G852, G2633
gaaagaaaaaacaagatattgtgaagaaaaaaaaaaccaaaaagaatatgggattcttcagttttaaggttgtcatgtcttgctgctagggattgtccttccctatacaaattgtgaatgctgctcagctactgatgttggtctcacagtgaagattaaaatcactccaccgtggcacccatgaaaccttgtcaagcgaaaaatccttgacgcccaataaacgtgcagaccaaagagataccagactgcataggtcatatattgacgaggcaggaacaatcttttcaatgcaagcatcacggcgcagaagaacaaccatgtctaatatgctttactgtgaacctgtgcagaaggcagaggcctactatctgcctcagtttcaaactttagaaagccatttgagctgcattaatggcagccttggaggtaatcactccttccagacttatcatgaccgctattgcatgctggaggcgtcttctgccactggaagcaacgctgtttaccactcaccatcaactgctagtttctcatcaaatggaagcacgacgtgcaatcaagaatctcagctgtacctgtcagatgttcgtcagtcccctgagacaactaactatggctcacccataagtggatcttgtattacagatgatgtgactgatttcatgcacaagctaaaggaattggaaacagctatgctgggacctgatgcggacttccaggagagttatgataattccttggcaagcagtatagcttcctcagaaattgatagctggaggcaaatgatgttggccatacctagacgggatttgaaacaggtgcttattgcttgcgcaaaagcagtttctgatggtgaattagtaactgcacaagtgttgatatctgagttgcgtcaaatggtatcagtgtcaggggaaccaattcagagactgggagcatacatcttggaagggcttgttgcaaggttgggtgcatcaggaagttccatatgcaaatccttgagatgcaaagaacccgcaagttttgagctgttgtcttatatgcacgttctttacgagatttgcccttacttcaaatttggatacatgtcagctaatggtgccattgcagaagcaatgaaggacgaaaatagagtccatataattgattttcaaattgctcaagggagccagtgggtgcctatgatccaagcttttgcagctcgtcctggaggacccccacatatccgcataacaggcattgatgattccacctcagcatatgctcgtggaggaggccttgatatcgtggggcagaggctttccaaacttgctaaaactttcaaggtcccttttgagtttcatcctgctgccatgtcgggttctgatattcagctaaaaaaccttggaattcaacctggagaagcactagcagtaaattttgctttcacattacatcacatgccagatgaaagtgtgagcactgaaaatcatcgggatagactattacggatggtcaaaaacctcaaccccaaggtggttacccttgttgagcaagaatctaatacaaatactgctgctttctttcctcgatttcttgaaaccttggattattattcagccatgtttgaatcaatcgatatgactcttccaaggggacacaaggagcgcatcaatgttgagcagcattgtttggcgagggacgttgttaacatcatagcatgtgaagggattgaaagggtagaacgacatgaacttcttggtaagtggaagtcgcggtttagaatggctggttttaacccatacccattgagttcattggtgaacgctacgatcaagacattgctagagagctactctgataagtataggcttgaagaaagagatggtgctctttaccttggttggatgaacagagatttggttgcttcttgtgcctggaaataacaaatggttctttcatagaacttttctctttggtcccttttttttctctctctcatctttgtaacagctgaagtgctaatatatagtaagaaaacaggttccttgtcaagtgtatcacttgatcaatcaaagtaaaagttttattgaaaaaaaaaaaaaaa

SEQ ID NO: 10364 - DNA, 2248 bp, Lycopersicon esculentum
  Predicted polypeptide sequence is orthologous to G852, G2633
gatgtgttcacataggaaatttgcagattgctgttgttgatttttctctctactgtgacacatcttaagatcttctctttctgagttcaacttgacagcagagagcagtatctcccaaatacgacattcagttacagggatcccataccagtttctggttgaattgaggagcagtttttgtaagggattattcaagcagcttcattttgagatttacaacaacaagtgaaccatgtctttagttagatctctaagatcaattggaaatgggaagctgtattttcaaaatggtcacaatgataactctagtttggctacatccatgtacaccaaaaatgcacgcgggattatgtatgcaaccgagtctagcagcacagacagttatgatccaaagtatttgctagaatcaccttcaccttctgaagaacttttaaacacatcacctacagatgtcttggggaatccattccaccagagacattcatcttctttccatccatcaagagattacaatcaggttagttatgattcagcagactgtgtcaatcaaagtccagattcatcagaatataatgatggaagggtgacaatgaagcttcaagaacttgaaagggtacttttcgatgataacgaaattgaaggagatgatgtatttgctcgtggcgagactatggacatagatgatgaatggtttaaccagatccgaacagagttacttcaggagtctccgaaggagtccacatcggcagattctaataccagtagcagtagtagctacaaggaaatatctgtatctgctcctcaaactccaaagcaaatgctgtttagttgtgctgctgctattcaagatggacacattgaacaagcgtcatctatgattaatgaactgaggcagatggtctccatccagggagatcctcttgaaaggactgcagcttacatggtagaagctcttgcagctcgaatggctacatctggcagaggtctttataaagctctaaaatgcaaagaagccacctcttctgagagactctctgctatgcaagtcctctttgaagtatgtccatacttcaggtttggttttatggcagcaaatggtgcgatcctagaggcttttaaagatgagaaaagagttcacatcatagattttgacgttaaccaaggaagtcaatattacactttattgcagacattgggtagtatgcctggtaagccaccccatgtgaggctaactggggtagacgaccctgaatctgtccaacgtgctattggaggccttaatgtcattggtctgaggcttgcacagctggccaaagatcttaagatctcttttgagttccaagcagtctcttccaacactgcattagtcaccccagcaatgttaaactgccgtcctggtgaagctgttctagtaaactttgcgttccagcttcatcacatgcctgatgaaagtgtatcaacggtaaaccaaagagaccagcttctgcggatggtgaagagcttaaatccaaagctggtaacagttgttgagcaagacatgaacactaacactgctccatttctacaaaggtttgcagaagtctacaactactattgtgccgtatttgagtctctcgatgcaactctttcaagggatagccaagagagggtcaatgtagaacggcaatgtctcgcacgtgatatcatcaacattgttgcctgtgaaggattggagcgaatagagcgttatgaggttgcagggaagtggagagctaggatgatgatggctggtttcactccatccccaattagccgaaatgtctatgaatcgatccggaatcttatcaagcaatatagcgaaaggtacaaagcagaggaggaggcaggtgcactttatttcgggtgggaagacaaaaccttgactgttgcttcagcttggaggtagaaacaacatatgctctctcagaaacaaacaatgctgtgcattggagatcaacttgtagcgaaaaccgactgtgtgataatatttcagtgtttatgatcagaatgcatggcattgtatactttgatgctattcttagatacgattaacttctgtgctgatgtaggttgatgtgaaactagtagataaaactgtttttttttgtcttccccattgtcagtttctactttagctagctgtccttacacttcattttagttttctgtccggataattgagcaggatcttagtaattgcagtgattttcttccgaaaaaaaaaaaaaaa

SEQ ID NO: 10365 - DNA, 887 bp, Lycopersicon esculentum
  Predicted polypeptide sequence is orthologous to G852, G2633
acataaggtgcaccgcttggcctggccgcaagagcttgaagaagagtcagccattgagtcccttgtgcaatttggaagtctataatgtgaatgcgattttcatttctacacgcatctgctattgcaccatttgcagccatgtaaccgaactttagataagggcatatctcatataagatatgcatgtaggaaagcaagtcccagcctgctggttccttacatctgagagccctgtatatgttggttccggatgcttcttttcttgctactagcccttctacgatgtaagcaccgagacgctggattggatcaccagtaatggacacagcacttcttgccttggcaatcaatttttcaaaatcatccaagttgttctcagcaagagctctggcacacgcgataagcagctcctttaggttgccaaaaggaatcccctgcgacggataatccaccatcggtttgtgatgctcctcactttgaattatatcccctgatatgccaaaaacagaaacatgtgatggctgcgtttcaattcgatatggaacctggccatcttggtgccacataccggacctctgaccacctgatgcttgtggctgctgaatttcccctgcagaggggctggatgttgtgacttcttctggccccattaaagcggtctctaattgaagcagcgcatgtttcatgttgtgactgtgatttgcatactggagtaaagaattatcaccagaataaaccagaagattgttgtggtggatatctggagagggactaggcctacagaaataatgattataatcccgcgaggaattactgcaaggactagtccctgaaatattttcagtagagctgtgttgctccaggctatcacttaatgtggtaggggt

SEQ ID NO: 10366 - DNA, 746 bp, Lycopersicon esculentum
  Predicted polypeptide sequence is orthologous to G852, G2633
aaagagtttgcgcatagagcagctaatgacagccgtatagtatggactcgcaccatttggttgcttatggtgtgaccggtagtgatttgtcgtattcttcatgccctactgttagtcctctagagaatagaccatttggtacatcgaaatttgattcaggaaattcgccacttgtgaactattttaactctgagaccttcaacacagtaagtgattaccaggagcagcccagctgtacagagaatctttcaggtgctagttcttcaagtggttcctcactggattataaccaatatttccatcgaccaagcccctcggaagatcatcttccagaagctccttacagtcggaacatgaaacatactctgctgcagttggagtctgctttaatggggccagacaaagaggcaatgaaatccagcccttatcttggtgaaaatatgggggcacaaacatcaggtcagaggtataaagcgtggaacaaggaagcccaagttgtgcgtcatcaacaatcagtagtttcaatccttaatggaattcaaagtgataagcgagacaatgtaatggaggacttgcccttgcagggtgttccgtctagcaatctgaagcagctgcttatagcatgcgccagagctcttgctgaaacaagctagatgattttgaaatactggttgctaaggcaaggagtgttgtgtccgttactggagatcccatccagcgtcttggtgcttacattgtagaaggcc

SEQ ID NO: 10367 - DNA, 552 bp, Lycopersicon esculentum
  Predicted polypeptide sequence is orthologous to G852, G2633
ttaatgtcttaactactcacggtggtatctgtttgtgggtctcccatacaacgtttaggtgcttatatgctggaaggtttagttgctagattggcctcctcgggaagctccatctacaaggccttaaggtgcaaagagcctactagtgtcgagctattctcgtacatgcacttgctttatgaaatctgtccatacttcaagtttggatatttgtcagcaaatggtgcaattgttgatgccatgaaagatgagaactcaattcatataatcgatttccagattgctcagggtagccagtggatcaccttaatccatgctcttgcagcacggcctggtggacctccaagaatccgcatcacagggattgatgactctacatcagcttacgccagaggaggagggattgaaatcgtaggtcgaagactgtcaagcattgctgcatcttgcaatgtacctttcgaatttcatcccgtgtctgcttcttgtccagatattgagattgagcatcttaaggttcttcccggggaaccattggctgttaactttgcgctc

SEQ ID NO: 10368 - DNA, 567 bp, Lycopersicon esculentum
  Predicted polypeptide sequence is orthologous to G852, G2633
tggatgttcctcctccactatcttgctcatcgtcctggtggacccccatttgtccgcatcacaggtgttgatgacgacgaatcagcttatgctcggggtggaggacttcagctagtaggcaaaaggctagcagaagttgccaaatcatgtggagtgccttttgaattccatggtgctgcactatcaggctgtgaggtccaactagagaaccttcgggttaaacatggagaagctctggcagtaaacttcccttatatgctgcaccacatgccagacgagagtgtaagtactatcaatcatcgtgaccgcttattaagactagttaagagtttatcccccaaaattgtgaccttagttgaacaagaatcaaacaccaacaccgcccctttacttccaaggtttcgtgaaactcttgattactatacagcaatgttcgaatcaattgatgcagctcgtcctagggatgacaaggagaggatcagtgcagaggagcattgtgtggcacgagatgttgtgaacataatagcatgtgagggagctgacagagtggaaagacatgaacttttc

SEQ ID NO: 10369 - DNA, 673 bp, Lycopersicon esculentum
  Predicted polypeptide sequence is orthologous to G861, G1140
ttggatcaaccatcactttaacttcagcttgtagaaaatagcaactactccagattaagcaaggaaatttccgaaaaaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggtatgcatctaatggaagaaaatgaaaaattaaggcaacaggtgatggagatatctaataataataataataataataatggatatagagaggcaggagtagtaatatttgaaccagaaaatggatttaataataataataatgaagatggccaatcatctgaatcagtaacaaatccatgtaactcaattgatcctcctcctcaagatgatgatagttctgatacttctctcaaattggggctaccttactcaggctgaagagatcaaaagcaaggtgtggctatttttgtatgttattagaagaaggagaaaaaaaaaagtaactactaattattataattaattaatgtctgattaatgtaaaagctaaccccaaaaatttcatattatggatgtaattggtgtattaatctcatgtattcgtctcccattagtt

SEQ ID NO: 10370 - DNA, 644 bp, Lycopersicon esculentum
  misc_feature (302)..(302): n is a, c, g, or t
  Predicted polypeptide sequence is orthologous to G861, G1140
ggcacgagtccatctccaaaattaggtcttacatatttctatactcaattattggcccatttttgtataggttttctaactagatctaaagttttcctcttttattagggtttcttacaatttcttactatttatatcttttgtgagatttcttagaaagtttgaggaaagataattagcttcttcgacctgttaaggatggcaagggaaaagataaaaataaaaaagatagataatataacagcaagacaagtaacattttcaaagaggagaagagggctttttaagaaagctgaagagcnttctgttctttgtgatgctgatgttgctcttatcattttttctgctactggaaagctatttgattttgccagcaccagcatgaaggatattcttggaaagtataaattgcaatcagctagccttgagaaagttgaccaaccttcccttgatttacagctagagaatagcctcaacatgagattaagcaagcaggtagctgataaaactcgtgagctcaggcagatgagaggtgaggaacttgaaggattgagtttagaagaattacaacaaattgagaaaagacttgaagctggtttcaaccgtgtgcttgagattagggtaaacgaataatggatgaaatt

SEQ ID NO: 10371 - DNA, 1245 bp, Lycopersicon esculentum
  Predicted polypeptide sequence is orthologous to G866, G883
atcatgagtagaaccaaatggctgttttatcaaaaatgaatgaaagttttgctgttgaagaagcagcttccgccggtttgaaatcaatggagaatttaatccgattggtttctcatgaaccggttcaggctgattgccgtgaaatggctgattttacggtttcgaagttcaaaaaggtgatttcaattttggaccggaccggtcatgctcggttccggcgaggaccggttcaggctcaggctccggctccggttcaggttagagctccggttcgtggtccggtttatcctgattcgtttacttcgttgtctcttgctccgtcgttaagctttgctacggcgaaggagagacttgctccgtcgttaagctttgcttcggcgaaggagagaccggtggtgcaggtgcagacggcgttgacgcttgacttttcgaagctgaatgttaaccgtccgatcgggaattcaagtgcttttactgcttttactgtgaaatctaaggaggttttaatggcggatccgacgccgacgaactcgtcgtcgtttatgtcgacgattaccggcgaagcaactgtatctaatggtaagcaagtttcttcttctatgttgttgcttccgccacaggctgtgaattttccgaccaccggaaaacgttgccgcgagcatgaacaatctgatgctatctccggcagcaaatccaccggctccggcaagtgtcactgcaaaaagaggaaagctaaggatcggaaagtgattaggattccggcgataagtacgagggtggctgatataccgggagacgagttttcatggaggaaatacgggcaaaagccgatcaagggttcaaaatacccaaggggttattacaagtgtagcagcttacgtggatgtccagcaaggaaacacgtggagcgcgcgatggacgatccaacgatgctgattgtgacttatgaagatgaacattgtcataatccagttgctgcgatgcatgggaacagttctcaaatggtgaattttgggttaatggaaaagaagtagggggtgaaatgaagatagaggagagttgtagggtgattttgtagtttggaatagttggggggttgaagttatatttgggaaaagttataagggttaaaagagtagagagtaggaagttgtgggaattggtttgttatgtaaatttggaaagattttaggggttgaaagagaaaaaaaaagaaaagtttcgcaaaaaaaaaaaaaaaaaaaa

SEQ ID NO: 10372 - DNA, 774 bp, Lycopersicon esculentum
  Predicted polypeptide sequence is orthologous to G866, G883
ccggtttagacgtagtccggttcaggttactgatgattcgtctacggctttaactctatcgccgttgacaaatccggcggaggaaactgtaccggcggtgaaagtaccggttgagaagtatcaatcgaaggcgttgactttagattttacgaaacggaaagttggtaaatctattggatgtgaagctgttccggtagcgagttcgacgacgtcgtcgtcgtttatgtcgacgattacaggtgaaggaagtgtttcgaatggtaaagtgttttcgtcgatgagtttacctcctcgtccgcctgtttcctccgggaagccgccaatcgccgggaaaagatgtcgtgatcatgagctgtctgatgaattttccggtagaacttctagctccgggaagtgtcagtgcaaaaagaggaaatctcgagtaaaaaaagtgatcagagttccggcgatcagttcaaaaactgctggtattccggcagatgaatactcatggagaaagtacggtcaaaagccgatcaaaggttcaccatacccaaggggatattaccgatgtagtagtgttagaggctgtccggcgagaaagcacgtagaaagagccaccgatgatcctggaatgcttgttgtgacttacggcggagagcatcgtcatgttcaaaccacgatctccggcaacgtcaccggcgctggagctggaagttccggcgagagaatgatgggctttgagttaacaggacagaaaaatggagaaagattagggttagaagatttagggac

SEQ ID NO: 10373 - DNA, 635 bp, Lycopersicon esculentum
  Predicted polypeptide sequence is orthologous to G869
ccgcaatttccctctttcatctcaccctaaatacttcattcaattcaacgtattttgccctttttttgtaataacaaaatcgccatggaagttgatcaattgagcagcaagtgacccgaatggtagagtccgacccggatgttgcaccctaaacggatcgtcgtcatcagttaatcagccggtgactggagttgatgagatttttcttctgataacaggtaaagcttataactcctttttttacaacaaaattacatggattctaagaaattagtagttaatgtcaatcaaggggaaacacttgaatatgatgagtgtaatattagtaaaaactgcaaaactaaagcgaatgtaagcttaattggaatccgaaggcaaaagaatgggagatgtgctgctgtgattactgatcgaattaggcataagaaagtatggttaggcacttttgacactgttgaagaggcttcacaagcttatttctctaagaaatctgagtttcagaatgagaaattaaggaatcaaggaaataagaagagtgaaagaaaacgtgaaacgagaagtattgttgaggtttacaagagaggaaaatattattctgagaaatcagatgtaaagcaaggtaatgaaaatgtgaa

SEQ ID NO: 10374 - DNA, 609 bp, Lycopersicon esculentum
  Predicted polypeptide sequence is orthologous to G869
ggaagaacaggaggaaggaggaggaggaaggaggaagaaaggggttgtgatatatgtcggcaaatttctgtttggctgtgattagagctccattgaagctctgggtgtctgtttcttcggtgatatttggtctttgcatgcaacaaatcctctgctgtgatcatcagcagcagggtattactctgtttttcacaactgtttcgatgcgtttgaggcccaaaaggacttgttctggtgttgtttgctttggtggatttcatataaaccgatttttacatcctattttgctcttgagacggccgattacttgaaaatttttgctgagtttttcaaattaaattcaattttatttgtgtttcctgttgaaaaaaaccaattttctgggcatatttcgaggggttttgaagatttgaagaaatcatgaaaatgtccgagtctcggagacaatctcagaaatcgaagattagggaagaatcagcccgacccatgaggaaaatccggatcgtttgtgacgacccggaagctactgattcatctgatgatgaaagggttgatgtatcgaaacccaaacgaattgttagggagatttatcttcctgttgttagctct

SEQ ID NO: 10375 - DNA, 638 bp, Lycopersicon esculentum
  Predicted polypeptide sequence is orthologous to G872
atcggccgaattggcccttatactaattattaatctaactaaagatggtgagggctaaagtaaagaaagagaaaaaagtgaaaggggatcgttataagggtgttcgtatgagaaaatgggggaaatgggtagctgaagtacggcaaccgaaaagccgtgacagaatatggttaggttcttacgatactgcggaggaagcggctagagcttatgatgcagcggtggtttgtttacgtggaccgtccgcgatgattaatttcccggacgatccaccgctgatttcatgtgatgctgataattataagttgtcaccttccgaaattcaagtgaaggcatccagacatgcacgtagtagtagtactagagtaagtgaagagttggctgcagctgctgctaccgtggttgtagaccaccaccacagcagatcagcagctgtggagagtgtgttttttagagatgatttggagtttggatgttcttctttagatcatggggaagtagtgttgcatgatgatttgtttgatagtgctagaatgtggtccttttgatggatgaatcaattcaaacacctaatgttgcttattgatacgtggttgtatttggactagattaaaatgtattcaagtttagcttgtatc

SEQ ID NO: 10376 - DNA, 575 bp, Lycopersicon esculentum
  Predicted polypeptide sequence is orthologous to G872
agcttgggtgcactctcatcataataatcctctaattcaatatccatggaaaacaattctactcatgatcagccaaagttcaaaggagttcggttgaggaaatgggggaaatgggtttctgaagtcagattgcctaacagccgcgacaggatttggttgggctcctatgattctgccgaaaaagccgcaagggcttttgacgctgcacagttctgcctccgcgggcccaaagccaaatttaactttcctgatagtccgccggatatatccggaggacagaggctttcgcccgcggagatacaggctgtagcagctagatttgcgaatgattactcgccgtcagtggtacaggagatacgccgtgatgatcatcatcatgatcacgagggcaatattggaaatattaattcacacgtgataaatatggagaaagatgagatttcactgtcaacaactagttgtgatagggtggtccaaatgggcactagtaatactgttgctgaaatggattgggcttttcataatgatatgatggaaaactattcatacaatgcaagtgggcctccacctgaata

SEQ ID NO: 10377 - DNA, 804 bp, Lycopersicon esculentum
  Predicted polypeptide sequence is orthologous to G872
gcatcaatttaacttcaatttcacaaaagaaaatttaaaatttgattaaaaatggtgaaacccaattcgaaagatactgaattttcacagtcgtcatcgtcgtcgttgtatcggggagtacggaagaggaaatgggggaaatgggtatcggaaattagattacctaatagtagagaaaggatttggttgggttcttatgatacgccggaaaaagctgctaaagcatttgacgccgcactttttttgtttgcggggtaaaggggctaatttcaatttcccggaaaatccgccggagattaggaacggaaggacgatgactccgtcggagattcaatcggcggcggcgcagtttgcgaataatacagaacccgaacttatccgggtcgggccaagggagaattcggatctttcttcttcctcatcggaaatatttcgagcggaatcaccgtcggtgtcagtttccgatagagtagaaagtgaaaagacggaaataaccttgggtaacgattttatcgatgtgtatcgggtggagtctagagtggaaagtgaaaagacggaaatgtccttggataacggatttgttgacatgttttcgtcgttaggaacggttaatgatatgtctgattttggaatttttccggggttcgatgacttatcgggtgaattttttataccaccaccatcgtcaccacaaccatcaccactgcaaatgcctaatttgggatcattagaagaagagaattatttgaactatggatggatttcaatcacagggggacttcatttctttggaaattttgaagg

SEQ ID NO: 10378 - DNA, 689 bp, Lycopersicon esculentum
  misc_feature (645)..(645): n is a, c, g, or t
  Predicted polypeptide sequence is orthologous to G878, G884
gcaccagtggattccttaattctcctggctttctttccccacttcagagtccctttggaatgtcacatcagcaggctctagcacatgttacagcacaggctgaattttctagttcatatatgcaaatgcaaatgcaaatgcaagcccaagaccagtgttcctctcaggtggctccagtagaagcattaggacatgagttgtcgattgatccaaaggagtcttccttgcagataaaggaatgtctgcaatctagtttggataacaagccatcagacaatcagggtaagcaatttgaacagccggaggtttctcaatctgagaacaagacatcctctggtgctctcgataagccagcttgtgatggttataactggagaaaatatggtcagaaaaaggttaaagctagtgaatgccctaggagctactataagtgcacatatctcaaatgtctagtgaagaagaaggttgagcggtctgttgatggtcacataactgagatcacatataatggccgtcacaaccatgatcaaccaaccaaacgaagaaaaaatggttctgctttggataatacagactgctttggagttcgaccagatattagtacacatgattggacagtaatgaatagctcggatgggtcttctncttctcgatctgaccaggttccaacccaaatggtatctgaactt

SEQ ID NO: 10379 - DNA, 706 bp, Lycopersicon esculentum
  Predicted polypeptide sequence is orthologous to G878, G884
ggtggtggaaatatgccctattttagtccaggtccaatgacccttgtctctactttcttctctgaatctgagtacccatctttctcccagcttcttgctggagctatggcttctccattagcaaaaccgcctaccctttttcctggagaagaagagaattgtaaacaagggtataaacagaatcgacccatgaatctaatggtggctcaatctcctttcttcaccattccaaccgcttttactccttctggattgcttaattcacctggatttctttccgcagttcagagtccttttggaatgtcacaccagcaggccctagcacatgttacagcacaggcagcgttatcccagtcttacttacaaactcaagctgaatgccatttcccctcgcaaagtaaatcagtacaagtattaggggcatctgacccagaggagtcttctttacaacctcaattagatactatgtcgtcagaccagaagagtaagaaatttgaactgccacagctttcgcaatctgaggacaaaccatcctttaattcagtcgatagaccagcttctgatggttaccattggaggaagtatggccagaagatggttaaagcaagtgaatgccctcggagctactataaatgcacacattctcaatgtcttgtcaagaagaaaggtgagcgatccattgatggtcacataactgagataacct

SEQ ID NO: 10380 - DNA, 746 bp, Lycopersicon esculentum
  Predicted polypeptide sequence is orthologous to G878, G884
tttcgtataagcaagcgtggactttctagtttctactaaaagtttgttcagatcctatacatacaactttctgtttaattttccaaattgaagagtaaactccaatcatcaaatctccatacaaacacccactttttccaacaataaacacaacaaaaaatcgacaaaagaaaaaaattgatttttttttgatagtttacagagaatttacaaacaagaaatgataaatttattttctacataataaaaatacccagaaattatggccgaaaatgaaggatcatcttcttcttcaacgtcgagaggtcaattactccgtccaactattactttaccgccgagaagttctatggaaagtctattttcaggcgggtcaagcggtattagtccgggtccgatgacccttgtatccagttttttctccgataacgatccagattctgagtgtcgttcattttcacagcttctagccggtgcaatgacacctccggcgggttttaccggtgttagaccgggtttcccgccacttccgccaccatctacggcggcgataactcagtcgccgactgcgtttactgtaccgcctgggttgagtccaactagtttgtttgatgggttcttctcacctggtcagggtccttttggatgtcacatcagcaagtgcttgctcaacttacatctcaggcatcccaggctcagtctcaaatgcacattcagcctaactatcccatctctgcaacggcagc

SEQ ID NO: 10381 - DNA, 1369 bp, Lycopersicon esculentum
  Predicted polypeptide sequence is orthologous to G896
gatctcaactctcaagtagtcaatccactttgatcaccctccatacaatggacagcaggagatgcaaatgccagtggtgtgggatgaagatagcagctcccattggagcacaaacagctacctgtccgaggtgccaatctgtgacacaactccaacctgcaagaaaccatggctttgctaattttcccactgccaataacaatatgagcccagcttttccatcaaggccaggaaggatgtgtgcaaatgctaataattttcagcctcaacaattcaaccgccctatgtcaccacagatcaataatatccgacctcctgcagtacatggacgaaaaagagcggttctgtgcggaatcacttaccgtggccatccaaagagtctgaagggaagcattaatgatgttttatccatgagatattttctggttgagaagttgggattcccaaatgcatcagtacttgtccttacggaggatgagaaagatccatacaaatacccaacgaaggccaatatcagatcagccttacgttggcttgttcaaggctgtcagccaggagattcactagtgttccactactctggccatggcacacgagtacgagaccatgatggtgatgagattgatgggcacgacgaatcactatgccctgttgattttgagacagaagggaggatactagatgatgagatcaataataccattgtcaggcccttaccccgcggagccacacttcatggaataattgatacatgctttagtggaactttcctagatttgccctttttgtgcagaataaacagggcaggatactttatgtgggaggaccatcggatccgctcatacaaaggtactaacggtggaatagcaatctctatcagtgcctgtgacgaccatcaaaattctggagatacaacggctttcacaggctttccaacaggtgccctgacttatagtttcatccaaacattggagcaacagactaaattgacttacggacgcttactcatgagtatgcagaagaagattcatgaagcacagaacggcataggccttgatggtgaaaatgaaactcaggagccccaactatcctcatctgagcagtttgatattcactcgaagatggtggctatataggaacttaaagtatccaactccagcccgagtacaacttccctggcataataaacttgttgtactaataaaatttgtaataaattcaacagtttgttttaccatcgcttgtagattcactcatatagtattgttctggtgtgaatcttggtcatatattttcgttatgtaaactatatagcagtaacactgaataaacttccagatggaaatttgccaaaaaaaaaaaaaaaaaa

SEQ ID NO: 10382 - DNA, 771 bp, Lycopersicon esculentum
  Predicted polypeptide sequence is orthologous to G896
gtaaaagcatcaccattttcaatttatcaaattaattgaaacaagaagaagaaagaaaaaacatgatgatgcttgtcaattgttccaagtgtcacacccccttacaactcccaccaggtgcaaagtccattcgctgcgccatctgcagagccatcacactaattgctgatcctcacgctgctccgccaacacccccttccgcttacaataaccactactatcccccttcttctccttctcctgctcttgctccatctacttatagttccggtcaaaattcatcgtcacgaaagagggcggtcatcgtaggtatttcgtatacgaatacgaggaatgaactgaagggatgtattaatgatgctaaatgtatgaaatttttgctcaccaatcgattcaactttcctcaagactctattctcatgcttactgaagaagagagggatccatacagaataccgacaaaacataacataagaatggcgatgtactggcttatgcaaggttgtcaagcaggggattctctggtgttccattattctggtcatggttcacaacaaagaaattacacccggagatgaagttgatgggttcgatgaaacactttgtccgttggattttgaaacccaaggaatgattgttgatgatgaaattaatgcaacacttgttaggcctcttccgcgtggagctaagcttcatgctattatagatggcttgtcacagtggtactatggcttgacctacccgtttctttgtaggatggacaggactgga

SEQ ID NO: 10383 - DNA, 740 bp, Lycopersicon esculentum
  Predicted polypeptide sequence is orthologous to G898
gggttgttgaatttttttgcagttttgaacaagttcaggaattatactgtcgaagctaacccttgagatatcacgactgtgcaaagcatgagttcccaagaaagtagtgcacaaccaattaggcgtacaaggtcccagtcaagaagaaatactgttctaaatgtggatctaaatgctgcaccgccagctgagaacagaattcaggaaggagatcctattcatgttgtgtctggggatacaccacaaggacgaagaggttcctctttgacagctggagcaattgatgttgaggcacttgatgatgatgtgattatatcatcccctagggcgtttgcagtagctaagaacaactctagaaggaatcaaggacgggttattgtgcttgatgtggattctgaggaccgtgcgtctaggggtaacagtcgcaacaggcatagaagagtctctacaaatcaagcagcaaacaatggtgatattcacatagacctagaaggacatagctgcccaaagagagttgatctaagaagtgcaataccagcaccaccaaaagagcctacattcagctgtccagtgtgcatgggtccattagttgaggagatgtcaacgaaatgtggtcacattttctgcaaggcgtgcattaaagcatccattgctgctcagggaaaatgtcctacgtgtaggaggaaactggccgcgaaagacccataagagtatatcttcctgccacaaattaagtccaa

SEQ ID NO: 10384 - DNA, 648 bp, Lycopersicon esculentum
  Predicted polypeptide sequence is orthologous to G903
ttctaaacagcaaatccttagttttgttagtttctaaaacctcaatatatataagaaattaaaggagccaaaataatctatatttagccttttgctttcattattatttactctttcaatgtcaaactcaaacctctcttctggaaatagtagtgaagaagcagatgaaactccttatgtgttgtctagtacaagtgatggatctagtgctcatcaacaacattctcaaactaataataagaaaagaaggaaattacctggaaatcctgatcctagtgctgaagttattgcgttatcaccaaaaacactaatggcaacaaacaggttcatctgtgaagtatgcaataaaggcttccaaagggaacaaaatcttcaactacacaggagaggacataatttaccatggaaactaaagcaaaaaacaagcaatgagattaaaaaacgcgtttatatttgcccagaaagttcgtgcattcatcataatccttctcgtgctcttggagatcttacggggattaagaaacatttttctcgtaaacatggtgaaaagaaatggaaatgtgaaaagtgctctaaaaaatatgcagtgcaatctgactggaaagctcattcgaaaacctgtggcacaaaagagtataaatgtgactg

SEQ ID NO: 10385 - DNA, 888 bp, Lycopersicon esculentum
  Predicted polypeptide sequence is orthologous to G912, G2107, G2513
ctatttttagctctcaacaacaatgaatatctttgaaacctattattcagactcgttaattttaaccgaatcatcttcttcttcatcgtcatcgtcgttttctgaagaggaagttattttagcttcgaataacccgaaaaagccagctggcaggaagaagtttcgagaaacacggcatccgatatacaggggaatcaggaagaggaattcaggaaaatgggtttgtgaagtcagagaaccaaataagaagacaaggatttggcttggtacttttcctacggctgaaatggcggctagagctcatgacgtggcggctttagcattaagaggccgttctgcttgtttgaatttctctgattctgcttggaggctgcctatccctgcttcctccaactctaaagatattcaaaaggcggccgctcaggccgtcgaaatcttccgatcggaagaagtttcaggagaatctcctgaaacgtcagaaaatgtgcaagagagtagtgacttcgtggatgaggaggcgatctttttcatgccaggattacttgcaaatatggcagaaggacttatgctacctccacctcaatgtgcagaaatgggagatcattgtgtggaaactgatgcctacatgataactttatggaattattctatctaaaatagtagtacaatttatcaaattactaggatttagaagattttgttagtttttggtattcagtatttagatactaagaatgtatattattagtatttttattttggccaaatacatgaacatgaacagaaacttgttgggtttttttactcaggtacctcaactacatcatttttctattgattattgaactacacataatttgtttctttaaaaaaaaaaaaaaaaaaaaa

SEQ ID NO: 10386 - DNA, 716 bp, Lycopersicon esculentum
  misc_feature (636)..(636): n is a, c, g, or t
  Predicted polypeptide sequence is orthologous to G912, G2107, G2513
cgtccatccatcgtacactactatattttactctctcgtcaaaatagtattatcatatcatggatatctttgaatcctattattcaaattctttcgttgaatcattattatcatcgtcattatcaatatctgatactaataatctcaatcactactcccctaatgaggaagttattattttagcttcgaataacccgaaaaagccagctggcaggaagaagtttcgagaaactcgacatccagtatacaggggaatcaggaagaggaattcaggaaaatgggtttgtgaagtcagagaaccaaataagaagacaaggatttggcttggtacttttcctacggctgaaatggcggctagagctcatgacgtggcggctatagcattaagaggccgttctgcttgtttgaatttcgctgattcagtttggaggttgcctatccctgcttcctccaactctaaagatattcaaaaggcggccgctgaggccgccgaaatctttcgatcggaagaagtttcaggagaatctcctgaaacgtcagaaaatgtgcaagagagtagtgacttcgtggatgaggaagcgctgttttccatgccaggattacttgcaaatatggcagaaggactcatgctacctnctccccaatgtttagagatcggagaccattacgttgaattagctgatgtgcacgcttatatgcccttatgggattattct

SEQ ID NO: 10387 - DNA, 647 bp, Lycopersicon esculentum
  Predicted polypeptide sequence is orthologous to G912, G2107, G2513
gagagaactcgccacccggtttataggggagtgaggaggaggaataataacaagtgggtttgtgagctacgtgagcctagtcaacagaaaagaatatggctagggacttactctactcctgaaatggcggctcgagctcatgatgttgctgcattagctcttagaggcaatctagccactctgaactttgctgactctcgatggggattgccagtgccggcatcaaaggaccccaaggacatacgacaggcagcagttatggctgcacaagctttttctcaggatactgaattagtcggagttgactatatgaatgaggaagttaattccaataccatcgatgaaataaagtatcaagagatagatattgcgagggctaatgatgggagtagtagtgattttggcgcaaaggaattgtgtatagatatggagaacattttatgttgtaactggggagaagataacgacatgttggagatggaaggatggcaagaaaagatggcaaaggggcttttgttttcaccaactccgcgtttaggtagttgtttcagttgggatgatgtagaaagcgacgtggaggtgtctttgtggagttatagtatttgatactaagtagccaggtagttaccagctaggagtagcatttt

SEQ ID NO: 10388 - DNA, 584 bp, Lycopersicon esculentum
  misc_feature (499)..(499): n is a, c, g, or t
  Predicted polypeptide sequence is orthologous to G913, G976, G1753, G2514
cctaccaccccacccccctatagaaatctacatatacatacacacacacaaaaaaaaacatatatatatatggctgactctcaaaattctaccaagtccacccaaataattcaacctcctaatcaatcaagtgaaagtacgaaaatacccttcaacactacccttcctccaccactaccaccgttgccgccgcctccggcgccaccggagacacatattcaaataaccaatacattatcatcaaaattagaaaacacaaatacaactccaaaaaccgttattattccaactgcaatcatgagttccacctcatcgagcggcttgggatctccgagccgctcaataggcggaaaacatgcggtattccgcggaatacgatgtaggagtgggaaatgggtgtcagaaattcgagagccacgtaagactacgagaatatggttaggtacttatcctacacccgaaatggctgctgctgcatacgacgtcgctgcaatggctntaaaaggaaacgacgccgtaattaactttcccggtaatattaattcgtatccttcactccctccttcgcccgccgcggcggatat

SEQ ID NO: 10389 - DNA, 884 bp, Lycopersicon esculentum
  Predicted polypeptide sequence is orthologous to G921
tcaggatcagaacagcgatggatcgaagaaaattaaaattgaaaacaacaacaataataataataataatgaaattgtgaaatcgtcagttcaagtgttgaattcagagagcagctcaagtgatgaagattcatctacaaagaaaccaagagaagaacacattaaaactaagacttcaagagtttatatgagaactgaaccatctgatacttctcttatagtgaaagatggataccagtggaggaaatatggacagaaagtaacaagagacaatccatctccaagagcttatttcaaatgctcttctgctcctacctgtcccgttaagaaaaaggttcaaagaagcgtggaagaccaatcgattctagtagcaacctatgaaggagaacacaaccattctaaagtggataccgcaggccctgttacaacaacttccccgtctagccgatttaacccgaaaaataatacttatgctgctgcggtaatgccaagacaaaccttaactcttgatttggcagaaccaaaaacattacaaaatgatatcaaaaaagttcatagcattacaagtacaagtagtgcaagtggtcagaagcgtaaatcaccaggaactgatcaacaacagcaaaatagaccagagtttcaacatttcttgatagaacaaatggcttcatcattgactaaagatccaagttttcaagcagccttagcagccgccatatcaggaaaattcttgcaaaataatagtaacactaaggataaataattaaaacgaaaattatgttgacacattgaaatgttccagagaaagacaggcagccactaggacatgtcgttataaattgtatatattgtttactatactcgtctctttttttgggagaaca

SEQ ID NO: 10390 - DNA, 782 bp, Lycopersicon esculentum
  Predicted polypeptide sequence is orthologous to G921
cttgaactttgaatactttaattattttaaataataaaaaaagcctaaaattcaattaatataaaatagaggaagtattttattagtggttgtgcaaataaaaacatgacaaatagaagacaaaagatggagttagatggagcttcatgggttcggacgaactcagtagctttttcataaaccctacacttgtattaaaaatttaattaaatatttatgtatattaatttatgaatcactaacaaagttaattgacgtttgttaacaaaatttagaaccccaaaacacttaatccccgcttcggctatgaactagaaggagtaaatgcttggaaaaggatgtgtttactttaatgttcccacctaacataagagtatagaaatgaaataacattactatactaagtatttaattttgtgttgtctaaatttcttttatattaataggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctagttttgcagctacagttgctacagccatctcaggattacttttttgaattatatgatgatttaattacctttcaatgacacaaaatactgtttgttgagaggatttaaatggtaatgtatta

SEQ ID NO: 10391 - DNA, 787 bp, Lycopersicon esculentum
  Predicted polypeptide sequence is orthologous to G921
tatggtggtgaaaaatgaggcaggggatttgttagaggaactaaacagagtgagtagtgaaaacaagaagttaacagagatgcttactgtagtttgtgaaaattacaatgctttaagaaaccaaatgatggagtatatgagcacacaaaatggtgtagctgaagatactagtgcagggtcaaggaaaagaaaagctgaaagtatctctaatcctgttaacaacaacaacaataataataacaatatggatgttgttcatggacgttcatcagaaagcagttcgagtgacgaagagtcctgttgcaagaaactcagagaggagcacataaaagcgaaagttacaattgtttctatgaagactgatgcatctgatacctctcttattgtaaaggatggttatcagtggagaaagtatggtcagaaagtaactagagacaacccttgtccaagagcttacttcagatgctcatttgcacctggttgccctgtcaagaaaaaggttcagagaagcattgaagatcagtctattgtggtagcaacatatgaaggagaacataaccatccacaaacctcaaaaccagaatcaggtccaagtactaatacttccacagccagccgattaaatgtgacaactatcgcgggcactactacttcagtcccttgctctaccactctcaattcctcaggaccaaccattactctcgatcttactgcaccgaaaacagtggaaaagcgcgatatgaagatgaatcacagtactactagtcctaccagtgggcatagcatt

SEQ ID NO: 10392 - DNA, 749 bp, Lycopersicon esculentum
  Predicted polypeptide sequence is orthologous to G922
ggtggagataccatgcaaaggattgcttcatattttactgaggctttagctgataggattctaaggagttggcctggtctttataaggcgttgcgttcgactaagttatcggttgtctcagaagaaattcttgttaggaagatgtttttcgagatctttcctttcttgaaggtggcgtttgtggtcacaaatcaagctataattgaagctatggaaggtgaaaagatggttcatattgtggatcttaatgctgctgaacccctgcaatggcgtgcgttgcttcaggacttgagcgcgcgtcctgaaggaccgccccatctgcgcattactggggttcatcagcaaaaagaggtgttagatcaaatggcacatgtgcttactcaagaagcagaaaaactggatatcccttttcagttcaatcaagtagttagcagattggaaaatcttgatgttgagaaacttcgcgtgaaaacgggggaggctcttgcgattagttcaattatgcaattgcacacccttctagcccatgataatgacaagaagtcccctttgccttttaagcattcaaatggtgttaacttaaacagggcactagtcaaccaaaatactttaggggaatttcttgaaaaagatatggctaatggttgcagtccaagcaatgacaccgcttcttcatccccgctatgttcaactggttcaacaagatggatagtttcctcaatgctttgtggggtttatcaccaaaagtt

SEQ ID NO: 10393 - DNA, 1413 bp, Lycopersicon esculentum
  Predicted polypeptide sequence is orthologous to G926, G2632
gaatcactaatcactcatcacttctctcttctctcttctctctcatacctcctacgtgcaggacactcatattgtggaactctgagagtaaaactacagcagtatgccatcaaattccaaaagcacaaatcgggaggaaaccaatgcatataatgttccacgttccactgtatatcctgaaccttggtggaatggtgctgtttatactcctgtttcccctgggttgatgcgggaaaatgcatcagattcatcatcattggaacaatccgtggatggccaatctcagtctgatggtggaatcaatgaggaagatgatgatgctcctgaaaaatcacaaagtgtcgtacctttgcatgcagatgggagttatgggaaggcggatcagaattttcagccagctgctccagccatacctccaagacttgatggaagcctagcacagccccagcagcttgaacttgttggacactctattgcgtgtgctccaaacccatatgttgatccatactatggcgggatgatgacagcttttggccagcctttggttcctcctcatgtacttgatatgcactatgcaaggatgcccttgccacaagaaatggctcaagaaccagtttatgttaatgctaagcagtatcgaaggatcctgcagcgaagacagtcacgtgctaaagcagaacttgaaaagaagcaaataaagggtagaaagccatatcttcacgagtctcgacatcagcatgcactgaggagggtaagggcctcgggtggacgttttgccaaaaagacagatgcttctaagggtactggttctgtgagttcatcgggttctgaacctttgcagttcaatgctgctgatactcaaaagaggaatgaaaatggaaggttggccgagcttcagcagtcttattcaaatggtagcagttatggcaatcaaagtagctttcaagaatcaaaggatgagtaccagtctgctgaaagcagggaaggaggtttttctgtcaagtaattggagatacgttcatgtctaaactagctcttgcactgcaacgaggctagagtatgaacaagaggagtttacaggtattgtttcatttcttggcttttcaagctaggcggcaattcattcttggctttttactttagtgttaatgggagcaacagaggtgacgagcgtatcagtgttgcagcatttgcttggagattacatcttcccttatgtacagagatggatgaacttagaactaggattagaaagtttttcaagtttatgtttggccagttactgtagttttagtttaggagaccatgtaaaaaggttgttagttttgcatacgtatcttttttctttccctaattgttgcattaatttctgagtttggtttgttttgatgcaaaaaaaaaaaaaaaaaaaaa

SEQ ID NO: 10394 - DNA, 763 bp, Lycopersicon esculentum
  Predicted polypeptide sequence is orthologous to G926, G2632
cttgaaaggggtttttctttaactgctgtcatccccagaaaaagaaagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacacaacggagactcaaaaatatggggcaaccattgcaactcactctggcaactcttctgggttccgggaagtctgatcaggggggaaaggaaggatctacagttcaagaca

SEQ ID NO: 10395 - DNA, 795 bp, Lycopersicon esculentum
  Predicted polypeptide sequence is orthologous to G928, G931
atcggccgaattggggagaaaacagcacagatagcatcaaaactcagcagatgtatggatccatctttcattatccaaaccaaaaggtatctccagtctagagagctatagtatactgcagtagcatataggttttccatatattcggtgtaaagcttctagagcaccggttttgaagaggatgctaagtttctcaaagaaaggtggccctggaaaagaaggtcaatcttttgctcctttgtttgtgagttgctcatctatgtggaattccagcgacaaagcaaaatatgctccctctaagaaggtgctgaccggagtggaatctgcattggaacatcactccgacatcaagaaatcagaatgccagttccaagatcaggattcaacgtctactctgtcaactggtcaatctaatcatgtggaggccgcaatgggaaaaagcaatactgttcttcaaaatgttgcagttcatccaggttggggtggaacttatgaggtgcaagcagagagtggaacaaacgcatcccgatcaggcgaaagtgacaccaacactctcccccagccacaagtgaatcataatcatccaatggcttgcgtatcctaccctttcgctgacacttactttggaaggctcgtgactgcttatggatcaaatgccatcatttatcctcaaatggttggtgtcacctctactagagttgcacttcctcttgaatgcaccgagagcttgcccatttatgtgaatgcgaaacaatacagtgctattctcaaaaggcgacaggtccgtgccaagct

SEQ ID NO: 10396 - DNA, 573 bp, Lycopersicon esculentum
  Predicted polypeptide sequence is orthologous to G928
ctgatgtgacaagtatcttcagtggtgacaacatgttccagcaaccagagttcagagtctctggcttcccttttcacattcaggaagctgaagacttcctgcatgttggaacctgacagcacacttgtgttatccatggtggcggtgccaatacaggctgcattacaaatgcattcttattggtgcacacaaatggataatcggcagttcatccttggctatgttactcttccttttcctgaattgaaatcatgaacacttttcctaaagctttagttgtgttatggtatatgtttcatagttaaatgagaaagagcgcaggttggtgccgcacgtgatcaagaagggcaaggaaaagagaaaaatatattggtcttaatgagaaacagtggagattaaggctgtaaaagaattctccttttcttggtcgagcgtgtgtgtatcatcttgcacttctaagtctgtacttgttagtgtcatttgcatttgtggttttcatttctgtgctatgtattgtatcactgttaatatgtttaactcaggctttgtgcaacaaaatgaacttgttgaatc

SEQ ID NO: 10397 - DNA, 1244 bp, Lycopersicon esculentum
  Predicted polypeptide sequence is orthologous to G929, G2344
aaaagaatagtaacagttacaaacacgtagtaaagctctctctagagaaggaaattcaacagagaacaccaaaattaaagctgcttattggttttcgtatacacgaagctcttcccgaaaggtttgttactttggagattctgtggcaagcagcattatgacgtcctcgcttcattatcattcagatggtagtgagaatgaacagtcagaaaatcaatcagaagcccacagcgagtcttcatcgcctgcagctggaatgtctgtccctggcactgtaacaacaaatatgcactatgttatgcccaatcaacttgggaatggaaatcctatgttgcaggctcaaacagcttatccatatccagacccatactataggagcatctttgcaccgtatgatgcacagccttatcctccacaaccttatccagcacaaccaatggttcacgttcagctaatgggaattcaacaagcgggtgttcctttgccatcagatgcgatagacgaacctgtttttgttaatgcaaaacagtatcatggcatcttgaggcgtcgacaatctcgcgcgaaagctgagtcagaaaagaaacttctgaaagctaggaagccttacttgcatgaatcacgccatttgcatgcattgaaaagagctagaggatgtggaggtcgtttcctgacagcaaaggaaactgataatcagcagaaacaggatgaatctggtgataaatctcaagtcaacattaatctcgagtctggaaaagacaaggtcgcttcttcagagaatgcctcttgatctatgcaatatcaaggactttgtggaccatagtatgttgttactgtttgtagaaacagcagtgcttttgtttaaatagaattgtggtagctgggcaaaatcagggtaattgtggtgttctgtatgtttatctgagtgtagatagatcggaataggcctactcgtttgagagctacaaagtggccgctgggcgtatgttctctaaataccatctctctgagcttgtttgtagacattctttcttgtcctttcgtaattgccttgtgattccttcaaaatgttgttctggtaagtgtatggaatatcgagtcagaaatttgagtaataacgtttggcactacgttttgttagtttaagaagataagcgtgcagcactgttggttgatgaattctaattttccaaggtcaatgcattctgtgtcaatatcttggttatctaaaaaaaaaaaaaaaa

SEQ ID NO: 10398 - DNA, 2402 bp, Lycopersicon esculentum
  Predicted polypeptide sequence is orthologous to G938
atagtctcttaaaaaatggtcaaattattattctcctaagtagagaaaaagagtttaatcaaattttttcaaatatcataaattcaggattaaatatcgcgtaatttggattgatgagtgttgagaaaggacaggataatctgtgaaaaaattgggtgttagctgctagttctgtttagatttcttgacgtttggtgattagttttttggaggagtttgttcttgtgaagatgatgatgtttgaggaaatggggttctgtggggatcttgatttctttcctgctccgcttaaggaagtggaggtggctgctccacagactgaggcagagcaggtggtggatgatgattatagtgatgaggatattgatgtggatgagctagagaagagagtgtggagggacaagatgaagctgaaaaggctgaaagaaatgaatcaggggatggaagatgttgattctgtcaaacgacgccagtcacaggagcaggcaaggaggaagaagatgtcgagggcacaggatgggatcttgaagtacatgttgaaaatgatggaagtatgtaaagctcagggttttgtttatgggatcattccggagaaaggcaagccggttggtggggcatctgataatcttagggagtggtggaaggataaagtgagatttgatcgcaatggccctgccgctatagccaaataccaggctgagcatgctatcccaggcaagaatgacgtatcaaatccagttggtcctacccctcacaccttgcaggagctgcaagataccacccttggttcgttattatcagctttgatgcagcactgtgatcctcctcagagaagatttccattggagaaaggtgtttcacccccatggtggcctacaggacaggaggactggtggccacaattgggtttgcagaaggatcaaggtcctccaccttacaaaaagcctcatgatctgaagaaggcgtggaaggttggtgtcctaacagcggtgatcaagcacatttcccctgatattgctaaaatccggaagcttgtgaggcagtcaaagtgcttgcaggataagatgacagcaaaagaaagtgcgacttggcttgctatcatcaatcaggaggaagctttggctcgagaactataccctgatcgttgtccacctttatcgtcagctggtggtagtggaactttcactgtgaatgacagcagtgagtatgatgttgatggtgctcaagatgagtgtaactttgatgttcaagagcaaaaaccacaccatctcaacttgttgaatgtcactgttgagagattcaacgagaggcagcctctgcaacaacagtctcatcctatcaaggatgaaataatcaccagcttagatttcacccgcaagaggaagcaatccaatgaacagactgttaccatggctcagatttatacatgtgagattcttcaatgtccttacagtgaacttcgccacggttttcaggacagatctgcgagagacaatcatcaactggtctgcccttatagaaacacttctcaatttggagtttcaaagtttcccatgaacgaagtcaagccagttgtcctccctcaacaatatatcccgtcaacttcagttgctctgcctgttaatccaagtccacctccttttgatctatttggagtaggagttcctgaagatgggcaaaggatgattgatgaccttatgtcattctatgattgtaatatacaaggaaacaaaagccaaaatacgggaaatgttgcagtgaccaaagagcagcagcctcatcaacaacctcgtgttgaccaggtcaattacctacacagtcgagggatgatggaggggaatatcttcaaagacattaatgtttccgcaagtcagtctatgcagccacaaggcaatcttgttgatcaatgcaagatcctaaattcaagtgacaatttgcaattcatgtttgggcctccattcaacttacagtccaccaattaccctggaagtctgcctggcattggatgtgacaccacaccgaagcaagatattccaatttggtactagccatgatattggtgaaacgtatatagtcagtcggggcttcatagatatagcttgttccccgagattggcacaccccattataattggtcttcattatcaggtggatttttaatcgcttacaactctcttagtcaagatatttcctgttaccatatgttttagagggttgaaagctaggcggcatggtgtaattgaggagaaggaagagaccccctccaagtattagccaatgctgcttatagaatgtatagatatctgataaataagttaagactatcttgttatcttgtgttgaaattttggtttaatccaaaaaaaaaaaaaaaaaaaaaaaaaaaaaaaaaaaaaaaaaaa

SEQ ID NO: 10399 - DNA, 2207 bp, Lycopersicon esculentum
  Predicted polypeptide sequence is orthologous to G938
ggcacgagcctctcttcttcttactttccaatacacaacaaaagtgaaaacatcacttcaatacacctaacattcttctcaaaccccttctctttctctcttttttcttttttttttggttcaaaatcaaagtagtatagccatagataacagcttcaacaagctgttttcaagaaaatcataatttggtaaatggggatatttgaagatatggggttctctggaaattttgagtttctatctgattctatgggatgtggagctcaagaagttgagcataagccggttgggttggaggaggatgattatagtgatgaggagatggatgtggaagagctagagaggaggatgtggagggatcgaatgcttttgaggcgtctcaaagagaaaaacaagaataaagtggtgggggatggtgcgaagcagcgtcagtcgcaggagcaggctcgtagaaagaagatgtcgcgtgcacaagatggtatactgaagtacatgctgaaaatgatggaggtttgtaatgctcagggttttgtttatggaattatccctgagaaagggaagcctgtgactggtgcttcggacaatcttcgtgcttggtggaaggaaaaggtcagatttgatcgaaatggccctgctgctattgctaagtatcaggctgataatcagattcctgggagagttgaggaatcgagtgtgatagtttccactccccacactttacaggagctgcaggatacaactctaggatcccttttgtctgctttgatgcagcactgtgatcctccacagaggcggtttccgttggagaagggggtatctccaccctggtggccctctggtaaagaggaatggtggggtcagttgggtctgccaaatgatcaagttcaacctccatacaagaagcctcatgatctgaagaaggcctggaaggttggtgttctgacggcggtaatcaaacacatctctcccgacattgctaagattcgcaagcttgttcgacagtcaaagtgcttgcaggataagatgacagctaaggagagtgctacttggcttgctattatcaatcaagaagaggctttggctcgtaagctgtatcctgacagctatccacagggatctctagctgttggtaatggttcctttttcatcagcgatgctagcgattacgatgtggaaggagtggataacgagagaaacaatgaagtggaatgtaaaccccatgacatcaatctccaaactggaattatgttacctaaagatagggttttgatgccaggtttagctccagtgaaaggagaaattattgatttaacttccgattttatccagaagaggaaggaaccatgttttgaggagtctgttgatcaaaagatatatacttgtgagtaccttcactgcccatacagcaattatcaagctggattccttgacaggacttcaagaaacaaccaccaaatgagttgtccattccggttcaattctgctcaaacacttactacacctaagtatcagatcaactatgagcacaacacagtttttcctgcacaaactgcaacttctaagccagcggtctcgtcagtcactgcttcctcttcgatgagtgcctcggggcttggactccctgaagatgatcagaggatcatttctgacctcataacatcatacgacaacaactttcagcaaaatggtagcatctgttccggaatttctgagattctagtaaaccaaagcctgcctcagcaacaaacagttgaacttcccatggatggcaacatcaacctaggacatatggagacctcagctcaagaaaccagcatgcctgtttatcgttcaacagagtttcaatatgatcaatgcaaaatgtcctttgacgcccccttcggtggaaacataaatgatataactgattacagattcggttccccgttcaacttgggaggaagcgactacgccgtggaacagctgacaaagcaggatatatctacatggtacctctgaactagtactagtattaaactgtcttatttcctatatgaaggcttgataggttgtatatgtttagataagtgatcaactctctgtcctttatatatacaggtattgtagtttctttgtgatgtagttgatgtttccatggttgtaagtgctaaacacaataattatctttatgcaattatgttttaaaaaaaaaaaaaaaaaaaaaaaaa

SEQ ID NO: 10400 - DNA, 2509 bp, Lycopersicon esculentum
  Predicted polypeptide sequence is orthologous to G938
ggcacgagtctaccttctatattctgaagggtcaattcttgaacaaaattttggaagcaaaaagaagaaacccctttgaggttgctggtttttttcaaaccaaaatttggctgccaagatgatgatgtttgaagacattgggttttgtgctgatcttgatttcttccctgctccgctgaaggaggcggaaacagtagctgctgttccaccaattgtgccggagccgatgatggatgatgatgatagtgatgaggagatcgatgtggatgagctggagaagaggatgtggagggataagatgaagctgaaaaggctgaaagaaatgagcaagggcaaggaaggtgttgatgctgtcaaacaacgccagtctcaggagcaagctaggaggaagaagatgtccagggctcaagatgggatcttgaagtacatgttgaagatgatggaagtctgtaaggctcagggttttgtttatggaattatcccggagaaaggcaaaccggtgactggggcatcggataatctcagggagtggtggaaggataaagtgaggtttgatcgcaatggacctgctgcgatagcaaagtaccaagctgacaatgccatccctggcaagaacgagggtgctaatccgattggtccaacccctcataccttgcaggagcttcaagataccacccttggttctctactgtcagctttaatgcaacattgtgatcctcctcagaggcgatttccattggaaaaaggtgtatcacctccatggtggccaaatggacaggaggattggtggcctcagttgggactgccaaatgatcaaggtcctccaccttacaagaagcctcatgatctgaagaaggcttggaaggttggtgtcctcacagcggtgatcaagcacatctcccctgatattgctaagatacgcaagctggtaaggcaatcgaagtgcttgcaggataagatgacagcaaaggaaagtgcaacttggcttgccatcatcaatcaggaggaagttttggctcgcgaactttatcctgatcgctgtccacctttgtcctcaggtggtagtagtggaaccttcactatgaacgacagcagtgagtatgatgttgaaggtgctattgatgaccctatctttgatgttcaagagcaaaaaccaaaccatctcagtttgctgaatgtcaatgttgagatgttcaaggagaagctgcctctgctacagcagtctcagccaatgaagggtgacatttttgccaacttagatttcactcgcaagaggaagccggctgatgacttgactttcctgatggatccgaagacatatacttgcgagtgtcttcattgccctcatagtgagcttcgcaatggttttccagacagatccagcagagacaatcatcagctaacttgcctcttcaggaatacttctcaatttgtagttccaaactttcacatggaggaggtcaagccagttgtcttccctcaacagtatgctgagccaaagcgggcttcgcttccggtcaacccagctccaccctcctttgatacatctggacttggggttcctgcagatgggcagagggtgatcaatgagcttatgtcattctatgaaagtaatgtgcaaggaaacaaaagttcaatggcggggaactctgtgatgtccaaagagcagcctcttcaacaacctagcattcaacagaacaattaccttcaaagccaagggaatgtgttggagggaagcatctttggggacaccaacatttctgctaacaactccatgtttgtgcagggtgatcggtttgatcagagcaaggttttaacttcaccattcaatgcaagctctactgatgatttcaatttcatgtttggatctccattcaacatgcaatccactgatctctctgaatgtctttctgggatttcacatgatgacgtgacgaagcaagatgcctcggtttggtactagcaatgcgattactcaaatgaacatcaagcagtggatatcacaatatacctttaatcaggtggatttcagtttgcctatagttctcagtttggtttttctgttaccatgtagttgtagaggttggaggatcgtgcatgacgttattacaagggagtagtaagagatgtcatgctgctggttagaaggaacttatagatgtttctaaataaggtttagcagtcagtttattttcatatatgtctataactctatataggttttagctttatcccatagtcaatcgttggtttcggagatatttaaacgcttttgtccctatatctggttctggaaatgttacaaattacctgcaggtgcagctgcaggtctttttgttatatgttatagtactatttgtcatggtggtggtgtaatatatacatatgtgttggccaaagctgtgtgatatgttgttagcatcctatataaggccatggcttgacaataaaatgttatgatgtattttggtatgtcctcttttcaccataaaaaaaaaaaaaaaaaaaa

SEQ ID NO: 10401 - DNA, 2458 bp, Lycopersicon esculentum
  Predicted polypeptide sequence is orthologous to G938
ggcacgagctgagttccagttgaaccacagttttgcaacgacataaaaaaagtgatctttttgaggctcatgtaatttgatcaatttcaattagattctgatctgaatattggattttgggtattagctgcttaatcctgtggaagttgcaagtagcttcacctttttcatcctgtggaagatgatgatgtttgaggaaatggggttctgtggggatcttgatttcttccctgctccgctgaaggaagtggaagtgtctgctccgcagagtcagactgagccggattctgtggtggatgatgattatagtgatgaggaggagattgaagtggatgagctggagaggaggatgtggagggacaagatgaagttgaaaaggctgaaagaaatgagtaaaagtaaggaaggtgttgatcctgcaaaacaacgtcagtcgcaggagcaggcgaggaggaagaagatgtcaagggcacaggatgggatcttgaagtacatgctgaaaatgatggaagtatgtaaagctcaggggtttgtttatgggatcattccggaaaaaggcaagccagttagtggggcatctgataatcttagggagtggtggaaggataaggtgaggttcgatcgaaatggtcctgcagcaatagccaaataccaagctgatcatgccatccctggcatgaacgaggggtctaatccagttggtcctacccctcacaccttgcaggagctgcaagataccacccttggttcgttattatcagctttgatgcagcactgtgatcctcctcagagaagatttccattggagaaaggtgttccaccaccatggtggcccacaggaaaggaggattggtggcctcaattgggtttgcagaaggaccaaggttctctaccttacaagaagcctcatgatctgaagaaggcgtggaaggttggtgtcctaacagcggtgatcaagcacatgttccctgatattgctaaaatccgcaagctggtaaggcagtcaaagtgcttacaggacaagatgacagccaaggaaagtgcaacttggcttgccatcatcagtcaggaggaagctttggctcgagaactctatcccgatcgctgtccacctttgtcctcagctggtgttagtggaaatttcatgttgaacgacagcagtgagtatgatgttgaaggtgctcaagatgagcctaactttgatgttcatgagcaaaaaccaaaccatctcaatctgttgaacatcagtgctgagagattcaaggagacgatgcctcttcagcaacaatctcatccaaacaaggatgaactggtcacaaacttagacttcagtctgaagaggaagcaagctaatgaacctactgtgatgatggatcaaaagatatacacatgcgagtttcttcaatgccctcacaatgaacttcgccatggttttcaggacagatcttccagagacaatcatcaatttgcttgcctttaccgaagttctacctgttttggagtttcaaactttcagattaatgaagtcaagccagttgtgttccctcaacaatatgtccagccaaagtcatctgctctgcctgttaatcaaggtccaccttcctttgatctatctggtataggagttcctgaagatgggcaaaggatgattaatgagcttatgtcaatctatgatagtgatgtacaaggaagcaaaaggcaaaatagggggaacattgcattgaccaaagagcagcctcatcaacaacctcgtgtccaccaggacaactacctgctcagccaagggataatggacggaaatatcttcaaaaacactaatatttccacaactcagtctatgctcccacaagtcgatccatttgatcaatccaaggctttcaatgcaggctccaacgacaacttccatttcatgtttgggtctccattcaacatacaatctaccaattataacggaaatctacctagcattggatacgataccacaccaaaacaagatgctcctatttggtactagccagccagaagtctgttgacatgttgtatatcaagtagtcagttttggcttcatagatatagcgatttctcatgggtaaaaagatcccatgtactcgtctgcttttttcattctggtggatttttcatcgcctatagtcctcttagttatggtgttttcagttaccatgtgttgtaaaggttgaagaactaggcatggtgtaaacaaacacccctcaaatacttgccaatgcttctcataggacatgtagatataaataagttacttgtttcatcatggccagttttatcagtctctttaaaactgttgaatttataggctatggttaaggtctttactccttgtttaatacttcttctcaagattgtttgggatatcaatgttgttattgttgccatatcttatatgatgtttttctttcattaaaaaaaaaaaaaaaaaaaa

SEQ ID NO: 10402 - DNA, 1041 bp, Lycopersicon esculentum
  Predicted polypeptide sequence is orthologous to G977
tacttttttgcgaacacacacacttcaattaactacatttgtaagattgtcaatattatggctagggcacaacaaagatatcgaggagttcgacagagacattggggttcttgggtctccgaaattcgccatccattgttgaagacaagaatttggttaggcacttttgagacagcagaagatgcagcaagagcatatgatgaagcagcaaggctaatgtgtggtccaagagctagaactaatttcccatacaacccaaacatgccacaaacatcttcctctaagctactctcaactacattaacagccaagttacacaaatgctacatggcttcacttcaaatgaccaaaacctcaccacaaggacaaaaattagcaaaaaatgcaaccaatgttcaagaaagtgttattaattcctataaaatgaaacaacaaatgttggtaccaaagccatcagtactattgactcatcatgatcatcatgaggaagctaaagtagtcaacttgggagtgggagtaattaggaaagttgaagatcaagtacttgagggtataccacaatttgtcaagccacttgaagatgatcacattgaacaaatgattgaagaattgttggattatggatccattgagctttgctctaatgttgttccttctcaccaaatccagtgagcttgctcgtaaatcgactattgcctaatacttgctacatttgatcagtgcaggtattagataactcttctactgatgttctctctcagtaattgtctctttttgggtcctacattgttctgtactagaaagatactcattttgctaatttaaccccatttgtatagccgttcccgatttgtttgggactgaagcttagttattgttgtattaagtcttttaagtagtctccctctgtttaaaatctatgtatcgttagtaggtctaggcattttctctttttggttcctagagtttttactctaagagaaccttctactagttgtaaaattccattataatataatcttttctctcttttaaaaaaaa

SEQ ID NO: 10403 - DNA, 1172 bp, Lycopersicon esculentum
  Predicted polypeptide sequence is orthologous to G987
atacaacgtctcgcttctagaccaggtggacctcccaagcttcgtataactgggattgattttccaaatcctggtttccgaccagcagaaagggttgaggaaactggtaggcggttagcaaattatgctgagagcttcaaagttccttttgagttcaatgctatagcgcaaaagtgggaaacagttaaactcgaggatcttaagatcaataagggtgaggttcttgtggtaaactgtctgtaccggtttaggaatctgcttgatgagactgtggtggtcaatagtccaagagatgtttttctgaatcttatccggaggttgaatccagatgttttcatactgggaactgtaaatggtggttataatgccccattctttatctcacgattccgtgaggctctttttcactactcatccttgtttgatatgcttgaaactattattccccgggaagtgcacgagagaatgctggttgaaaagaatataattggtcaggaggcaatgaatgccatcgcgtgcgaaggtgctgagagaattgagagaccagaaacatacaagcaatggcaagttagaattctgaaggctggttttcggcagcttcctttggatgaggagattatgagaatgacaacagaacgattcaaggtgtacgacaagaatttcattattgacgtagatagtgaatggctactgcagggctggaagggtcgtattgcatctgcactttcaatgtggaaggcagcatattgaatttgttctcattcaaggagcacattcagcagccatgatacccctctgcccctttaaacaacgagctcatgaacggtactcactttaccaagtgctacttattgatttggtcatttctttagtgttaatttaacaagcacaaatgtgaattgctatgttcataacactgctttgcttgtgggggagtggaagcagaacttcatttgctgtcttcctcccctacgcgttgaactgtggcatcaacaacaggagagaggaatgacaaataggcgatatttgtattggtttctcttcgtttatattttatatcaaacatgttagttatatgttagcatttgtaatgatttgtgaaggtgttataggctggtatctcttctaataaatgcgagttccgacgtgcttattcgaaaaaaaaaaaaaaa

SEQ ID NO: 10404 - DNA, 2525 bp, Lycopersicon esculentum
  Predicted polypeptide sequence is orthologous to G987
gctcttcaaaaaaactgagaaaagcgcctgcctctcattttttcacttttgctgtcatcttgttcactccactcattaagattgttttatacacaaaactgttatggatcctcgattcattccgttgtctgatcctgtaaacactttcgagttcgaagatcagattaatttgtctagctatgagggatctctgaatcctcctcacaattataatgatgactatgttgcttttggtgttccgtatacggccccaagtgtagacattggtaatttcgccccatcatcaaacgtgagctcggaagtggactctccagatgatcatgactctgattttctgtttaagtacttaaaccagatacttatggaggagaatattgaagataagcccagcatgtttcatgacccgcttgctctaaaagctgctgagaagtccttatatgaagcccttggcaagtcgtaccctccttcaccctatcatgttgaccatcagttagaaagcccaagccctgacagcattttccagacttccagtgaccatagtacaagtagtagcaatgctcatagtaattccatggatcctcactggattgttgatcctggagaatctagtttgtctttgcctgtggagagtcatccatcagagtactccatccaacctttgatgcagagtaactcagagaggtctcatggttctttaaacaacatcaacaacttgaatgtccatatggactcttttttaaatcctaatgctctttcaaacatgtttactgatcgcgagtctatcttacagttcaagagaggggtggaggaagctaataaattccttccaaatgttagtcaatttgttgttgatttggataaatatacctttcctccaaaggtggaagaagtgaccaaagaggctgtggtcaaggtagagaaggatgagaggaatcactcacctaatgggactaaaggaagaaaacatcagtatcctgaggacagtgattttgaagatgaaaggagcaacaaacaatcagcaatatatgtggaggaggaggctgagttatcagagatgtttgacagggttctgctctgtacagataaaggtgagacaatatgtggtgatgtcaagtgtgaaatgccagtagacaatagtttagaccagaatggacaagcacatggatcaaatggtggaaacactcgtgcaaagaaacaagggactaaaaatgaagctgtggatctaaggactctcttagttagctgtgcacagtctgttgctgctgacgatcgcaggacagcatatgaacagctaaagcagatcaggcagcattgttcttccattggtgatgcataccaaaggctggccagtgtatttgcggatggccttgaagcccggttggctggcactggcactcaaatatatgctgcccttgctccgaaaaagattacagctgctgagaaattgaaagcataccaggtttatctttcggcatgcccgttcaagaaaatatcaatattctttgcgaataaaatgatcttccacacagcatctaatgccaggacattgcatctcatagattttggtatactatatggtttccagtggccaatactcatccagcttctctcagagatacctgatgggcctccaaagcttcgcattactggaatagaccttccccaacctggattcaggccagcagaaagcttagaacagacagggagccgattggcaaaatattgtgagcgctttaaagtaccatttgaatataatgccatagcaacacagaattgggagaacatcaaacttgaggacttgaaacttgcaagtggtgagactgttgctgtgaactgtctttttcgttttaagaacctgttggatgagacagtgatgttggacagtccaagggatgcagttctgggcttaattagaaagatgaatccggatatcttcgtgcaagctgtaatcaatggatcttacagtgcacccttctttgtcactcgcttcggggaggccctcttccattactcaactctctttgacatgtttgatgctaccttaccccgtggtgatcagaagaggttgcattttgaacaagaattttacagacgcgaggcaatgaatgtcattgcttgtgagggttccgagagggttgagaggcctgagacgtacaagcaatggcaggttcgcaatatgagggctggattcaagattcttccgttgaaccaacaactcgtgcagaagttaaggtgcaaggtaaaggctggatacctccgcgattttgtgtttgatgaggatggtaaatggatgttacagggttggaaaggccgggtagtatgcgctagcccgtgttgggtgccagcatagaagtatctgaaacatgtttgttagtcaaggttttagttcataggaattctgttatgttagccataacgatgtgttctaaagctattatatgtacataactctggccctagaaaggattagtcttgctaatctttgatattacagctttgtattcctttgaaaaaaaaaaaaaaaa

SEQ ID NO: 10405 - DNA, 696 bp, Lycopersicon esculentum
  Predicted polypeptide sequence is orthologous to G987
accacttcaacagctatatatcaggtaccattctcagttcctattttttgtttcagttcttcttcttcttcttcttcttttggttagaatttctgggattgctttgatttcttcaatcaaacatctcagaatttagtagctcaaaccaatttccatggaagccctttttcaagaacagctttttccttgtgctgattcttttatttttaggcacccttccattccaatggatccaagaaaagaagttatacaaaatggactcaataatcatcctagttttgatcaagattacttttcaaatcatgttgttggagtgggagattcttctcctcctcctcaagaggaaggggaaaaggactattctgatgcaatgtacaaattcttaagtcagatgcttatggaagaagatgatttggagaataagccatgtatgtttcatgactgcatggctctccaagctaaagagagatacttatctgatgtacttcatggatccgaaaacaactattccccacaatctgtcattatcaatccacacgattcctctagttttctcagcaactattcacctgattctattgagtcacctcaatgggatcttaatttcgaatcccctgcttccatgtccactttatctaatcatgactctttcttcacttccttcggcaatggccattttgaagaaggagctgtcaa

SEQ ID NO: 10406 - DNA, 1729 bp, Lycopersicon esculentum
  Predicted polypeptide sequence is orthologous to G988
cctctgtccttccccccaggtcccctttttttcctttctctctctcctttatttctcttttcataagcatattctttctctctctagggttttcactttcacctgaaatagtgttgttaaattgaatgatatgttaggatcctttggttcttcatcatctcaatctcaccctcatcatgatgaagaatcttctgatcatcatcaacagcgtagattcaccgctactgctacaactatcaccaccaccaccatcactacctcaccagctattcaaatccgccagctactcattagctgtgcggagttgatttcgcagtccgatttctcggccgcgaaaagactccttactatattatcaactaactcatctccttttggtgattcaactgaacggttagtccatcaatttactcgcgcactttcccttcgtctcaaccgctatatatcgtcaaccaccaatcatttcatgacacctgttgaaacaactccaactgattcttcttcttcgtcatcattagctctaattcaatcatcatatctatctctaaaccaagttacccctttcataaggtttactcaattaaccgctaatcaagcgattttagaagcgattaacggtaatcatcaagcaatccacatcgttgatttcgacattaatcacggggttcaatggccaccgttaatgcaagcactagctgatcgttaccctgctcccactcttcgaatcaccggtactggaaatgaccttgatacccttcgtagaacaggtgatcgtttagctaaatttgctcactcattagggttgagatttcaattccatcctctttatatagccaataataaccacgatcacgatgaagatccttctattatttcctccattgtactactccctgatgaaaccctagctatcaactgtgttttctacctccaccgccttttaaaagaccgcgaaaagttaaggatttttttgcatagggttaagtcaatgaaccctaaaattgttacaatcgcggagaaggaagcaaatcataaccatcctctttttttacaaagattcatcgaggcgttggattattatacagctgtgtttgattcactggaagctacattgccaccgggtagtcgagagaggatgacagttgaacaagtgtggtttgggagagagattgttgatatcgttgcgatggaaggagataaaaggaaagaaagacatgaaaggtttagatcatgggaagttatgttgaggagttgtggatttagtaatgttgctttaagcccttttgcattatcacaagctaagcttcttttgagacttcattatccttctgaaggctatcaactcggagtttcgagtaattctttcttcttaggttggcaaaatcaaccccttttctccatctcgtcttggcgttgagaaaaactatcaaatagccaacttcagagggtaattaagactactgatagtttaggagggatctgaagaaaacgcgtggagtgaaaaccctaaataaccagattttctaatgaagttgtagtagtagaaatttgcatggtgaagaacaatattgaagaggtattgaaatttcatgttttttttgttttacttattgatatgaatgttttaaaatttttaacatagaggactaggttgatgatatatagtatttaagttaactagtctttgtataacgcaagatcttgatcaacttatttttatttttaatta

SEQ ID NO: 10407 - DNA, 691 bp, Lycopersicon esculentum
  Predicted polypeptide sequence is orthologous to G989
tgatgttatttcacaaagtagagaaatcgataaccaaatgagaattcatcatttattgtcggtgtatggagaggcaatggaaaatggtcacaaagaattagcagaagtgatcatacgatgcataaaggggaaaataaatcctttaggtgaatcgttggaacgcgttgcttcaaacttattccagcatacagaagaagaggatcaagaaagttacttgaaacaagaatcaaacaagattattgaagcagcattcaaagccttctaccaaattttcccattagggaaatttgctcattttgctgctaactccgcaattatagaagctatgcctgatgagtcacagacaattcacataatagattatgatatgggaaaagggattcaatggcctccaattattaaagccatgagccaaaaaagaaagattttgagattaacatccataaagaaatcaacaagtgatcattggagatttgaggaaacaaaaagaagacttgttgattatgcaaatctttttggcctaacattacaagttgatgagatgacatttgaagaattggcaagtgaattgagaagaatgaagaaaaggggtaaaaggagtgaatggttggttttcaactgtatgtttcaattttcttacatggggaaaaggatgcgtagaatcgacgcgttggagtttctgaaactagct

SEQ ID NO: 10408 - DNA, 864 bp, Lycopersicon esculentum
  Predicted polypeptide sequence is orthologous to G1017, G2567
taccgtcaggactgttaccaccaagtttccagcgcgttgcagccaactcacaacttcctaatgtcatcaataagtgccaaaatgacagaaatgataacatctcttgtttgcttacaatgggtacttcaagtaagacattggacaaaaatgatagtgtgaatacacctcggttcttactcttcggtcagccaattctgactgagcaacaaatctctaatggatgttctgtcagtgctccacaagtagtccaaacagggaaagacttaggaaggatacaaccgatcaacgaaaaacatccttctgagcagaaaggcagcattcaagacatctatcaagtgcaacatttttctggaatcgaggttatcatgcagctgaacttggtgtactcaatactggtcactgcaaagtattcctcgagtcaaaagatgttggccgtacacttgatctgtcagttatgggatcatatgaagaactgtacaaaagacttgcaaacatgtttggacttgaaagaccagatatgctgacccgtgtgctctatcatgatgcaacaggtgctgttaaacacaccggagatgaaccattcagtgactttgttaagagtgcaaaaagattgacaattctgatgaactcaagcagcaatattaaaaggaaatggttaactggtctcgcaactgctgaacgtggtctagattcatcaaaccaggcaggacctcttagcatctttgcatagcctctgtgtgtataagtacttttctcgttcttttgtttttcgtaacgactgcttcactgctagtactaaagaacactatcagtgaaaatattatgtttgtttctgtatggatattttgagttgctctttgtgtt

SEQ ID NO: 10409 - DNA, 926 bp, Lycopersicon esculentum
  Predicted polypeptide sequence is orthologous to G1020
gataaaacaccaattcaaaaaatcgtatcagcacctatggctgtgaaagataaggctgtgaaaggaggtaatgtgaaagtgaatcatggagttaaggaagttcactacagaggtgtaaggaagaggccatggggtcgttacgctgcggagattcgtgacccgggtaagaagagtcgggtctggctgggtacttttgatacggcggaggaagcggctaaggcttacgatgccgctgccagagagtttcgtggacctaaagcgaagacgaatttcccctttccggcggagatgaataatgttggtaacaataacagtcagagcccgtgtgggagcagtaccgtggagtcatccagcggagaaacggttgttcacgcgcctaatacgcgacacgcgccgctggagctggatctcacgcgccgtctcggtgccgctgctgaaggtggacgtggaggtgtcggctacccgatcttacaccagcagccgacggtggcggttctgccgaacggtcagccggttttgttgtttgattctatgtggagaccgggagttgttagtaggccgtatcaggttgtaccggcgacgatggagtttgccggtgtcggtgccggagttgttactagtgtgtcggattcgtcttccgttgtggaagagaaacattatgggaaaaagggacttgatcttgatcttaaccttgcgccacctatggaagtttaaattaatgacgacgataatctaattttgtgagagagattaagagagtgacagagctaatggctgatttttgtatataagttcaaaagaattgattgcttttttttttttggcagctgaaactttctcgtgctgtttctaccatttgtaactctaaatccttttaattaatgagaaaattccatattttctcctttccaaaaaaaaaaaaaaaa

SEQ ID NO: 10410 - DNA, 725 bp, Lycopersicon esculentum
  Predicted polypeptide sequence is orthologous to G1033
caacgcaccaaatccacacaaacgaataatatccaattctctctagaggtttcatcatgaaaggagctaaatcaaaggctaaagctgataccaagcttggtgtaaggaagaaggctactgagagtaagaaggcgaagaacgctgctaaggatccaaacaagcctaagaggcctccaagtgccttcttcgttttcatggaggagtttaggaagacctacaaggagaagcacccaaacaacaaatctgttgctgttgttggcaaagctggtggagacaagtggaaacagttgtcagatgaagagaaagctccttaccaagccaaggctgagaagaggaaggctgagtaccaaaagagcatggatgcatataacaagaaactggctgctggtgatgctgatgatgagtctgacaagtccaagtctgaggtacatgatgatgatgaggacgatgatggaagtgaagaggaggatgatgattaaacaatcagtaggctgttgaaattcagagaatgatggataagttcatgtaggaattgctcagtccttccttgataaatagatgccctctttttttacattttttgtctagtttttgttctttgagggtttagtttggacagaaaggtgaaattcagatgacttgccttgaaagctcaagtagtttatgtaatttctctattttgctgatgttaatgaaaatttagcttggaaaaaaaaaaaaaaaaa

SEQ ID NO: 10411 - DNA, 993 bp, Lycopersicon esculentum
  Predicted polypeptide sequence is orthologous to G1033
ccaaagccccttcttatcctctcttcacaacacacacacaatacacaattcatctcaaagggcaaaaaaatatctctttgtttttttctctctcaaccctagaagtttttttttaatcatgaaaggaggtaaatccaaggggaaagcagataacaagctgggagtgaagaagagtgctgcccagactaaaaaagagaagaatgctgccaaggatccaaacaagcctaagaggccagcaagtgctttcttcgttttcatggaggacttcaggaagcagtacaaggaaaagcatccaggcaacaaatctgttgctgctgttggcaaagctggtggtgacaagtggaaacacttgactgatgctgagaaggctccttacatcgctaaggctgagaaacgaaaggctgattatgagaagctaatggacgcttacaacagaaaacaggctggtgaagctgaggaagatgaggaatctgacaagtcaaagtctgaggttgatgaggaagatggaagcgatgaggaagaagaggatgatgactgaagtgctaatgggagggagtaaattggtggggaagctgtgtaataccttagatatttctctatatgatgactccttacttttccccgttaaatacttggctcttttttttagtttattttggggtttcttaggtatgggaaaaagatgaattagatgagagctatctttaaagctcagtggcttatgtactttttattctgatgctggtgttgcttaatgataatgcaactttttaggcaatttgtctttctttttctatatttgtgtagagcttattgtttgtttctattagaacgctcttttttttagtttattttggggtttcttaggtatgggaaaaagatgaattagatgagagctatctttaaagctcagtggcttatgtactttttattctgatgctggtgttgcttaatgataatgcaactttttaggcaaaaaaaaaaaaaaaaaaa

SEQ ID NO: 10412 - DNA, 714 bp, Lycopersicon esculentum
  Predicted polypeptide sequence is orthologous to G1033
gaggcaacgcaccaaatccacacaaacgaataatatccaattctctctagaggtttcatcatgaaaggagctaaatcaaaggctaaagctgataccaagcttggtgtaaggaagaaggctactgagagtaagaaggcgaagaacgctgctaaggatccaaacaagcctaagaggcctccaagtgccttcttcgttttcatggaggagtttaggaagacctacaaggagaagcacccaaacaacaaatctgttgctgttgttggcaaagctggtggagacaagtggaaacagttgtcagatgaagagaaagctccttaccaagccaaggctgagaagaggaaggctgagtaccaaaagagcatggatgcatataacaagaaactggctgctggtgatgctgatgatgagtctgacaagtccaagtctgaggtacatgatgatgatgaggacgatgatggaagtgaagaggaggatgatgattaaacaatcagtaggctgttgaaattcagagaatgatggataagttcatgtaggaattgctcagtccttccttgataaatagatgccctctttttttacattttttgtctagtttttgttctttgaaggtttagtttggacagaaaggtgaaaatcagatgacttgccttgaaagctcaagtagtttatgtaatttctctattttgctgatgttaatgaaaattagcttgaaaa

SEQ ID NO: 10413 - DNA, 651 bp, Lycopersicon esculentum
  Predicted polypeptide sequence is orthologous to G1033
gccaacaccttcttatcttcctcttctgttttaagtttcaatgaagggtggaaaaggaaaaggtgcattgagaaaagaaacaaggtcggcgttgaagcctgttgaggaccgaaagatggggaagagaaaagccacgttgaatgttttccaaaaagaaggtcacaaaggataaaaaggcaaagaaagatcccaataagcctaagaggcctcccagtgcctttttcgtattccttgaggaattcaggaagacatttaaaaaggagaatcctaatgtgaaggctgtttctgctgtcgggaaagctggaggagaaaagtggaaatctttgagtgcagctgaaaaatcaccatatgaagccaaagctgcaaaaaggaaggcagagtatggaaaactcatgaatgcttataacaataagcaggtggaaagctcagatgatgaggacgaagaagaaaaagaagaagaaaaagagaaaaggtcaaagcctgaggtacatgatgaagatgcggaggacagtggacagggcgaggaagaggacgatgaagacgaagaggatgaagatgaggaagatgattgaagctatgtaatttctggcttgcaccgtttccttggtccatcacatgcacacttcaaacataataagtttcgtaattctg

SEQ ID NO: 10414 - DNA, 569 bp, Lycopersicon esculentum
  Predicted polypeptide sequence is orthologous to G1037
caggtttccgtacctttcgaagcttcaagaggagaaacacaatgccgtgaaagtttaggggctgctgttcagattatgaaccaagcaacctgccaacggtggccagatcagaaccaacattattcccacaattcaaacaatatttttggtaacatgagctctcaagtttctagcaatggtggaatggcctctttaactcatcctgtggaccaaaacaatgatatgttctgcacaagggtggagacttctttgaactgcatatcaaatggtagttcttcaatgcacacacacaatcgtgaaagtgaaaaattaactcatgactcgaggacaaaaacaaatgaagactacctcttccagacaacaaagcaacaagttggttttcttcctcagggctatggctcccttgatgatcttatgggtgaaatgaaacaggatcaagatggagccatgttagacggaggagaattcggatttgatgcttattcacttggttcaggtttatgaggtttttgtaactagcaagttaggaaggagaggatctagtgatatagcaaaattttatttgctca

SEQ ID NO: 10415 - DNA, 801 bp, Lycopersicon esculentum
  Predicted polypeptide sequence is orthologous to G1043
gctcatcgactgatctaaatagagcaatagaaggtttaattcgtggtcgagaatttactcgacgactaaaagagattattaaaaaatctggtggtgaagttgaaaacattatggctgaggatttagttgccaaaattctggattcattttctgagactctctccgttataaacaattctgatgtcgtcgtcgctacggcggttgaggtcaagtcgccggaagattattctagtggaagttgcaagagttcagatcgaagaggatgctacaagagaaggaaaacttcagaatcagacataaaggaatcctcagatttggtggatgatggtcatgcttggagaaaatatggacaaaaacagatccttaattccacttatccaaggcactactttaggtgcacacataaatatgatcagaaatgtcaagcaagcaaacaagtacagaaaatccaagacaacccacaaagatttagaacaacatactatggacatcacacttgcaaagcttttcctagagtttcacaaataatattggattctccaatggatggaaattctaattatattagttttgatcaaaatcatacatttccatcaataaaacaggaaacaaaggaggaagtagttttcagattctatcctaaaattgaagatcaaattcaatcatcaagctctgattattttcttcccatgatcatgatcatgatcatctcactccaacaacatttgaagcctccggcagccgtatgacctcgcccgatgttatgtcatctgggggttactcttcttgtactactactag

SEQ ID NO: 10416 - DNA, 489 bp, Lycopersicon esculentum
  Predicted polypeptide sequence is orthologous to G1043
gaatgccgggccacaaaacaagttcaaataatccaagaaaatccaattataatgtatcacaccacatattttggcaatcacacttgcaatccaacaaagattccaaaacatacatacaataatcatgctatggtaaagcatagtgactcaacagtactaaaagaagaagaggaagaggaagaatccaaaggacaaagtgataatgcatcatcaattgtggattctaatttatggcaagattttatgccttcttctccctctgctcatgattccactatggctgctaattataattcttcttattatgaagaaatcatatctagtcatgatatggaagattgggctaaatttggtgaaattgaggccattgagttttgttgacatattgttaatagtaatttagcccttatggggtatggctaatgttgtagaataaaaccttcggctatgttcttggtattacttttaaatgaaaaaaaggtatatagt

SEQ ID NO: 10417 - DNA, 635 bp, Lycopersicon esculentum
  Predicted polypeptide sequence is orthologous to G1043
cttcctgtcatgttcttatctctttccttctcactctcacccaccatatataaactataaccccatcatcacttcctaaattctcagatcttataataactttttttttttaaaaatggaggattttcttggtgaaaacccacataatagattgataaaagaacttgttgaaggaaaaagtttcactgtccaacttcaaactctacttaaacaacctaatgaatcagtcttagctgaagaacttattcgcaaaatatggggatcttttactcaggctattactgtgttgaatagtttgggtaattccgataatagtttaacccagggccagatcgaggaagttgatcaacccaattccggttctgaattgaagaagaagaagaaggagaagcaagaccgtagaggttgctacaagagaagaaaaacttcaggttcatggatgagagaatctgcaacaatgaatgatggttgtgcatggagaaaatatgggcagaagaaaatactcaattcaaaatatcctaggtgctactataggtgcacccaccagtacgatcaagaatgccgggccacaaaacaagttcaaataatcccagaaaatccaattataatgtatcacaccacatattttggcaatc

SEQ ID NO: 10418 - DNA, 630 bp, Lycopersicon esculentum
  Predicted polypeptide sequence is orthologous to G1047, G1808
tttccggccatgttgtccactttcccggccactactctgtccgccgacggacttttttccaatttatttccggcatttgatggaggattcactccttgggaatgtatcgaaccggcttttctattttcacaacaagtggaatcggttgtttcacccaaggaatccccaccacctgaaccggttatttcaaactccgattcaggttctgatgactccaaacctaattctgttcactctagttccggttcagatgacccgaaccggaataataacaataataataagtcgaaccggtgtcctgacgagagaaagcggcagcgcacgacatcgaaccgtgacatggatgagaggaagcgtcgacgtatggtatcgaaccgggaatcagcaaggcggtctcgcatgcgaaagcaaaagcatctggaaaacctgcggaaccaagcgaaccggcttaaagtagggaaccgggaaataatgaaccggttacggttaatcactcaccagtgccaagtggtccagtgtgagaacgagcggctgaggaccgaatcggctatccttcggcaaagacttgagggtatacgtcaaatatggatcaaccggcaatttaattcttattctgcatgggcatgcaat

SEQ ID NO: 10419 - DNA, 785 bp, Lycopersicon esculentum
  Predicted polypeptide sequence is orthologous to G1048
tcgagactaggagcagcttcttatgaacgatgacgatttcggtcttgtctctgatcctcagtttgctgccgaatctctttctgacttcctcgtcgattctcctcttcactccgatcattctcactctcctgctgaacaagccattggattctccgatcccaaggtttcaagtgccgatcaggacaaacacaaggtttcccagtcgccttctgacggcgacgacgaactaaacaaccatgaccccgtcgataagaagcgcaagaggcaattgaggaatagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttttctttgcataatagcagtgctaatggtgtttctatgaccaagcaggagtctgccgtgctctttttggaatccctgctgttgggttccctgctttggttcctgggcatcacatgcctgctcattctacccagccaaacctggtcagttccagaagaaagtcagggaagcagaaaccacgggcttctggttccaataaaggagggaaaaaagactagtcggattttgttgttcctgtccttcatgatgagcaaaagatgcaaagcttcaagatcgaggatgaagctcaacccccatcccttgggaagttgtgatgtggactcgttgtgatcaaatcttttcccataggtggatcatgggtcctttt

SEQ ID NO: 10420 - DNA, 2252 bp, Lycopersicon esculentum
  Predicted polypeptide sequence is orthologous to G1050
gatcatagaaaaaacagtattacaagggggaaaaagtacacacaaagaggaatagaggagcgtcttctgttgaaaatggtggatttacactcaggtgtaacagaagtactgtaaaggttggattttggtaaagttgaaagggtttttttttggttgactggtagagttgaaatttggggaaaaataaatggctggtgacaatgacgaaggtcatagtgatatggtccagagacttcaatcatcatttgggacatcatcgtcttcacttcctaaacagcttcaacctatttcgatgaaccaattggacataccccagttgacaacttctcaatttaggggtcaaatgaggcaattttctcccaattttggtgttgaaaatagtaaaagagtaggtataccgccttctcacccgcaaatgccccctatttcaccatattctcagatccctgtaaccaggccagggaatcagcaaatgggtatgcagaactttactagtgcagggccatcacactcgcgatctttatcacaaccagcgtttttctcactggattccttgccacccttgagcccttcaccgtatagggaatccccgtccacgtctatgtctgacccgatatctgctgatgtctcaatgggtgatcaggatggcaattcacattctttattgccgcctacgcctttctctaggtgtaattcatcgagggcaggggagagtcttcctcctcgtaaggctcataggaggtctaatagtgatataccattcggcttttctggtataatgcagtcatcaccaccacttgttccgctaaggagtcctggtgctcttgaaaggtcagttccttcaagggataatttgggtggtaaaccagttcagttggttaaacgtgaatctatgtgggaaagaggaaatgataataacaatgttgaagggatgggtgagaggaaatctgaaggagaagttgtggacgacctgttttctgcatatatgaatttggacaacattgatgcatttaactcttcgggaactgatgagaagctgggtattgagaaccgtgaagatttagatagtagagcgagtggtacaaagacgaatggtggtgacagcagtgataatgaagctacaagcagtgtcaatgacagtagcagcggcagtatgcagaagagagaaggggtcaaaaggagtgctgtgggagatatcgctccaaccactagacactacaggagtgtttcgatggatagttttatggggaagttaaacttcatcgatgattcaccaaagttgcctccatctcctggaccacgcccaggccaactctcaccaaccaattcacttgatggaaattcaaacagtttcagtttggaatttggaaatggtgaatttagtggtgctgaattgaagaaaattatggcaaatgaaaaacttgcagagatagctttagcagatccaaaacgagccaaaaggattttagccaaccgtcaatctgctgctcgttctaaagaaagaaagatgagatacattgcagaattagaacacaaggttcagacattgcagactgaagcaaccacattatctgctcaactgaccctcttgcagagagatgcgactgggctgacaagccaaaatagtgaactgaagtttcgtttgcaagccatggaacagcaagctcaacttcgtgatgctctaaatgaagcattaactgctgaagttcaacgcttgaagatagcaaccgcagagcttagtgcagacgcttccaagtttcagcagctatctctaaatcctcagatgttccaatcgcagcagcaacaatcgaatcagctaaacatgcatcagttgcaacagcagcagcagcagcaacaatcatctcagccacaacaacatgctcaagcacgacaacaacttaacagctcgacgacttcaaagcatgaatcaaagtagtagcttttgggaaatatctcatcttcataatatttatgttagtttgtcaatagatgttgcaagtgttttcatatcattcaatgcattcattcatttagttctgcattcacaacaaaacacaccgagtcttggtatttattatctataggacatgcatgttcattggatttacttagtcacagagtcttgtgatgtatacagttggttcttttttttttgttcaacaaggatattgaattcaaggtcatatgaacttgactcgttttgttattatggaagtttaattcaaatttgcctaaagaaaaaaaaaaaaaaa

SEQ ID NO: 10421 - DNA, 2096 bp, Lycopersicon esculentum
  Predicted polypeptide sequence is orthologous to G1050
ttcacttcttctctactcttctctttcatatcagtacaagttattttcattttctcttacaaattcaaccgtaatcaccgccattttcagcgggaaattcaccttctctccaaaatcccattttttcccctataaccccaccccccacaacttcactttcatcaatgtttgcacgtttgtctctcatcatattcaactgtagctcctttaaattttgactataaactttcaggtactccgttttcttccttgctctgcttttctcaatcttgtttttcattcatctgttgtttggggttttgtgtttgtttgaattggattgggttgaaacagttttttttttgggtgggtttaaggagttttctatttagggttttgctgggagctgaaattttgatttatttaatgagaattgctgaagttctttgattattacgaagaaatagcatttggggtgtcggaaaaattgaatcttttgcgggttttatttgttgatttttgatggctcagtctaattctaagccacctatgagtagtcagaattttggtgttggagctgtatctcatgtgaggtcgttatctcaatcgagtattttctcgaatagttgtttgcccccattgagtccttttcctcctagtgagccggggatggtgtcgggtcgttctagcttgaaagatatatccatggaggaagcagatgtgaattctcaaggtgtaggagttgtgtcttcgtttacgagggatggtcttcctcctcggaaggggcatcgtcgatctaatagtgatgttccattgggattctcggctatgattcagtcttcacctcagttgatgcctataagtggtcagaaggttttagggagagcagtgagtcttggggatagcaatggaaagattgatgagaggaaaccaaagggagaggttacagatgagttgttgttttcctacatgaatttggaaaatatagagacattgaacggttctggcacgaaggacagagataaggacagcattgtcagtgggacaaaggtaaccggttctgagagcagcaataatgaagcagaaagtgttatgaaagggaataatgttagtatccaaccaacaaatttaagggaaggaaccaagaggagcgctgatgcgaatattgctccagctgcacgtcactttaggagtctttccatggatagtgctattggaaattttcactatggcgatgagtcaccaaatttaccaacttctctgatgatgcgttccggtcagctttcaccaagtaattcaggaaatgaaagttcgagcaagcacaatcttgacttcggaaattctgaatttagtgaagctgagatgaagaagattatggcagatgaaagacttgctgagattgcagttttagatcccaagcgtgctaaaaggattttggctaatcgtctgtctgctgctcgatccaaggagcgaaaaacacgttacatctcagaattggaacacaaggttcaaaagctacagacagaaacaactaccttatccacccaagttacaatcctgcagaaaaattttgttgagatttcaagcctgaacagtgagctgaaattccgcatccaagccatggagcaacaggcacagcttagagatgctctgcatgaggcattaactgcagaagtccaacgtctaaagcttgctgctggggaacatagggaggaaggacggttgcctaataacatgacacaacagacaccagtgaagcataatatattccagatgcagcgtcagcagcctagtcaaatgcaacaattatctgttggtaaagcatctgcggcttcagcaacacctgcatccgcctagtgggcgaagattaaagcctttgaggaggtgaagattatctctacatgaagcctaaaagtttattacttcaattatcggtcttacatgctacgcacaaacagtgagaaactaagctttcagatagtattatatccatataagtttcttatgtgtgtctggctacaatttatactatatgtagtgaatcattattttgttctttggaaatgactgtatcaataaattggagtcaaactttgtggtgccaatgttttctccta

SEQ ID NO: 10422 - DNA, 536 bp, Lycopersicon esculentum
  Predicted polypeptide sequence is orthologous to G1051, G1052
tggctcaactaccacctaaagttcctactatggcacacaattggccttttcaaaacatgcctccattgcctaattcctccaccatcgtctccaatcaccacactactaattcctgggtagacgatttcctcgatttctcatcttcccggagaaattctcaccggagatcagttagcgatccaattgcgttcgtcgaagctccgtttctccagcaatgccgaggaaacggattgagtaacggattcgataaattggatgatgaactacttactactatgttttccgatgatagcggcgccggtgctgcgtttgctggtacggcgccgtgttcgaatccgtcgagtacgaatccttctacgccgtcggatcaagtcagtgaaaatgaagatcagaaatcgccggtcagattggaggttaatctagtggttcagccgaagaatgagcccggagaagatgatagtgataatcaatcgccggtgactagtaaaaatccggtgaatgattcttctgataataataataataattctattgtg

SEQ ID NO: 10423 - DNA, 640 bp, Lycopersicon esculentum
  misc_feature (577)..(577): n is a, c, g, or t
  Predicted polypeptide sequence is orthologous to G1051, G1052
gatggcacacttaccaccaagagcgcctaacatgacacaaaattggcctgatttttcgcttcatcaaaaaatggaaaacttagctccgtccgcccataatttatgggcggacgaattcctcgacatgtcgtcgaggcgtgggtcccaccgaagatcaatgagcgactccatagcttttttggagtcgcccatggttgaagaatgccggaggctatccagtactactccgggatccggtgggaccactaacggtcacgacgaattcgagagattcgatgacgaacaacagattatgtccatgtttaacgatgacgtccacgatatgtcgtgttccaacccgtcatcaccgtccgattacatcaacgttactgaagataaaaagatgaacggccctgatcaaatgatgatgcagcgtaagagtgatcaaaatgaggaagttgaaagctcatgcaagactaatgaggaattagccacagctaatcaaaatgcaagtactaataataatgaatattcttctgaaagagttgttgatcccaagagaatcaaaaggtactaattatatacttaattgaatcgnaattatgactcaatacgaagtttataaaacccgataattatatcaggattttagccaatagac

SEQ ID NO: 10424 - DNA, 1968 bp, Lycopersicon esculentum
  Predicted polypeptide sequence is orthologous to G1062
gagaaagtttagtagtaataatagtgatagcagagttgagttttctctctctgtgttaagttgtcttctctctcatataaagggaaaaaaaagaaaaaatgataactggagtgaatgatatgggttggattgatggtaaggaggatggaggaactggttcttgggttaatcagaacaatgaaaatcatcaacagaacaatggtggttttcccaatgaaaatcatcagctgaacaatggtggttttactaatttccaaggtatggttgatgatggaggtgtggattggtttatgggtggtggtgatagtaacaatcatcacatcaacaacaacaacaacaatggtggtggtggtggtggtggtagcaacatgcagagccacatttcttactctacaagtttcactgaagctgaaaacagtttgcttctgcaacctgttgattcttcagcttcctgctcgcctgtttctggtaacgttttcaacaacattgacccttctcaggtgaacttcttcatgccccaaaaatctactattccttcttcactcactgggttatccaacaacccaatggataacagcttcaatttgggtatgttgaatcaagctgggaacgggatgatgaatactgggtatcatcatctgggttcaccaaaccaaatggggacgaacaacctgagttcttatactcagttttcttctcccaatctgctccagctacctcaggtagctggtgggtacagttcgatgggatttggggctaacaattctgctaatgggaacactttgtttctcaatcggtctagaactcataaacctttagacaattttgcttccattggagcacagccaactcttttccagaaaaggattgcaaagaacttggttagtaatggtgaaaatttaggtacagaaatcggtcaaccttccagtaatctgactgataaaaaaaggaagtccagcatgaatgatgagtttgaagatgttagcatggatggaacattgaattacgactcggatgagttcatggatatctctaacaaaatggaagatgggatcaagattggggacagctctaatgcagccagcactgtcagtggcgctgatcaaaagggaaaaaagaagggacctccagctaagaacctgatggcggagcgacgccgcagaaagaagctgaatgacaggctttacatgctgcgatcggttgtcccaaagataaccaagatggacagggcttcaatcttaggagatgcaattaagtacttgaaggagcttctgcatgacatcaatgagctgcataatgagttggagtccacaccagctaacaactcttcattgagtcccgcaaccagcttccatcctctgacaccgactgcatcagctctgccaagtcgtataaaggaggaacttgttccaagccccctgtccagccctactggacaacctgctaggattgaagtgagggtcagggaaggaaaagcggtgaacattcatatgatctgcagccgcaaaccaggggttttactctcaacaatgaaggctctggacagtcttggactggacattcaacaagctgttatcagctgcttcaatgggtttgtgttggatgtgttccgagctgagcaatcgaacgaaggtcaagagatgcatccagatcagatcaaagctgtgttgatggagactgctggctttcaaggggggacgatataagctgctcgatctagtatacgaaggagaggctctatcgaagattttggacctcagggtgctatagcttttagacctcaagactttattagtttacttgtgttttcatgttattagatggttacagaccatggtggtccgaaccgggttttgtcctttttcttttttagtcagttatattggtgttttctttaggagaaacattgagcttatgaagctccaaaactgaatgctatgaaattcctttcagaaaaaaaaaaaaaaa

SEQ ID NO: 10425 - DNA, 753 bp, Lycopersicon esculentum
  Predicted polypeptide sequence is orthologous to G1062
gggaagagaaagtggggtagtggggaagaacttgatgatgtgagctttgatgggtgcacattgagttatgattcagatgaccttactgaaaatgttactaataaggtggatgatactgttaagaatggtggaaatagctcaaatgcaactagcactgtcacctgtgggaatcagaaaggaaagaaaaagggacttccggctaagaatttgatggctgaacgacgacgtaggaagaagctaaacgataggctttacatgttgaggtctgttgtaccaaggattagcaagatggacagggcttcaatcttaggggatgcaattgagtacttaaaggagcttttacagaaaatcaatgacctgcataatgaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctggcaagggttgaagtaaaggcaagagaaggaagagctgtgaatatccatattgttttgcagccgcagaccaggcctcttactctcaacaatgagggcactcgacaacctcggactggacatccaacaagctgttatcagctgcttcaatggatttgccttagatatctttagagctgagcatgcaaagaagtcaagactttcatcctgatcaatcaaagcagtactgctggatt

SEQ ID NO: 10426 - DNA, 622 bp, Lycopersicon esculentum
  Predicted polypeptide sequence is orthologous to G1063, G2143
tgtggtatcccttttagcccatctttcattctaatatttctatatatcctcttgtttttttatttttaccttacaaaaacaaatcatggatttacaaaatattgctcactcactagaacttggattctccaatagcaatattgaaatgatacctttacaatcaccactccataactccaattacttaatgaattctcctccatctaatttctcattcatgggcaatccaattgaagagccagccgcgatgccaatactctcatcgatcgatgaaattatagcatcgactcatggtaatggaaatgattactcatgtttgcagaggaggaattctatggaggctatgagggagatgatttttcgtatcgcgatgatgcaaccaattcacattgatccagaatcagttaaacctcccaagaggaaaaatgttaagatatcgaaggatccacagagtgtggcagccaggcatcggagggaacgaataagcgaaaggataaggattttgcaaagactagtccctggaggaactaaaatggatactgcttcaatgttagatgaggctgtccattatgttaagtttttaaagaagcaacttcaatcactagagcaagccgcggttaat

SEQ ID NO: 10427 - DNA, 1521 bp, Lycopersicon esculentum
  Predicted polypeptide sequence is orthologous to G1064
aaaagtttgtttttttttgtgaaaatttagttattaagagtgatcatggaaggaggaggaggtgacgatcatctccaccatcaccatcacaatcaccagcaccaccaacatcaccagcaatatcgtcctaacaacttccctttccaattactcgaaaaaaaagaagacgaaccttgctccagctcctccgcagctaataatattaattatccttcgctagccatttccccatccgatacaaatacgaatataaaccctaatagtaacgaccttcaaattacagttgcctctactgagactgctaaaaagccagctcccaagagaacttccactaaagaccgccacactaaggttgatggccgtggcagacgtatacgtatgccggccctttgtgctgctagggtttttcagctcactcgagaactcggtcacaaatccgatggtgaaaccatcgaatggcttcttcaacaagctgaacctgcagttatagctgctacgggaacaggtacaattccggcgaatttcacgtcactcaacatttcattacgtagttcaggatccagcatgtccgtaccatctcaacttcgatcttcgtatttcaatccgaatttttcactgtcccaaaggcgcagtttgtttcagggtatcggtttatcatcagacagatctgcaactacaacgttgctgaattttcagacgggtaattcgaacctccatcaattccaagctaaacaagaaatgcgagacaattcgttagatttaacagaaacaagtatagaagagagtctatcgcgaaaaaggcgacaagacctcgatttacaacaagaacaacaacaaaatcagcagcagcaaaacgagcaacaaatgggaagttatttgttacaatcatcaagtagtgggactatgccaactagtcattcttcaattccagctaacttttggatgttgacgaataataatacccaagtattgggaggcgatccagtgtggacgtttccatcggttaacaactctggtgctgcagctgctgctttgtatagaagtacaatgtcaagtggattacatttcatgaattttcctactcctgtagcactattgccaactcagcaatttggcgctggtagtaatggcagtacactagccggagaaggccaattaggcatggtcaccggattaaatccgtatagaccatgttccggtgtatcggaatctcaggctagtggatcacattcacatcacggtggtggtggaggtggtgatgatcgtcatgattcaacaagccatcataattcctaaaaagaagttgagtttttgtgtgataaattaaaaagtttgggatggttaattaaacacacaatacgtgaggtttgattatatgcttgctctataattttgaatttgcttctattattattattttcacctcttctttttttgtgtgattaatatttgcctgccggtttttttagggtttgaagagggaaatatattttttattttattaaaaaaaaaaaaaaaaaa

SEQ ID NO: 10428 - DNA, 683 bp, Lycopersicon esculentum
  Predicted polypeptide sequence is orthologous to G1068
tctgctatgatgcaacagcttcagcaacaccagcagcaaaattctggttttccttttaattctgtggttaatacggcttctgcggcggtggcggcgcctcaacataatcttgattactcagatgcgtcatctcctagggctactggattcagcattgagcctgctaggaaaaaaaggggccgacccaggaagtattcacctgatggtaacatcgctttgggtctctcgcctactcctgttaccccgatttcatctggggtgcctcctacagattccggaagcggtggcggtggtgatgcggagggtccttcttccgagaatccttcgaaaaaggcccgaggaaggcctcctggctctggaaagaaacagctagatgctttaggtgcagctggagttgggtttacacctcatgtgatcacagtgaatgttggggaggacatagcttcaaagataatggctttctcccagcaagggccgcgtactgtttgtattctatctgcaaatggagccatctgtaacgtcacccttcgccaaccagcaatggggggtggcactattaattacgagggccgatatgagatcatctcattgacaggttccttcatgcagtcggagaatatggcagcagtggaccaagtggtcttgagtgtgtcactggcgggggcagatggtaaagtatgggt

SEQ ID NO: 10429 - DNA, 1082 bp, Lycopersicon esculentum
  Predicted polypeptide sequence is orthologous to G1075, G1076
gaaatttcttgtgtgtttttttttttttaatatatacctattttcttactcatgctcattaattaatttcccttataattaatcatatatcatagtttattataccttagttttctgttcactacttttgttattgttatcgttatcgttatggctggtttggacttaggttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatccggatctttcctaccaccacccgctccccctggggccaccagcttaacgatttatttagcgggtggtcaaggtcaagttgttggtggaaacgttgtgggtgcgctaattgcatcaggaccggttattgttattgcttcgtcatttactaatgttgcttatgagagattgcctttggatgaagaaaatgagtcaattcagatgcagcaacaaggacaaagtggtaattttgctgatccatctaatattggattaccttttcttaatttgccattaaacatgccaaatggtggtggtcaactacaattggaaagtggaggaggtgaaggttggaatggaaacacaacaaacaggccacaatattaggtcaggttttattaagaaattaattttctacttttttttttttacttgaaaaaaaaaaaattctctcaatggattaatattatcatttgtacattattaagcttggtttaaatttttctaaaaaaaaaaaaaaa

SEQ ID NO: 10430 - DNA, 466 bp, Lycopersicon esculentum
  Predicted polypeptide sequence is orthologous to G1078
gtatctctaactcactgtgtgtaaaaacactttcatggcattttttcttcttcttcaccgtctccgcccatcgccgtcgcaacttctttagctccatagcaacaccagtaactgcgccgccggaatagccaccgtcaacggcggagacccatttgatttttttttttgatatttaacgatgggttgcgcggcgtcaaagctagataatgaagatactgtccggcggtgtaaagaccgccggcgattgatgaaagaagctgtttatgctcgtcatcacttaacagcagctcattctgattactgtcgttcacttcgtgttacgggttctgctttatctacctttgccgccggtgaaccactttctgtttctgatcatactcctgctgttctcctccgtacgtctttttcgactactgctgctactaacatcaaaacccctccacccccaccccctattcatatccca

SEQ ID NO: 10431 - DNA, 620 bp, Lycopersicon esculentum
  Predicted polypeptide sequence is orthologous to G1078
cttcgatgagttgggggaacggaaatgggaaagtggagatggtatctgatagaagtatagtggtgaggcacaaggatctagcagagattgttgctgccattaaggaacactttgataagactgcttctgctggtgagcaggtgtctgagatgttggagacaggtcgagctcagcttgaccggagctttaagcagttaaagaaaactgtgtatcattccggtggagtttttagcaccataagctccacctggtcttcaaaacctccattggcggtcaagtatcgttttgaacctagttctattgatgaaggtgggcaaaagagtctttgttccaccttggagcgactcttggcatgggaaaagaaactgtatcaggaagtgaaggcgagggaaggagttaaaattgagcatgaaaagaagttggcaacattacagagtcaggaaagcagaagtgatgacatagccaagttggacaaaaccaaggcctcaataacaaggttgcagtcactgatggtggtcacatcgcaagctgtttccactacgtcctctgccattattggcctaagggactctgaccttgtcccgcagcttggtgaactttgtcatggatttatgtaccat

SEQ ID NO: 10432 - DNA, 618 bp, Lycopersicon esculentum
  Predicted polypeptide sequence is orthologous to G1082
tggattttgaacatgaggctgttaaggaagttcatgaggatcaaaggtttgtagatgaggctgcaactgcaagtggaagttattcaaaggcagttgaggagaatgagaaggcagctgattcagagtccatacaccaccactcaagaacaagttcatctgtggaggatgacccgattgagtatgaggtacacgtcgtggataagaaagtggttgatgatgcgaatcggggaaatgtagctggttccaagggtcgtagtttcaatagtgattctgatgtggtgaaggagattcaagttcaatttgagagagcttctgaatcagggaatgagcttgctaagatgcttgaagttggaaaacttccccacaatcgtaagcacgcgacatatcaagggatagtttcttccaagatgttgcacgcgattaccccttcctcggctgtactctcgctaccgtctactttaaagaacgatgcgattgagattgctgatcatgccattttagatgtagaaggagatattagttcaagagctagaaacatttcttccacattgcagaagctgtacctctgggagaagaaactgtctgaggagggtcaggggcgagagaaagataaggtgc

SEQ ID NO: 10433 - DNA, 728 bp, Lycopersicon esculentum
  Predicted polypeptide sequence is orthologous to G1089
cacatctttccccccctttcatcaacaagcaaacccctcattcaggacgtgtctgaagtctgcctgtcatggtgatgtgtattagttctctgtagacgctgcttaacagttaaagaattgcacactacgttaacgttggcctcaagcgctgcattgcacatgaggttattgttttgtagtattttgcctattggggtttttaagggggaatagttctctttagccatcatatcactatgttttgcaagatgaatggcttaatctgtattgacgtgtctgcggaaatgataattttcagttgagtataactaggtattcctctgagggtatttattcagggtccctaggagattctgtcgttttatgctgaatagcagataagattgccaaatacagctttctcctgcagaccatgaacccgaaactcctgtactctccttggagtagataaattcagggtttccccgagttaaattgatgtcaaagtaagcactttgttgtctgattcactatctgagatggttaagacatcatatatttgtactgttctgtgaggttcttccttggaataaacaagtattttaccgtgtgaagaagtttgtctgcaaatgctggtttcttgttagtttgaaccgataattgaaacttcagaatggatgttcctgtgaagaacctcaggataatgggccgaaaaccttagtcagtgatgacattttggctaagaggct

SEQ ID NO: 10434 - DNA, 758 bp, Lycopersicon esculentum
  Predicted polypeptide sequence is orthologous to G1095
gtttgaagttgaatcagtgattgatcttgaacagagcatcgaattaatgggcttgactcagttatggttgctgcaattccgaccatgaaatttcacagtgaggctttcacctcctcagaagaagatacgcagtgcagtatatgtttatcggagtaccaggagaacgaagttctgagaatcatgcccaaatgtggccatagtttccatctttcatgcattgatatatggctaagaaaacagtctacctgtccagtttgtcgtctttcggtacaggaatctattgaaaacaaacaaaggcgccctgcaatgcttggcagggatcagaactctgatagttctgaaatttcattggagcattcaaggcagtggtttctacgtactgctgagcggtcacaaggtactgtaagtaacagcaatgaagcagtttctatttcaattaatcctgaacctgaggtctctcgggaagcagaagcaaggtcatgatgaaaggcaaatatagaggtacataagaaattatgccttctgtttgcattcagatgtttccttgtaacctatcttattggagactgacaaatgggactgattctgaacaaggagaatctgaagacacagaggaaggacacagaaacttctgtagatgaatgttacatataaccggttagaaattctagttgcactcttttagcaattcagagattttggaccaagtttgtggtataccggttaacctatcaaaacacagtgcatcttatatcatg

SEQ ID NO: 10435 - DNA, 1929 bp, Lycopersicon esculentum
  Predicted polypeptide sequence is orthologous to G1108, G2394
gactttatcgatcatcaaatataatcgctggtaggctttgcttgtgagtataaggtggtagctgaaccagtagcaatattttcttgagatttatggttgaatggctgttacctcggaagaacttaatcaagagaacccaaccgacagatttcctttgctcatggagcaagcagaaagtcatgagaggaatgaacatgttattgatgtagaacaaggaagtagcccctcatcatcaggctcatctgataatgattctcctcatgaattggaaatacccaaccatgaaaatagaccatcaaatcgacattccgtctcttcttcgtccaacgaatcagattctcatagcccttctagtgctaggagagctgatggttctgatcgtcgttggagcccatttaatactctgttgtggctttccattgagctaatattcaccttaggacagattggtgctgccgttgtcgttttatccttgtcaaaagaggaaaacccagaaactccattatttgcttggattgtgggatatgcaactggatgtgcagcaacccttcctttactgtactggcgttatcttctccgttaccaaaccatcagtcagagatcagctcaactgcgtcaagattcaccccaagtcaattccactgcagagccaaattcttatattactatctcattaactcggtcctcggatgaggaagatggaaggaatacacctaccgacatttggaccaggcaaagcaatgcaagacttggttcattggtagatcatttcaagatggccttggattgcttctttgctgtgtggtttgtcgttggcaatgtttggatctttggggggcactcttcttcttctgaggctcccaatctgtacagattatgtatagcttttcttaccattagttgcattggatatgctatgcctttcatcttgtgtgcgatgatatgctgctgcctgccttgtatcatttcaatcctcggtgtgcgtgagaatatgcatggagtgagaggagccacagaagagtccatcaacgctcttcccacactcaagtacagggtcaagacagatggaactggaagtaatgaaagtaaaaatctagaagaggaggaaggtggttgtgtagctgctggcacagagaaggaacgtgccatatcaggtgaagatgcggtgtgttgtatttgcttagcaaaatatgaggacaatgacgaactgagggaattgccttgctcgcatttcttccatacacagtgtgtagataaatggctgaagattaatgcgacttgccccctctgcaaatctgaaattgacgccaagaacagagatctaccttctgtagaagaggaacccctccaacaatcctaaggtgatgcagaaaccaacttcttatggttgaaacacagatcatcgcggctagcttgttgcatggggaaccagtagagtatatcccaactgttacttcttctgctgttgctgctactgctactgctgtttctaccacacgaatttcagtttgtatagttgtagctcataccaggtatccataacaagcttgaaagaagaggtaattccattgttgatacccttacatctctctcctgcctcaccagctatatgttgctcggaacttccaaaaaaaatgtcagctgcactcgtgttggatcttcaaaaaatgcatagcttttggaagatctaaaccgggcgatatttttgaagtgtccatcatctaatgcaaacatagcacactgtataaatagatttaagggtaaagctgggtgtacaccgttctcctcaggcgtcgctattgggattacactagagatgctgttatctcgaactttagtctctactttgttataagcttttttttcttcttataacactaaacaactgtcattattaacagtagtttctttgtgaaaaaaaaaaaaaaa

SEQ ID NO: 10436 - DNA, 639 bp, Lycopersicon esculentum
  Predicted polypeptide sequence is orthologous to G1108, G2394
cacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggtgatctttcactgttgttttcattttggggtgtttccttactttctatcatctctaccagcatcatatttgctcatgtttctattcatccgtaggttgtgtatagtatttctgacctttagctgtatcgggtatgccatgccatttattctatgtgcaacaatatgctgctgccctccctgcatttattcagtcatgggcttccgagaagatctgactcaaaacaaaggcgcccacacagaatcaattaatgctc

SEQ ID NO: 10437 - DNA, 709 bp, Lycopersicon esculentum
  Predicted polypeptide sequence is orthologous to G1128
ctggacatactttaagcgtgaagaagtgtaaaaaggaatggcaagatttgcacgaggtagaggtagaggtcggcgaggtggaaggggccgtgggcgtggtagtgttgaaggagtacgtgataattttgcagtggtgtcatccgtaaatattaacccatcacatagacctacacttgatcaatcatctcagccacaagcacaaacaatagggattcccgaagcaattcagtgtacttctccaggctttcagacccctggaacaagtcaaaaacaattgtcggggtcacaattatcaaggaatatggaaggaagtgtacatccctcttcagtgaatttaaatagtggtgaaggttagttttctcgcatttgacttataagtggtctgtttccctcttctctgttgtactttggaaaattattatgcaatttttacttgcattgttcattttgttttttcaataacattttagtattctgttgttgctctttcaatgcctttggtcaatttcgtagagtctattatgtactatattgttgtacagttatgttttgataagatgattctgtcatgagaatcttcatggatgtataacatactgatttttttttttgataactgagcaatccactgggtcacggttcaaaactcggtgagtagtggctctgacccttctccatttaaacatggtaattttacaagattataccc

SEQ ID NO: 10438 - DNA, 1488 bp, Lycopersicon esculentum
  Predicted polypeptide sequence is orthologous to G1129
gattgatgaatattgcattaccagaaatgctacataacatcactagcaatggaagctcagaattgagcgtgcttgatagaacgaaatggcaggtgcagcaacaagagatgagttattttaatggacaaaatgatcaactcatgaattcttttcatcaaacggctgaagctcaacaatttcatggtctgatcaatgtaaacgatcagagtcttaatgagcttgtgactcgggcaataaagccagacccctgtatggagaacagttggggtggttttgggaccactggtactaatggttttgattatgttccagttggagttggacacggaggaatgtcacacccatctgaaatgaactatgctatttcaagaactacaagttgcccgcctaccatggcggacaatgttgttaaacccaaagacactaggctgagttctaacagaggcagagagagcttcaagaaaaggaaagcagataagaatcagcatctcaaggaggttgcagaagaggaaaccaaagacaagaaattgaaagaatgcatcgaagaggaggatgattcttccaaggtaacaacagagaaaaaaagcaacaaaaggagtgcgactaacagtagcaacagtaaggaaaattctgatacttcaaaggagaagtccaaaattaccgatgataaaaagctcgactatatacatgtcagagcacgtcgaggtcaagccactgatagtcacagtttggctgaaagagtaagaagggaaaagatcagtgagagaatgagattcctgcaagatttagtaccaggttgtaacaagataacagggaaagcaggaatgctagatgaaataatcaactacgtccaatctctccaaagacaagtagagttcctatccatgaaactagctgctgttaatccaaggcttgatatcgatgcagacaatttcttcaacaaagatatatttgcaactagcacgtctactttttccgcagtgggagctggaacatcatctgaaatgcttagtatggcccaacgccagttcaattcattgcagcaaataatgtcaagttctggattagaaatgggtattgtaaatctaaacgaaatggcactacgtagaaccactagcgctcctgtaccaattcctgaaatgtttctcgactcatcaagtatcaatcaagttcagagctttcaaacttggaacactgatttagataacatgtatgcaatggagcttcaacaaggaagatcagcacagtttcttccccatccgtgtacaggttttgctgaagctggacatgacctgaagatggaaatgtgaccttataattctagacatattcaagatccttgatatgacttcacctcagatgtcatggatcctgattctttttttccaagtacataacatagtatattatgtaagtaaatgttgcagttcaagagtatcaaagcaatactatgacactgttcattgcaaaaaaaaaaaaaaaaaaaaa

SEQ ID NO: 10439 - DNA, 481 bp, Lycopersicon esculentum
  Predicted polypeptide sequence is orthologous to G1134, G2555
aaacataaaaacaacaaaaaattcacctgaagagaaaggttagagttaacttttgctagaaaaaatttcaccgatgcaacgtggaactaccggtgacgggggtggtggactttcccgtttccggtcagctccggcgacatggttagaagctctacttgaatccgacactgagaacgaagttattcttaacccttcttctcccattttacacactcccaataaaccaccacctcacccatcaactccgaagcttaagctggaaaccggcggagctactaggttcactggcgatccgggtctgtttgaatccggtggtagtagcaattttctcaggcagaatagttctccggcggagtttctttcacatatcagctctgatggttacttctcaaactatggaattccgtccagtttggactatctttctccatccgttgatgtttcgcagtccgctaagcgaacccgagacgatgattccgaa

SEQ ID NO: 10440 - DNA, 555 bp, Lycopersicon esculentum
  Predicted polypeptide sequence is orthologous to G1134, G2555
ccagtttggactatctttctccatccgttgatgtttcgcagtccgctaagcgaacccgagacgatgattccgaaagttcccccagaaaattagtatcccagttgaaaggagagtcaagtgggcagttacatggttctggtgggtcactggatgctgaaatggagaatctcatggatgatttggtgccttgtaaggttcgagcaaagcgtggctgtgctacccatcctcgcagcatagcggagcgggttcgtcgaacgcgtataagtgacagaattaggaagcttcaggaactggtgccaaatatggacaagcaaaccaacacagccgacatgttggaagaagcagtcgaatacgtcaagtttctgcagaggcagattcaggaacttacggagcatcagaagaaatgcacgtgctcaatgaaagatcaataatgagaagaagagagctccactagagtatataggcaatagtttggttagttgcatgcagtttagaaatggtaattcactcctatatatcctattcttcttcatgtgtagatattaatggaaattt

SEQ ID NO: 10441 - DNA, 726 bp, Lycopersicon esculentum
  Predicted polypeptide sequence is orthologous to G1146
gacgcagatgggattatccctgaatattgatatgtcttccacagcattcattgagccactgccggtcattgaatttgtgagccagcttctgaatcgggatatctcttctagaccattgtctgatgctgatcgggttaagataaagaaggccctgagaggtgtaaaggtggaggtcactcatcgtgggaatatgaggaggaagtaccgcatatctggtttgacatctcaagcaacaagagaagttgactttccctgtagatgaaagaggtaccatgaaagctgttgtggaatactttcgagaaacgtatggttttgttattcagcatactcagttgccttgtcttcaagttggaaatacacaaaggccaaattatttgcctatggaggtctgcaagattgtggaggggcagaggtactccaaacgcttgaatgagaggcagataacagcacttctgaaagtgacctgccagcgtcctcaagagagagagaatgatattcttcagactgttcgtcacaatgcttattcagatgacccatatgcgagggaatttggtattaagattagcgagaagcttgctcaagttgaggctcgcattttgcctgcaccttggcttaataccatgatacaggtcgagaaaaagactgtctaccacaagtgggccaatggaatatgatgaataagaaatgggtaatggaggaacagtgaacaacctggatctgtataaa

SEQ ID NO: 10442 - DNA, 544 bp, Lycopersicon esculentum
  Predicted polypeptide sequence is orthologous to G1146
gaccagaaatcaccacctgaccaggagtgggaacatcctacctggtacctgtggtggatacaaaaatatgtcatccaactgaattcgatttttatttatgtagtcatgctggaattcagggaactagtcgtcctgcacattatcacgttctctgggatgaaaataatttctccgcggatgaaatgcagtctttgacaaacaacctttgttatacatatgctcgttgcactcgttctgtttcagtagttcctcctgcatattatgctcacttggcggcctatggagcgcgtttctacgtagaaccagactcacgtgacaacggttctatacgtggcacacgtgcaacgaatggttctgtcaacgtccggccgctaccagcattgaaagagaaggtgaagaatgtgatgttctattgctagagggtgaatgttgagtttatgttatatagtagtagtgagtagataaaatgtatgaaattaggatatgaaatgttatgggtatgatatacatcataattagagtcaataaattataatttaatttt

SEQ ID NO: 10443 - DNA, 801 bp, Lycopersicon esculentum
  Predicted polypeptide sequence is orthologous to G1146
ggtgtgaaggtggaggttactcatcgtggaaatatgcggcggaagtaccgcatcgccaatttaacatctcaagcaacaagagagttaactttccctgttgatgaaaagggcactttgaaatctgtaattgaatattttcgagaaacttatgggtttgttattcagcatacccagtggccttgtctgcaagttggaaatcagcagagacctaattacttaccaatggaagtctgcaagattgtagagggacaaaggtactcaaagcgcttgaatgagaaacagataactgcacttctgaaagtgacctgccagcgcccccaagaaagggagcgtgatattcttgagactgtgaagcataatgcctatgctgaggacaaatatgcgaaggagtttggcattaagattagcgacaagttggcacaagttgaggctcgtattttgcctccaccttggcttaaatatcacgataatggccgagaaaaagattgtctgccacaagttggccaatggaacatgatgaacaagaaaatggttaatggaggaactgttgccaattggatctgcataaacttttctcgcaatgtgcaagacactgttgcacatgggttttgttctgagcttgcacaaatgtgtggaatatctggaatgaacttcaacccgaatcctgttctgcctcctgttagtgcacgccctgatcaggttgagagaagtttgaaactcgattcatgatgccatgacaaactgcagccgctatcgaaggagcttgatctcctggtcgctatcttggcagacattatggct

SEQ ID NO: 10444 - DNA, 413 bp, Lycopersicon esculentum
  Predicted polypeptide sequence is orthologous to G1146
tttttttttttttttttaaataactagccatgctcttcaatagcaattgttcaagccacaatgtacaaacatcacttgcgaataaactactgtttaactgacaactgaactttcataaacatcaaggtgagataatcacatacaatttgaaaagaaattactccagcatgtccatatcatatagcctggttagagaggacttctaacaatagaacatcacccttttgacattctccttgagagcaggaaggggccttacagcagcaccaacacctggcgcccttgtgctccttccaacagctcctacaccacctttgtacggagcagctccgcttgtgacagatccaccgtcagatgtctctggttccatgtaaaaacgagcacggaaagctgccaaatgtgcataatatgct

SEQ ID NO: 10445 - DNA, 611 bp, Lycopersicon esculentum
  Predicted polypeptide sequence is orthologous to G1146
aaaatataattgaacatttactgtcagctgtgatcataacttcgtcacacaacgtgcagttgcaaaaagcataaccatgatctgtaaagcccacagaccaacttaaaaaaaaatagtttaacataaaagaagatttctactgaatacttcttcagcagtaaaacatgacctccgacacattttcatgaatcttaggaagttgcctgaattgtgctgctgctcctccctcaccaccttcattagcagctcttacatccacgtcattctccatgtaatagcgtgcacgaaaggcagctagatgtgcatagtaggcaggtggtactaaggaaactgatcgtgtacacctaacgtacgtgtagcacaggtagttcgttacattctgaatgccatctgcggtgaaattgttctcatcatacagtacatggtaatgcgcaggacgactggtacccttgatcccagcgtggctacataagtaaaaatcaaactcagttgggtggcatatgttggtgtctaccacagtacctggcaaaatatttccactcctgtctgtcaaagtacgatcatcatgattggaagggaatagacgtgtatgatgtcgcttctgcactacc

SEQ ID NO: 10446 - DNA, 666 bp, Lycopersicon esculentum
  Predicted polypeptide sequence is orthologous to G1146
catagtgaaagccaatcacttctttgctgagctgcctgacaaagacttgcatcagtatgatgtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtattgtccagtaggtcgttctttctattctcctaatttagggagacgacaaccattgggagagggtttagagagctggcggggtttctatcaaagtattcgccctacacaaatgggattatcattgaacatcgacatgtcttccacttccttcattgagccattgctggtcgttgattttgtggcacagcttctgaaccgggatgtgtcatctagaccactgtctgatgctgaccgtgtaagatc

SEQ ID NO: 10447 - DNA, 752 bp, Lycopersicon esculentum
  Predicted polypeptide sequence is orthologous to G1181, G1850
ctcacctctatgtggcgccggaaacttccagaatcaccgaaaattccgacggtcgtcctctctgtagttttggctccagatctgtgagaatagcttcatcgatcttcactcaattcgtcaggtaataagaagagatgactccacagccaatagaccggaacaaaggagagacgacagccggtgaaacgccgaggtctgtgccgacaccgtttttaacaaagacctaccagctcatcgaggatcaatctattgacgatgtgatctcttggaatgaagacggatctacttttatagtgtggaatccaacggagttcgctagggatttgcttcctaaatattttaaacataataatttttctagcttcgttaggcagctcaacacctatggatttcggaaagtagtacctgatcgatgggaattcgcaaacgacagcttccggagaggtgagagaagtcagttagttgatatccagcgtcgaaaggttgccacgccgattgctactccttccgcagctgcaacagcggtggcgattgtggcttctccgcctcagcctccacctccacctccgtctccgtctccgcctccgcctccgcctgctcaacaccggtggctgtatctacctctgattcctgtgaagagcaagttctatcgtcgaactcatctgcaggtagcacagcggagcttttaggagaaaacgaacggttaaagattggagaaattacagctcagcaaagagttgaaccaaatgaaa

SEQ ID NO: 10448 - DNA, 2359 bp, Lycopersicon esculentum
  Predicted polypeptide sequence is orthologous to G1190
gggttccatagttagttataattgcctgattctgacagtaagatctgtaattgtcctatgcttcaacaagaactgagattattggcccttttagaaaagaccctatacttgtgttggttgatgcattattcttgatttggcttgtgagttttccagttgtaaaggtaagtaatctataaaaaaggatacaacatgaagcacaaagatggaaaaccatatccaccaaataaaaattcaaagaaaattcaagtgacactaatagttgtggtgctctgtgggttttccttctatcttggaggaattttttgttctgaaaaggatacatatgcaactaaggaggttaacagggaggatgaaacttccatagggaattctgctggctctctacaaactagaggcaattcctttactgaatgcagtgctgactatcaggactataccccatgcacagatccgaggagatggaagaagtacggtcttcatcgccttactttcatggaacgacattgccctcctaattttgaaaggaaggaatgcttggttcccccaccagatggctacaaggtgccaataagatggccaaagagcaaaaatgaatgttggtacagaaatgttccatatgattggattaacaaacagaaatccaatcagcattggctcgtaaaagaaggggagaagtttatctttcctggtggaggtactatgttcccaaatggtgttgggaaatatgttgatctgatggaagatttgattccagaaatgaaagatggcaccgtgcgaactgccattgatactggttgtggggtggcaagctggggaggcgatctactagatcgtggaattctgacagtctctcttgctccaagagataatcatgaagctcaagttcagtttgctctggaacgtggaattcctgcagttctgggaattatttcgacacagcgtcttcctttcccttcaaactcttttgacatggctcattgctcgagatgcctaattccatggactgaatttggtggagtttaccttcttgaagtacatcgtgtactgcgtcctggaggtttctgggtcctttctggcccaccagtgaactacgagaaccgttggagaggatggaacaccaccattgaggagcagagatcagattacgagaagttgcaagatttgctaacttcaatgtgcttcaaattatataacaagaaggatgacattgccgtgtggcagaagttgacagacaatagctgctataagaaacttgataactctgatagctacccaccaaaatgtgatgatggtactgaacctgattctgcgtggtacactcctcttcgaccttgtgtagtggtgcctccagctactaggaaagttaagttgaatgccctagccaaatggccagaaaggttgcatgtcgccccagaacgtgtttctgatattcgtggaggtagcgagggtgccttcaagcatgacgatagtaagtggaaggtgcgagcaaagcactacaagaagttgctccctgctattggaagtgaaaaggtcaggaatgtgatggacatgaacaccttgtacggaggtttcgctgctgctctggttgaggatccactttgggtcatgaatgtggtctcctcttatgctgccaatacactccccgtggtcttcgacagaggtcttatcggaacgtttcatgactggtgtgaggctttttcgacctatcctcgaacatatgatctccttcatgttgacaatctcttcactgctgaaagtcatagatgtgaaatgaagtatgttatgctagaaatggatcgtattttgcgacccaatggatatgcaattatccgggaatctagttacttcatagatgtcgttgcccctatggctaagggaatgagatggagctgtcacgaagaggagacagaatatagcggacagaacgagaagatactgatttgccaaaagaagctttggtattcaaaggagacttcactataaacatggtgaaactatatacaaagttgtgattatatctctttggataagaggagtccatatatttataataccaccaaaaccataggagaaaaactccagagctcaaagagtgtttttatttgtttctatagattatgagaaattgagattttgattttgaagaaatttagtccagaaaaataacaaccatgtgttgtgctagtagtctcttagttccatttcatgctataatattcttttgtaattttctttcatgtatcttcttagagttgttgaaaaagtaacaaacattgtagcctccttttttttatgtatctaattgattgtcaatttctcatgaatgaaatggttaatattcaaaaaaaaaaaaaaa

SEQ ID NO: 10449 - DNA, 2362 bp, Lycopersicon esculentum
  Predicted polypeptide sequence is orthologous to G1190
ttggttaaaaattgagtcttgaaaacagattctggcccagaaagtgaggggaaattttgggtcttgaaaatacaaggtagctgataaggaggatcaggaaaaatgaagcacaaagatggaaaacctcatcaatcggataaaagttcatggaaagtcacagtgccattaacagttgtggtgctgtgtgggcttttttttctaccttggaggtattttttgctctgaaagggagagatatgtagctgagcctgttaacaaggctgtcgacactcccacgggaactgctactgtacctgtccagatcaaagctgtttcgtttcctgaatgtagtgctgagtatcaggactatactccatgcacagatccaaagagatggcacaagtatggtcgccatcgtcttgctttcttggaacggcattgccctcctagttttgaaagacaggaatgcttggtacccccaccagatggctataaatcgcctattagatggccaaagagcaaagatgagtgttggtacaggaatgttccatatgattggattaacaaacaaaagtccaatcaacattggcttaaaaaagaaggggagaagtttctctttcctggtggtggtacaatgtttcctaatggagttggtgcctatgttgatttgatgcaagatttgattccgcaaatgaaagatgggacaatccgaactgccattgatactggatgtggggtagcaagctggggaggtgatttactggatcgtggaattttgacggtctctcttgccccaagggacaatcaccaggctcaggttcagtttgctctggaacgtggaattcctgcaattctgggcatcatttctactcagcgtcttcctttcccttcaaactcctttgatatggctcattgttcaagatgcctaattccatggaccgagttcggtggagtttaccttcttgaggtacatcgtatactccgacctggcggtttttgggtcctctctggtcctccagtgaactatcaacgtcgttggagaggatggaataccactattgaggagcaaaaatcagattacgataagttacaagaactactaacttcaatgtgcttcaaattattcaacaagaaggacgacattgctgtgtggcagaagttgtctgacaatagctgctataagaagcttgataatcctgacaactatccctcaaaatgtgatgatggtactgaacctgattcagcgtggtacacccctcttcgtccttgtgtagttgttccaaatccagctgctaagaaagtcaagttggatgccctccccaagtggccagaaagattgcacactgctcctgaacgcgtttctgatgttcgtggaggtagtgctggttccttcaagcatgatgatggtaaatggaaggctcgggcaaaacactacaagaagttgctccctgcacttgggactgacaagatcagaaatgtaatggacatgaacaccttgtatggaggtttcgctgctgctgtggtcgatgatccgttgtgggtcatgaatgtggtttcatcttacgcaccgaatacactttctgtggtctacgataggggtcttattggaacaattcatgactggtgtgaggctttctcaacatatcctcggacatacgatcttctgcatcttgatggcctcttctctgccgaaagtcatagatgtgaaatgaaatatgttcttctggaaatggatcgtattttacggcccaatggttatgctataatccgagaatccagctatttcgtagacactattgctactatggctaaggggatgagatggagctgtcgtaaggaagaaacggaatatggcgtagagaaggagaagatattgatttgccagaagaagttatggtattcaaagcaaaattcatgaacaactttgaacatcatagcataaaacacagttgctgataatggagagaaaaagttatatatttaatattggcatcataggagataagtaagtccatacagctcatatattatatatttgttcaacaaatcattggagattgagattttgaattgaagaatcaatagccaagaattaaccatatgctaatattatgatggcttgttcatgcaatatattctttgttaaggcccaaagttttttctttgtggatcagctggctctcggagatttctcgattataaaaaacggagcgttttaatctttggttgtattctatttttattttattttttaggaaaaaagaacattgcagctccttatgtacctagttagatttgttcattttgaggacttcttggatgtaataataactaagctctatttttattgtcaaagtgcttctatctaaaaaaaaaaaaaaaa

SEQ ID NO: 10450 - DNA, 3007 bp, Lycopersicon esculentum
  Predicted polypeptide sequence is orthologous to G1206
gacacacgaaacaaaaacaactattgaaccgtttgcttttacagttttccctcttaaaaaaacaaacctaaaaaaccacaaggtagatcaatgactaagcggaatcatggcgacggcgagaaacgttcctcggtaccggcggatgatctccgttgccatagatcagatggaaagaaatggagatgcaaaggttttaaggttgaaggtaaatccatgtgtgagcagcatttacaccgtgcatccgctagtgtttctgtcgtcaagagagtagaaaaacggcgaaaaagatacgttgcgagaagcgatacgagtgattctgatgatttaagtgaaccagaggacgataagcctgttcctgttagtttaggtgatccgagggaagtagtagagggtgagggtgacaaaaagaaaaagcgtggcaatgaggagaaaccttgttctaaatggatcaaatctcctgaaaagtctttttcgaagggaataaaaatggtttcacaagaggatggggagaggagggttagtagagtggtgaagaaaggggttgaatgtgaccaaaatgattgcacaaatccaaaggacaagaagaagcctgatccaaggagaaagcatttcagtactgatgacccatatgatgattgccagatgtgccatcagtgcatgaaaagtgatagaaaggttgcgaggtgtggaaaaagatgcggtaaacgctattgcagcccatgtattaaaagatggtaccctcatctgtcagaggaagcaattgccgaggaatgccccgtttgtcgtgggaactgcaattgcaaagattgtttacgcaaaaacattattcctaaggaagcaaaatatttaggaataccacaggaaaacaatgaaagaattaattgcttgaagtatcttgtggatgcactttacccatttttgaaaacttttatccatgatcagactatggaaaaggagatggagacatcaattagaggttcgtcactgaaacggctaagaataccaagtgccttcctttataaggatgagcgtgtttattgcaacaactgcaatacctccattgttgatcttcatagaaattgtacaacttgttcttatgatctctgtctgacctgctgtcaggaaattcgagaaggctgttttctaagagatgaagacagaaggctccctgaatggaaagcaaaagaaactggtgaaataccttgcccaccaaaggaaagaggtggctgtggaaataaccgcctggagcttaagtgtctcattgatgaaaagcaggttgaacagataatgagggaagttgaaaacttagtcaaagcaaattcatctgccagtgaggcccactccactgaagaacagtgtacctgtaactctaataatagaagaaaagcagcttccagatcagattctgatgacaattatttgttctgcccttcaagtgacatacaggaagggcacctggagcacttccagaaacattggagaatgggagaacctgttattgtaagcaacgttcttgaattaacatctggattaagctgggaaccaatggtgatgtggcgtgccttccgtaatatagcaatcaagaagggctcatcagatttgatggtgacagcagttgattgttgtgattggtgtgaggtggatataaatattcgtcaattttttaggggttatgttgaaggtcgagcacacccagattcgtggcccgaaatgcttaagcttaaggactggcccccatctacagaattcgagaagcggttgccacgccatggagcagaattcattagagccttgccgtacaaagaatacacacatcccctttctggtattcttaatgttgcttccaaacttccagatggtatactgaagccagatctgggtccaaaaacatatatagcatatggatttgctcaagaacttggacatggagattccgttacaaagcttcattgtgatatgtctgatgcggtgaatattttaatgcatactgctgatgttactattactaagtggcagctttcaaaaattgatgagctgaagaaaaagaaagcttctgcttcagatgatcaaaaagaactaaataatactgatacagatgatcatctagttcgtaagaatgattttgcatctgcaaaacaagaaaaagccagtgatgttttttcctctgacgagaatgtgcaattggagggcagtttatcttctgatcaggtggttgatcttgaaaacaagtttgatggaccagaggaagaaaatggtggtgcagtctgggatatctttaggagacaggatgttcccaagctcgaggattatcttaaagagcatcagaaggaattcaagcatacacttggttctccggtggaccaggttgttcacccaattcatgatcaagttttctacttaaccacgtatcacaaggagaaactcaagcaagattttggcattgaaccttggacgtttgtgcaaaaacttggagaagcagttctcattcctgctgggtgtccccatcaagttagaaatctgaagtcttgtataaaggttgctctcgattttgtttcacctgaaaatgtgggcgagtgcattcgcttgaccaaggaatttcgtatgcttccccaaaaacacagggctaaagaggacaagttggaggtgaagaagatggctttatatgcactggagagggctgtagctgatctaaaggagcttgaatgtaatgacagagcccaggtgcagcaaccacattcaagtagtgagcacaatcctgttcaaactaaagaggtggtggagtagttccattctgttgctgtaatatacatatgcttgtgtaaaaagagtgccgcaaatgactcttttgtatcatctaatctctactgtcatcagccaaaacttttgcatgtacattatccctgattcatcttacagctccaacttaggagaagccacacctacagtaatatgaaatgatttttgattttttgaaacatttgtggaccttttgaaaaaaaaaaaaaaa

SEQ ID NO: 10451 - DNA, 407 bp, Lycopersicon esculentum
  Predicted polypeptide sequence is orthologous to G1206
cggccaaatcggccgaattatcctgagctctatgcatctgtttcactatttcaattgccgaccgctgctcatcagttatagccatctctgctgtgtgtgtcaaaatatttatctgagcaattcaaaattttaaaatattagcttgtcatgaaataagcctgaaaaagtaatggttgcagtctttgcaggcttcatcatggacagaatacagaactgggaaaagcagtaaactgctaccaaggtgagaataaacattaaactagattgtggtatgtggattaatttaccgggaatgtgacaattgtcgaacatattgtataggactggccataaggcagaagagattggacgaatgtggttctatatatttgaaataaaattttagttttttttgctcaaaaaaaaaa

SEQ ID NO: 10452 - DNA, 623 bp, Lycopersicon esculentum
  Predicted polypeptide sequence is orthologous to G1206
ctcgggcactccatctctgccaacataagatggtgaaggcggagactctgattgtagttgcattctcctgttgtccttttctcacagcttcaacaacagtaggtgttgcaaagacaacaggtccagcaggataaaccatgggtgtaaaaggaatttggacattgatgaggaatgaagttgagaacaaaaaggatgaaaggatcaaaaaacatgggtatggaagaattggaagggcttattctttcatggcaacaatggtgaagagggcctaagctgcaagaaatatgtatcaaaattgtccttggcctaacacctaaaagaacacacaaggacaatagcaataaccaaatactaactgctactgctgccaaagaaagtactgctatttctctaagctatgtatgtgagctgctccaaatctgtgacaacttggttgattgcatgaaggaccatcttctttatctgttacaccagaggatgaaacaagtcagtaagaaatggaggcttgtcttaacatagtcagattaaaataaagcattttttatatggtacctctagtttgtcttctctggccttgtggcctttcggcaatgtcctgaactcagctgtgaggcggaaacatt

SEQ ID NO: 10453 - DNA, 776 bp, Lycopersicon esculentum
  Predicted polypeptide sequence is orthologous to G1228
gaagatgagcatctcactgtatacaccagtttctcccaaaaaccaattacaagtatttttgaaaccaaatcagaatccccttctactaggtgattctgttcttccaaaacgtgtttcatttgctagaagaaaatgtaccacaagggctctgctttcacattccaaagatgctgttttgaaagagtttcacgagaaaaaagcactaaagattatcgcaggattgcaaaatctggacaaagagaatgtggcttctgttgttactgctgcagataagggaggagcaacacatgtagatatagcttgtgaccctgagctggtgaaacttgctataagcctgacttcccttccggtttgtgtttcttctgtggatccttcagcatttccagctgctgtggaagcaggagccttgatggttgagatcggaaactatgactcgttctatgagaaggattggtgttctctcctgaacagattttgaacctaacgaaggagacaaagaagttacttccatcagtgatattatcagtcactgtgcctcacacgctaagccttcctgatcaggtcaagctggccgagcaattagaaactggaaggtgttgacatcatccaaacagaaggaggaaaatgctctactccatcaaaaggctgtattcttggattaatcgagaggcaacaccaacactagcagctgcttattcgatttcaggggctgtcatatccccgtcatgtgttcatctgggattgagtgcagtcacagcaccaatggcaatcgtagc

SEQ ID NO: 10454 - DNA, 366 bp, Lycopersicon esculentum
  Predicted polypeptide sequence is orthologous to G1242
ttttttttttttttttttataatcctatcataatcatttagctctttgtatctttctttgaaaacatttgcgtatctttcaacctcctcctctgtctttccttccatttcagcagcaatactttctatgtcattccgaccatacttctcacatgccctgataaaagtattgaaatctctcctactccatgttgaaaatccttcttctaataatttgtccttctcttcctgctcgtcggcagttaaaggatctccgacatcttcgggctcttccacttcaatgctatcttttaattgatttttctggtgagcttgcatgagaaaacgaacttccttctcgtacagctcacttagcctctgggtatta

SEQ ID NO: 10455 - DNA, 672 bp, Lycopersicon esculentum
  Predicted polypeptide sequence is orthologous to G1255
gctgtttgtcaaagagagcacgttggttttgcccagctgatgatgcctttctttgtcaatcgtgcgatgtttcgattcattcggcgaaccaattggcgagtcggcatgaacgtgttcgtctcgaaacatgttctaacaaatcaaccattacaaaattagtcgacaaaactcatcaaccttcttggcaccagggatttactcgaaaggctagaacgccgagaaatggaaaaaaggcacaaatcaggcaatggaaaaagaacgaggaaaatcgggtaccggaaattggcagcgaagagaactcgttggatgaaaatgaattcgaaaacgaagagcagctgctttatcgagttccaattttcgatccgtttgaagcagaactctgcaatgtgccagatgaaactggatctattgttgatctggacattttgttgaacactgaagatgcttgccatgatctgaaccttcctgagtttctttcatctgatattgagcttgctgaattcgctgcggatgttgaaaccttactgggaggcgaagaagaacagagtactcagttatttaaacggcggattttgaaaataacaaggcgattaaaattgaagttgaagacgaagaaatgagagctgttgttgcttgtcatttggatcctgaattggatatggaaagggaagc

SEQ ID NO: 10456 - DNA, 642 bp, Lycopersicon esculentum
  Predicted polypeptide sequence is orthologous to G1255
ggtgggttcctcaaataattgcacttttagcactgtctttttgagttcctctagagcttttttttaacaattatacataaagatctaactcaacatatctccccttagttttcctcttccacctactcttcaaaagtacaaaaaaaagttcattgattaatatccgtatcagagacggattcagaatttgtcgatggtttccgaaagaaaattggcaagtgcaatgggtggaaaaacaacaagagcatgtgacaattgtattaaaaaaagggcacgttggtattgtccggccgatgatgcatttttatgtcaaaattgtgacgcttccgttcattcggcgaaccctttggcacgtaggcacgaaagggttcgtcttaaaacatcatcactaaaacaaacatcatcaccatcatcatcatcggacgattactttcccgatttggaaagtccgctatcaatttcatcagtatcagtgtcagtgtcagtcccatcgtggcatcgcggatttactaggaaggcacggactcctaggcaggggaggaaggctagtaaatccgcgggggatggagatgtcattcgaaagaatcctattcatctcgtccctgagatattaagcgatgaaaatcacttgatgagaatgaa

SEQ ID NO: 10457 - DNA, 458 bp, Lycopersicon esculentum
  Predicted polypeptide sequence is orthologous to G1266
ttttttttttttttttttttaattctctgatagagagcgcttttgtctttattaagcttcagaataatcgaatcgatgaattccgaacactacatgaactatacacatgtagtgagtgagtgagaatgaaaacaaaatagaagcattttttatgtacaaacaagtagaagaatataattctaattagaggaagtactcgtcaaaagttcctctaacaattcagcacccaaatcttcaaaaaccaaaacatttctcttcttcctatttctcttatgtttaacacgtctcattttatttgttgcctttaaaacagcagctggtgaaatcccatcttcacaaatatacttaatattttcaagtgattctcttactttgtccattggaaaatttaaaagtgccaatggacctctcattgtaagtgcagcttgatcatacgctaaagcagcttcttcacaagt

SEQ ID NO: 10458 - DNA, 1022 bp, Lycopersicon esculentum
  Predicted polypeptide sequence is orthologous to G1266
acaaaaatcaaaagatgtcaagcccactagagatagatacttcattttcacattccaatttgttgtttttggaagatgaatcatcatggagtaatactcatgatccatttgttgatattgatgaatatctaccaataattataccatgtaatgatgaagaaatagtagtagaatcctcaaacgctagtactacaacaacaacaacaacaacatcaaaagtagcaagtatccaaaatattcatcatgatcaagaagaggtaacatccatagagaaaaaacatgaagatgatcaagaaaaacattatattggagttagaaagaggccatggggtaaatatgcatcagaaattagggattcaacgcgtaatggaattagggtttggttaggaacatttgatactgctgaagaagctgctttagcttatgatcaagccgcattatcaatgaggggtccttggtctctactcaattttccaatggaacatgttaaaaaatctcttgaaaatattgagtattcttgtaaagatggattatctccagctgctgttttaaaagctactcataaaactagaagagtcaagcacaagagaagtagtagaaagaagaagaatgagaatttggaaaatgtttttgtttttcaagacttgggagttgaattattagaagagcttttaatgacttcatcataggaatgtttattatattcttcgtgtcgaaaatactaagttcagttttcgtgggagataataatcaagatcgcaatgtacgagtctcttttttttcttttttttttatttgttctggatttcttgaagaatttagagtttagtttcaagaagagcttttgatgagttgaaataatgtctcagacttgttttggtacatatagatttgtctttttttttttttaatttttattcactttctttgctattttgttataaataaataaataaataccaatgctcaccaaaaaaaaaaaaaaaaaaaaaaaaaaaaaaaaaaaaaaaaaaaaaaaaaaa

SEQ ID NO: 10459 - DNA, 782 bp, Lycopersicon esculentum
  Predicted polypeptide sequence is orthologous to G1266
aaaattccctctaataaaagctatggttccaactcctcaaagtgatttacctcttaatgagaatgactcacaagagatggtattatatgaagttcttaatgaagctaatgctctaaatattccttatttaccccaacgaaatcaattactccctagaaataatattcttcgtccattacagtgcataggcaagaaatacagaggagtacgacgtcgtccgtgggggaaatacgctgcggaaattcgcgattcggctagacatggtgcgagagtatggctaggtacgttcgaaactgctgaagaagctgcgttagcttatgatagagcggcttttagaatgcgaggtgctaaggcactacttaattttccatctgaaatagtgaacgcctctgtttcagtagacaaattaagtttgtgctcaaatagttacactacgaataataattcagattcaagtttaaatgaagtttcaagtggaactaatgatgtatttgaatcaagatgttaaaacagagctgtgcatggagaatttcttggcactctaagcgaataatgtgtggacacgtagaaaatatttctatttatgtaagaatcaactgaactattaaaatttcgttgttgtatttatattatgtgcttgcctcttctcttattttccttatggaattgtttgcagcgacgcacgctataatctcatgtaaaaagattgcttaggatactttagtagtatgtttataagttgtaatatacaccttctattttctaaaaaaaaaaaaaaaaaa

SEQ ID NO: 10460 - DNA, 1018 bp, Lycopersicon esculentum
  misc_feature (866)..(866): n is a, c, g, or t
  misc_feature (877)..(877): n is a, c, g, or t
  misc_feature (887)..(887): n is a, c, g, or t
  misc_feature (901)..(901): n is a, c, g, or t
  misc_feature (910)..(910): n is a, c, g, or t
  misc_feature (918)..(918): n is a, c, g, or t
  misc_feature (925)..(925): n is a, c, g, or t
  misc_feature (948)..(948): n is a, c, g, or t
  misc_feature (957)..(958): n is a, c, g, or t
  misc_feature (962)..(962): n is a, c, g, or t
  Predicted polypeptide sequence is orthologous to G1266
gataacttgaaaaagaaaaaaaaaacagagcatcccccaaaaaaaaacaaacagagcattcattttttttttccaaaaaaataaatggattcttcttcttcttcatctcaattcttctactcaatgaattctgatttaaattcatcagattcttcatacgaatggtccaatttcaacacacaatcttatctccctttcaacgtgaacgactccgaagagatgcttctcttcggagttcttaacgctgctcatgaagaaacaacatccgaaacagtcacatcgcatcgcgttaaagaagaagaagttacctcagaatccgaggttattgaagcaataccggcgaaggagaagtcgtaccgaggtgttaggaggcgtccatggggtaaattcgcagcggagataagagattctacgagaaatggggttcgagtatggttagggacatttgatagcgcggaagatgctgctttagcttatgatcaagctgcgttttcaatgaggggtaattctgccattttgaattttccagtggagaccgttagggattcgctacgtgacatgaaatgtcacgtagacgatgattgctcccctgtagtggcgcttaaaaagcgccactccatgaggaaaaggagcacgaattccaaaaaagttaatagtattagtaaagtagtgagggaagttaaaatggaaaatgtaaataatgtagttgtgtttgaagatttgggggctgattatttagaacaacttttaagtacatcttgtcaagtgatcaaagtagttgtgatgcaactcatttcagtccatggtaaaatcaaagattagcccatgggtgttcttttttattaactaattttatttttggtacntttttggggtnggggtgggtngggggagggttacntctctttgntctttacntgaaggnccctatattgtaaaaattttggngatggatgnntttnaatttctaagcgaatgattttgctttaaaaaaaaaaaaaaaaaaaaaaaaaaaaaa

SEQ ID NO: 10461 - DNA, 1144 bp, Lycopersicon esculentum
  Predicted polypeptide sequence is orthologous to G1267
tcgagtttttttttctaatttctatatgatataaaacaaaatttagttaatcctcaaaaagtttttattttctttcttttttttttctaagttatataagttatttttgtgttttttggtcatggaagatagttcatacaaaaatctattttttcataaacaagaagattccaccggaactccaccggataatgctgctgattcttgtttttccggtgatgaagcggcggaagttagcatgccatcacctagaaaaagtaggagaggagcaaaaaagaaagtaatttcagtgccaataattgaaggtgatggatcaagaagtaaaggggaagtttatccaccacaagattcttggtcttggagaaaatatggacaaaaaccaattaaaggatcaccttatcccaggggatattatcgatgcagtagctccaaaggctgtcccgccagaaaacaagtcgagcgtagccgcctggaccccaccatgcttctcattacctattgctccgaacacaatcaccaaatcccggccgccgccgccgccaaacaccaccatcacaaccaccctactaccaccaccagttcacccactacctctaccggcaccgccggagacaataatgctactgcggctgtagccacggactctaccgtagtagacaaatcatcccccgaagaaccagatctatttgcttatcaacacgataatggattttcagagctcgccggtgagttaggttggttttccgatatgggaacaacaactacgtttatggagagtacgtcgtcgtccatggcgggatccacgtggaacgacagtgacgtggcgttaatgttgccgattcgagaagaggatcagtcgttgtacggtgatctcggtgaattaccggaatgttcagttgttttccggcggtacagtgtggaaactccctgctgcggaggtacaggataacaaatcatttgtcaatttttcactgaaattgccatatttttattttttaattatcttcctgacttttggttccacgttcttcgtgacccttttttttaattttatttttatgtaaagatctggtagattaaaaaaaaaaagaaatatactttgatttgatttttacttgaaaaacaaaaaaaaaaaaaaaaaaaa

SEQ ID NO: 10462 - DNA, 3104 bp, Lycopersicon esculentum
  Predicted polypeptide sequence is orthologous to G1272
gactctctcataaatttgtcactctccctccttctcctctcttccatttagggttttgttcttgattttggtgcttcatctgcctcttttgagcagaagataggatcctgatatggctgaagaagaaacaaatggagcagcagcagagggtctgccacctcctccccctgttccaccagatttcactcctgctaaaactgaaattgagcctgtgaagaaaaagatcttgcgcgttcccatggccaggcgtggtgttggaaataagggacaaaagattcaaatacttactaatcactttaaagtgaatgtaaacaatgtggatggacacttcttccactacagtgttgccttattctatgaagatggtcgaccagttgatgggaagggagttggaaggaaggtgttagacacagtgcacgaaacttatgatacagaattagctggaaaggactttgcctatgatggtgaaaaaagcttgtttaccattggagcactccctaggaataaaatggagttcactgttgtccttgatgacgtgatatcaaataggaacaatggtaacagcagccccggtgggcatggtagtcctaatgaagctgacaggaagaggttacgtcgtccttaccagtcaaaaactttcaaggtggagatcagttttgctgccaaaatcccgatgcaggcgattgcaaatgctctgcgtggtcaagagtcagagaactctcaagaagccttgtgagtcttggatattattttgaggcagcatgctgcaaagcagggttgcctgcttgttcgacaatcctttttccacaatgatcccaagaactttgttgatgtcggcgctggtgtgcttggttgtcgaggattccattccagcttccggactacccagagtggcttgtctttgaacattgatgtgtctacaacaatgattatccagcctgggcctgtcgtggacttcttgattgcaaatcaaaatgcaaaggatcccttttcactggattgggcaaaggcaaaacgtgtgctcaagaatttgagggtgaagacaacccccactaatcaagagtacaagattactggactgagtgaccgtccttgtcgtgagcaactatttaccctgaagcagaaaggaaaagatgcagatggtgaggtccaaactactgaagttactgtgttcgattactttgtcaaccaccgcaacatagagttgcgttattctgctgatttaccctgcataaatgttgggaaaccaaagcgtcccacctttttcccaattgagctatgttccttggtgtctttgcaaagatacacaaaatccttgtccacattccagaggtcttcactagttgagaaatcaaggcgaaagcctcaggagaggatgcaagtcttaagcaatgctctcaaaatcaaccaatatgatgctgagcctctgcttcgttcctgtggaatatccattagcaataacttcactcagattgaaggacgtgttcttcctcccccaaagctgaagacgggcggtgatgactttgtccctcgtaatggcagatggaatttcaataataagagactagttgatcccactaagatagaacgctgggccgttgtcaatttttctgcacgctgcaatgtacaagggctagtcagtgatctgatcaaatgtggaaaacagaaaggaattatggtggaagacccatttgatgtctttgaggagtctccacaagtcaggagggctccaccacttgtgagggttgagaagatgtttgagcaggttcaatccaagctacccggggcacctaaattcctgctttgtttgcttcctgagaggaaaaactgtgatgtatacggaccatggaagcgaaagaatcttgctgagtatggcattgttacccagtgtatagctccaacaagagtcaatgatcaatatatcaccaatgtgctcctgaagataaacgcgaagcttggaggtttgaactctatgttaactgttgaacattctcctgcaatccctatggtgtctaaggtccctaccattattcttgggatggatgtgtcccatggctctcctggccaatctgatgtcccttcaattgcagcggttgtcagttcaaggcagtggccatcaatatctcgttacagagcttcagttcgtactcagtctcctaaagtggagatgatagacaacttgtttaaacgtacctctgatactgaagatgatggaataatgagggaggcgttgctagatttttatgtgagctctggaaaaaggaagcccgagcatataataatattcagggatggtgtcagtgaatctcagtttagtcaagttctgaatgttgagctggaccagattattgaggcttgtaagtttcttgatgagaagtggtcacccaagtttgtggtgatagttgcccagaagaaccatcataccaagtttttccagcctaatgatcctaacaatgttcctccaggcacaatcatagacaacaaagtctgtcacccaaggaattatgacttttacctgtgtgctcatgctggaatgattggtacaactcgtcctactcactatcacgtcttgtatgatgagctgggtttctctgctgatgatcttcaagagcttgttcataatctctcttatgtgtaccagagaagcaccactgcaatatctgttgttgctcctatctgttatgcccatcttgctgctactcaaatgggacagtggatgaagtttgaagatgcatcagagacttcctcaagtcataatggagtaaccaatgctggaccagtctccgttcctcagcttccaaagctcgaggagaaagtttccagttctatgttcttttgctaaggcgcgtaacgccttcatgcttttcttttttatgtgtggtttgtgaatagtttctggttcaaaactcttttgagaagacggtggtagttaaatattttgtctagacttaaataggtaaatcactctgctaaaagatttcacatcttttggctctgtggtttgctatctcttttaacttatcctggatcatgtacttatgttttggtggtgtttttaagttatggacatgactagtagtttctctcaaaaaaaaaaaaaaaaa

SEQ ID NO: 10463 - DNA, 551 bp, Lycopersicon esculentum
  Predicted polypeptide sequence is orthologous to G1272
gagctttagaagattgtggtaatggctgaagaagagaatggtggatccacagaggctctgcctcctcctccccctgttccacttaatttctctcctgcacaagctgaaccagagccagtgaagaagaaggttttacgtgttcccatggcaaggcgtggccttggaagcaagggacaaaagattccgatccttaccaatcactttaaagtgaacgtgtctaatgttgatggacacttctttcattacagtgttgccttattttatgaggatggtcgacctgtcgagggaaaaggcattggcagaaaagttctggatagagtgcatgaaacatatgatacagaattggctgggaaggattttgcatatgatggggagaagagtttgttcaccatcggttcactacctagaaataaactagagttcacagttgtactagatgacataacatctaatcggaacaacggtaccaatggcaactctagccctggcagacatggaagccctcctaatgaaactgataggaaaagattaaggcggccataccaatctaa

SEQ ID NO: 10464 - DNA, 489 bp, Lycopersicon esculentum
  Predicted polypeptide sequence is orthologous to G1272
ccttgtcgtgagcagatgtttactctaaagcagaagagcaaagatgaggatggtgaagtgcaaacttcagaagtgactgtttatgattactttgttaatcatcgtaacatagacttgcgatattctgccgatttgccgtgcctcaatgttggaaagcctaaacgtcctacctatttccccattgagctctgcactttggtctcattgcaaaggtacacaaaagccttgtccacctttcagagggcttccttggtggagaagtccaggcaaaagcctcaggagagaatgcaaattttgagcaatgctctcaaaatcaacaattatgatgctgagcctctgcttcgttcttctggtgtctcaatcagtagcaacttcacccaggttgacgggcgcgtactgcctgctcctaagttgaaggctggaaatggagatgaccttttcacccggaatgggaggtggaactttaataataagagattctttgagcca

SEQ ID NO: 10465 - DNA, 736 bp, Lycopersicon esculentum
  Predicted polypeptide sequence is orthologous to G1272
aacgaaaaatgatatttgatgccttactttcctatgtaaactgaatgttgagaagccctttgaattacatatgtgtatacaaacaagagaagagtaaattgagtggtggaaatacaaattgtgagatttgttccaccttattctcattttagtttacaaatatttagattggagaaaacagtaaattaaataagagcaacatatttacaactgttggacatcaaacgcagttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcagggatggtgtcagtgaatctcaatttaatcaagttctaaacatagaactggaccagctcattgaggcctgcaattttctagatgagaagtggtcgcccaagtttgttatcattgttgctcagaaaaatcatcatacaaagtttttccagtctggatctccctgatatgttccaccagggacattatagataacaagtttgtcatccagggaacatgacttctatctgtgcgcccatgctggaatgattggtacgactcgacctacacattaccatgtggtgttggatgaaagtggtttctcacctgatgaa

SEQ ID NO: 10466 - DNA, 768 bp, Lycopersicon esculentum
  Predicted polypeptide sequence is orthologous to G1357, G1452
attgactctggatccgaatctgataaaccgactaaagagttctctcatcacgattcctctggccacttcaaggattttgatgtcgaagatgactggtttgctgatataatgaaggatgatatcattaagctagatgattcttcacttaatcccagacctgtttccatgatcccggataggcctgaatcctctgaaatatcaaatcatgaagctcaagctgcgatgtcctctgttgttcctttccagggcactgcgaatcgaaagactcagactagtaagagaaattgtaatgaagtgtggagtaaaggaaatccaaccatacaaagctattaagaagaataaagtaggagtgggcacgactagttcagtaagatggttgagaaacatgttttcagttaaatggatgaggcaatatgtgataactatatttgttgctaccttgatatttctggtcatgcttcttagtttgttgggagtctcgcagcaagtaaaacagcgtaggcatcttctcgttttggcgagcagctgaagttcatactatactgggaatgttgtttaagtaataatgttatttggagtggagattgaagatgattggttatgcgaaaacgaacaagaaccaactgtgtagagcagatgtacagttgtggtggtgcttgtagcaatgtataaccatatatttatattgggatctatttggatgcataaattggtgcctgtattctggtgaaattgctggggattctgtttattatgcctttcactatc

SEQ ID NO: 10467 - DNA, 1304 bp, Lycopersicon esculentum
  Predicted polypeptide sequence is orthologous to G1380
cttcttttctctctctaaaattctcatccaaaaacgaccacacaatacagtagagagagaaaatcaaatcgaagattttacagaaggatatcgagtttcttcggagacgaagggtagcttaatcctccattcgatctcaaaaggggaggtgtgatttttttattttttattttaaaataatttttggatatgagaagaggcagagcaactccggcggcggcggcggcggcggtgaagccagatggatctggaggattgaaggagattaggtttcgtggagttcggaagaggccatgggggagatttgctgcagagattagagatccatggaagaaaactagggtttggttaggtacttttgattcagctgaagatgctgccaaagcttatgatgctgcagctcgaactcttcgtggacctaaagctaaaactaatttccctttacctatgtattctcagcatcatcagttcaatcgaagtttaaaccctaatgatcggttagttgacccgagattgtactcacaagaagctccgatcatttgtcaaagacctacatcgagcagtatgagtagtactgtggaatcattcagtggaccgagaccgccacgtcagcaaacggcggttttgccttcgagaaaacatcctagatcgccgccggttgagccggatgactgcaggagtgattgtgactcatcgtcttctgttgttgaagatggtgattgtgaagggggaaatgacaacatcgtttcttcatctctcagaaatccactgcctttcgatctcaactttccacctccgatggatgatgtttatgctaattcaaatgatctttactgcacagcactatgtctttgaaggaaaatggtttcaaagtttcaatctttcaattatattgaaacacacaaaaaaaatcacagatttaaagcaattgctatgaatctgttgctggaagagattttaactcttccatttacttatcctatttaatgtcatggtatttcatgatagatggattagtgtctgacaattgatctgattatgtgtccttcaactatatatgagttttgggataatgtagtcttttattgtcagatttatatacattaacatgtaaaattagagggaactttcagttctgtgttgtactattacaatgatagctctagtgtcgttgatgtaagacaatatctactctttcaatcacttaatgtaagaatcaagacttcatctaatcaaatattagcttacatgtgttcgttggcatatatgctagtttaatgttttgattgaaaaaaaaaaaaaaa

SEQ ID NO: 10468 - DNA, 484 bp, Lycopersicon esculentum
  Predicted polypeptide sequence is orthologous to G1380
aaataatcataaaaaacattaatttacacaattccgatcaatttagtggccgccggcgacaatttccgacaaccccatctcctattttaaattaccggccatgccccgtcggaaaaatccggagataaatggatcaagatccgttgttttccaacagtcggtgattgagccacctcgttataggggtgtacgtaaacggccatggggtcgattttctgctgagataagggatccggtgaaaaaagctcgtaaatggctgggaacgtttgatacagcggagggtgctgcacgagcttatgatactgctgcaaggtcttttcatggagctaaagcgaaaactaacttcccagtattgcctccttatggggagaatcaatttgaaaatcttcaacaatcaaggccggcgtcgagtagtatgagtagcacggtggaatcatcgagtgatgcgcgtgcattgtgtaaaacgatgcaaccgcggattgaa

SEQ ID NO: 10469 - DNA, 743 bp, Lycopersicon esculentum
  Predicted polypeptide sequence is orthologous to G1380
ctttttttaaaaaatcttcggtcatgcggagaagcagagcagccgctgcggcgagacaagttccggcgacggaagttccggtaccggcaccggtggccggagaacacaacggatctggaggatctaaggagataaggttccgtggagttcgaaagagaccatggggaagatttgcagcagagattagagatccatggaagaaaactagggtttggttgggtacttttgattctgctgaagatgctgctcgtgcttatgatgcagcagctcgtactcttcgtggacctaaagctaaaactaatttccctttaccttcttctcatcatctacctccatatcctcaccatcatcagttcaaccaaagcatcaaccctaacgatccctttgtcgattcccggttatactctcaggaccacccattagtttcacagagacctacttcaagcagcatgagtagtacggtggagtccttcagtggaccacggcagccgccgcggcagcagacggcagcttccgtgccttccagaaagtatccccggtcaccgcctgttgtcccggacgattgccatagcgactgtgactcatcgtcttctgtcgttgaagacggtgaatgtgataacgacaacatcgcttcttcctctttcagaaagccgttgcctttcgatctaacttaccggcaccgatggatgacttcagcgccgacgcatatgccgatgatcttcactgcacagcactatggtctt

SEQ ID NO: 10470 - DNA, 2140 bp, Lycopersicon esculentum
  Predicted polypeptide sequence is orthologous to G1382
ggaatccgtcaatggaagattctcagtctcactcccactctcaccctaaccaatacaaccactcagctccactcctttccatcaatgaatcttcacagcaacttaaatttgcaagctccgatgctgctttctctcacaccgtctcctccgccgttggatccaacaccggtgctaggtacaagctaatgtcacctgctaagctcccgatctctcgctcctccgcatgtatcaccatccctcctggtctcagtccttcatcctttctcgaatctcccgttcttctatcgaacatcaaagctgagccgtctcctaccacaggttccttctccaaatttcaagtaatgcaaggctctagtgggagtgctgctttttcatatttgagaagctgttcaagtggaaatgtatatggtgaaacgaccggcgaatttgagttcaaatttgctattgcatctaattctacatcaggatcactggcgaatgaagctgcagtgatttctgcaggttccaaccaacagcaaagtgaacctctgattcaagttcaagatcgatatctttctcaatcattagcaccttcagttcttgttgaaaccgagatgcctgattcaaaagagctgagtctacctgcacctgttagtttagaagcctcgtcaattagtacttctgctgctgcaactgataatgaagaaacaaatcagagaggtcaatcaaatacaagctcgcaagggtcacatgctgataataaagatgtatcatcgataactgctgagagatcatcagaagatgggtataactggagaaagtatggccagaaacttgttaaaggaagtgaattcccaaggagctactacaaatgtacatacccaaactgtgaagttaaaaagatatttgagcgctctcctgatggacaaataacagagattgtgtataaaggttcccatgatcatcctaaaccccagcccagccgtaggtttactcctggtgtgcttacttccatccaagaagacagaggtgagagagatgcatgcctcactggtcaagaagacaaattcaacactaatgcccagactagtaacactgagcccggcggtaatccactatcacctcgacaagcaggtgatgatggtcttgaaggtacagtgtctcagttgcatagtgctaatgatcaaatggacgaggatgatccatttgcaaaaagaaggaaaatggatggtggcatggatattacaccaattgttaagcctatccgtgaaccacgtgttgttgttcaaactgtgagtgaagttgatatattggatgatggatacaggtggcggaaatatggtcaaaaggtggtccgtggtaatcctaatcccaggagttattacaagtgcaccaatgctggatgccctgtcaggaaacacgtggagagggcatcccatgatcccaaatctgtaattactacatatgaggggaaacacaatcacgatgtaccagcagctaggactaataaccatgaaatggcaggatcagcatctgtaactgggggttcaagggtcaggacggaagagaatggctcagttagcttgaatctaggtgttggtattggttatggtatggagaataggcgcaatggacaactgcacacactgcctgcagaaactgcacatagccaagttcaggtttcaagttctagtatgatgttagtacagccagctacagttgcagcatgctacaacattgtaaatggtggaatgagccggtttggaactatggaaaatcgtgttcagggcactggctttgagactctgcccttgcaatcatctgctcaatgtcctcaaaactatggaaggatacttttgggcccgtgaatgtttcttccctcaggcaaaaacttaaaaataagaagcttccatccgttttctttttcagcttctcggtgggattacagagggctgcatctcttattggcgtaacctcgcttcaggattaagtacccagcatgttgtatgatacagtttcaccaaatgttcattatgtaattagctttaatatcactgttgctttatactgacagtatgctacaaaatgtaacaactatggatgttctgagtagatgtgaacgtcaatatattccctaaaagtaggcaaaaaaaaaaaaaaa

SEQ ID NO: 10471 - DNA, 754 bp, Lycopersicon esculentum
  Predicted polypeptide sequence is orthologous to G1382
cctgaagccacttaaaccaggagatgagggtgataataatggtggtcgcaactcaaagagacggaagaaagaagtacctacgagtgatgacatgactccacctatgaagtctcctagtgaatcacgacacattgttcaaactagcagtgaagtggatgtagtcaatgatggttaccggtggcgtaaatacgggcaaaaatttgtgaaaggaaatccaaatcctaggagttactaccgatgctcgagtgctggttgccctgcaaagaagcatgtggagaggtcatcccataatccaaaatcagtgattacagtatatgaagggcagcatgaccatgacatcccaccttccaaaactgttatccaaaatacagcaaaggctgattctaatacaacaagaataagtggagagtccacatctgaatcaggtgaaaacaaacatgttgtccatattggtgcaagttgagagcataatgccaaacaatcaaactcaatacagatttagataatgttacatcatcaagttatctaatcttatcttttttcttatttgttgtaattggtcaattgttctccacttgtaggagaaaaaagaaaggataaatatatatgtattatagaaacagctgatttaacctcataattggtgtgaattcctatacttaaatgtataagttgtgttaataataaatttaagagagttcagatcgatataaaataattaaaaaaaacaaaaattaaaccatgtcggccgcct

SEQ ID NO: 10472 - DNA, 634 bp, Lycopersicon esculentum
  Predicted polypeptide sequence is orthologous to G1382
gtaaaactgagcctagtagtactcccgtatcacctcagcaagcggacactgatggtcttgaaggagcagggtcacagatgcatggcactaatgatgatatggatgaggatgatcaatttgcgaaaagaaggaaaatggatggtgggatggatataacaccagtgattaagcctatccgtgaaccacgcgttgttgttcaaacagtcagtgaagttgatatattggatgatgggtacaagtggcgcaaatatggacagaaggtggtccgaggcaatcctaatcctaggagctattacaagtgcaccaatgctggatgccctgtcaggaaacatgtggagagggcttctcatgatccaaaagctgttatcaccacatatgaaggaaaacataaccacgatgtacccgctgcaaaaaataataaccatgaaatgacaggatcctcgcctgtaaccggcagttcaaggatcagggcaggagagaccaactcacttagtctggatctaggcgttagtactggatatcgtcttgataatgggaacaacgggcaacttcacaccctccatcaccaagttcaagtttcacgttctggtatgatgctagtacagccagctgcagttgcagcgcgctatggtat

SEQ ID NO: 10473 - DNA, 641 bp, Lycopersicon esculentum
  Predicted polypeptide sequence is orthologous to G1435, G2741
cttcattcaacggcatctctctcaaattcgccggaatatactccaccagcggaagaagattgtagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatg

SEQ ID NO: 10474 - DNA, 769 bp, Lycopersicon esculentum
  Predicted polypeptide sequence is orthologous to G1446
agtttgacacttcgaatttgattcaaaaccccttatcggtcgatcggttatataattaaggatgccttttccatggaagaaggtgaagaaaacaagcatttcacaattggtgaaggatcatgtaaattctcaaagtggatctcctctaatggtggaaactggttttccaacttctcttgtcgattttgttgtcaagaatcgccgaagattcaagaaatcttccaagaaaaaaatggttgacgaccctttgttcgttctaaatcccccttcgtctgtaacgttaccctctacttctgaattcatgattgatgataatgaagttcctcctatgatccgtgtaccagaagtggaaggtgacaaacctgaatctcgcaagatgaacgacgagaaagagtggggttatggttgtctcagtatgaatcaggggttggtggccgttctgaagatgtttctcgtggcggcattggttttagggatgaacaatcttgttgtgggggtaaccatgtcagctttcttattgtttttcttggaatatttaggagaacgtttgtatggcttcttttataaggcacctttggagctgtcgaaggatggttgctctgactttcgatttcaaattcaagaaattgaggctgcacagggaactaatgttgaggatagtcaatgtattagggagaagattgaggaggagagtatttgggatggaaaaaggtaatgtgtaggggctagatggtatagagaaaggagaggagtatagatatgatttatg

SEQ ID NO: 10475 - DNA, 675 bp, Lycopersicon esculentum
  Predicted polypeptide sequence is orthologous to G1451
ctggtgagctaggacatcattcaatgaatcttcagtcttttggcatgcttccttggatgcaacagagagtcgattcaacaattctcccaaatgatattaatcagcactatcaagctatgctggctactggcttgcaaagttttgggagtggagatttactgaaacagcaattaatgcagtttcagcagcctgtccaatatctgcaacatgcaagtactgagaattcaattttgcatcagcagcagcagcagcagcagcaaataatgcagcaagcagttcatcagcatatgctgcctgctcaaacccaaatgctgtcagagaaccttcaaaggcaatcccagcatcaatccaataatcagtcagaagaacaggctcaccaacacacttaccaagaagcattccaactcccgcacgaccagctccagcagaggcaaccatcaaatgttacctctccatttttgaaagcagattttgcagatttgacctctaagttttcagcatctgttgccccttcaggcgtgcaaaatatgcttggttcgttgtgttctgaaggaagtaataattcattgaatatcaacagaactggtcagtccgtgatcatagagcagtcgcctcaacagtcctggatgtcaaaatttacagagtcacaactaaatacgtgctccaactcatcat

SEQ ID NO: 10476 - DNA, 515 bp, Lycopersicon esculentum
  Predicted polypeptide sequence is orthologous to G1451
cgaaaaaagggaatttactcacaaaagttcaactgcattaacaagtttacaaatcaagattcttagtctacatcacatatgtcctgatcctcagtacagcgatcaagattaactaatacaaatagcattgtaatacaaatgacagatggggattaagtctttactacataaagaacagtgtcttagaaacgagaccggattaattaggcgaaagcaaaagaacgccaagctcttgtgaagcagagccacacttggtttatcgaacaacgacagcagtcagtaatcaagtgatcctatagatggaagtccggacatgaaatctcgaccatcagcactattattactgctcatcctttcaggtggaccgcggtttagggatccaacctcctctttccccagtttctgcacatcctcgggtgaaagaattttgatgtaccaaacattattgacaaattcctcccacggatcgtctccaaggagaaggacatcattctccctggagagagagaactagt

SEQ ID NO: 10477 - DNA, 780 bp, Lycopersicon esculentum
  Predicted polypeptide sequence is orthologous to G1451
gtatcttcatcctcatcatctaagcgaattgctctagaatctcagctcccttctcgggttactccatttgtggtgtcccagcctgaggatgtgatagcgcacaatacaaaggtctcggatctttcctctttactgccaccttttcctagtagagaatcgttttctgattatagaggagtagacgatagccaaagcaatgcactctatggatttacagactttttgaacatactgcagaccggtatgtccaacatgaagggtagtagtggtgataatggatctttatctattcattatgctacctctaccttcacaagtactgcgggcaatgagtacccccttaactcagacatgacagcttcaagttgtgtagatgaatcaggtttcttgcagtcctccgaaaatggggaccaagcaaacccaactaatagaatctttgtgaaggttcaaaaatcagggtcctttggacggtcactcgatatctccaaatttagcagctatcacgaacttcgaagtgagcttgctcgcatgtttgggctagaaggcttgttggaggaccctgagagatcaggttggcagcttgtaattgttgaccgagagaatgatgtcctcctcctcggtgacgatccttggcaggagtttgtgaacaatgtttggtacatcaagaatactttctccatgaagtgcaacagatagggaaagagggacttgatcttccaaatggtgtccaagcgcagacgcttcctggcaatgtcaatggatgtgatgattatatgaaac

SEQ ID NO: 10478 - DNA, 643 bp, Lycopersicon esculentum
  Predicted polypeptide sequence is orthologous to G1451
ctaagcttgcaaatcagccacttatgcagttccaacatatccctagtacttcagcatcttcgattcagagccagcttttgcatccatccaatttgcaacatactttcctccaaggcctcccggagaaccaactaatatctcaggcacagatgctgcagcagcaattgcagtgccaccaatcttataatactcagcagcaacagttgcagcgccagcaattgtatcatgatcaacaacttcaggaaccccatcaagtacagcgtcaagatcagcagcaaaccaaggctcaattgtgttcagctactcagtcacagctttctcatttacaggtcctaggttcaacgggttctcaacaaacattttctgatttagttggtcatcatattaatacatctaacaacagttccaccatgcaaagtctcctgagctcattttcccataatggagcatccacttccctgaacatgtctgagaccaactccctagtgtctccttcctcatcatcaaagcgaattgctctagaatctcagatcccttcacaagctccatacatggtgacacaggctgaagttattacagtgcctaatactaaggtctcagatttttcactttggtttcaccaatcctggcagaaagttttgga

SEQ ID NO: 10479 - DNA, 1345 bp, Lycopersicon esculentum
  Predicted polypeptide sequence is orthologous to G1480
aaaaaataaaaagcaaatcaatttttgattctctcacttaacacagaaagaaaaaactaatcgaaataatgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaattattttttatatatatatttattatctctaattattaaaaaaaaaaattgatattttgcttttttcctctttatgttgttagtgaggaggatcgtaactacgtgtatatatatctaattttgtttctctttttttgtatcaaaaagctattaaaaaaatagaaatttgtaatggataaaaaaaaaaaaaaaaaaaaaaa

SEQ ID NO: 10480 - DNA, 704 bp, Lycopersicon esculentum
  Predicted polypeptide sequence is orthologous to G1480
atacttgtattggacaccatgaaaacaacaatgatccatggattccaccaaacacaatcacatcaaagcttccattaaacacagaaatgaaagggatggatttcatatttacagattcagaaaactttcttgattttgattatcctgcttgtgtagacacacaatctcaacctcattacaattcatccaatgatagagttgtaccagtacaagctaatactccaattaaatcattgccatttcatcatcaagaaaaacattttgagattgatttcactcaatcacacatcaaatcttacaacaccccatcactcagtgtttcttcgtcttctttagatgttggaattgtaccagatggaagttcaatttccgaaatatcatacccatatataagaactatgaataacagcaacagcagtattgatttatcgaattctgcgaatcatcaaggtgaaaaattactgggtttagatagagaagcaagagttttgcgatacagagagaagaaaaaaaacagaaaatttgagaaaactattcgttatgcttcaagaaaagcttatgctgaaacaaggccaagaattaaaggtcgatttgctaaaagaacagacggaagcgccggcgccggcgagtttgatgacgttgacgggattttctccggcaccgatttcattgcggctgagtcgcgatacggcgtcgttccttcg

SEQ ID NO: 10481 - DNA, 600 bp, Lycopersicon esculentum
  Predicted polypeptide sequence is orthologous to G1481
aattgttgcttttttttttgtccatttgaaaaaatacaaagaaattatgaaaaactgtgacctttgtacgggattggctaggatgtattgtgaatcgaataacccaagtttgtgttgggactgtgatgcaaaggttcattcacctaactttcttgcggcgaggcattctaggtctttgctatgtcaggggtgtcaatcgcctacggcttggccggctgccggggcaaaccttggaaaaacggtttctgtatgtgataagtgtgtggatggttactatcatagggatggagtggaaaaaatggaggaaagtgaaaccgtgaatgatgaaaaaagtgatacaaaggacaaggaaactgattacgaaaaaaatgaggacaaaattgattcgggggatattcagggggttccgtggtcaaatacaacgcctccaccgccggttagttcatctagcagtgaaaattcttcaaatggctgtaaaaatgtctcttcaaagcaaatgcgtgaacctgatccggatcttcagtcaaatgacgacagcggaagttcgtcgtgtcaacggaaagtccatatatccccggcaatggatgcaaacggcggaaa

SEQ ID NO: 10482 - DNA, 803 bp, Lycopersicon esculentum
  Predicted polypeptide sequence is orthologous to G1482, G1888
ctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttgggtatttggggtcccctcagcccctcctctttcagagtcaaagcaagagactcagatccaatttttcccttcacaaattttgaactttggtgggcaaattggtctaaagaatcaagagaagtactaatatcaagtccagtagaaagtgacagatgacaattcatttgctgtcccac

SEQ ID NO: 10483 - DNA, 202 bp, Lycopersicon esculentum
  Predicted polypeptide sequence is orthologous to G1482
tttttttttttttttgttaaacaacaacaacaacaataataattatagtaattatgttaaaagtccaagttagtcgataggaaatgactacgttgtctcctcgtaaggctttgcttaccaaaccaaattaaagatcattaacgttgtttcaacaaataccagagagattttgaaaaaaatgtgaaaggaggtaatacatgtg

SEQ ID NO: 10484 - DNA, 711 bp, Lycopersicon esculentum
  Predicted polypeptide sequence is orthologous to G1483
gcaacttccagatcttttgcttcttcatacgtcggagtgctgaagaagtgatgaagattcagtgtaatgtttgtgaggttgcggaggcgaacgtgttgtgctgcgccgatgaggcggcgttgtgttggtcgtgtgatgagaaggttcatgctgctaataagcttgctagtaaacatcagagagttcctttatctggttcttcttcatctatgcctatgtgtgatatctgccaggaaacagttggctacttcttttgtcttgaggatcgggcattactttgccgaaaatgtgatattgctattcacacagctaatcctcatgttgctgctcaccaaagatttttgctgactggagtgaaagtaggacttgaacctgttgatcctggtggtatttcatcctcagggacatcacagtccattcagaaggtttctgagccagagtctgctccactttcaaaacggaatgcctcagtatcattggatgctcaatttaacaaagtgttacctacccaggtcagtggcattgaggattttgctcctactaagtctccgtttgctggaggttctgcagctggaagtatgccacaatggcagttcgatgaatttattggtctgagtgatttcaatcaaaattatggatacatggatgatggatcatctaaggcggataatggcaaacttggtggagagtcggaactcttcatcatcttaa

SEQ ID NO: 10485 - DNA, 278 bp, Lycopersicon esculentum
  Predicted polypeptide sequence is orthologous to G1488
ttttttttttttttttttaattcaaactttttttttaaaacgagaaaagtgcaaagtagttatcccctacactaggtgactgatactagatgaggtgcctgaaatttggaccacaattttggtgatgatgaagcagaaattcatcaccgccgtttgatacaccgaaaatagtgggttgactaagcaattgatgctggtggtgatgtgcttggtgtctctggagatccttttgcctccggagttccagaactttccgatgagaattcgagtctggtgcc

SEQ ID NO: 10486 - DNA, 644 bp, Lycopersicon esculentum
  Predicted polypeptide sequence is orthologous to G1488
cttcacactcaattccttcattctctcttcctttttatcagcttccgattctccatataaagaattagtctcaaacctaccgttactttgcgttttacactccaccattcttctcttacactacacaccaacaacttcttcttctaaacaatggaagcgtcggatttattcgtcagcggttttttctcgcatgccggagacgaacaaattccgaataacatcaacaataactgtaacaatttttctgtggatgatcttttggttatcccaaaggacgatgaagttatggcagacgcatttttcaacagtattacaggaaattctgctgattcttccaacgttaccgtcgttgacagctgtaattcctctgtttctggtggagatggacaatttaacggaaacctgagcggccgcagcttcaccgatgctcccttccctaacagcgaactctgtgttccgtttgatgacttggctgagcttgaatggctctcaaattttgtggaggaatcgttctcaagtgacgacgttcaaaacttgcaattcatccctgtagcaaacattaattcctcctccaccgtcaccaccgacagttcctcttccgcaacacattttcccacgggactaactttcgcactgccttcccc

SEQ ID NO: 10487 - DNA, 616 bp, Lycopersicon esculentum
  Predicted polypeptide sequence is orthologous to G1506
caaatgggaagcaatggtgccttcaaggaagagaacctgcataagtcgttcaaagcattcttcagttgaaaagctcactaaagacctgtgtacgatcctacatgaacaacaatcttcatacttctctggatcttctgaagaggatttgctttttgagagtgacaagcctatggtctctgttgagattggacatggaagtgtgcttattcgacatccaaactcaataggtagagaagaagaatcagaaggcagttccctgtcggttaataacaagcgacattatgtaaatgaggcttattcacgattgtctgccccacctgtaaatattaataggggtgtcaatttaccaaatctgggcacggagataaccaagaagcctaacagtcagggaatggaacaacacccgattaaaagggataaggatcaccttgaaaaattgcacattcttggacatcatacttcaccactgtgccatatagacctgaaggatgtacttaattatgaagagttcgtgacacatttctcaagcgatgaacagaagcaactactaaaatacttagctcctggtgattcttttgcacccccagatagtctcaaaagcatgttccatagctct

SEQ ID NO: 10488 - DNA, 893 bp, Lycopersicon esculentum
  Predicted polypeptide sequence is orthologous to G1512
aatttttcatcttttttcacaccgtctctttaccttcgctttctgcaattcgccattgttgaaacttcgtccttacgttttttcatctattgacctcatggctgtggaacaaaattttgttgatgaagatatgttcacttttgtatctgaagaagatgtttcccttgagaaggggagtgcaattccagttccagttccaacatcaagttctgacaatataacaggaggttatgattgcaatatttgtctcgactcggcacacgatcctgttgtcaccctctgcggacacctctactgctggccttgcatttacaagtggcttcaagttgatagatctactccgggatcagaaaagaaatgtaaatgtccagtctgtaaggctcacatctcaaactcatcgctggtacctctttatggccgtggaacatcatccccagaatctgaatccaagaagtctcaacgggatgttgtagtaccacgcaggcctcaagccatcgagatagcaactctcgttaattcattgtctccagcttctcacgtgagtcagcaacttcatcacagacgatccgtcccctctgcctttggtagctatgctgctttggctccatccagctttgggggtacttcaacgatcagtttgtccagcccaacagttggggtattcggagaaatgtttttgggaaggatgtttgggaactcagacacaagtttatttgcttatcctcacccaaacacttccaccattccaggaagtggcggttttagaatgaggcaagtggaaaaatctcttaacagattatccatctttctttgctgctgcattatcctatgccttctcttattctgagcgtttaacatatgatgtatagttgtgaaaattatgcagactgttg

SEQ ID NO: 10489 - DNA, 619 bp, Lycopersicon esculentum
  Predicted polypeptide sequence is orthologous to G1521
ggcacgagcagatttaaggaaattgccgctgccgttgcccggcaatcatgtccgatatgcctctgccagatacaccatcggagcgcggcggttgttatcccatgtatgcacgcctactgcatcgtttgcatccgcagatggagcgatgtgaagagaaaatgccctctctgcaacgccgactttgattcatggttctccagaatcagcttctcctcccggaccttccagaaagagcaattatcagctcgtaacgagactaagaagttacactcaggttttgttccctctaggctgagagaccgattggcggaccgaagagtgattaggagaaggagagaagagttgaatacttttggctccagaacgaggccgttcccaaggcggcgatcctttgatcacaaaggagctttgaatccagatgatattactaggagaatcattctctggcgttccagcatttatgaagagagattgcaggctgttcctttttcatctaaaaattgccttatgcagcacatggataataggagtaccaaagaaaagatgttacagagaatagaaccttggataagaagagagctgcaggctatactgggtgatccagatccatccattatcg

SEQ ID NO: 10490 - DNA, 582 bp, Lycopersicon esculentum
  Predicted polypeptide sequence is orthologous to G1538, G1545
cccttcaaaataaataaataaaagtcttctccatttcacttttacaccacaaaaaataaataaaaatataaacaccatgaaccatcaggttatagaagatgataatatggtacttatttcccagtactatcctgatatttacacccaacttgtaccacaacaaggagagtcaaagccgcggagaagacgtaagaagaacaaattaggagaagggagtgggaatgatcaaatgatgatgatgaggaagaggaagttaagtgaagaacaagttaatttacttgagcaaagttttggggacgagcacaaactagagtcagagagaaaggacaagctagccgctgagctagggctcgaccctagacaagttgcggtgtggttccaaaacaggagggctcgttggaagagcaagaagctagaggaggaatattcaaagttgaaatctgaacatgacaataatgttgttgagaagtgtcgtctggaaactgaggtgttgaagttgaaagaacaattgaatgaatcagagaaggagatacaaaggctattattagaacgatgtgatggggtatcgagtaattacacaag

SEQ ID NO: 10491 - DNA, 1035 bp, Lycopersicon esculentum
  Predicted polypeptide sequence is orthologous to G1540
ggcttacatacatacatttgtagagttgttgttgttttatgatggaacatcaacacaacatagaagatggtggtaaaaatagtaacaacagtttcctgtgcaggcaaagtagtagccgttggacgccaacgagcgatcagataagaatattgaaggatctctactacaacaatggagttaggtctccaactgctgaacagattcagaggatatctgctaagttgagacagtacggtaagattgaaggcaaaaatgtgttttattggtttcagaaccataaagctcgtgaaagacaaaagaagaggctcattgctgccgcctctgccactgataataataatatctcttccatgcaaatgattccacatctttggagatctcctgatgatcaccacaagtacaacactgctactactaatccaggtgtccagtgtccatcaccatcttcacatggggtattaccagtggtacagactggaaactatggttatggaactttggctatggagaagagctttagggagtgttcaatatcaccaccaggtggtagttatcatcaaaatttgacatgggttggtgttgatccttacaacaatatgagtactacttctccagcaacttacccttttcttgaaaaaagcaacaacaaacactatgaagaaaccctagatgaagagcaagaagaagaaaattaccaaaggggtaactctgctttagaaactctgtcacttttccccatgcatgaagagaacatcatctcaaatttctgcatcaaacatcatgaatcttctggaggatggtaccattctgataataacaatttggctgctcttgaacttactctcaactctttcccctaaattatgaactagtctatcttatgtttgtagtaagtaagtactaatctaatttggtatgtgccaagctatttggaccttatggtaatgttaattaatcttaatctaagttgtactaatattattaattaaagtatggataagtttagcaaaaaaaaaaaaaaaaaaaaaaaaaaaa

SEQ ID NO: 10492 - DNA, 632 bp, Lycopersicon esculentum
  Predicted polypeptide sequence is orthologous to G1554
attcatcccactgaagaagggtaattctgatgaaattggaagggtaaaaaagtcaaatgatttaagtgataagaaaaattggatgagctctgctcagctatggagcactccagttcagtatgaaagctttaatcttcaaaacttaaaacggagtggtgtagaagataaagccaaggagaagcaataccagttaggagcatgtaaattgacgagtgaaagaggggcatttttgccatttcaaagacaagctttgaaggtagacaaaaaatgtttggcagtgaaggatttatctctgtcaatggcagtgacagtgggtgaaggagaaaaccgtgaaaatccaattgatgtgagtgtcaaaagagagaacggcccatcaaattcaaatgggtgtgatggtttttcacatgacaaatcactacagaggaaacagaggcgttgttggtctccagaattgcatcgcagatttgttgatgctcttcatcaacttggaggtccacaagtggctacaccaaaacagatcagagatatcatgcaagtggatggcctgaccaatgacgaagtgaaaagccatttacagaaatatagacttcatgtgcgacgagtcccaacatcaggttgttcatggtctactg

SEQ ID NO: 10493 - DNA, 585 bp, Lycopersicon esculentum
  Predicted polypeptide sequence is orthologous to G1554
atgacgatggcaacgcagaagaagattattcaaagtcatccaagcaccgttagtgaaagtgatgatggtggcagttgactacttacttttgagcaggtgtaggatggaaggggaggaggatatagaaatgttgaaaagtaaaatatattggcgtgggtgcagtagccgttggttaatgattcaaatgacagttattcaatgccctagtttgttggaggggaatttgaattgatgggaaaatctttggctagtaggtgatagaaacttgttttattattttttcttgttaaatttaaaaaagaaaaaactttattcgatgggggataagtagttttaaattggctttgtaaaaccgcgttgtggataatagttggtctgtgtgtttttaagtgtgagcgtgttgagagagatgctgatgatggagggtagagtaaaagctaatatgtttttgcaacttgcaggtgatgccagatgtcagtcagctaatttgatttgcatgcgatgacatgatatgataacacgcccgctccggctcagaaatatctatttaaataaagagaaaaaaggaatggtcccaattcgacc

SEQ ID NO: 10494 - DNA, 694 bp, Lycopersicon esculentum
  Predicted polypeptide sequence is orthologous to G1635
attggtctagggattgctgaatattcagttgctgagcagcagaactctcgcttttcaccagtctcttgtactacggatgcacacactgcaaatataatttctacggagaatgatgatgagagtatgagctcaaactccaacaatgtggatgcaatccacgtcacgttaaaaccagtagctgctagtatcagtctgattaccaattcagagttcatggaatgtaatatagttcatatggagaattcttgtaatggtgaaaagctagctgttgaaccaccttctgcaagtatcaagctgtttggaaagactgttttcgtaccagatgccaataaccttgctccgccagctccatacaacacagaaaaggaaaaggagatcagctatgaagatgtacttcatggattccaagctaaccaagcaaattcaccatttgtacttgccatggttccaggcaatatgattccaccagcatcttggttgtcacaaaacatgcttgaaaacaatcgtgagagtactgcggccttccctgcagctacaatttcttggtggtcctggtaccaagatctcttatatcggtccatctcatcgtgtggccaaacaaccgtggaggctgcttctcattgtcagggactaaaagatgaagaacctcaaagagagggatcatcgactggttcaagcattggctcaactagtg

SEQ ID NO: 10495 - DNA, 672 bp, Lycopersicon esculentum
  Predicted polypeptide sequence is orthologous to G1635
taaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccaga

SEQ ID NO: 10496 - DNA, 696 bp, Lycopersicon esculentum
  Predicted polypeptide sequence is orthologous to G1652, G2776
cataatattaagattagctttgtcctgatctcctcttaattaattaaagatttctccacattgtttttgggatttttcaagaatttcgtaatttacgaggaaatggaatattatgggtttaatcaacattggcctattagctcatatgatgagctaagtgcaatatctatagcaaattcatttggtcatgagaataatttgcatgaatcattcatctctcatcatcagccactattatgccataaaaggcctatagaattgtcccaaattattgaagaaaggccactaaaaaattccaaaacaagtcatagctggaacaatactattgaaattgatcaaatattgagctcacaatctgtggtttctcccaattattcccatttgatgaactcatcaaataattacactaaccaacaagttgtgacaatgaagcccaaagaggaaacaactaatttgtcatcaagcagtataacttttgcagctgatcattgtcataacaatatggtttgtcatcaagattcttttgctaatcagaattatatgatgtttaaggctgcatcatgtcaaggtgctaataagagtgttagcactaatggaaaattaacacaagctcaagatcatatcattgctgagaggaaaagacgcgaaaagcttagccaaagattcattgctttatctgctctaattcccggactc

SEQ ID NO: 10497 - DNA, 801 bp, Lycopersicon esculentum
  Predicted polypeptide sequence is orthologous to G1655
ctctctctctctacataatccttctctcctccgccacctaccgccgccgtctccgccgtcaaactcaaaactcagtttgcatctatttacagaagagaagcaaacgtacaattcgcgagaatcattccgaattttgcatcagaaaattgttccttctgatggcgtcatctcaaaccgtctcgaatcccgatgttaactccagtcactcgcgagaatccaagcgcaaaaagagaagaaaaattggagatgatggggaaattgagcaacaaacgagccttgatcaatccaggtggagaacggataccgagcaacagatctactcttcaaagcttctccaggctctccgtcacgttcgccggagtaatgacaatccatctccggttaatgccggacgcgccgtcagggagaccgccgacagagtcctcgccgttacagcgaagggaagaagtcgttggagcagagcgattctcactggccgtctcagcctcaggcttagccaaatcaataaaaagcataagaaagcaaaactgaatagcggcaatataaaatcaaagaaaccagcggcgaagaagcgattgcctgctttgcaacggaaagttcgtgttctcggccgtttagttcccggttgtcagaaactcccgtttacgaaccttctagaagaaactaacgactacatatcagctctacagatgcaaatcaaagccatgacttttctgaccggcctcctctccgccggtggagcaggatcagttgccgctcaccccgatcggctcggctaagtggcttgggtacacatgtccc

SEQ ID NO: 10498 - DNA, 2126 bp, Lycopersicon esculentum
  Predicted polypeptide sequence is orthologous to G1660
ggagtagaaagtgtagggactacacactcttcatttctctttttgtccatttggatgttgacaagattcatcactacaatttcactcttttctcagagatactgtcacacccacaagcttgaaatcatcctttatggagtatgaaagaatcgacaagagaaatttacagctgtctcctagaaaactgaggtctatgctactgggagcagaaaagaagaggaaacaagaagggaaggatgacgtagtagaagatcaagagcttgaatctgctactgtgtccttgagatcccatttgcctgagatccatgaatccggttgtaatttggagaattacaaagatgtaaatgttgtaagtgttgttcctgagagttcgacttccttagcacttgattcatcaatgtcattggagatgattaatgacacgagaatcaaagatcaatctttggttagtacaagaattaggtctcaagatgacagtagtttggactgtgatggtggaatcgatagtgttggtactgtatctcctctctttgaatttcaaaaggctgaacgggcagcacagagagtgcccctagctcatttctcaaaacctgccccgtccaaatgggatgatgcgcaaaaatggatagcaagcccaacatctaacaggccgaagactgggcagagcagtcaagttgttggatctcgcaagactagtcattctggatatggctatcgacaacaatctacaaaagttgtagttgaggttcctgatcaaaaattggttccttatgaggagcctgttgacacaaaacagatagactcaggccaaccaaaggacagcggtgttcagaagttcgtgagttgggaggctgagccacacccaattgctgaatcatatgttaagccaatgctcatgattgaaacatccatcggacaatcagcaataaatctgagccgtcatgattcgtctgtttctatacatagtgcgactgttatccccccaccatcaactgcaaggtcagtctcgatgagagatatgggcaccgaaatgactccaattgcaagccaggaaccttccagaactgggacacctgtgagagcaactacacctactcgcagcccaacttcttctcggccatcaactccgggagctgcaccagcttcctcaccttttcgtccttcaaatgataatttggatgctcatacaaatgcattgtctgaccaggaattacagttgaaaactcgaagagaaatcatggcacttggaactaaacttggtaaaatgaatatagctgcctgggctagcaaagatggtgaggatagaaatgcatccagcttgctgaaaactgataagcaagaccaaccaaataccactgttactgagacacgcgcagctgcttgggaggatgcagagaaagcgaagcacttagccaggtttaaacgagaagaaatcaagatacaagcatgggaaaatcatcaacaagcaaagacagaagccgagatgaggaaaactgaggtggaggtggaaaagatgaaggcacgagcacaagacaagctaatgaacaagatagctgcggttaggtacaaagctgaagagaaactggcagcagcagaagccaggagaaacaaacatgctgtaaaaatagagaagcaagcagaatacattcgtaaaactggtcgtttaccacactcattctcctgctgccgctggtgcttctgaagagcttcaaatcactatctaatgcgctgtatatttttgcttttccactaagctagtattgtgaagttggagactgcctttgtgtatgcttgaagctcttgtacaaactcaactggttggccactttacatgtaattgttgatcaatggaagttgaagttcaggcagtctcctgtaaccaattgtgatttgatgattaatgaagggttcctccaagcttattaatttcaagttcttgtacatgaatttagtagtcgcgtagtctcttattatgtaatgtgtagtaatatttgttgcttcgtttattgtgtactttgctatattgttatcatattttcttgaaagcaagatgacttctcttttgagcggagtagcaaaacaatctctctgtctcacaaagaaagggatggaaaaaaaaaaaaaaa

SEQ ID NO: 10499 - DNA, 1460 bp, Lycopersicon esculentum
  Predicted polypeptide sequence is orthologous to G1700
ctgttttcttaccaaagattccatttttttgatgtgggtgttgttcaaattgaatcagattaaccgccattgttgttgattgcgatgtctcttactggaaaaggctattcagatccacatcaagaaagcagtaataattatcataatgcttcatctaattgttgctcagaagctttagctcaattgaagctttatcaagctttcatcttttcagtccctattttgtttgcttttatacttttactgttattctacttattttatcttcgtcgtcagagagtcgattggtcctcactgcggatgaggacgtctacattccacactgctaatgaatctgatgaactctcaaggtgtgaaatggggttgaagaaggaagtgagggagatgttgcctattattgtcttcaaggagagtttttctgtcaaagatactcagtgttcagtgtgcttaggggattacctggcagatgataagcttcaacaaatacctgcttgtgggcacacatttcacatgatttgcattgaccactggctagctgcccacaatacctgccccctttgccgccaatcaatccttgctccaactaatgcttgcactgaaatacctgatacgagctcagaaactactgagagtacttctagtgaacaagatgccgatgaaacatctcaccagagcagctctgagtgttgtggggattctcaagtaggtcaatcaaattcagagccagaacccagagaagaaacggaacacagatcgtctaatgaagaagaaagtgataacgttaaccacgatatcgcctcaacaaatagaagttatgacactatgcaggatccagaagaaacggaacatagattgtctaatgaagataaaagtgataaaattgaccacgacagcatctcaagaaataggagccatgacactacgctggagccaagtgattcagtctgatgttcataagttaaggaagataaaaatactagccatacactggctagatgtgatgcagcttgatgcatgttaggtgacacaatagggatgagactgcaggatgaatatgacagcataagcttgcccctttgttcggattccaaaataccccagtctttctgagatcaaagttcatcaggctcatgaagtttcgacttctctcaggaaatgggaggcagaacggctcggttaaatcaccatacgaggttaaggcttgcattatttctccgtctgggataagaagctcaaacaatccttaggcaagtatacagattgttgaagtatccgcagagttgtaccatgtaacctttctgtgtcgtaaaggtgtatagtaatctttaatagagttgtacctgctaatactatgttgtgcgtaggcgtagaggagagcgatttgaagtttaaagttactgtgttctaaattaacaatttataaatatttagtggatttttaaagtaaaaaaaaaaaaaaa

SEQ ID NO: 10500 - DNA, 651 bp, Lycopersicon esculentum
  Predicted polypeptide sequence is orthologous to G1743
cttcttttgctcatcactatatatatatatatatattataacaacaattataagtttttctgacgaagagaaaaaattatgggttttccggtgggatatacggatttattcctacccaaattgttagtacacttactaacggttctcggattcgtcagaaagttcatttgcacgattttcactgtttttggtttaggtgattttctcgaaccggaaatgtcgtttccgacccgacccgaatcacactcggagcttcattcagtgtcggcggcgttgatccgggagctacttccggtggtgaagttctctgagctggttgacccgccggagagttgtgcagtttgtttgtatgagtttgacggagaggatgagatccgacggttgacgaattgccggcatatttttcaccggagttgtttggatcgttggatggatcatgatcagaaaacgtgtccactttgccggacgccatttattccggacgatatgcaagagagctttaatgagagattatggttggcttccggcatttctgatttttacggcgagtattctccggtcgccgccggtttgtagcaatttttttttatagtttaaaaatgtatatatactataagataaaaaaaagagggggaaaaataattatggagg

SEQ ID NO: 10501 - DNA, 616 bp, Lycopersicon esculentum
  Predicted polypeptide sequence is orthologous to G1777
caaacattgcccaaactgtcaccaatgccgtggagaagaatgggggatgccaaccttgtaagatgtagatgtggacagccgttttgttggttgtgccggtggagctactggcttagaccacaccatggagtagcattcgaggtcacacttgtggcatttataaggaaggggaagaggataagtcgacgactgtcagaaatgatctcttgcgctatactcattattatgagcgctatatggttcatcgtgattcgttggaggctgaagcaaacatgaagcaaaaactaaagtttgaagtgttgaaactcgaagcaagggaattgctatcaaaggacttcagctgggtagaaaatggatgtaatagactccttgaattgaggcgaattctctcctgttcctatccagtttcattttacgtttttgatcagaccctgttcaaggatgaaatgacacaaaaagatagggaaataaagaagaacctttttgaaaacctgcagcagcaacttgaaataaacgttgagagactttcgatgttcttggaagaaccatttgctaaatatcctgaagataaacttttggagactagaacgaagatcatcactctctccgtactaac

SEQ ID NO: 10502 - DNA, 612 bp, Lycopersicon esculentum
  Predicted polypeptide sequence is orthologous to G1789, G1911
ctgcttagtactctcttcttctttgtatctctttttctacatttttcacaacttgtgatacttaacaaaagatcatcatgagctcgatgtcgtctcaacatggttcttctggatcatggactgcgaaacaaaacaaggcgtttgagaaggcattggctgtgtatgacaaggaaactcgcgatcgttggtccaatgttgctaaagcagttggaggcaaaacagcagaagaagtgaaaagacactatgaaatccttttgagggatgttttctttattgacaatggtatggtgcccttccccaaatacaaaactactggaggatcccataattccacctctgattaacattatttttactaaaggagcaaaacctaacacttcatcgaagtaacaaacgtcaataagcagactagaaaagtgcaaataatttgccttggaacctgccttttaaaatatttaattttcaagttgtatatttaatttctttgtccaattaaattttaaacgctgagtttatttagtattaattacctacggaaggaatcatttgaattctgtctgctcttgtactcgtcatgtccccctctaatattaattaattatattgttcctt

SEQ ID NO: 10503 - DNA, 844 bp, Lycopersicon esculentum
  Predicted polypeptide sequence is orthologous to G1794
ttaatgtgtttaatacgatgtttcaagggaatattaatagagaaaaagaaatgtctgttatggtttctgcattaactcgtgttgttgttggtaatcatcctagtgaaaatatcgaaaatcatcatcaaaataatacattgatttctaggggtgttggaaaaaaaagaggacgtgatgaagtattattacatggaactaattcttctcatatgatattatcatcagggggtgaaggttcaagcattaggacaacaagagaagcaacattcatatacactaattcaacaaacaatagcattattgatgaatctgttaataatcaagtaagacgacgatacagaggagttagacagaggccatgggggaaatgggcagctgaaataagagatccatataaagcagcgcgtgtttggttaggtacttttgatactgctgaaggggctgctagagcttatgatgaagctgctcttacatttagaggtagtaaagcaaaactaaatttcccagaaaatgttacattattagtgccttcttcaattcaacaacccatttactcctcacccgacccagccatttctccgtatcgttccaattttattattggacatacctctacggaagtggagcctatacttcacaccaatccttcaaattttattgagcctatagctcacacttcatctctgtatcgttccaattttattgaacggaatcatcacatggtgcagcaggagccgtattttcaggcaggtagtactagtggtggaagtgattttcatcaaactacaaattcttctaattcgtcaatttatgatcacccttcttcttcatctggaataatttt

SEQ ID NO: 10504 - DNA, 797 bp, Lycopersicon esculentum
  Predicted polypeptide sequence is orthologous to G1794
ctcaggcgagagatatgtcggagatggtgacggagtttacacgtgtggtatcgggtcaggattatcgacccgataccagatgttattcggttaattcaccgtctccggcttattcttcgtccagctcgggttctagagctggactgaagagaagccgtgatcaacaagaatttggaactgggttgtcatcttcttcctctgttaaaattgaagctacaagtatggttgcaccaattcccgctttcacaaccacaatcacaaccacgaccacaacaggtgagggttcgagcgaagaaacaggaggagataggaggaggaaatacagaggtgtacgacaacgaccatggggtaaatgggcagcggaaataagagatccacataaagccgccagagtttggttaggaacattcgatacagcagaagctgcagcaagagcatatgatgaagctgcattgagatttcgaggaaacagagcaaaactcaacttccctgagaacgccagattgtcatcgttaccacaaacacaaaatactgtaacgtcaacaatctccaatccatcccctctaatagctcaaccaacgtcgttcctcaatcctatccagagttcagatacaacaagagactactgggaatactcacaattgttgcaaaatccaggagattttacggatcaacaaccatcaaacttattggaacaaatgttcgttgcctcatcgatggcaatgttgcatttcaacacattgccattaatatcttcgtcttcatcgttagctacatcagcaacttctttcacgtca

SEQ ID NO: 10505 - DNA, 768 bp, Lycopersicon esculentum
  Predicted polypeptide sequence is orthologous to G1835
ctagatagctagctagtttcttcaaggtaaaggtttttagagtagaaaaaaatcaagaaactatggggtcaaatgtggtagatgagatagattgtggcagcttctttgaccacattgatgatttgattgatttccctcttgagagtgagaatgttggccttagttctactgattgcaaagattttccaagcatttggaatgaccccttaccggattctgactcccttttctctggcagccaccggaattctgcctctgacctctcggctgagctctcagttccgtatgaggatattgtccagcttgaatggctttcaacatttgtggaggattctttctccggcgggggattgactctcgggaaagaaaacattcctgttgagaaagagccgtcatcccaaggcaagttccagacttcgagtcctgtgtctgtgcttgaaagcagcagcagcagcagctcgtcattttccagctcgggggaaaaaactttaccccttagtccatgccaccgtggtccacaacgtgctcggaccaagcgtcctcgcccaacaacttttaatcccttcccagtatttgttgctccagttgttccaacagaatcagagaatttcgcggagtctcccatgaagaagattctgaaaccggctgaaccagaacagaaaaagaaaaagaagatccaattctctattcctctagctccggtcgagacaaatcagaatccagtggcacaacaagcagttcggaaatgccagcattgcgagataacaa

SEQ ID NO: 10506 - DNA, 772 bp, Lycopersicon esculentum
  Predicted polypeptide sequence is orthologous to G1835
ccacaacgtgctcggactaaacgtcctcgtcctacaacttttaatccccggtcagtaaatcacctcatgtttccaacatcagtaagtccccagcaatttgttgctcctggagttaactcattggactctgagaatttcgccgagtctcccatgaagaagaaaaagaaaatcaagttatcgatccctctagctccaatcgagactaatcaggataactaccagcccgcgccacaagcagttaggaaatgcttgcattgcgagataacaaagacgcctcaatggagagccggtccaatgggaccaaaaaccctctgcaacgcctgtggtgttcgttacaagaaaggcaggctctaccctgagtaccgtcctgctgcaagtcccacgttcgttccatccttgcactccaactctcacaaaaaggttctggaaatgagaagcaacgttttccccgaagaggaaacacattacaagcaggccaaacctagacgagcccgcccccttatcactgtccaagctgagaacaacaccacagctagtactactccaaccgagtaacaaaatcatcataggagcagacagagcagaaaccagtttttcctagtcctcatttttttcaggtcttttagtgttatttgtttactgttttttcattgctttgttcattggttctttgtataaagatgtaggaggctatagtaaagaagtagatgacatatagtttagttggtagctagatttaagagatgaaaatggagtcaggctagggcagctt

SEQ ID NO: 10507 - DNA, 740 bp, Lycopersicon esculentum
  Predicted polypeptide sequence is orthologous to G1852
tgggggattcatgtgttcctattcaaaatgaatttgggcttgagctgtgtgatgaatcagtagatccaagtgctgcatggtacttcaagttgaaaaaatgtgtgactaggacttcatcttccaaaggagaatttgccattgggaaaattccaaaatggccagcgaggctgatgaaagctccttcgagggcaattgtaactaaaaatggagtggatgtgtttgaagctgactcaagaagatgggcgcggagagtcgcacattataagagttcattgaacttgaaactaggaacttcatcagttcgtaatgtcatggacatgaatgcattttttggaggatttgctgcagcattatcatcagacccaatctgggtgatgaatgttgttccagcacaaaagcctttaacacttgatgtcatttatgacagaggccttattggagtttaccacgactggtgtgagcctttctcaacatatcctcggacttatgatctgattcacgtgggagccatagaatctctcataaaggatcccttttccggcaagatcaggtgcagccttgtcgatttgatggtggaaattgatagaattcttcggcctgaaggaactgttataattcgggactctcctgaagtgatagacaaagtagagcgtattgctcctgctgtaagatggacggcaagtattcatgagaaagaacctgaatcacatggaagggagaaaatcttggtagccacgaaa

SEQ ID NO: 10508 - DNA, 359 bp, Lycopersicon esculentum
  Predicted polypeptide sequence is orthologous to G1855
gggaatcgcttttttttttttttttttttttgagcatgaattgatcttctatcctattgatctgcaaatgaagttaataattccaactataagcaataacaagaaagaaacttaataaccatacacgacgatattgaatggttgattatctattctcgttttggttcaccggtccagtaagtttttacagcaataagaatcttctctgggttgaatggtccgctctcatgatccacgatacgactctgccatctcataccgtctgcaatacttttgattttcactaatgcttctactccgtctctgaatataactgtaccttcaggcctcaatattctatccatctcaagtagaatata

SEQ ID NO: 10509 - DNA, 1521 bp, Lycopersicon esculentum
  Predicted polypeptide sequence is orthologous to G1863, G2334
gatgataagaaacacacaaatgacttaactttgcaggtttcaccgcactcgacactgcaaaaaagatacatataaaaaaaaaggtccactcaactctctgcaaaaataaaaaaaattaaaaacttttgtccaagacttaactttctcttcagaaataaatttgccttcacattaatattttgttgttagtaacaaaaatcattctcaatcgaaacatggacttcaatatgaagcaatggagtaatcaacatgagtcagaaaatcaagaatcaccaacaaagttaccaagacttcttcttgacttccactctgtttcttctgattctgcttctgctgctgctctaccattgtttgtatctgaaccaacaacatcaacaacaacttgtaccaaattaatgtcagattcagcaaccactgtcaccaccaaatttccaaggattggaagtggtggtggttacttcagcttggctcaatggcaagaacttgaactacacagtttgatttttaggcattttgtagctggtgcccctgttccttctgaactacttcatcttgttaagaaaagtattattgcttctcctcctcctcctccttcatattactttgctcatccatatcaacagtatcctcattatcaacaagctttgatgcagtcagggtactggggtagagccgccatggatccagaaccaggaaggtgtaggaggactgatggcaagaaatggaggtgctcaagggatgtagtggctggccagaaatactgcgagcgccacgttcatcgtggccgcagccgttcaagaaagcctgtggaaattcccacacctgccaacaatggcagtaaaaacaacaacactgtttctcatcatcaagcctttggaaaaatgactggacatgctcatgctggtggtggtgctcctcagttttctctttcgggacattcaccttccactaatgcgccttttcatctcaatcaaaggccaattaagggtccaccacaagaagtacttcaaaaagatgtatctattggtgatggtaaatcatctagtggccaaatcctacgccatttcttcgacgattggcctagacaacaacttcaagaaggcgacaatgctgcaaccagcctgtccatttcgatgcccggtgtagggggtaacccctcgtcagacttctcgttgaagctttcaactgggaattactatgattcaggtactcaagttagtaatgttgaacggtctacatgggggacgagtcaccaccacgtagcctcaatgggtggtccacttgccgaggccttaaggtcatcaacaactaactcgtcccctactagcgtgttgcatcaattggcacgaggtagcgcgtccgaggccagctatattagcacttgatttctgcaagtgttcttgttaaatgtttttttcttttggactttattgttttttaacttggttgtgttgttgttcattgttctttattggtattgatatacctaactgtcacctgtacaaaaaaaaaaaaaaaaaa

SEQ ID NO: 10510 - DNA, 747 bp, Lycopersicon esculentum
  Predicted polypeptide sequence is orthologous to G1868
tagagacatgttagattaagagaattatttagacaaggttgaaaatgttacacaagtaaacaaatgaacaaatcttaacaggaatacttaagtcatttaatatcttgagtacatatttgatttggcaaagggtgtgagcattaaggggaaaaagggaaagagctcacttcaagagttgcaaaatagcatgttcctagttttacatattacatggcaggtagggttggattcataagagttgttccaagaaggccattacaaagactggagccttcgttcgttgtcttactgtgttctgctctaggactgctccctgcactgctgttggagagggaaccgaaggaggacttttgcaagactccggttggtgatgatcccatccgagggcttctatcccatccttcagtcaggagattaagagctgacttgttcttgcaatcgcctgagctgctattagtgctatgcaagacctcaccaagaggtccacccaaggaagattcccatgatataggaatccaacttccttgtctttggttatgttcactgatgatggtaccaatgcctagtcccatttgagttgcttcatgctcccgagacctacgtggtgaggccgtgagcttgtcattcgcgggagaggaagtcgaagacatgaagtctgatgtgactaatgggatggaaatggagagctgagttggatctgactgcaaaatcatgtctgggccatgaacatttgattgatcagattgg

SEQ ID NO: 10511 - DNA, 203 bp, Lycopersicon esculentum
  Predicted polypeptide sequence is orthologous to G1880
catgccccatttttttaaattcttaatctttttttattttgaaagttgaaattattgtttgtgttagttagattcaaagaagagaccatgatatgcacttatgtaaaggataatggttggcattgaagaagttgaaaagtccattagtaagtttgaagaacaataactgagctctatgaattggtgatactaattcaaatttg

SEQ ID NO: 10512 - DNA, 679 bp, Lycopersicon esculentum
  Predicted polypeptide sequence is orthologous to G1902
cagagcaaacagaagctcacaatatgcaagatccatcatcaatatattcacagatcaatcctcagttcccagatcaacaagtcctgaaatgccctagatgtgattcaatcaacacgaagttttgttactacaacaattacaatctttctcagccacgccatttttgtaagaattgtaaaaggtattggactaaaggaggtattttgaggaatattccagttggtggaagctctcgtaagaacacaaaacgatcttcttcgaatagctgtaaacgctcctcaacgatgacgatttcatcttcaacttcatcagaacaaaattcaaaaacagagcattttgatacccctgttgttcggaacagcccgattgttgacgccaatgggcctttcggctcgctactagcatcaaacgggccggagatagggaattttttaaatgttttgaatcctaacgggcccgattcgggctcagacgctgctgccgctcaaagtgggaatagtaataataatcatgaatttttgggtgaagattctaattgttggaatggtactaatggttgggctgatcttgctatttacaccccaggttcaacctttcagtaattaattaattaattaattacaatagattattagaactttgtattagtactactaatacttatgaaaatgcacttatc

SEQ ID NO: 10513 - DNA, 2140 bp, Lycopersicon esculentum
  Predicted polypeptide sequence is orthologous to G1927, G2184
ggtcccaattcgattcctaatccatttttttctctcaagatcatattttttggatacccttttgcttattgaatcattttgtggttgaatttttttttattagtgaagagatgaagatgtttgagttatctgattcggattcgtttgctgtttttgcatcatcaaagaatgtttttccaccgggatttaggtttcatccgactgatgaagaacttgttctgtactatttgaagaagaagatctgcgggaagaggattctgcttgatgccattgctgagactgatgtttacaaatgggaaccggaggacttgcctgatctatctaagttaaaaactggggaccgccagtggttcttctttagccccagagatcgaaagtatcctaatggagcacgggcaaacaggggaacaaagcgtgggcactggaaagttacaggaaaggatcgaatcattatgtgcaactctcgtgctgttggacttaagaagaccctagtcttttataaaggccgagcaccggtaggtgaacggacagactgggtgatgcatgagtatactatggatgaagaagagctgaaaaaatgtcaaaacgcccaggactactatgcgctttacaaggtatttaagaagagtggctccgggcctaagaatggtgagcagtatggtgcaccttttagagaagaggagtgggctgatgatgaatgtcctagtgccaaaggctttgtccatcaggataattccactaaccacgttattgaagctccttctgtggatggtggacttgaggagttgttgaaccccgtgcttatggagccactttctgtagattatgattatgcagtggagcagcttgtacaggaggaagatactcgaagtaccttgctatatcattccgcaaaggaagtcaattttccccaccgcagtgcggtgattgccccagcaaaggaaagctttgacttgacacagtcaggcacatcacagcgacagttgcatgaggcactagaagtcacatctgctcctgttatttatgaacagcagccacatgtggtggaagaggattttctggagatggatgaccttcttggcccagagccaagcactcagaactttgataacttggggccgtgtgttcaaaactttgatgaggcaggccaaagtggtcaaaactttgatatgcctgctggaaacttcgaagatttgccattcgattattttgatgggttggcagagtttgacctgtaccatgatgcatccttgcttgatgatgtaagaacaactgaagtggggcaaaatactgaaccacacatgaacaacttagtgaatggttctgttaaccctgcttctacaacgtatataaacactttccagcatgaaatgatgaacaaccagccaatgtatttgaataattccgaacagattagcaatcaactgtgggtacacgatcaaaggttcaatatctcttaccccagcgaggcaaatcagttggttgctcctccagctacttcagatgatggtataagaataaccatgtcatcttcagcatggcgagaactctattgcccaagtggaaatgggggagtttgagcctgcaagagctctgctgctgctaatatattggtgttgagattatttttttcccctaatttttgcaagttttggcaatgttttaggtgttgtatatgatagtattttggcaaatcatcctatggacgcaaatcaaaatcaaccacccaatcaagatgaaggtacaccatcatggttaacctctcagttgtgggccttcgtggattctatacctactgctcctgctatagctgctgaaagtcctgtggttaatagtgcctttaagcgcatgtctagctttagtaagatgagaataaacgccaggaacatgaatgttgcggcagcaggtaacacagcaacttcaagaagttcgcgctactctaagaatgggcttttttatttttcttttgttggaatactgtgtgcaatcttatgtgtattactaggaacatttgtcgacatcttgaggagacccatatcctcttaaatatgcaaagaaaagttgatgttctatcatttggcatcttgccagaatcaatgagaagcagagcatacattttatgagcaaaaaaaaaaaaaaa

SEQ ID NO: 10514 - DNA, 2238 bp, Lycopersicon esculentum
  Predicted polypeptide sequence is orthologous to G1928
gggtttgcttttagatgagagaaggaaggaaagtaattttttattttttttttcatttgagactttgttaaaaggcagaattattagtaataatacaataaagaaagatgaaatttttttaaaaaaatttctttgtttctggggtttgagaagagaacaaaagaaaagacagaaagtgcacgtcagagttagccgtagggtggtctctttctttctttctttcttgtggagaggattacagagaggattccctcttctcgtccaaatctcattctctttcttaacagttttggtagattagcttgaagagggagacgaaagagatcaagattatgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatcaaaaaacacttctgtagaaaacatggagagaagaagtggaaatgtgagaaatgttcaaagcgttatgcagttcaatctgactggaaagctcactccaaaacttgtggtaccaaagagtatagatgcgactgtggaacgctttttttcaaggagggatagtttcataactcacagagcattttgcgatgctttagcggaagagagtgcaagagcgataacagcaaatccaattctgccgtctcaagctggttcttccacatctcaaatgaattttcagtttcaaccatttaaccacgaaattccagttacattttccttgaagaaagagcaacaaactggtttcaacttgaggcctgagattccgccatggctattggttggaggtggtggtggtcctggtcctggacctggtcctccacaaccacaacctattgacctaagttcatcgatcttccaatcatctaggttcagtgatcaggactacacgcagagccaccaacaccaccaacaaggctttatgaaccctaaccctagtctatccggacctacatctggagcgatggcctctccacatatttctgcaactgcgttgttgcagaaggcagcgcagatgggtgcgaccatgagtaacaaagcgagtactgtttctgcagtttcatcaggcccaggcccagccatgctgatgagaccccaccaaattcacgtgtctgctactgctactgctgctgagtctgttagcaacgcaacagattttggactcaatttgtcttcacgtgaagacctccccactggtttcttcaatagcttggcttcatatgggaataaagctgctaatccctctgcagttattactcctgttacaatcccattatcaaccgcacctcatcccactccttctactcttcaggatatgatgaattctttctcatccgttaatcctaccggattcgaaggatcaaatttcgaagatccatttagcattttgaatcccaaaaacaacaatggcagcggtaacgatgatatgaccaaagatttcttaggcttaagacctctttctcatagcgacattttcaacatagctggtctagttaatagcactccgaacgaaactcaatcacaaaatcacaaaacatggcaaagttaagtacaattaaaccgcaaaatgcaggttctttttctcccctttctagtcaattatgtctgttattgttagatctgtattactagtatgctcttttttttttctcagaataaagagatagctagctagaactgggaagaaaaaccctagcctagatagtctcttttgttgttacccagctgttatggatagtgacatttttatacaaaaatagtgcattctcaagcactcggatgagtaaaaattaaattcatgcaaaaaaaaaaaaaaaaa

SEQ ID NO: 10515 - DNA, 658 bp, Lycopersicon esculentum
  Predicted polypeptide sequence is orthologous to G1928
gcaccaggtaccgctcagtaattttagctcatcgtcaatttttccagctactactaggttagatcaacaatacagtcaaagcagccacaaagatttaaatcttcatcatcagaacccaaaccctaatctcagaggacctacattaggttacgattcaatgggagaatcaggtgtggtctctccagtacacatttctgcaactgcattgctgcagaaagcagcccagtttggtgctacaattagtaacaaagcaagtgctgtcactgctactgctgcttacacaggcacagcaaaaataccccacaatactcacgtgtctgttactagtactgattctgctaccaaacaaactcagcagaaattgtcctcacgtgaagacctgaccactattactgggcctgcaaataatataagtggcatcatgacatctttttctaatggctttgatgggtcaacaatgtttgaagatgcgatattattcggtggattcaacaatttgaattcaaaaaaggagaacgaggacgaagatcaacaactctacttcaatggaagtatgaatgaggaggatcatatattaaccaaagatttcttgggtttaaaacctctctctcacactgatgacattttcaacattgctgctcttgttaatactgaattt

SEQ ID NO: 10516 - DNA, 510 bp, Lycopersicon esculentum
  Predicted polypeptide sequence is orthologous to G1928
tagtaatcaaggaaataggctgttgttcggggatatgaattccacttcattagaaggtaatgcaagtggaaagaactcagatcctttcaatttgatgccgcgtaacaacaaaggaaaacaagttaatctgagtggaaatgaagcaatggaaggaggtttaacaagagattttcttggggtaggagggaacgaaagtaggccttttctatcgaaaaatgagctagccaagttcggtaacatatctgcttcagccatgggattaagcgattatagtgaaactcattgactggatctgttatttatatacacaaaaaagttatgtgtgcttataacaaaagcacacacattctgaatgtggattactcaaaaggtccaaacttgtggggagatatcgtttcaaaggactttcactatagtggaatgatacaatgttcagagtgtggagaaaaaaaaagttggaagaaggccaaaagcttcaatgttgatgagagaagagagagaaaggcagcc

SEQ ID NO: 10517 - DNA, 611 bp, Lycopersicon esculentum
  Predicted polypeptide sequence is orthologous to G1928
gtggaacccttttctctaggagggatagtttcattacacacagagccttttgtgatgctttaacagaagaaagttcaagaacaataatcccaccaccaaattcttcaacttctcatcatcttaatcttcatacacttcaaaacttccaaatgaaacaagaacagcaacaacaaaataacgacctctcctctcagttattcattcaaaaccctaatggcaatagtagtaacatgttcggtgcaccacctcctcatatgagcgcaactgcattgctacaaaaagcagcacaaattggagtaacttcttcttctcatactgctaataacatgagcgccacaacttttttcagtcctactaccagtacaacaactggcattgcaatgtcaggatcaggatcaggagcaggagtagcacgtcaatatcatccatttgaaaataataataataataataatacaaacactgattttgttactggtaatacgtcttttcctgattttggtgcgagtgtcacccctgggttcatggaacaagtccatgacatgcaaaacatgatggctactactgcaccttctttgccatgtactagttttgatgaaaggattggtcgc

SEQ ID NO: 10518 - DNA, 615 bp, Lycopersicon esculentum
  Predicted polypeptide sequence is orthologous to G1928
ggtatgctaggagatgatagtatgtcaaatttaacaagtgcatctaatgaagcaagcatatcttcaaccaacaatagaattgaaattggtagtcatgttctctacccacaactacaaaacattcaaacccaaccacctcctaacaagaagaagagaaatctaccaggaaatccagatccagaagcagaagttgtagcattatctccaagaagtctattggcaaccaatagatttgtatgtgagatatgtaacaaaggatttcaaagagatcaaaatcttcaactacatagaagaggacataatttgccctggaaattaaagcaaagaagcaataaagaagtgaagaagaaagtatatgtgtgtccagaagcatcatgtgtacatcatcatccatcaagagccttaggggatctgactgggattaagaagcatttctgtagaaaacatggtgagaaaaaatggaaatgtgaaaaatgttcaaaacgttatgcagttcaatctgattggaaagctcactctaagatttgtggtacaagagagtatagatgtgattgtggaacccttttctctaggagggatagtttcattacacacagagccttttgtgatgcttta

SEQ ID NO: 10519 - DNA, 655 bp, Lycopersicon esculentum
  Predicted polypeptide sequence is orthologous to G1928
ttttgttgatgccaaagtcaagaacaaatattattgaacctaatttttaggttcaaacaacttaattttgcctctatataaaagagtcaacaagcataacatgtccattgtaacttgtgaagaagctgctgcaagtttatcttcttcttccaacatgaataatgatactaatggagccttttgctatccacctcaacatcaattagttactcaacaaatcaagaaaaagagaaaccaaccaggcaatccagatccagaagcagaagtgatagctttatcacccaagacactagtggcaaccaacagattcttttgtgaaatttgtaacaaagggtttcaaagagatcaaaatctacaactccatagaagaggacacaatttgccatggaagttaaagaagagagaaaataaagaagtagtgaggaagaaagtgtatatttgtccagagtcgagctgtgtgcaccatgatccgtctagggcattaggagatcttactggaattaagaagcattttagcagaaaacatggtgagaagaagtggaaatgtgagaaaatgttcaagcgttatgctgttcaatctgattgcaagctcacttcaagacttgtggtactagagaatacaaatgtgaaatgtggtactattttctcaagacga

SEQ ID NO: 10520 - DNA, 556 bp, Lycopersicon esculentum
  Predicted polypeptide sequence is orthologous to G1935
aaattcattttgcttcactctaatacactaaactagaagcttctctctaaaactcacatgcagtggatcggaaaaagttccactgctgttttcatctccaaagctaaggcgaaaatattagaatttttcatctaaaagctcccaagctaacttcatgcttctctccaagcgatttttttcgaagtagagtactacggatccaaaagatttcatttcaatctaccaaaatcaagttctagtttgcatcttctcatgggtcgcaataagattgtgatgaagaaaattgaggattcaacatcccgtaaacagttctattcaaatcgcaaggatagcattgtgaagaagtcaaatgagctggcggttgtatgtggtacagatgtggggttgttgatgttttctccatctggtcagctgactacctattctagcaaagaaagtattgaggacatcatgatcgaagctatgaacaagtctgtgaatccgcgacccataccaaatctaaatgaacagcttttgatgcagagtctcaaacagtcaaaatctgaaggccaatggt

SEQ ID NO: 10521 - DNA, 519 bp, Lycopersicon esculentum
  Predicted polypeptide sequence is orthologous to G1935
gcttggattggcttgacctaaatagaaggaagctcgagctacattgcaaaagcttttatcagcttgtgatgaagaaaattgaggatccaacatcccgtcaacagttctattcaaagcgcaaggataccatccttaagaagtccaatgagttggctgttttatgtgatgtggatgttggtcttctaatgttttctccagccggcgaagtgactagctattctagcaaagaacgtcttgaggatgtcatgctccttgctatgaacaaggctggtgaactgaacaagctatctcctgaaaatccaaatgaacaggctttgatggactctctcacacaatcaaaacatgaagccgaaatggtggagaagatagcgattgttgaggctcatgaggagaagcttaatggggtcaaagaaagactaagtgaagcacaacagaaaataaggtattacgaaccacaagtggagagtatcaactctgtccaagaagctgatgcatatgagaagttcattttgagtgctc

SEQ ID NO: 10522 - DNA, 605 bp, Lycopersicon esculentum
  Predicted polypeptide sequence is orthologous to G1938
aaccacaacaatattaagcctactcatgatcagataaaagagttgcagattttgaaaaatgatgaaacgaacaaggtggctgctcccaaaagaaaagataggcatacaaaagttgaaggtagagggaggagaatacgtatgccggcgctctgtgcagcaagaatcttccagcttacgcgcgaattgggtcataaatctgatggtgagacaattcagtggctgctgcagcaagccgagccttcgattattgctgctactggcacagggacaatacctgcctcggctttagctgcagcagcctctgtttctcaacaggggatctctgtatcagctggtttaatgattgaatcgggggcgaatatcgcggggtctggtagcagtagaagtagtaatagtaggaccaattggccaatgatctgtgggaattttggaagaccccatttggctacagcaggaatgtggcctgcccctgcccctgttgtcactagttttgggtttcaatcctcatctgctccatcaagcgcgagtttaggtagtgatagttcaaattattacttacagaaaattgggtttcctggattttgatctgcctgcagctacaagta

SEQ ID NO: 10523 - DNA, 636 bp, Lycopersicon esculentum
  Predicted polypeptide sequence is orthologous to G1946
ctaaaaaaaaatgactggtacaatccattcaaagagaagagagaggatcaacgctctagctagtaattcttttttggaagtgtagacattcagtatttgtaggcctggagatgaaagtgatctagatgcttaatgatggttgggtgttaagtttggcatcaaatagaaatatttcaataagtgaaaagctttaatggttgcagaaagattgtgacaagttggaagtttgcttgtgaaattagttattactggatatttttactgtagtcttgttagaaattttccaggaggcactttctttgtccatatgactatatttaataggagaaatcaacgggataagtcaaaatgattcatggacatttgaacaagactccatattcaattggtttttcagtggtgaaaattgacgagggtcatagatgtctagcatctattgtttgcatcagacgttttaggttgacaaactttagtggtgggatagtagttctattctgaatatattgcctttaagccttcatgctctggaattctgtagatcagtagggatcctctctttaccagtgacacatttctttttgtgaggcggtctctctttttcaatctgaccatttatatctactgattgttgaaccc

SEQ ID NO: 10524 - DNA, 710 bp, Lycopersicon esculentum
  Predicted polypeptide sequence is orthologous to G1948
ttcatggccattcaaaagaaagagcgccaccaaatctctttcccacttctccaatggatgctctctttgtcaattcatctctctcccgactcaaactcaaattctcttctcaatttcctacattctctcccctgccccatcactcttatctcccacttaaaaaacttaatttaccacttgtatttgccacgcttcagaaccaacaccaacaacaatcagcagccgaagaagtagcacaagaagaatttgaagattacgatgccgacgaaacgtatggagaagttaacaaaatcattgggagtcgagcaattgaaggtgggaaaggaatggagtatttgattgagtggaaagatgaacatgcccctacctgggttccctctaatttcatcgcacaagatgttgtcgctgagtatgaaaccccttggtggaacgctgcgaaaaagtcagatgaatcggctcttcgggaacttattgaagccgaggacgacagagatgtggatgctgttgatgacgatggacgaacggctttgctctttgtttcgggactcgggtcggagccttgcgtcaagctgctcgctgaagccggcgccgacgtcaattaccgcgacaggagcggcggtttgacggctctgcatatggctgcaggatatgtgaagcctggagtcgctaagctgttaattgagctcggcgcagaacccgaagtgcaagaa

SEQ ID NO: 10525 - DNA, 480 bp, Lycopersicon esculentum
  Predicted polypeptide sequence is orthologous to G1950
ctaaaaccctactgataccctaccgtccgtacaaatcccggcgtaaatggaaccggaaaaatcctcagctcaaatcaaagacaaagatttgttcaaagccgctgaatctggtgattcatcgctcttcaaatcacttcctgaagaacaactcctcaaatccctctctctccgtaatgaagatgatcgttctctccttcacgttgccgtctctttcggacactctgaggtggtgaagattcttgcagctgctgatccgtcagtgagtggtataaatagtggtgatgaagaaggttgggtgccgttgcattctgccgcaagcagtggtaatgtggaaattgtggagattttgcttagcagaggggctgatgtaaatctgaaaaatgatggtggccgcactgctcttcattatgctgctagcaagggtcaagtgaaaatagctgaacttttgatttcacgtggtgctaagatcaatgcaaaaga

SEQ ID NO: 10526 - DNA, 739 bp, Lycopersicon esculentum
  Predicted polypeptide sequence is orthologous to G1957
cttttaagccctaaaatcattaattttgtctatttttttttttcgattgaaaatatcaattcattactagatctgtttgatcatgaatttctttggtagtgttgtaggagaagaagaagcatcttcttcgtcttataacagccaacaacttaaaaggcctagtagtagtactactacggagcttatgttgatggattcatcgtctacttgtgatgcgttggttgaaagggaacatatgttcgataaggtagttactcctagcgatgttggtaagctcaatcgtttagttatacctaaacaacacgcggagaagtatttccctcttgattcgtctagtaacaataaggggggacttctattgaattttgaagatagtaatgggaagccatggaggtttaggtattcgtattggaatagtagtcagagctatgtaatgactaaaggatggagtcgttttgttaaggagaagaaacttgatgctggtgatgttgtttcatttcagcgcggtgctggtgagttgtctaagcaccgtctcttcattgactggcgccgtcgccctcatcatgagaatggaaataatcaatttatgttaccgcatcaattttctgatgggcggctcttttattacccaacaacattttcgagtaatttgttgctggaaggaggtagcaatatcgttcatccacctaattattattatcctcaaaagtacatgtatgaaatttggtaccgctcttat

SEQ ID NO: 10527 - DNA, 742 bp, Lycopersicon esculentum
  Predicted polypeptide sequence is orthologous to G1958
tccatgctggccagtccgatactcttcctcctcctcttcctgctgctgctgcatcgtctgggcaaaactacccagttggtagcccatcgtctaccgcagcacagacgaaacctcggatgcgatggacacccgagcttcacgaagtctttgtagaagctatcagtaagcttggtgggagcgaaaaagctacaccaaagggagtcttgaagctcatgaatgttgaaggcctaaccatctatcatgtcaaaagccacttacagaaatatagaactgccagatacaaaccagaatcctcggaaggaacaccggaaaagaagaccaccagtgtgacagagatgccatctttggacctgataacgaccatggggataacagaagcactaagaatgcagatggaagtccaaaagcagcttcacgaacaacttgagatccagagaaagttgcagttgcggatcgaagaacaaggtaaataccttgaaatgatgtttgagaagacaaaggacataggaaaagatctaaaggtatcatcatcatcaagaacagatgaacatccttcaccatccaataagatgaagcatacatctcccaacgactaatcagaagcactcgagaaagatcgtttgtggaactcaccagacaaaaaagctcatgaagatcatgactcagatgatagagacttgtgttgttcacctacatcgaaacgagcaaaaacagaggaaatatcaggtcttcatgaatcttg

SEQ ID NO: 10528 - DNA, 746 bp, Lycopersicon esculentum
  Predicted polypeptide sequence is orthologous to G1990
gagaagccttcactaagccaaaagaaaatggcggtcttctctatgatgctttggcaagacctacaaagctttgattgtttaggtgtgtaaagaagacaacccatttgcccaaaaggagaataaattagcatgtgagctgaagtttctgaagaaattggcttcgcttgcctttataaccctctttcccattgtcaatttcaagatatttactacagttgtcttcttctcttcatttaatgagatatcagtgatgcctcatcagaaccagggacaaaatgggcagcagggtatgtggatgtaccaatgcatccattgtaaaaaaaacttcccttcaagccaggccatagcaggccatacaaagggtcatttcagagatggctgggttaaaggaaccccccagagcaaagtatttgtactattttctgagtatcagcaacagcagggttctatcactgactcttcaattcccgagaaacagattttttctgcagcaacttctgacactgacttagcagatgctcatcaattgcaaataggtgatgtgcagaattccagaagccctggtcgtgcggcctccatctccagcttcgtctagcagagaaccacgaatccctaggcatcatttgaggcttcgtgatctgaagatactagctaggctaagggctcgtcttaccagagaggagccagaagtcatttttgcgtcttcttgatagtgctatggaacagggcaaacaattcaagcagaa

SEQ ID NO: 10529 - DNA, 739 bp, Lycopersicon esculentum
  Predicted polypeptide sequence is orthologous to G2010, G2347
atcatttcctataaagacggataaaacattactacaatggagaaaaaaatattttctctactttcaaacgggaccgttgcacaattctctattcccaaacgaagattatattggggtaacctaaagaagattccctcttttcctataaaagtatgtatcctctcaattatgaaactcagtatgcaccacaataattttactgattttctaagcagctgctttcctgttgcaaagtctcggcataggtaaaatataagtactgaaaactcacaatggtctgagtatctgacaattgaaacatgaaagagagtaaaaacagaaattagcaaggacagagagcttttctccctgcaccatttcccttaagtgactagaaaagaaccaatcagaatttacttgaggtgatttttcttgctctattttgttccaagaatgtgacatcttggttctcttgcatcctctcagaactacttatgggaagtttcatttttttttacattataaattatggtaagcagatttcatcagttggcggagtttgatgatgcaaaaaagagttgcaggagacggttggcagggcacaacgagcgccgccgtaaaagtgcacaagattatccaggagaagggtcaagttgaacgggcacctactagtggactgatgagaacttaagctccctctgaaaatatagagtttatcacgctctctctcttctgtcatttgccatatttcctttttaac

SEQ ID NO: 10530 - DNA, 790 bp, Lycopersicon esculentum
  Predicted polypeptide sequence is orthologous to G2011
cagagttgtttacaggagatatttcttggtttgtatgtcggcgttacctatataaacctcccttcaaccccttttaccgactttttatctatcacccttatcgaaattttgaatcttttgatcacaaaaactattaaagtttcaatctttgatccataaaaaccacaaatctctttgtatgatatgaacccatttgataaaaaacaagaatctgatactgatacaaaaaccccatttttgactgaaatggactctgaatttgctgcgttttcaccaatttcactcccttttgctgacccatcttctccttttatcaattttggatcttttgccactcctttgagccaacatccagttggagaaggggaaggagaaggagaagggggagaaattgaacagccagctgagggaggattgggtgtgccgcagcctatggagtgtttacatgggatacaaattccgccatttttgtcaaagacttttgatttggttgaggaccctttattggatacgattatttcttggggtagaaatggagaaagctttgtagtttgggatccagtggagttttcaagattggttcttcctaggaatttcaagcacagtaatttctccagctttgttcgacagcttaatacatatgtttgcagcactgaaggcgagtatgggacttctttagagatttcggacttgaatgagtgaatgacattgctcgctcaagctttttccagtcgattcttctgtattggcttggctggatcttgtaccctcgcctagggcaagcaatgat

SEQ ID NO: 10531 - DNA, 757 bp, Lycopersicon esculentum
  Predicted polypeptide sequence is orthologous to G2035
tgcaatcccagcttatacaaaatgaaaagacccgaaggcgtgtttctggtattgccaaagaacttaggaagattcatagggaagctgttcagaatacgattaactctgtgaccgtggttgctgttttgtttgcgtctattgcttttctggctatattcagcttgccaggccaatatgtggagactggacctgaagcaggaaaggccagaattgctgatactgttgcattccgtgtgttctgcctcctgaatgcaacttctctctttatatctctcgctgttgttgttgttcagattactctggttgcctgggatactagagctcagaaacaaatcgtctcagtcgtgaacaagttgatgtgggcagcctgcgttagtacctgtggagcattcctagctgttggttttgttgttgtagggaggaaaagttcgtggatggcaatcactattactgtgcttggtgcaccaattctcattggacctctcgttagcttgtgctactttgtcttccgacagcattttggcatttgtggtagcgattctcaaaggcgtatcagaagagcaagtgggagcaaatctttctcatggtctcactctgcaaatatctctgatatggatgactacaactctgatgacagaatttattgctttgtgagactgacgttatgcaaatgtttcgatctaactctgatatggatgactaaaacacgagaaagactgaagtttagtcaaacgcttgtgaaccctgtgcatgtcac

SEQ ID NO: 10532 - DNA, 760 bp, Lycopersicon esculentum
  Predicted polypeptide sequence is orthologous to G2041
cacaacccaagaagtacaaaatcccggttaagaaagggtctaatgaaggtcaatacacggcttaggattttactttctggtacattatttcagaataattttaggagagtatttcaatacacttaccttagcaaggccaacttttgttgatgaggtcttgaaggagcttgatcccaagtacaagaacaaaaacaaaggtgcatcgcgcttttcattggaaaatcgagcaagaaagatgtttattgataaaatttcaactgtcattgattcagacatccccaagaaaaggaaagaaggcctaaacatattgaagaaactaacaggtggattcatagatgtgcatgatggtggaacatctgataaccttcctggtttacaatgttacaccttgatgatgaaatcaactactcttcaacaagagatcttggtgaagcttcaaaatcaaaggcccatctataaaggatttcctctggagttagagctgttgattacccttggtgcaatccatccttggttgatcagaacgacagcatgttctagccagtacttcaaggaagaggagctggaggctctccagaaattcaagtttgatctgaagctgggttcgaaagtcaaatttgtgatgagcctaattcctcgttgtctcctcaggagaagaaaggttttgatattttgccacaatattgctccaattaatctttttctggagatatttgagaggttctatgggtggagaaaaggcattgaagtactgggtgct

SEQ ID NO: 10533 - DNA, 551 bp, Lycopersicon esculentum
  Predicted polypeptide sequence is orthologous to G2052
agactctgatcactcaaatttagcaacttctcaactatttagaattgatagtactagaaaaaaaaaacaacctttttttcatgttttgacaaaccatatagtgacattttgtgccttgtgggataaggcagttttgaacctttattttttttcctggaagatgattgaattgttccagggatattgcatcttatgtgaacttacaaaattcagtgtagctaaaagtttttatttttggatatttcaaattttcaataggtacagtttgaacatttagctaaatttcatattgtaatttgtgtgtagttatagcagttggaaaaatatttacttatatggcaggaatatcgttacctcccggatttcgtttccatccaactgatcaggaattggttggatattacctgaaaagaaaaactgatgaacttgaaattgagttggaagttattccagtaatagatctgtacaaatttgacccatgggaccttccagagaaatctttcttgccaaaacgtgatatggaatggtacttcttctgctctcgggacaag

SEQ ID NO: 10534 - DNA, 701 bp, Lycopersicon esculentum
  Predicted polypeptide sequence is orthologous to G2071
cggccaaatcggccgaattgaaagtttgtgaaattataaggagcaatttgtgtatttttagagtaagaaaaggaaagggagaaacgagatccctacgaagtcggcaactatggcgtcaaaggtgatgccgtcagcatcaacaacgcctaattcggatcgttcattacatccccaaaacccatcttcttctctaaatcactctcatccttctagaaacttcgattctatgaacatggatgaaattctgaagaacatttactctgattccgacccttttgcttgttctgtatctgcaaccgccgcagtccatacaccttctgctaccgcagccggtgttggggatgtggggcctactaagactgtggatgaggtgtggagggaaattgtagcaggaggagggggagggggagggagtagggagccggagatgactctggaggattttttgaccaaagctggggcggttactgaggaggatgttagagttccggtgatcgctcctccaccacctccgccaccgcctccagccacgggggctccgtctgccaaagggtttgtggtggataacatgatgggtactgggaattgtcagtttccggtggccatgcagaatggaccaggagggtatggtatggaaccccaaccccacatgggatttggaaatggggtggtggctattacagggagtggaagtgggagtg

SEQ ID NO: 10535 - DNA, 520 bp, Lycopersicon esculentum
  Predicted polypeptide sequence is orthologous to G2071
gcttgtacctgccaaaacggattttgtttgtcgtaaccatgggatcttacctgaacttcaagaactttgctgacacatcacaaccagagagcagtgggaataatagtaattcttttttggcccaacaatcttccatatactcgtttacctttgatgagctgcaaaatacatgtggacttggaaaagattttgggtcgatgaatatggatgacctcttgaagaacattgaagagtctcaagcgttgtcatcttctgctgctttagggggtaatttgcagagacagggttctttgacactgcctaggacacttagtcagaaaactgtagatgaagtatggagagactttcagaaagagagtgttgttgctaatgatgcaagtgggactggaggatcaaactttgggcagcgggaatctaccttgtgagaaatgacattagaagagtttttggttagagcatgggccgtgcaagaagatatgcaaccagctggatactcaaatgatgttacatttgctagtgg

SEQ ID NO: 10536 - DNA, 684 bp, Lycopersicon esculentum
  Predicted polypeptide sequence is orthologous to G2071
taagcacatgaggaaactttatgcaagaacattgtttacataacgtacaggtacacagcacctgtcctgtactatagtcgatacataaagttatctatcctgtgaccaacatatgtgaattagaacatattttaattcacaggctgggaggagggtcgaggagcaggctctgaacttgtttgttgaaacaaaaaagaggaaggaaaagctatttcacttcaatctcctgtctaccaattctccgagtgtttactcgggaatttgctcttctactgactaccaaggtcccgtcactgtccttcgcaagcatattagtttattttcccatggcacattcatcttttccaataactgatttttctgcttctcgataaattcagcctgtttcttctgcaactcttgcttaatttctttaagctttgctacttcagcttccaactctaaagtatatgcctgcttccgatcccttgatctggccgcagactccctgttctttatcatcctcttacgccttctctcaacaactttttcaaaagaggtgcatgatctccttcctcttccaccttcaccacatgcataaggtgaaggtgaaagagaagatgtatcaagatttccaggggatactccttttactggcatggtcataacaccaccctgcatgacactactagtatttgcagacgg

SEQ ID NO: 10537 - DNA, 661 bp, Lycopersicon esculentum
  Predicted polypeptide sequence is orthologous to G2108
atcggccgaattgactcctcctctctgaaaagcagaagtgccacacctctttctcctcatctcctctctccctctgttgttctcttacaacgagaaccactagagaataatcatgtagatagtggccaagtaaactcaactgctcgaccactgccaaccctttttcccaaacaccgccgacttggaaaaacctacagaaacaacaccagctccagcggcttcgaccaacaagcggtgaataatgactctgggcgacgagaataacaacgctccagccagtggctacgaggtctacaacaatgacggccagaatatcgatccaacacggtagctcaagtttttcagtcggcttaaagacaaatctgttaagggaatcagaagtcttgatgtgccatggaggatggataggttttcaaggcttgaagatgaagtattagtgagtcctcatcaattcgaggataatatccacatgtcccttatgtcatactcttcatcttattgtcttttatgggattagtcccaagtgttgtatactctaaagtttagatggttcaagtagatgttgtaaagatttaaatgtttcaatgaaagtcttctgcttgtgtaatatttatgaaagagttcaacatgtgaaaaaagttttacatttttaaaaaaaaaa

SEQ ID NO: 10538 - DNA, 753 bp, Lycopersicon esculentum
  Predicted polypeptide sequence is orthologous to G2110, G2574
aagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctcccctacattacactcgatttgacttccacctcgtcctcgtccccgtcctcctatctcatctaacagaatgactcagaattttcctccta

SEQ ID NO: 10539 - DNA, 770 bp, Lycopersicon esculentum
  Predicted polypeptide sequence is orthologous to G2110, G2574
aaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgatgaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatccggacccacaagtagtacagcctctgccacaacctctgcgctcaactattgcttctctgataactcaaaacaaacccattt

SEQ ID NO: 10540 - DNA, 612 bp, Lycopersicon esculentum
  Predicted polypeptide sequence is orthologous to G2115
gcgtaaacgccactttctccaatgttttgacctcaatacacgccaaaattcccttcaattttccaatcattagtacccaaaatcccatcaattctcaatctttgcttcaattatcacaaccccagatcaaaatcttgacaaaattagcaaaaatttgctagttctatgttgttctaccatgtaaaaaatcccaaaactccataaattcacaatctttactgccattctcataaccccagatcaaaatcttgataaaattagccagttctatatagttgtctgatgtaaaaatccataaatcccaatcttttctccaaatctcacaaccccagatagtattttgacagaaagttgcctgttttagagttctttgtgtaccatgtgtcatgatttgaactataatctttgatgcctaagaaaacccagtttagtataagctcatctgattcagattccccaagaaaaaatcttggttcttctgtttctacagagccaggaccaggaccaagcagtagtagtagcagctgtaaggttaataataaatcatctgtttggtctggtttattggtttctcctttttcaatatttgatagtgagccaaaagggtgtttg

SEQ ID NO: 10541 - DNA, 724 bp, Lycopersicon esculentum
  Predicted polypeptide sequence is orthologous to G2124
tcgtcgtgtaaggctttcagttcctactgctattcaattatatgatcttcaagacagattagggcttaatcaaccaagtaaagttgttgactggttgcttgatgcagctaaaaatgaaatcgatgaattgcctcccttgcaaattcctcctggaagtttgaaccctaatctttatcctatgttaggtaatgctcctcaaattactactaataaagaaggtcgcattaattgggataataacattccattggaaccacctaataataatgctttgggctacaatcccaatttttttaaatgggatccttcaaatttatccttagctcattcagaaaattcattatctcatcaacatgatcatcatcaaaacttcaatttgatgtctagtatgccattaacttcacatcatcaacctgttgtttatccaccaggattgcctcaatttttccatcaacataataataatattaatgttggagcatcgtcgtcatcagaatttgatcccaaagaaatcaacttccaaatgttgagtaacaattccggttcagaaaatcccttgtcaactagtactaattcctttagacattctattgactccacaaaccaatctataagacctttccattttctgccttctcaaaatgtgatgacacggagcctttccattaagatcatttacttcctctctgctctttataaacacttaagttttacacaaagaatc

SEQ ID NO: 10542 - DNA, 801 bp, Lycopersicon esculentum
  Predicted polypeptide sequence is orthologous to G2141
aaataacaacaaaaaagacattgtataacatttaaaaaaaaagaaaaaaagtgtgtactgtgtacagactacagagtaacagcaaaataaggcacaaaactataatcttgttccttcaatttctctacctgtatggatgtgtaatgaagtggaggcatttcaccagctgaacaatcgatccctctcgtcggatctttgaaagtggccaattgtttgatgtgtatcttatagattgttaatcttgaggcaaggggattttttttttttagtttaagtttgattcatttcccaaataatggatatgggtagcaagaatgatactcaaggacaaaagaggaacaaggatgctactaattttcagtcaccaaacatatcgttggactggcaattaagtggaagcaacttgacaaatgcatcaatggggatgatccctaatagcaatcctttagtagattcagtttttcccactatttgggatcggcctcccaattcgtcacacttaggtttctatggtaataataatgctaatgctcaaatcagtccttgcattatgaatcagcacgagactgcagcaattggctcggtccctacgagaggtagtatgagttggaatccactgaattcgatgctgaaaggggctatgtttgtaccacctattcctggaatgattcctcaaagcttagctcagcttccagctgatttgggtttcattgagagagctgcaaggttttcgtgcttcagtggaggaaacttcaatgatatgatgaaccggcctttaagcgtccctgagtctactaagcc

SEQ ID NO: 10543 - DNA, 607 bp, Lycopersicon esculentum
  Predicted polypeptide sequence is orthologous to G2142
gaacttgcagcagtaatccaaatcccaatttctccaaagaactcaaaatcccagaaaaaagataaaacacaatgaaagctgtgaagggtcatcaagaagaggaagaagaggaggaagatgagactggtattgttaagaaggatgccacaccttctagcagtaataccaaagatgggaagagtaatgagaaggctagtgccctaaggtctaaacattcagtgactgagcagcgtcgaaggagcaagatcaatgagagatttcagatattgagagatctgataccccatactgatcaaaagcgagacactgcatcattcttgttggaggtaattcagtacgtacagtatttacaggagaaggtacagaagtatgaaggaccatatcagccttggagctcagagcctacaaagcttatgccatggagaaacagtcattggcgcatgcaaagtttacctgcacagccacatgccttgaagaatggtagtggcccagaatcaacatacctgggaaggtttgatgaaaatctcgctactgttacttctacgatgcaaccaaatcagcagaatccaattgaatctcatactagcaaggatgtatcatttaaagc

SEQ ID NO: 10544 - DNA, 783 bp, Lycopersicon esculentum
  Predicted polypeptide sequence is orthologous to G2144
cattaacgaaattcgagaaactgtagaaattgagcttggggttgtcttgttgagtctcattctggaattgggttagctgtgttgtatcaaagttgggtttggtttgttttttctgtgaaatggataatctgatagagtgtattgaagcaggagaagctagatccgagaattgcggagctagaatgggagaaattaaagatgggtttcatcaatttggtgaggaaattttgtctgttacgtcggaaggtggaagttctttcactgctttacttgggcttccgccgaatcaagcggtggagcttttggttcagtcaccggaaactgacaaaatagcatcagataagcttgctatcagtgaacctcactatcgttatcctcctcctcctccgatttttccttcagatatcgctttgatcgatagagcttctaagttctccgtcttcgccgccgccggtaactccccggagtccaattcaaccctttcgaattccgggtcgaaatcactgttcgtcaagcaagaacccctagattccgaatgtaaccacaactcatctccggcgacttccaatccactagtccatcagaaatcaacaaagagaaaggaacgcgagaaaaaggtaaaagaaacttctaaaaaggggaaaaaatcagctaacgatacctcagaagacggcggcgagaagctaccatatggtcacgtccgagcgcgtcgaggccaagccactgatagccatagtttagcagaaagagcaaggagagagaagattatgctaggatgaagct

SEQ ID NO: 10545 - DNA, 475 bp, Lycopersicon esculentum
  Predicted polypeptide sequence is orthologous to G2192
ggaagaagaaatgaatttcattttccgttcaaagccaaaggactttgtacatccaccgccggcgacggcggcggcggcgcagcagcagcagcatgcggtgggggagaatcatagggattcgttgatgatggatcttgatttggatctcgacgcttcctggtcatttgatcagatcttcgccgcagctgcttcagcttcaaatcctatgtcgccgtttctcgtatcggctgcttctgaacagccttgttctccactttgggctttttctgatgaaaacgaagataagcctaacggaaatgctctctctacaggcagtttacggctctccaactaccctagatttgtcacttatgctaatgaacatgaggctgcacctgaaactgtgtctgtcactgatgataagaaaagaatccctccaccaattaaaggattagccccgttagattatctggatagttcttgcataatcaaggag

SEQ ID NO: 10546 - DNA, 698 bp, Lycopersicon esculentum
  Predicted polypeptide sequence is orthologous to G2192
ctgcccccaaatgatggagactacactgaccagctggccttgctgaactctctcttattgacaatgaagcagcactttaggagtcttagggttgcttctggtgaggaacttgagcatgactggggttcagttgagattattaaagcatccacagaagaaaaacttggttcaaggtttgactctgtgccaaccaccaaatctcttcctcagtctgctagtgtagcaaatggaaggagacatcctgatctaatggaagagcagcactccactgtggcaaaaggtgcagagggtgtaaatgttacagctgaagcccataatcatgcttctgtcccccaaaataaacagactggtaagaaatcagagagaaaacgtggaaaagctgaaaaaacaataagcttagaggttttgcaacagtattttgctggaagccttaaggatgctgcgaagagtcttggcgtttgtccaactacaatgaagcgcatttgcaggcagcatgggatctctagatggccatctcgcaagataaacaaggttaaccggtccctttcaaagctaaaacgtgtcattgaatctgtgcaaggagctgatggaacattcagcctgacttcacttgcaccaaattcacttcctgttgctggtggttctatttcttggcctgcaggcataaatgggttcgccgtgtaaagcttcggagtacc

SEQ ID NO: 10547 - DNA, 736 bp, Lycopersicon esculentum
  Predicted polypeptide sequence is orthologous to G2192
aaccgggagcttctctagagaagagagcacggggacgcctacctcccatggatcatgccaaggtagtccttcccctgcaaatgagtcctcccctcagaatgagctgctcaattcacctacacaagagtcggtcatgaaagtggaaggctctttggaaccagctcgtcagaccacaggagaattaaacttatccactgcattcctaatgcctgggctttttattccagaacacactcatcaacagtttaggggaatgctagttgaggatgcaggcagctcacatgatctgagaaatctctgtccggctggagaaaccatgtttgatgaacgtgtcccagaatacagttggacaaacccaccatgttctaatggaattgctacgaatcaagttcctcttcctgtcgagaagatgccacaattttcttccaggcctgaagtaacatccgtgactataaaagcaacctatagggaagacatcataagatttcgactttgtttgaactctggcatatataagttgaaggaggaagtatccaagaggctaaagttagagatgggaactttcgatattcagtacctagatgatgaccacgagtgggttttaatcgcgtgcgatgcagatctacaagaatgcattgatatctcaagttcatcaggcagcaatgtagtaagattgttagttcatgacataatgcccaatcttggtagctcctgtgagagctcaggtgaaatgatt

SEQ ID NO: 10548 - DNA, 742 bp, Lycopersicon esculentum
  Predicted polypeptide sequence is orthologous to G2207
ttatagcaagtcagagtatccactttctcattatgcaaaaatgtttggactgcaagctgcagtagctatacgtctacgtagtatctcaactggttcatctgattttgttttggagttctttctaccctcagactgcagaaatcctgaagaccatagaaaaatgcttacttcattatccatcatcatacaaaatgtttgccggacattgagggttgtgacagataaagagttgcaggaagaaactatatctgtgggagaaatggcaaaccacacagttgaacaacataaggagcacactgaaacctctcaagaaaggacatcgtggacctcttgtgacgcagagttccaggagagttctgttatgtctacattccaggatgaaaaaccagatgaaatgctaaggaaagattcggtggagtttaggcaccgtaagaattctgcttatgaggagggtgtctctcgtaatctgggtaaaacgggagacaggagacgtgcgaaggctgagaagactattaccttgcaagttcttcagcagtattttgctggtagcctaaaagatgctgcaaagagcattggtgtttgtcctaccactctgaagaggatatgcaagcagcacggaattaaacgctggccttctcgaaagatcaagaaaggtggtcactccttacaaaaatcccaacgtgtattgattcagttcagggtgcctctggcacttttacaattgaatccttctattcaaact

SEQ ID NO: 10549 - DNA, 577 bp, Lycopersicon esculentum
  Predicted polypeptide sequence is orthologous to G2226
caataaatttctctcccaattctcttaatatttcaaatttcaaagaattttctaacatcttctagctcctactacacctataggcaataatataaagtccagttcagtcagctgttccagaagttgttgctagtagaaatctctaagttacagcctagattccaatccagtatgggactctcacagtatccaactccagcagatgcaggagtgctctgtgttattctagtgaacacagccatatccatctccattgtcaaggagatgggccgatcgatccttcatgtgattggcatccacattgcatcatgggacgattattccatcgaaggctccttggactcgtttgaatgtcgcagaagcccatcagagtcatatatggaggaattcagaagccagacccctgcaattcgttatgattccatctgtgtctctaaccacgctgagaaagagtgctcactctgcctgacggattatgagccggacgcacagataaaccatctgtcatgtggccatgttttccacaagcattgattagagaagtggctcaagtactgccaatgtaacttgtccactt

SEQ ID NO: 10550 - DNA, 610 bp, Lycopersicon esculentum
  Predicted polypeptide sequence is orthologous to G2226
caagaatgctctgtgtgcctgacaaaatttgagcctgatgcaggggtaaacagcctctcatgtggtcatgttttccataagctgtgtctagagaagtggctcaggtattggcatgtaacttgtcctctttgtagaaattacttgatgcctcaacaagaagaggacgatacatgtccaatgtgagattaaacgttttacggtgccacttcatccatttgctgatgttattatgtacagcttagtagtgtacaggctgagtatgtgtatgcttgatctttgatgtgatatagtctgttagcttgtcatatttgtgatggtttgcgtcctctcagagtgacgggtctctttcgtgtgaccaaaaaacttatactatgttgtacatgatttagtcctgtagcttcttgtgtttgtaatgctttgcgtcctctcagagtgacgggtctctttcgtgtgaccaaaaacttgtacattatagtacatggtgtagtcgtgtagcttattaatgcttttcgtcctctccaagtgacgagtctcctttggcatcaccaagaacttctacattgttgtacattgttgtacatataacctaaaactttctcttatgttactt

SEQ ID NO: 10551 - DNA, 719 bp, Lycopersicon esculentum
  Predicted polypeptide sequence is orthologous to G2226
ggttataggaaacaaaagttcgcttcttttttatggggtcttgataaaaaatccagtgcattgagttcttccaaaagtttggcttgaagaagaaattcctcacatctacactaggttcctattcataatgggactctcaccatatacgactccagcagatgcaggagtgttctgtgtgattctggttaatacagccatatccatctctattgtcaagggaatggttcgatctatccttcatgtgattggcatcaactttgcatcatgggaagaatattctattgaaggccctttggacccatttgagtgtcgtgggagcccctcggtatcatacatggaggagttccgaagcagaacccctgctgttcgttacgattcattgtgttctaatcaccctacacaagaatgcgcggtatgtctggcagagttcaaacatgacgaggagataaactgcctctcatgtggccacgtttttcataagctgtgtctcgagaaatggctaaagaattggaatgtcacctgtcctctctgcaggaattacattatgcctaaagaaggtgaggaagatacttgtccaatgtgaattttgtagtttgtcaggcctgtttgatatgttctgatgtacagcttagttgggtaaaaatttattgatgactgcctgatctttgacactgcataattctgtaaccttttatactgtaatacttttgcgtcctatc

SEQ ID NO: 10552 - DNA, 1778 bp, Lycopersicon esculentum
  Predicted polypeptide sequence is orthologous to G2239
ggagcttccttttttcaattctgtctgccaagtaggatccttctgcaccatccaccatttttgttttaatacccccaaacgaatcgaaccacagttatttcaatttctttgatattcaaaattataaagcttacttccccagattagtatgagatatgggcaattctatgaagcaagaatctcctcttcttagttatcttctctttgtgtttctcttcacatgttcttctttaattgacgaatcagtcgcacagccaccaactactggaaataaatttcaatatgcaaggctcagtcatcctttggcaattatcataattgttcttattgctgcgctctttttcatggctgctttttctatttacattcgacactgcactcaggcttctggattgagcggcagtgtccggcgagctctatccatgcgccgccgtgctgcggcggctcgtggattagatgcagcggttattgagacttttccgacttttacttatgctgaagtgaaggatcatcaaattggtaaaggagctttggagtgtgctgtttgtttgaatgaatttgaagatgatgaaacgctgcgtttaattccaaagtgtgatcacgtttttcatcctgagtgtattgatgcttggttggaatcacatgatacttgccctgtttgccgtgctgatctcaaccctcaaccggatgaaccgccggttcaagttccagaagatgaaccggcaacggaacagcaacagcaacagcaaaacgatgaagtttcaattcgcatagtgagcgacgacgaacaaagggaacaagtacagcaacagcaacaagaagaaggttctgttaattcgacggtgaagcggaatttgagcttcaacgtgccgaaccgggttcccaagcaagaagaaggcggttcagttaaatcaggagtaaagagaaacttgagtttcaacgtgccgattcaaccaccgagatcaatttccatgaggccaaagatgttcagcaaattcagatcacattcaaccggtcattcactagtactaccaggtgagaatttagaccggtacactctcagattgccggagggcgttcggaaagaggtaatgaaccgtgcactattgaaccgggctaaaagctttggaggcaccttaccaagagatacaagctccagaaaaggatacagaaccggtaccggagatggaagcaaccggggttctagatctaacaaaaggatggagtggtctgaaccggaaccgaaatcggaccggtggattttcaccatgacaccaccattcttttcaagaggttcatcaatgaaatcacccagagttggagctgaagccggcgagggttccacctcagggagtatgagaaccgccgtcaaattgccgtcgtttaaatgcttggaaccaaaaggcgatgaagcctcattgatgtcgactgactcggctcgaccgccggtttaataatccggttcgaagtcaaaccgtaatgattcgcaaggacttttcatgggctataggaaaggggaacgtgtttttcatgatagattgggcccccgctttgaattaacaagcccaaacttgactctaaatttattttttcgagaaaagcatttttgtttttatttttttgttatataattgaaaaatctttaagtttttcctttttctcgttttaaagatatagtgcatatcaatagttgatgtaagtgtaaccaaaaaatcacttgtaattttatttatttttccttattggataatgtcctatgacaaaaaaaaaaaaaaaaa

SEQ ID NO: 10553 - DNA, 649 bp, Lycopersicon esculentum
  Predicted polypeptide sequence is orthologous to G2239
gggagctttggagtgtgccgtgtgtctgaacgaatttgaagatgatgaaatgttgcgtttgatccctaagtgtgatcacgtttttcatcctgaatgcatcgatgcttggctcaaatctcatgtaacttgccctgtttgccgagctgatcttactcctaaacctgatgaaccggtgccggttcaaactcctgaggtgaaccgggaattggggcaagaacaggagaatacacagcaaaataacgaagttacgattcaaatagatgtagatgagaatttgatgtcacagcaagaggagacctctgtaaaaccagaagttaaacgaaatttgagtttcaacgcggtgaaccggccgccgaggtctttttctctgaagagaccaaagatgttaagcaaattcaggtcacattcgaccggtcactcattagtggtaccaggggagaatttagaccggtatactcttagattgccggagaaggtgaggaaagatgtaatggaccgggctctactaaaccggacaaggagctgtgcagtcacgctaccaagacacggtggcaccacaagaggatacagagccggtccaggagagggaagcaacagaggtgcaaggtcattcaagcgaatcgaccggttcgatccggaaacaaaatca

SEQ ID NO: 10554 - DNA, 1154 bp, Lycopersicon esculentum
  Predicted polypeptide sequence is orthologous to G2290
ggcgtaaaattcactctgtaactatggatgaaaacgataagcaggttgataatgatccattacctggtggtggtggtggtggtgcagcggagttcaccggcgctactactgaatcaagctggtcactcggtggtggagatgatgaatcggataatgtttacttcttcggtactagtagtactgatagagagagcagtatattaaccgaattcggctggaattttcaaccgcacggaaatagagatgttcgcgccggtggtgacggtagtcgatttgatcggatcgatgaggatttggcgggaaatagtactacaactactgcttctgtttctgcttctgtttctattactgaaccgacggtgacggagaaaatcaccgacgaacctgtttcatctagctgttctgatgatcccccggagaaatctacagcttccggtagctcctccgcctctcgaccgccgtccgatacagcaagcaaggttaaaaagaagggtcagaaacgaatcaggcagccccgctttgcatttatgaccaaaagtgaagttgatcatcttgaagatggctatagatggaggaaatatggccaaaaagctgttaaaaacagtccatttccaaggagttattatcgttgtacaaatacaaagtgtacagtaaagaaaagagtggagagatcctctgaagattcctcaattgtaatcacaacatatgaaggacaacattgtcaccatacagttggatttcctagaggtggacttatcaatcacgaagcatttacatctcaattaacacctttaccctcacaattctatcatccatccggtgttcaataccctcatgaattagttcctatgagtagccccgctgcaccagaatcacatacaatgcctggtgaaaccggacccgaacctattagattgccagaaacaagtcaaccagatgctacacaacaaccaactgatgaaggattgcttggagatattgtacctcctgggatgcgaagcagataatataaagggtaatatattccgtttcttaatttgcattaatttacatatatttttttatttcatcaatgacatagtatttgaacgttacacgagtgcgcctacacaagtgtaagtgtatgtgttttattcaaaaaaaaaaaaaaaaaa

SEQ ID NO: 10555 - DNA, 630 bp, Lycopersicon esculentum
  Predicted polypeptide sequence is orthologous to G2311
caatggaaacatcgattccactcttgacgcaactcatttcttagtgaactacaaaaagtgaaaaatatgctgaagtgcacaacctactcagcaggaagtaaaagcagagcactctatcaattttccagctagaataaagagcatggtctacaagcatcaaatctctctccctctattttgttgttacattgaatacaacataataggaggcgagaatctgtgcatagctcataatccctggtacataaactgacaacagactgcatatcactagttgatacaacgagaaacatgtactactatagaggtgctgaacagctggttctgactttaaaaaaataggggaaagaccatatcatgccgttagcagcacaatctccccatgtgaacatttgtcgaagatatccttgtagatctgtagtgaattatcactgtcttcctccatctttgagactctctcagcttccttggccgcttcagctgctacaaatgatttattttcagcttctgcaaccttataggcagcagtgattgctgcttcttccgcagtgtcaccgagataggcaattatttggtaactgccttgggcccaacgttgcttttgttttaggggtagccagcccgtctttg

SEQ ID NO: 10556 - DNA, 795 bp, Lycopersicon esculentum
  Predicted polypeptide sequence is orthologous to G2319
aaaattgtacatctatggctaataattctactcccaccgacgcttctagcaagaaggtacggaaaccatacaccataaccaaatctagagaaagctggactgaagaagaacacgacaagtttctcgaagctcttcaactgtttgaccgtgattggaagaaaattgaggatttcgtaggctcaaagacagtaattcagattcgcagtcatgcacaaaaatacttcttgaaggtccagaagaatggttcaatagcacacgtgccaccacctcggcccaagcgtaaagcagctcatccatatccccagaaggcaccaaaaaatgtgttagtaccgttgcaagcatccatgggttacccttcttcaatgaattcccttccacctggatatccaacatgggatgacgcgtccgtacttataaattctccatcaggcggagtaatgccatcacaagatgaataccatcttcaaagaattcaggctgataatggatcaaagggagctacattgattagtaactgcagtatgagtggcattagaagttccaacagaacggcaccgagttctgaactaccagaccagaataaactaggttctgttcctcatggcataccggactttgcagaagtctatagctttattgggagtgtgtttgatccagacactagaggtcatgtacagaagctgaaggagatggaccctattaatttcgaaactgttttgatgttgatgcggaatctttacatgaacttatccagcccgggacttgaaaccattaaaatgtatttgtcacgtatga

SEQ ID NO: 10557 - DNA, 1373 bp, Lycopersicon esculentum
  Predicted polypeptide sequence is orthologous to G2343
tttttactaattaattattataatcatagaaagaaaggatattcatacatggggcatcattcatgttgtaatcaacaaaaggtaaagagaggactttggtcaccagaagaagatgaaaagctcataagatatattacttctcatggctatggctgttggagtgaagtccctgaaaaagctgggcttcaaagatgtggaaaaagttgtcgtttgagatggatcaattatttgaggcctgatattagaagaggaagatttaccccagaagaagaaaagttgattataagtctacatggagctgtaggcaacaggtgggcacatatagcgagtcatttacctggaagaaccgataacgaaataaaaaattactggaattcttggataaaaaagaagctaaaaaaaacttcaaagtcatcaacaaacacaacttcaattactgatcatcatcaccaccaacatcaaaatcaaagacctcaattgacaaattataacacaattacaagccaacaagatatattcttcacacaagacattggaacaaaatctcaagtactcctccaagattctaccctattcaattcaccaaaccaattgttcttttttgatggtggttcacttgactcaatgacaaatgttcttattaacgatgccacaaatcgaaatgctactaataacacctcgttatttcaagaaacatcgatattaaattcagagttctgctggcaagtagatcaacaacaagtacagacatcttcttacgcgatagggatgaattcaaattatttgccacctttgatagagagtatggtaccaccaatggaaatacctagtagtaataataacaataatataatattggaaggacaagaaaataataatgaattgaatgaatggaatagtcaagttgacacacaacaatgttgtccaagttatctattttgggatcaagaaaatggatcaattggtggtgatcatgagattatagatccaactacatcaaacaatatgggacaaattttatcttcttttccttctactttatgagatgattgaagattgattattttttttcgaattatttcgggagtttttattttattttattaattgagttgtgaaatagattagagagtgaaatgaaagcatgttaattaattaaaagtgtttctttggacatatttttaaaattaagtgagaggggaaataacattgagtttttatctatgagaaatgtttcacttattctttaattcaccaatcagtatcagagtttaagttatatatatttaccgatgttagtgtaagaaaaatttacatgtatccattgtaatagataatttgatttattttcacaaaaaaaaaaaaaaaaaaaa

SEQ ID NO: 10558 - DNA, 525 bp, Lycopersicon esculentum
  Predicted polypeptide sequence is orthologous to G2372
gagttagtgtatcaagtttatccaatgttaagagcaataaccttgggttgtgcactaacaatagcttagatgaagaaatcaaggcaaagcttgacagtgtttctcccaaactgaatattggcagttcatattcagacaatttatcactggatagtcagagcagtgtgcattttggggacaatgagctgattacaaaaccgggttccagctcttttacaaaagatcgtttcagtactttccagttatttggtaaggtcatccatgttgaacgtgttgagggagctttagatggttttggtttctctgaaagtgataacgttgaagtgtataaagagatagatgatccatccaactcagacgtctcaccaaataaagatgatccatccaactcagatgtctcaccaaataaacctttcaagctgtttgacaatcctgatgtccaacatgaatgagcctcagctgtcgaagcatgttcatcttgagataactatattccgtaattgccatcaattgcaaagttgtaca

SEQ ID NO: 10559 - DNA, 649 bp, Lycopersicon esculentum
  Predicted polypeptide sequence is orthologous to G2382
aggttaacagacctccataatgttattattgactgttgaaacaacatccagatacattcttacatcacattaagttgccttgcatatagccatcaatggtgagaaactaaaatgcaagatataatacaacagtggaaaatagccaacatacaacgaatagagagataatctggcttgtcatccactaacattttcagcagacatgtcgttctcttcatcacttccttgacgtattcttgcaatttctgcctgagctctctccataatttgcctcttttggagttccaattctcggtggaagtccatcctcattttctccagttccatcatttgctgtctcttgctattctcaatcttcacatatatctcactaaatttatggatagaatctgctattaatttgaaagaatgtccattcccattcccgttccctcctggttgtacatttcttgatctttttggtggaagatcctctgaaccatcctcctcaccatcagcagattctgagttagcaggactgtccctcatctcatccaagccattagcacgattcagataagcttttgggctcatgaaaacatactctccagagtccattccacatgaaacaccaactttctggggagttgatgttagtaacatgtccatc

SEQ ID NO: 10560 - DNA, 694 bp, Lycopersicon esculentum
  Predicted polypeptide sequence is orthologous to G2404
cgcaaaaccaacaagaaacccaagatatggatccagtttcttcttcttctcgctccactaaacccacaatttcatctctacttctagcaccattttcgcctacaagtcctatccatgaaaactcaactacccccagtgcctctacagttttttccactaaaaagaagaactttgctacatttaggggactgggttgcactgcatcaccgcaagtgtcggttcctgctgtgattaggacttcggctgactgggattccaagagaatcaagaagaaaaagcagaacagcaacaagaacaaatcccttaattctgctgttaatgttggtggaggagtatccattggctgcagcagtaactcagtccagaataataacccttcatcgtcgtcttcttcatcaggaccattatcgttatcatcgagctgtgtggcggttcctgacgtttggtgtggtcctggaattggattaactactgatgctgcttctgttgattgcgtcgtttcaagaagacccgtgtctgggaggggaagaatcgaaagtgacaaagctacgcctagagagagatctgcatgtcctatacgaagaatggtgagcccagaagacaacccttttctggatatagaaagtagcctaggtataccacgctcccaaatagaagtatttgcatctaggcatcatcgacattctcgccatgg

SEQ ID NO: 10561 - DNA, 849 bp, Lycopersicon esculentum
  Predicted polypeptide sequence is orthologous to G2455
gcttttgtaagctaggtcttttcaactctcttcctagctacataacatgatgaacattacacatatttcttgattttgactcatacttttacttctaattcttcgatccgtattttctgacctaaaaagcttataagaaatgtcacttgacatgacatattcctcctcttcctcggaacgtgtttgctatgttcattgcaacttctgcagcacaattcttgcggttagcgttccatgcaacagtatgatgacaatagtgacagtaaggtgtggacactgcgcaaatttgctttctgttaatattgcaccttcccttcagtctctccccattcaagatttacagagacaaaatgagtcaagtattgaagatggaatgagtagaggttatggatcatcatcctcttctacaaattcatttcacagattttctcccattcctactgatcatgatcaacctagatcccctcctattcgcgtaccggagaaaagacaacgtgttccttctgcctacaatagatttatcaaggaggagatccaaaggataaaggcaagcaatcctgatattagccacagagaagcatttagcactgctgccaaaaattgggcacatttccctcatatccattttggactcaagctggatggcaacaaacaaaccaataaattggatcatgctgttgcaggagagggtcctcagaaaacaattggtctctattaattataaataaaataataaataatatgatctagctatattatgatcacaaatatatataaatataatattatataggtgagatgtattatatatattatattaatctctccaaactaataaactgtttttag

SEQ ID NO: 10562 - DNA, 679 bp, Lycopersicon esculentum
  Predicted polypeptide sequence is orthologous to G2456
ccgtcctcgcggtaagtgtaccgtgcacaagtttgttcaaaactgtgacggttcgatgtggacactgcactaatcttttgcctggatggcttttgccttccactaatcatcatcatcatcattttggtcacacttacttctctccttcacacaatcttctggatgaaataagcaatgcaaccccaaatttcttgatgaatcagagtaattctgctcatgaatttgtgcagctgcctgctcgacctggatttgatgatcttcctagaccaccacccgttgttaacagacctcctgagaagagacagcgagtcccttctgcttacaaccgattcatcaaggaagaaatccaacgcataaaagcagggaatcctgatattagccacagagaagccttcagcgccgctgcgaaaaattgggcccactttccacacattcaatttggtctcatgcctgatcagactgttaagaggactaatgtgcgtcagcaggatggagaagatgttcttacgaaagatggtttgtttaatacatcagccaatgttagtgtgtctccttactgatgatgggatgagaatcaaaagtgaacaagttttgagatggatgcagaagctatattagtagctaaatgtctaagtgtctaaccaattaatgtgaactctctagcatggtcaatgtgtga

SEQ ID NO: 10563 - DNA, 706 bp, Lycopersicon esculentum
  Predicted polypeptide sequence is orthologous to G2456
agtagtctcaaatcaggaattagtaaggaatcttatcatgtcgtcttcatctgctgcttttgctccggaccaccacctccaccaccatcacctctctcctccttcaggagaacaactctgttatgtccaatgcaacttttgtgacactgttctcgcggtgagtgttccttgctcaagtttcttcaaaaatgtgacagtaagatgtggtcattgcaccaatcttctctctgtcaacattattcttcccactgctgctaatcagcttcatctcccacattctttcttttcacctcacaatcttctggatgagattcggaataatccaccaagtttgttgatgaatcaacaaattaacccaaatgaatcactcatgccagtccgaggaggagttgatgaaattccaaagccaccagtcgcaaacagacctccggagaagcgacagagagtcccatctgcttacaatcgattcatcaaggacgagatccaacgtatcaaagctggaaatcccgatataagtcacagggaggccttcagtgctgctgcaaagaattgggcccattttccacacattcatttcggacttatgcctgatcaaaccgtgaagaaacaaatgcatgtcaacaggaaaggggaagatgttctgatgaaaggaagttttctgctcagcaaacattggtgtatctccttactgataaggaagtcatgg

SEQ ID NO: 10564 - DNA, 748 bp, Lycopersicon esculentum
  Predicted polypeptide sequence is orthologous to G2457, G2459
attaaccatttcttcttcctttttttctcttcaaataaacaaaaaagataaaatacatcaaaaaatggcaagttgcattgatgttgcttctgatcaactttgctatatcccttgcaacttttgcaatattgttcttgcggtgagtgttccatgcagtagcctatttgatattgtgactgttcgttgtggacattgcacaaatttatggtccgttaatatggcagctgcatttcagtcctcttcttctgcttcgtggcaaaatcatcacgttcaggttccaaactacactgctcctgagtataggatggattttggttcatcaaccaaatgcaacatgaacaggatgtcaatgagaactccaatcacaaacaacgttcacgaggagaggattgttaatcgacctcccgagaagaggcagagagtaccttctgcatataatcagttcataaaagaagaaattcagaggattaaagctaataatccagatatcagtcacagggaagcatttagtactgctgccaaaaattgggcacacttccctcatattcactttggactcatgttggagagcaacaatcaagccaaacttgcttgtgggagcagaaaactataagttactttgcaagacaaataaaagatcttcatttcatgaagctgtgtgtgaacttgaagacaagtgtgacattcaagatgttctatggagtgtggacattctaaactatatattataattatgtctctttttttt

SEQ ID NO: 10565 - DNA, 613 bp, Lycopersicon esculentum
  Predicted polypeptide sequence is orthologous to G2457, G2459
cccctacccaataaatatattttgttctttaaaacccccaaaaaaacattttttttcttttctccatctgaaaaaaaaaaaactccatggattatgttcaatcttctgagcatctttgctacgtccgttgcaatttttgtaacactgttttagcggttggaattccatacaagaggctaatggatactgtgacagtgaaatgtggccattgtagcaatctttcatttttaactactagacctccaattcaaggtcaatgctttgatcatcaacccaatattcagggctattgtagtgaattaaaaaataaggggcaagcttcatcatctacctcatcaacttctagtgaacctttatctccaaaggcaccttttgttgtaaaacctcctgagaagaaacacaggcttccatctgcctacaatcgattcatgaaggaagagatacaacgtatcaaatctgaaaatccagagataccacatagagaagctttcagtgcagctgctaaaaattgggctaggtaccttcctaatccaccaaattctggaaataccaacaatgtttagatgttgaattgaagcaaatattgggactatattataagtatgtaataatg

SEQ ID NO: 10566 - DNA, 542 bp, Lycopersicon esculentum
  Predicted polypeptide sequence is orthologous to G2465
tggaagtggaggagcattgcatccttttaagaaagagaaaaacacggtcgccgccgttgaaacaacgccagctctggctggcgttgtgttggcggcgacaggtagttccaccgcggagaatagcggtggaagtaaaaaagaggataaagatggacaaagaaaacaaaggaggtgttggtctccagagttgcatagaagatttttacatgccttacaacaactaggtggctctcatgttgctacaccaaaacaaattatggagttaatgaaggtggatggacttactaatgatgaagttaagagtcatttacagaaatatcgattacacacgagaagacctagtccttcatcaattcacaacaacaacaaccaacaaccaccacaatttgtggtcgtcggaggaatatgggtcccaccacccgaatacgcctcgatggccgctggtgctccagcggcctcgggcgaagcatcgggagttgccaactcaaatggaatctatgcacctattgccactcatccaaagggtccactccatgatcatg

SEQ ID NO: 10567 - DNA, 1292 bp, Lycopersicon esculentum
  Predicted polypeptide sequence is orthologous to G2520
gtgaatgcctaataattcaccattcgcttcggatttggatcgggtattgaaatggatccacaagcttccatgatgaaccacgccggaggatttcagtctccgccgtttaatttatctgagatctggcagtttccgatcaatgcaggtgaaggtgagacgccgtatagttttccgttgtctacggcggctgcgccgcagaatgtgagtgatgatgttcggaataatgatcctatggttctagaccggagaactaataattacagcggtggcggcggtggtggtgcagctaggaagcgaaacgaggatgatgaatcagctaaaggagtttccactagcggcaatggcttgactgaatctgctagtaagcggatgaaggttacaagatcaaatgagaattgcgaagctagaggtgacggggaagggaattcagtgaaatctgcagaacaacctgcaaagcctgctgaaccgccaaaagattacattcacgtgcgggcaaggaggggtcaagctactgatagtcacagtctagcagaaagagctaggagagagaagataagtgagaggatgaaagtcctccaagatatagtccctggttgtaataaggttattggcaaagctcttgttcttgatgagataataaattatattcaatcattacaacaccaggttgagttcttatcaatgaagcttgaagcagttaattcaaaaatgccaagcatagagggatatccatctaaagatttcggacagcagccatttgatacaaatgctatggcattcagttcacaagctacaagggaatataccaggggaacatcaccagattggttgcatatgcagcttggtggaggctttgaaagaacaacataaatttgcatcagaaggttaataataagttcattggaaggttccctcttttggtgattgccagaacacaagaccagtccaggtttctttgaaagcttatatccagtatctttatcaagcacaaaattgttgaatgtctagtacagctgataaacagacaaccacgttttccacttcgttcgtctatcgtgttatacttgtggcaggcaccatataagtattcttgtgaaagtgcttgtttaataataggtaaagaattgggtgtattagtatgctgaagttgtagctaaataaagtggtctgtcccgtccttaaaaccattggtagatagcatcaagtcttgtaaatagggaaaatcagtgtttctgtgtttcgattgttcaacaagttaagacaatatactttatatcaaaaaaaaaaaaaaa

SEQ ID NO: 10568 - DNA, 637 bp, Lycopersicon esculentum
  misc_feature (517)..(517): n is a, c, g, or t
  Predicted polypeptide sequence is orthologous to G2520
caggcagaatcaagttctcagacggctaacaaggggactgagcaaagtagtaaacctgagccacctaaggattacatccacgtaagggcaagaaggggtcaagctactgatagccacagtctagcagagagggccaggagagaaaagatcagcgagaggatgaaaattctgcaagatttggttcctggatgtaataaggttatcggaaaagcacttgttcttgacgaaataataaattatatccagtcactacagcgtcaagttgagttcttgtccatgaagcttgaagcagtcaattcaaggatgaaccaccctatagaaacctttccttcaaaagatctagcaccatcagcttttgatacgagtggaatgattttcggcactcaagcaccgagagaatatgctcaagggacacaatccgagtggctccatatgcaggttggcaacagctttgacagagcaacatgacagataccctaatgaattggaatatagattattcaggaacattagcctnccacaattattcatcatgtcttttagagaaccttggtactggatccagcagctgtgttccactatagaagaagcattcttaaatgtgtaatcatataatcatttccagtagaattggctg

SEQ ID NO: 10569 - DNA, 667 bp, Lycopersicon esculentum
  Predicted polypeptide sequence is orthologous to G2522
gggtcacctctgttttgcacttttatcctatggtgtctgtttcttataaaaaatagtataaaggtgtgatctttattgagtttgcaaagcaagaaattgatttttattaagtgttcatgactggggttcttgttcttgatgtaatggcattgatttctctgttggggtttggctctttctgttgaatgtacagaaatttagtgttttaagggtttgttttgaatggtaatggatcaggttcagtctctgtttgttctgcatttgtcttcattattttgcatttattgggaggctttgttcttgaaggagctttctgttattattctttgtgccaattgggaagtgaaattcacagctaagtacattcttggattctaaagagattttgaatgtgcataatagagttcccttgagaatttaaagaagttcagtctttttgtgccatgttctaatcaaaggctacaacttttactggttttgatgttgtgaagatcactttccatgtttacgaataaagagttgtgactttgattcccttccttagagatttaaatcattgttcgaaggggatatattggttgcggagttctgtaaaaaaaatgaatgtatggatcgaagggaagctatgatgttacctggatcctctccttactatatgcaaagaggg

SEQ ID NO: 10570 - DNA, 752 bp, Lycopersicon esculentum
  Predicted polypeptide sequence is orthologous to G2550
aggagaaggaaatggaagcaaatcacatataccgtcatccactgtggtttctcccaactcaggtagtgttggaggcaccaccacggactttgcttcccaattagggtttcaaagaccggggttggtgtcaccaacacaagcgcaccatcaaggtctttctctaagcctttctccacaacaacaaatgaatttcgggtctagtcttccactagaccatcgcgaaatttcaacaaccaatcatcaggttggaatactatcatcatcaccaggagtaaataccagtaatatcgatcatactcgaggatcaggggcattatcgtctttttcgatttctaatgggatgatattgggttctaagtacctaaaagttgcacaagatcttcttgatgaagttgttagtgttggaaaaaacatcaaattatcagaggttggtggtgcaaaggagaaacacaaattggagaatgaattaatatctttggctagtgatgatattgaaagtaacacccaaaaaaatagtggtgttgaacttacaacagctcaaagacaagaacttcaaatgaagaaagcaaagcttgttagcatgcttgatgaggtggatcaaaggtatagacaataccatcaccaaatgcaaatgattgcaacatcatttgagcaaacaacgggaattggatcatcaaaatcatacacacaacttgctttgcacacaatttcaaagcaatttagatgtttaaaagatgcaatttctgggcaaa

SEQ ID NO: 10571 - DNA, 1088 bp, Lycopersicon esculentum
  Predicted polypeptide sequence is orthologous to G2552
ggggaaaaataaaaaaaaaatggagagtggtaatgcatcaatggaaaataataatgttaatgatattgggcttattaatttcttggatgaggataattttgaacaattcattgagcttattaggggtgaaactgctgatcctattgtaaatttttgcccaaactatgattgtgaacatatgacaggttgtttttccgcagccaatgcccaatttgagccaatattatcgtcgatggatttctatgatacaacattgccagatcctatttcgctatataactgcgaaatcaagctggataataatgatgatgaagacgatgatgaatcttctggcacaacggctaccaccaaaatgactccaacaagcaaaggcacgaggactgaccggtccagaactttgatttcggagcgcaaaaggagaggaagaatgaaggaaaagctttacgctttgcgatccttagttcctaatatcacaaagatggataaagcctccatcattggagatgcaatattatacgtacaaggactacaaaccaaagcaaagaaacttaaagttgaaatagcagagtttgagtcatcaagtggaatatttcaaaatgcaaagaaaatgaatttcacaacctattatccagcaatcaagaggataacaaagatggacattaatcaagtagaagaaaaaggattttacgtgagattaatttgcaacaaagggcgacacattgcagcttctcttttcaaagctcttgagtctctcaatggattcaatgttcaaacttccaacttggctacttctaccaatgattacattttcaccttcactctttatgtgagagaatgtcatgaggtggacataaactttggcaatttgaagctatggatagctagtgcttttcttaatcaagggtttgacttcgagacatctccgttggtctaatatcatgttattattgtaactttctaaaatactgaactatatttaatttgtattatcatttagtacattatccaaactaaacgggacttttacttaatgaagagaaaacttgttttgattttaaaaaaaaaaaaaaaaaaaaaaaaaaaaaaaa

SEQ ID NO: 10572 - DNA, 998 bp, Lycopersicon esculentum
  Predicted polypeptide sequence is orthologous to G2559
ccaaaatagtccctctttctctcttgttttctatggtccaatttatatatagtatgtccaatcaattagggtgacagttaccttcctccaactactgaaatatcttctttttttccaagaattctctgttttcttgattctgtttgtagccatggcagaattggaagctaagaaagtagaaattgtggaccctgcccctgcacaagaaccagttgaagctcctaaagaagtggtggctgatgagaaagccatagttgaaccagctccgcctcctcctgcagaagaaaaagaaaaacccgatgactcgaaagcactagttgttgtcgaaaataaagcagaagaagctgctgatgagaaaaaagagggatctattgatagagatgctgtgcttgcacgcgttgcaactgagaagaggctatcactcatcaaagcatgggaagaaagtgagaaatcaaaagccgaaaacaaagctcagaagaaggtgtctgcaattggtgcatgggagaacagcaagaaagcaaacctagagtctgagctcaaaaagatggaggaacagttggagaaaaagaaggcaatatatactgagaaaatgaaaaacaaaattgctctactccacaaggaagcagaagaaaagagagcgatgattgaagctaaacgtggagaagatcttctcaaggcagaggagcttgcagcaaaataccgcgccactggaactgctccaaagaaaatccttggaatattttgaagcagcaagtaccaggtctgcatcgatactgattgggagttgcattttgtaaagtttgtgcaattggattttttcttcttgttagattacatttgtgtgattatatattttagaaccatttattgtttattgttacgtgtgcatagtaatgtatttccagtgtatatagcatctggacaaaattaactttgtgggattgttatggaaaaaaatatgttgaaggaaatcttcatgttaaaaaaaaaaaaaaaaa

SEQ ID NO: 10573 - DNA, 785 bp, Lycopersicon esculentum
  Predicted polypeptide sequence is orthologous to G2559
atcggccgaattgagatattatacaactcatttccattttgcttttttgttcattgattccttcttctttcactatatacatacatttaatttcaacaataacaatggcagaagctactgcagttgcagctcaacctcaaccagaatcaacaactcctcctcccatggccaaatctgatgactctaaagctattgctactcttcccccaacaaagcctgactcttcaacaaagaaaagttcaaagggatccttcgacagagatgttgctctcgcacaccttgaagaagagaaaaggaattcctatatcaaggcatgggaagaaagtgagaaaagcaaggtgaataacaaggccgagaagaagctctcgtcagttggaacatgggagaacaccaagaaagcaaatattgaagctaaactgaagaaacttgaggaacaactagagcaaaagaaggcagaatatgcagagaagattaaaaataaagtagctgcagttcacatggaggcagaggaaaagagagctatggttgaagcgagacgaggagaagaacttcttaaagcagaggagatagctgccaagtatcgtgctacgggacaagcccctaagaagattggatgccttggatgttaaagccatgaaatgtatcattctcttttgtgaattttcatgcttgttgctctttattcggtgtttcaaacatatcaagtttttctagttcgtgtaagaaaagcactcatgaaaagtttcaagtgtcatgaagtttctactaatacttcatactgtatc

SEQ ID NO: 10574 - DNA, 774 bp, Lycopersicon esculentum
  Predicted polypeptide sequence is orthologous to G2565
tgaaactgttgtgttaatcttaaagtctttattaattcaatttatggggaaaaatgaacacgcgccgtgcattaggtattcaaagatctagtgaaacacagcacagtaatatgggtgtctgtggagctatgtcgacatctttgtccattttgccgtcatttgaagagaagcatcttaaagtgacagattctcttcatgtgctcacagaaaaggaacaaaccacaaaccttatttcctcacgggcaatcccgtctgcatctaaaagtggaacagtagggcatctgttatcttccacttctggaccccacaaacattttcacttttcttcaaccccctctcgagaaagtaggaaacataactatccatttatttctagtgaagcttctgcagcaacctgccaatcttcactctcaaacattcattcgacatcattggataattaccccatggagaacagcaataattcctggggcgaagatgcatatcatgactgtataaatttttctactaatgttcctgttcagaatgaccaagtcgaaagccttgcagtagtcatgacgtctgatgaccaggttaagagatctgattggcaggactgggctgatcagctaattaatgatgatgatgttttggattcgagctggagcaatattcttgttgatatcaatcctccagacactaagtttctgagagcatctgaagtccatgctggccagtccgatactcttcctcctccctcttctgctgctgctgcatcgtctgggcaaaactacc

SEQ ID NO: 10575 - DNA, 762 bp, Lycopersicon esculentum
  Predicted polypeptide sequence is orthologous to G2565
caccgttcaaattgtttcgatttcgccggcgatgaaatgaaatctcccgaaatcggcaacaacgagttagctgtttgtgcatacaggaatcaatcttggacactggttactaagaaattagaagatactaattgaggagaatatagtagtgtattgtactcatccacaaagttcaaatggaagcacgtcctgctgtgtctgttcaaagtgtggttgcaagtcaactcagtaattgtggtgcatcaggggcactttcttcttccctgtctatatttccaacagcccttggagaaaagtaccctaagtttcctgacttgcagcaggcttcgatgggaaaggagctcaagcaacatcctgcaactgttgtctcttctttgccttccaacagtggggctgttggtcttatgttctcatcatcatcaggattttccgccgatcttcagttctcatctgtttcaccccaggaaaagcattcaggaactgcacctttcatttctcagtcaacatatagtgagacatcgatccaattacctcattcgggagttcttcagtccacagcatcaagccaatatttgaatgaaaaccatgaaccctggtgtatagatccactgcctaatttccttgattattcgatggataaccctgtccagaatagtcaggtagcttctagcaataaacaaagcgattggcaggagtgggccgaccttgtactcaatgatgaagatgctctaccttctgattggaatgaattattgctgatac

SEQ ID NO: 10576 - DNA, 438 bp, Lycopersicon esculentum
  Predicted polypeptide sequence is orthologous to G2567
tttagcgacttcctgtaaacagcgcgaaggttaacaattctaactgattccagcagtgacaatgtaggaatcagggaatagagagaacaagtaaatctccactttccttttttcgaactgatgttcgagtgctttgttcttaacatttcaactctttcggacatgctgatgatggcgatgctcagtttacctagttcacgagtggaaaagtttgcgttttgcatcaacggtatatttactagtagttttcactttccttgggatcgttttcgagtttttgtttcaagacaatacctacaaagaacaagatagaacttgttttttgtaggctttgtctgctaattctagtactccatttgttagttaaaggccttctaagaaggcttaaaagacttgttctagtttttgttttctatatatctaatcagtatatagttc

SEQ ID NO: 10577 - DNA, 1781 bp, Lycopersicon esculentum
  Predicted polypeptide sequence is orthologous to G2592, G2713
gtacaaaattcccataaaaaaattggttcttgtaaaggtgaattaggttgcattgggtgttgtatagtttattatctgttgaggtttaggtggtagcatgtcctttaagagtatgattcaggacatgaaggatgagtttgggagcatttctcggaaaggatttcgctccaggtcacatagggtggttcaggattgtaccgtgactatcgatgcgttgaggcaaagttgttgggccaacatgccgcctgagctattgagagatgtgctgatgaggattgaggagtcggactctgattggcgtccaaggaaaaatgttgtggcgtgcgctggtgtttgcaggagttggagggaaatcatgaaagagattgttaaaacacctgaagttagcggaaaattgacgttcccaatctccttgaagcagcctggtccaagagacaaacttgttcaatgtttcatcagaaggaaccgcagctcacagacatatcaccttttccttaatttaaatgaagttgctaacgatgacggtaagttccttcttgctgctcggaagtgtaaaaggccaacatacacagattacatcatttctttaaatgccgaagttgcttccaggggtagcagcacctacattgggaagctgagatccaacttcttggggaccaagttcactgtctatgatgcacaaccatctaatgcaggagctaaagtcagtaaatgtcgctctactaggtttgttgggatgaaacaagtctctccaagaatacccactggcaactatcctgtagctcacatctcgtatgagttgaatgtcctgggggctagggggcccaggaggatgctgtgtatcatggacgcaattccagcttcttctattgaacctgggggtttagcccctacgcaaacagaatttgttccagtgaatgtagattccttcccctccctccacttttttagatcaaaatcaactcgcgtggataatttctcatccgggcctttaccaagtccaaaagatgaagttctaactttgaagaacaaagctcctaggtggcatgaacaactccaatgctggtgtcttaacttcaatggccgggtgaaagtcgcttctgtaaaaaactttcagctagttgcttctcttggggatggagctggacaggaaaatgagaatgttattctccaatttgggaaagtgggagaggatttgttcaccatggactatcagtatcctatctctgcatttcaggcatttgctatctgcctcagtagctttgacaccaaaatcgcctgcgaatgatgagataaacaggtgcttctgctgtaaccttctcctcgaaaaaaaacatcatttgatgtatgtacaatctctcacatcatttgatgtatgtacaatctctcatttctgtaatgatcggtagactgaatcgtgcaggttctgcaagaagtactgaggtgtttggattgggagattgcactaaccctatttacgttggttactgaactaacgctcagttaaattgcagtaggtatgtttgttgttgaggattaatcacccgttcttcatgctctcggaccttccgtttcttggttttttgtaaatagacaaggatgtttttacagtttggttcatccaacttttctatttctattagcacaatgttcatccaacttttctatttctattagcacaatgttgaactgtaatacatatatctcctgtgtgagatgtacttaaatttctgaagttttatgttctttctcatatagttgagagcaaaaaaaaaaaaaaa

SEQ ID NO: 10578 - DNA, 952 bp, Lycopersicon esculentum
  Predicted polypeptide sequence is orthologous to G2592, G2713
catttcatgacttgagtgaccagcctcctgtcaaccagaacagttgttgggctaatctcccacctgaactactttttgatgtaattagaagattagaagagagtgagaactcatggcctgcccgtaagcatgtcgtatcatgtgcttcagtttgcaggtcatggaggattatgtgtcaggaaattgttagaagtcctgaagtttgtggaaagcttacatttccagtatcgttaaagcagcctgggcctcgtgacggaatgattcaatgtttcatcaagagggataaatctaatttgacttaccatcttttcttgtgtctcagtcctgctttactagttgaaaatgggaaattccttctctctgcaaagagaacaaggcggactacttgtacggagtatgttatctcaatggatgcagaaaacatctcaagatcaagcaacacttacattggaaaattaaggtcaaattttctgggtacaaaattcgttatatatgacacacagcctccatacacctttgcaaacgttccgcctccaggccgcacaagccgcagattctattccaagaaagtctctccgaaagttccaactggaagctacagcatagcccaaatcaaatacgagctaaatgttcttggaacacggggtccacggaaaatgcactgcgtaatgcactcgattcctgcctcagcagttgatgtgggtgggtcagtgcctggccaaccggaacttctcccaaggtcccttgaggattctattccaagaaagtctctccgaaagttccaactggaagctacagcatagcccaaatcaaatacgagctaaatgttcttggaacacggggtccacggaaaatgcactgcgtaatgcactcagtagctcacggtttctgatattgttagagcatcatccagtgcagaagatgatagtaagtgaaacccttggttctagga

SEQ ID NO: 10579 - DNA, 799 bp, Lycopersicon esculentum
  Predicted polypeptide sequence is orthologous to G2592, G2713
atcggccgaattggtttcttgactctgacccactttacctttttttgatctacttatctatgaaattcttggttacttgatgaggctgttcttgttcttgtttttgttttaaggattctaaaagaagttatggagctttgattgtcctatatgcagctgtaactatttgtcaagctttctttaaaatactgggagcttgtatggtatgaagagtaaataggccagtaacatttaatagtggtgcttggcctttgacctttcagtttcaagttcaaatgtcgttccgcagtatagttcgtgatgtaagagatagtattggtagcttatcaaggcgaagctttgatttaaggctgtctggtcatcctagggacaaatcacatggttcattttatgacttaagtgaccagcctcccgttatccaagatagttgttgggccaatcttcctccagagctactttttgatgtagttagaaggttagaggagagtgagagcacatggcccggtcgtaagcatgtcgtagcatgtgccgcagtctgtaggtcatggaggagtatgtgcaaagacatcgttagaaatccggaattttgtggaaagctaacttttcctgtttccctaaagcagcctgggcctcgtgatggaactattcagtgcttcatcaagcgggataaatctaatttgacttaccatcttttcttgtgtcttagtcctgcattgttggttgagaatgggaagttccttctctctgcaaaaagaacgagacgtactacttgcacagagtatgttatctcaatggatgc

SEQ ID NO: 10580 - DNA, 583 bp, Lycopersicon esculentum
  Predicted polypeptide sequence is orthologous to G2592, G2713
agagagagaaacaacaacaacatagttgtacagaaactcagaaaaagaacaagatttaatttttacggtatatttaatgtgcacggttgtcggggattcaaatctgtcactccaaaagattcacatatagaaagtagcctgtgaaacgttgctctggtccagtaaatgtcttttcgcagtatagctcgtgatatcagggatagtattggaagcttatccaggcggagttttgaagttaagctgtccagtcataacagagggaagtctcagagtgctgttcatgagttgcatgaccatgctatcgtcattcaaagcagttgttgggcaagcctcccaccagagttgcttcgtgatgtaattaaaagattggaggcaagtgagagtacgtggcctgctcgtaaacatgttgtggcatgtgcagctgtttgccgctcatggagggagatgtgccaagaaattgttcagcgtccggagttctctggaaaattgacctttccaatctctcttaagcagcctgggtttcgggatggaaccatccaatgcttcatccggagggacaaatctaaattaacttaccaacttt

SEQ ID NO: 10581 - DNA, 562 bp, Lycopersicon esculentum
  misc_feature (546)..(546): n is a, c, g, or t
  Predicted polypeptide sequence is orthologous to G2592, G2713
caagtttcttctttctgctaagcgtaatcggagaaccacatgtacagagtacatcatctctatgaatgcagataacatatcaaggtcaaacagctcttacattggaaaactgaggtcaaattttctgggcacaaagttcataatttatgatacccagccaccatacaacagttctagtattcccccacctggtggaagccggagattctactccaagaaagtttctcccaaagtccctacaggaacctacaacattgcacaggttagctacgaactgaatgtactcggaaccagggggcctcgcaggatgaattgtgtcatgcactcaatccctgtctcgtcccttgaacccgggggcactgtcccaggccaacctgaacttctccctcccaatcttgaagactcatttaggagcatgtctttttcaaaatcaattgatgcttcaacagaattcaatagtgctcggttttcagatattgggggtccaagtgaagtagatgaagaaggtaagagtagtcttttggtccttcgaaacaaggcacccangtggcatgaacagctg

SEQ ID NO: 10582 - DNA, 447 bp, Lycopersicon esculentum
  Predicted polypeptide sequence is orthologous to G2592, G2713
aagagctatgacgtcgcatgcacgcgtacgtaagcttggatcctctagagcggccgccctttttttttttttttttttttttagtagatttgcttcactgaccaagaaacacttttaggtttcagaagcaacattgtcttgtctcacgaaacaatacaatacttgaatcaaacacctacttcttaaattatttacatgccaaggctcagaatgcttatcactttggaacacataaaacgaacgactctctcaccgttcgttcgttcattcattcattcattcattcattcacaggccagcttggtgtcgaagctcgtcagacatatggcgaaggcctggaaggccgacagcgggtaccggtagtccatggtgaacatgtccctcccgaccttgccgaactgcaggatcaccgggtcatggtacgacgacgacgacggcggcggcggc

SEQ ID NO: 10583 - DNA, 783 bp, Lycopersicon esculentum
  Predicted polypeptide sequence is orthologous to G2592, G2713
acacactccttcagtgctttataaagagaaaccagacaacacaggcatatcatctatacctcagtttgactcaagcattagctgatgatgggaagtttcttcttgctgctcggaagtacaggaaggccacctgcactgactacactatatcattggatgcaaatgaaacgtcaaagggaggtggcacttgtatcgggagattaagatcaaatttccttggaaccaagtttactgcatatgattctattcttccttatgctggagccaagctggtgaagagccgttccactaggcttgtgggctcaaaacaaatgaattctagagtgcctgctggaaattatgaagttgctcatatttcatatgagttgaatgtacttggagccagggggccaagaagaatgcattgtgtgatggatgctatcccagcttctgccattaaacctggaggtatagctcccacacaggttgattttccaatgggcaatagtggttcctctcttccgatgcgatttcttcgatccaaatcaagtcgcttggagaagtctttgtctgggcctatagaaactcaaagagaaggttcactggttctgaaaaataaggctcccagatggcatgaacagctccaatgctggtgtttgaactttcatggtcgggtaaccgtcgcctcggtgaagaactttcagttggtagcttctccagagaatggtgcggctggaccagaacatgagaaagggtattttgcatttcggtaagtagggaaggacatggtttacatggattacc

SEQ ID NO: 10584 - DNA, 815 bp, Lycopersicon esculentum
  Predicted polypeptide sequence is orthologous to G2604
atcggccgaattgaccccaacccccacgctccctctctctttacatctgcatatgtaaaggtctgtgtctgcctcactcctaatgcttgactaagctcctcttatgtttcaaatgctcagaggatgaaccagtaacaatcatgagacagtaaagatggaagcagctgctctgttagaagtttttgaagcactaggcttttgagatctcaggagaggactacctctgttagcttcacaatgccagttccgcttgctccatatcctacaccaccaacaccatttacaccaccttctaacggtacgcagagccagcttgtgtgctctggatgcagaaatcttttactctatccagttggagcaacatctgtttgctgtgcagtttgcaatgcagtaacagcagtaccacctccgggcactgagatggctcagttggtttgcggaggctgccacacattacttatgtacattcgtggagcaacaagcgtgcaatgttcgtgctgtcacacagtcaatttagctatggaagcaaatcaggtagcacatgtgaattgtggcaactgccacatgctgctgatgtaccaatacggggcacgatcagtgaaatgtgcagtttgcaattttgtgacatcggtaggggttgcaacgagcacagctgagcaaaagtttaacagctaactttaaagctgctgagccagtgctagaaacttctacaactaaagttgtcgtgttatgtgtcagcggcatttcagctgcatcaactggaggaaatttctagttgctactagtatagagctattacagagctttttttccct

SEQ ID NO: 10585 - DNA, 763 bp, Lycopersicon esculentum
  Predicted polypeptide sequence is orthologous to G2633
agtattttcttcaccactagtggcttactaaaaatggaatatgcgttgtctaaagttaagctttttttctctgattatttcattaaccatgttcttcaatctttttgcttaagatttcttctctgagtatcaggatagttggatctttgaaatgtgttatggatgtgaatgttaaagcttggagctggtgaactttttgtaacgaggcggggtgtatgctggaaatgtttctgttgtcttctggatatctatgatgtgctaaacggttagataatatttcacgatgaggccttctcagaaccctgaggaaatcaacgagttcaacaaattctataaccaacccatagagtatcaagaatcctatttcctgccttccgttaacaatccgaacaacaaccaatcgttctatgctgatgtctctgccttaaaacccgcccaacactgttatgttgaatcatccgcgggaaattctagtgaacttgtttctgattcacctcctattgttaatttcaaccccatgatgaaccaaggttctgattcgtgtcgttcagacatgcatcattctcctgatgatacatttcagtcgtcgggtaacagttcgtgctacactagtgatgttactgacctgaagcacaagttaagggaacttgaaactgcaatgctggggccagattcagaaagcttggaatcatttaataatactatccctgtgactgcagccaaatcagttccatcagagtcggataaattggtggaatgatgg

SEQ ID NO: 10586 - DNA, 696 bp, Lycopersicon esculentum
  Predicted polypeptide sequence is orthologous to G2649
cagtcaacaacttgtcaagattgtggtaatcaagcaaaaaaagattgtacacatagaagatgtagaacttgttgtaagagtagaggttatgattgtaacacacatgtaaagagtacttgggtaccagcttcaagaaggcgtgagaggcaactaatgggtgcatcaacaacaacaacaacaacaaatagaaatgttgtagcagctggatcttcttcccaatcaacatcaagtgctaagaaacctagacttgtcaattctcaaacaactacaacagcttcacatacttctacttcaaataatacacctccaagaagttttgacactagctctagtcatcaagatgcaagttttaaaggttcattgccaggacaagtaagggcaccagctgtattcaagtgtgtaagagtgacttcagtagacgaaggtgaagatgaatatgcatatcaagctgttgtcaaaattggtggacatgttttcaaaggtttcttatatgatcaaggtcttgatgaaccaaaagataataataattttccaaatttatctgatttacatttgggtgctgttgctaccaatgaacatctttatgctgcttctactagtggtgggggaggattacttggtggaggatcaaattatggtaatcaaataaattgatgatgaccactatttgtgtaacttaattaaattgttgatttt

SEQ ID NO: 10587 - DNA, 638 bp, Lycopersicon esculentum
  Predicted polypeptide sequence is orthologous to G2655
tttcccttttagtcaatttcaaaagaaaacttctgaggctatactcttagacttcatcgatcgataatggctctagaagctataacgcaacaacaacaatatctttatgctttactcggaactacaaattggagtattgattctggctctgattattacaacaataatgaatttgttccgaatcatcaaaatgtaacagcacctcaagagtacgaggactactcaaattggaatttgccagctccattattagtagattcccaaaatgaatttcatcaatggggtcaaaattgttcctctgttttagatcataattttacaattgtggatcaacaggaacagttggagtctccaatcgaaatgtctagtagtacaactagaccacgaagaagaagaacaagaacaaagaagaatgacgaagagattgagaatcaacgaattacacacattgctgttgaacgaaatcgtcgaaaacagatgaatgactacctctctgttctccgtactctcatgcctgaatcttatgtccaaaggggtgatcaagcatcaattgttagtggtgcaattaactatgtgaaagagctagagcaacaacttcaattccttagtggtaagaagcatttgacaagtcaaaatca

SEQ ID NO: 10588 - DNA, 722 bp, Lycopersicon esculentum
  Predicted polypeptide sequence is orthologous to G2699
catgcacgtacataaaacaaaaccttacatatttttttaattccttatatataatacttagtcatacatcactccatcatgaaaaaggaaatcctatttcagtaagacttgatctgatcaatcgtatagtttagattcaagttggtcgttgcttccattttattgtgtttatcattatacatagtagagtcaagtttcaatgaactctacaaccattcccctccaaaaccctagttttttcaacaactctcaaagttctctagcaggagcactacaaggatgcattgggagccttgatggagcatgtttggagaaactattacttcattgtgcaagtgccttagagaacaatgatgtaactttggctcaacaagtcatgtgggtgctcaacaatttggcttcttctaatggagatccaaatcaaagactcacatcatggttccttagggcattaatttcaagggcttctagggtttatcctaatgccacaaatttacatggaagtagtaaccttgaaaggagattaatgagtgtgactgagctagcagggtatgtggatctcatcccatggcatagatttggattttgtgcatcaaatagtgttatttataaggccattgaaaggcaaacaaaagttcacatattagattttagtatcactcattgtatgcaatggccaactctcattgatgcaattgctaagaggcctgagggtcctcctt

SEQ ID NO: 10589 - DNA, 1317 bp, Lycopersicon esculentum
  Predicted polypeptide sequence is orthologous to G2717
aggacggactaacgccacgaagtcgatacaatcgaggactgcttgcaaatttcgcagaagatgacaatggcgtaaattctgttcaccggcgagttactttgtcaccttcacagactctgcgccggcactttcttccgataggagagctcaacttctgtgttcagtgctagaaagttgtcaacttattaatgggtgcacctaagcagaagtggacatcagaagaagaagctgcccttaaagctggtgtagcgaagtatggggttggcaaatggagcaccattcttaaagatccagagtttgctgttgtgttgcgctctcgctcaaatgtggacttgaaggataaatggaggaatctacatgtcatggcaagtggatggggatctcggcatcgggggaagattgtgtctaaaagtgctcagcctacaccgaagcacgatgacagcaccttggttagctatgtgagtgagaatgatagagatattcctgatgttaaacctcttgcatcgactggtgatgaactgaaggatgttggctcaaaaagaccactttcaagattagatgatcttatactggagtcaatagccaaattgaaggaatcacgtggatctagtcggaatgcaatttcttcttacatagaggagcggtacgtagcacctctaaactttgaaaggctgttggcagcaaatttgaaggtgttgactgaaaaaggaagactgataaaggtaaagcatcactacaggattgcaccgaatagagcatcatctgatggcaagggaggccctttctctttgcctatgggcggaaagcttgattccactatggtagaaaagaatgaaactagagtactgactaaagaacagattgatgcggacttagagcaaatgaagagcatgagtgcagaggaggctgctgcagccgcagctcaagcagttgcagaggctgaagttgccattgctgaggcagaacaggcagcaaggattgcagaggagtatgaagcggaagcagaggcagcacagtgctttgctgaagtagcatcaaaggcactacagcatcagactatccttgtctgatgggactatctggatccaccgctagggttttcatcttcagtacagttggcaatttattgttgatatgtggatagagctgtaaatgtggagatttctttcattgctactgatctttaaatatagcattgtggtgataatgaagtttataggcaagtggagttcagttgccctcttttcggtggttgacaagcgatttgtatatcctataaaaaactgtaccttttccctctctaaaaaaaaaaaaaaa

SEQ ID NO: 10590 - DNA, 762 bp, Lycopersicon esculentum
  Predicted polypeptide sequence is orthologous to G2717
gctagaatctcgctatacgaatactcaatcgatttatgttcatgtactgctattttgttaattgtccgtttcaatatacaattgtgatcaacaggttgttctgaagtttcctccctcagtttttgatgggtgcacctaagcaaaagtggacttcagaagaagaagctgcccttaaagctgggatacttaagcatggaccaggtaaatggcgaacgattctcaaggatccagaatttagtggagtattgtgtttgcgttcaaatgtagatctcaaggacaagtggaggaacatgactgtaatggcaaatggctggggttctcgagagcaagcaagattggctgtcaaaaagatgagacaggcccctaagcaggatgggagtcctttgactgatactactgctgctgatagtgatgaggaagcagctgaaacaaggactgtcacaacttctagtggttctcctcagacacatggttcaaaacgatctatgataaggttggataatcttataatggaggctataaacaccttgaaggagcccaggtggttccaacaagatcacaatagctgaatacatagaggaccagtactgggcacctccaaattttaaaaggctactgtccgggaaactgaagtatttaactgcaacagggaaacttatcaagataaagcgtaggtatagaatagtacctatgtcaacaccatctgacagtagaagaaacctgtcccttccacttttggacagcagccagaggatctttccc

SEQ ID NO: 10591 - DNA, 693 bp, Lycopersicon esculentum
  Predicted polypeptide sequence is orthologous to G2766
gaaaaacatcagttcatcctcccacaagtaataaaaatgcagttttcatcaatttttgtgtgagttacacacgagaaacatgattgagtatgccaacatggattattttgtctattttattttacatacttctgcagaaagaaaagaaacacatacacagaatgtagttgtaaggttgttaaggggaaaaatgtaaaggaagtatatctatcgccgtttacatgttgaaaacacagatgtcaaacggtgaaggtttatgtgttttctgatagtgaccttcaagttcatattagctgagtttccccgtcatcgagcccattgacaatgtcattgctaatctgcttggatcgtttgctaggtgtgacagagaacattatagagttgttatcttcccaagaacccatcgcgaaactacttgcactggcataagaatgtgttgactttctgtggccattggctatactggtcccttcaatatcctcattttcctctgctatttgagaaagagcttcttgcgttgtgaagctgagctgagagttcagccttgttattccccggccactatctccaccgccttttgggttatagcttcctctccccattgaaacagtatcacctgcagcagtagcaagttgattaaggaacctcgccggtgagctactatgtcgaaccaacggcgtcgttgaagtcgtc

SEQ ID NO: 10592 - DNA, 2433 bp, Lycopersicon esculentum
  Predicted polypeptide sequence is orthologous to G2777
gatagagaaaagtagagagagatttctctgctctatgagacccattttctgtttttctttttcctgggtgtttgatgcatattgaagcaattgagaaaacggtagaatatttgtatacatattattagtgaattcggtttagacaagacgacgaggccctaccagcaatatctttcgaaaatcactgtttggatcacttccttcttacgtttggggaactgtgggagctatttttttcatttctttcggaagaattctcatctgaattatgcattattcatcgttaaatctcatctaaactgaatttacttacaacaattggaggaagtgaattgccattagaggcgaataatttgaagttagttttacagaagatttgccagttgttaatgcgcctccaattttcgttggaggcggatctgcactttaaagagatttggatacagaattttccagatttacgcaacgacttaatcagcgaaattcggttgaattgtgtgtaattacttgatctggcgaatacacaattcaagtgtgtggatggagctgcctcagcccagaccttttggaacagaagggaggaagacgactcatgactttctttcactgtattcacctgttcaacaagatccaagacctccccaagcaggtggctacctgaagactcatgacttcttgcaaccactggagcaagcagagaagacattaagggaagaagaaaccaatgttgaagtagcaactgtggagaagcctccgccaccagtagctgctactccttcaggggagcatattcttcctggtggcataggcaccttcagtatttcttatttgcaccaaaggataccaaaaccagaggcaagcttgttctctgtagcacaagcaagtagtaccgacagaaatgatgaaaattcaaactgtagttctttcacagggagtggtttcacactgtgggatgaatctgcagtcaagaagggaaagacagggaaggagaattctgggggtgatcgacacgtcctaagagaaggaggtgtgaacactggaggtgttcagccaacgacatcattagagtggcagtcacaatcatcttcaaatcataagcacaacactacggccttaagttcgctctcatctgctcatcaatcatcgccccttaagagccaaagtttcttgcatatgataacatcagcaaagagtgcacaagatgacgatgatgatgatgaagattttgtgattaagaaagaaccacagtcgcaccttagaggtagtttatctgtaaaggttgatggaaaaggcaacgatcaaaagccaagcaccccacgttcaaaacattcagcaacagagcaacggagaagaagcaagatcaatgacagatttcagatgttgaggggaatcatccctaatagtgatcagaaaagagataaagcgtctttcttactggaggttattgaatatattcattttctacaagagaaagtgcacaagtatgaggaatcataccaaggctgggacaatgaacctccgaagttgccattgagcaagtgccataggacgactcatggcgttagcaatcttcctcaacgcattatcaatgcatccagtgcttcactgacgtatgctggaaagtttgatgagagcataatggggatttcttctgctaatcctatcaatgtgcaaaaactggaaccaaacataagcagcacaggtttaaaagataaaggtcagcagcctggtttaacaaataagccgacaacagttcctatgcacccaaacacgttttcattttctgggactagtagcacggcagcgctttattcatcaaagctgatagctgatactgataagttggagtcaaagtctcattctcaattttcacttagcagatcgcatatgactgattatgctattccaaatgctaatccagaaaggctggagctgcctatagaaagtggtaccatcagcatctctagtgcctattctcaagggctattgaacaccttgacacaagcgctgcatagttctggagtagatttgacccaagccaatatctctgtgcaaattgatcttggaaagagagcaaatgggagagtaaattcatcagcttccactgttaagggtgacaacgtttcaacaagcaatcaaccaattccaaaatctagagttacaaccacaagggaggagcctgatcacgccttcaaaaggcggaaaacaagctaatgctaatttgaaacactagtgttctttcttcttttttttccattggttaaatttaattgttttcctctttcccttccccttctcaaccaatatcgatgtccacacctgatacagaaaatctcccaaatgagagatcacaagccactgtatatgtaatgaactagtactactactatttttctgccccttcaaattgttgggctgaaaaaaaaaaaaaaa

SEQ ID NO: 10593 - DNA, 552 bp, Lycopersicon esculentum
  Predicted polypeptide sequence is orthologous to G2777
ggagaatcagagtttcatacatatgataacatcggctaagaatgcacaggaagatgatgatgacgacgaagaagaatttgttgttaagaaagagtcaccttcaccatccagaggtttgtcttgcataagtctgacagttgcgtttctcagtactctgaatctgtcatttataacagaaggacagctacttgtataggcaatttatcagtaaaagtcgatgggaaaagcagtgatcagaagccaaatactccacgctcgaagcactcagcaacagagcaaagaagaagaagcaagatcaatgacagatttctgaagttgagagagatcatccctcacagtgaccagaagagagataaagcatcattcttgctggaggttatcgaatatattcaattcctacaagagaaagtgcacaaatatgagggatcctaccaaagtttggatagtcaaccttcaacattaccttggggcctgtcactgaacagacacaagagccaaacagaacttgcagtgtgaaagaaagcagttttctgtctgaattgacaaacaggg

SEQ ID NO: 10594 - DNA, 685 bp, Lycopersicon esculentum
  Predicted polypeptide sequence is orthologous to G2783
tctctcacatcatccacatattttcctctagggtttcaacacgatgcaaccggcggcaagttcaatggttccaccaccaatggcggcgcaaccacagtaccaacagcagtggatggctcagcagccgcagtaccaggttctgccaccgcaggccggttattattaccaaccaccaccgcagcagggtggcggagtacccccaccgcagcagcaacaacaacaatctcagtacacggcttcagctcagccgaccagtgctgatgaagtccggacgctttggattggagatctacagttttggatggatgagcagtacctatatagttgcttcgcgcaaactggagaggtggtttccgctaaagttatccgcaacaagcaaactcagcaatcagagggttatggctttattgagtttaatagtcatgctgctgcagaaaggaatctacaagcatacaatggcaccttgatgcctaatattgagcaaaattttaggctcaactgggcatcacttggttcgggtgaaaagcgttcagataacacccctgaatatacaatatttgttggagacttggcagctgatgtcacagattacatgcttcaggagacattcagacccaattatccttcaatcaagggtgctaaggttgtaacagatagggcaaccgggcacacaaagggttatggg

SEQ ID NO: 10595 - DNA, 725 bp, Lycopersicon esculentum
  Predicted polypeptide sequence is orthologous to G2783
tatctctccacttgtttctatcacaccggcgagcttgtttctgctaaggtcatcaggaacaagcaaagtggccagtctgaaggttatggattcctcgaattcaggagtcatgcggctgcagaaactgttttacaaacatataatggcgccttgatgccaaatgtggaacagaatttccgtatgaactgggcatctcttggtgccggtgagaggcgagatgattcacccgagtacacaatatttgttggtgatttggctgctgatgtgacggattatgtgctacaagagacattcaaacccgtgtattcatcagtaaaaggtgcaaaagttgtaacagatagaattactggacgtaccaagggatatggatttgtcaagttctctgatgagagtgaaacaattgcgtgctatgactgaaatgaatggtgtactttgttcatctaggcccatgaggattggcccggctgcaaacaagaaaccaatgggtaccccccagaaagctacctaccaaaatcctcaagctactcaaggcgaaagtgaccccaataatacaactatattttgttggtggtttggatcccagtgttgcagaagagcatttgcgacaagttttctccccatatggtgaattggttcacgtgaagatagtggctggaaagcgctgtggctttgttcagtttggtagtagagcttctgctgagcaggctttgtcaagcttgaatggc

SEQ ID NO: 10596 - DNA, 498 bp, Lycopersicon esculentum
  Predicted polypeptide sequence is orthologous to G2834
caatagttagaaagaagaaccattggctgaccttcaatctggaagcatattcagatatggatcctgacgacagtctaagtgaagatccttggataaagtcttcttcgtctggcaacgaattgctgaaaattatgccctcagataaccattcatttaccaatttaaatctgcatgagcagaagtgggaaggttcctcttatttggatcaagaaatcaggattgagcaacagtttactggatttgctaaaccaaaacacacatctgagatggatcaacaggggaatcaaaatcatgatacgaccagaatacatgactgggatccaagagctttgctaaacaacctttcgtttctcgaacaaaagattcatcagctccaggagctggtgcatttgattgttgggcggagaggtcaagatgaggctcacggaaatgaccttatagttcagcaacaacagctaatcacagctgatcttacttgtattatagtccaattgatat

SEQ ID NO: 10597 - DNA, 654 bp, Lycopersicon esculentum
  Predicted polypeptide sequence is orthologous to G2834
gccattttatcatattcctacaactctctcaaaattattcacatcatgtcatttaccggcgacttacgtcatttgccgcccaacacaatcggagatgatcctatggttccactgctcaacctctccgccgttcaaacacgaatggattccctccagaaatttctctcagattcggtcaactccaatactttacttggtcaacaccagatgaacatggtttccgacgaaatcacctccgcaatccatcagattattgtcaacggcgccgctctactctcatctgcccagttgacaaatcctcctccgcctccgcctccgcctccgcggccgtcgtcgtcggctgaattgaaaataaatctaaaatcgaatcataagagatcgtttccggaatttgatcggagagatttcgagtcgaaagtagaggtattagacgaagaagaggaagacggtggcgattgggagattattgagctagatgcggttgagctactagcggagcacatccacttttgtgatttctgcggaaaaggattcaaacgagatgcgaatttacggatgcatatgagagctcatggaaatcagtacaaaacaccagaagcattagcaaaacctggaaaatgcatcgattcatcgaattcgaataaacgaaggaga

SEQ ID NO: 10598 - DNA, 449 bp, Lycopersicon esculentum
  Predicted polypeptide sequence is orthologous to G2846
tccttgacaacaacaattacaacaatctctgtttgctactaataacaaccaaccaatgaatttcccaacatcatccttaaactataggcctgatttgaatgacttttcaccttctatgcctaaattccctaattccttgttgataccaaaacaaactacaacaccttcgaatcattttccaaattactctcttaatgctactgcctctctctacaatacttcatcagccacatccttaaacaatatgcgcgctactcttatgccttctatgcatccacaaattctccagtcaccaacatttaacgacaattccagagctcctaacgttactccaaagagtaaagttgaagatttaagagagtcgagggtgagtaagaaaagtgtgactaatgaagcaacattgaagagggcaagaatagagacaccatcaccattgccaacttttaagg

SEQ ID NO: 10599 - DNA, 517 bp, Lycopersicon esculentum
  Predicted polypeptide sequence is orthologous to G2850
aaggaccagcaatactttggagactaataaaggtcctcaaaatgcaccaaaaaaatcaagagttgattcacgcgcatcatgtccaccctttaaggtgagaaaggagaaattaggagatagaatagcagctcttcaacaattggtagcaccttttggcaagacggacacagcatctgtactaatggaagctattggttatatcaaatttcttcaaaaccaagttgagacactaagtgtgccatacatgaaatcatcacgaagcaaagccagcacatcattgcatggaggtggtggagagatgaataatgaagaaatgaaaagagatcttagaagcacaggtttgtgtatagtgcccttaacatgtttaacttatgttactgaaggtggaggaggtgtttggccgccccctaattttactggaggcacttaaatttaggagtttcatttggccaactcatttcctttatgtaatttgtatcatttttgctttattaatggagcaaacttggtcattctg

SEQ ID NO: 10600 - DNA, 764 bp, Lycopersicon esculentum
  Predicted polypeptide sequence is orthologous to G2854
ggccaaatcggccgaattatcccttctctctcaccaaatcctttagggttttcgccgccaccgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactacccctcagtcaagggtgcaaaggttgtgactgatagggtcactgggcgcacaaagggctatgggtttgttaaatttgc

SEQ ID NO: 10601 - DNA, 606 bp, Lycopersicon esculentum
  Predicted polypeptide sequence is orthologous to G2854
cgaagccaccgttccccccctctctgaaccccattgcatcacgatgcaaccagcgaattccatggttccaccaccacagtaccagcagacacagcagtggatggctcagccgccgccgcagtatcaggttgcgcctccgcagcaatcgggatattactaccagcaacctcagcaacagggcggagttcctccaccccaacaacaacaacttcagtacaacgcctctggtttggctgctactgccggttctgttcagccgactagtgctgatgagatccgaagcctttggatcggagatctacagttttggatggatgagcaataccttctcaactgtttcgcacaaactggagaggtgacctctgctaaagttatccgtaacaagcaaagtggacaatcagagggttatggctttattgagtttattagtcatgctgctgcagaaaggaatctgcaagcatataatggtaccttgatgcctaatattgagcaaaatttcagactcaactgggcttcactcggttctggtgaaaaacgttctgataatggtcctgaatatacaatatttgttggtgacttggcagccgatgtttctgattatatgct

SEQ ID NO: 10602 - DNA, 523 bp, Lycopersicon esculentum
  misc_feature (285)..(285): n is a, c, g, or t
  Predicted polypeptide sequence is orthologous to G2898
taattctgaacgcctgaatatccctgaggccgacgagctcgaccccgtctcgtcgtctatcaacttacgtcaccgttcatagcttctggaaccctagtataatcgacatggtcgaggttgaggcttctacacctgatctcaacgacaaagcctcatctcctcaccacacaatgacaatggtgcctactgaaggagaattttcaataggaaagaggaaggatcaaggtattagtgaacctgaagggagtagaaaaaagaagaaaaaacaagtagccactcctcgtnctgcttgctcttgggtgcacttcagccgtgactttattaaagagtatagtgctacacatcctgaatcttcaggcctgaaagttgccacaaaggcagcatcagatgcatggaagctgatgggtcctgaggagaaggcaaagtacactactcgtgctcgtgaagtgtgggataagtacctgagctcagcacctgcccgtgcctctaagccaagaagacagaccaaactagtcactaggtg

SEQ ID NO: 10603 - DNA, 2370 bp, Lycopersicon esculentum
  Predicted polypeptide sequence is orthologous to G2907
ggatcagaagttgaatccagatttgacatctggtcagaccattgggtctagtggtgtatatggtgtagaacatcacaattccttggaggcttctcagctacttcctgcgcagcaagataaacacccaatccagaatgaacttcaatcacagctatcagatgcaaatattggaggctctctaaatgctgatttagatcacaatctaagcttaggggtcaaaaccgattattcagctttaaaacaacctttgttagatggcgtcttgaaaagagaaggtttgaagaagcttgatagctttgaccggtggataagcaaggaacttggagatgtaagtgagtcgcatatgcaatccaattctagttcctactgggataatgttggagatgaagatggagtcggtaattccacaattgcttcccaagtgcagttagacacctatgtgctaagtccttcactcgcgcaggatcaaatctttagcattattgatttctcaccaaactgggcattttctgggtcagaaattaaggtcctcatcactggaaggtttttgaagtcccagcaagaagtggagaactgtagttgggcatgcatgtttggtgagttggaagttcccgcagaagtaatagctgatggtgttcttcgctgccatactccggttcaaaaggctggaagagttccattctacataacatgctccaataggttggcatgtagtgaggtgagagaatttgaatttcgggtcactgaaggccaagatgttgttgcaaatccaaatagttgcagctccagtgaaagtcttcttcatatgagattcggaaaattattatctctggaatcctttgtttcccaaacttctccacctatcagtgaggacaatgtttcctatatatccagtaaaattaactcattgctaagagacgatgacaatgagtgggaggaaatgttgcactttactaatgagaacaactttatggcagagaaagtaaaagaccagctcctacaaaagcttctaaaagagaagttgcatgtttggctccttcaaaaggttgctgagggtgggaaaggccctaacatactggatgaaggtggtcaaggagttctacattttgcagctgctcttggttatgactgggctgtaccacctactatagctgcaggcgtaagcgtcaatttccgagatgtgaatggatggactgcactccattgggcagcatcatatggaagagagcggacagtgggtttccttatctccttaggtgcagctactggagcattgacagatcctactcctaaacatccttcaggcagaacacctgctgatctagcttccagcaatggacataaaggaattgctggttacttagcagagtcttccttgagctcccaccttttttctcttgagttgaaggaaaagaagcagggtgagaatgaacaagcttttggggaagctgttcaaacggtttctgaaaggactgctacaccagcttgggatggtgactggtcacatggagtctcattgaaggattctcttgcagctgttcgtaatgctactcaagcagctgctcgtattcatcaggtcttcagggtgcagtcattccagaggaagcagctaaaagaatacggtggcagtgaatttggactatcagatgagcgtgctctctcacttctcgccatgaagacaaatagggctggacagcatgatgagcctcacgctgctgctgtccgtatacaaaataaatttcgcagttggaagggaagaagagattttcttctaatccgccaacgaattattaaaattcaggctcatgtgagaggacaccaggtaaggaacaaatacaaaaacataatatggtctgtggggatcttagagaaggtaattttgcgatggaggcggaaaggaagtggattgcgtggatttaaaccagaagcacctactgaaggaagcaacatgcaagatcaaccagtgcaggaggatgactatgatttcttaaaagaaggcagaaagcaaactgaagaaaggttgcagaaggctctggaaagggtaaagtcgatggttcaatacccggaggctagggaccagtataggaggctgctgaatgttgtgtccgacatgcaagaacccaatagtactgcagccagctacaactcagcggaagcagttgatttcaatgatgatttgatcgatcttggtgatttattggatgatgatacttttatgcctacagcaccttgagttctgtgttaataatataccatttgtggattagtatttgttatacatggctgttagagttgttgtatacataggctgcactaactagtttgtaaatgtgaaaatcaaaaatccattgtgcgaaaaaaaaaaaaaaa

SEQ ID NO: 10604 - DNA, 681 bp, Lycopersicon esculentum
  Predicted polypeptide sequence is orthologous to G2979
ccaatttcatctatttccctctctctttcttcaaagcttgagcggtttatctcgaattttccgtagggttcttctctgatcgctttcaactttcgataacagagaaacctagcaatgtcatcgtcactccatactgaagattctcaatggaaaaaccctagcatttatagccgcaaggacaaatcgctcggtcttctttgctccaatttcttgaagctatgtgatcgggaaggggtggactccaccattggtttggacaatgctgcagatcaattaggtgtcgagaggcgtcgcatttatgatattgtcaatattttggaaagtgttggggttttgtcaagaaaagctaagaatcagtatagatggaatgggtataatgcaatttctaaggctgtagatttgcttaagaaagaaggactaaaagatctgtccactgtctcctccacttgccacaatgtttcaaatgtcatagcttgtaacaattcagatgttaaggaaaaaggagaaggcaagactgctggatcacataaaattgaacaaccggaaggagaagtctttgatgattctagcacaaaattttgtaaagcttttccactggtctgatgttgacttgatatctcttgaccaggctgcatcagctttgcttggtgatgtccacgatccgatggctatgaagacaag

SEQ ID NO: 10605 - DNA, 789 bp, Lycopersicon esculentum
  Predicted polypeptide sequence is orthologous to G2981, G2982
gaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcttatttagaagaacttgaagatcaatatgtagggcttcaaaacctcataaaacgcaatgatcagttgtatggctcaggcaatgctcctagtggtggtgtggctttaccgtttattttagtgcagactcgtcctcatgctacagtcgaagtggaaatatcagaagatatgcagctggtgcatttcgacttcaacagcactccgtttgagctgcatgacgataattatatcctcaaagcaatgaatttttgcggaagatcaaatgacggttctgtcccacagaatgtatctgctgatggaggtgaaggtccgagttccagtatggccaacatgtttcagcatcatatccctaatccatctgccccaaactcatctggcaggcttccgacctcacctcctctccccggaatactaaaggctcgtgtcaagcatgagcattagtcttctggcttctttcttgatcgattactgtactcattaacgcatagtatttctgtacattatgtaaagtatttttactggaagcagcctcctctggtgactaaatacttctcttgacccttgtctcaatttgagggaggttactagttgagcttttaaatttttttgctaag

SEQ ID NO: 10606 - DNA, 627 bp, Lycopersicon esculentum
  Predicted polypeptide sequence is orthologous to G2983
cttacaatgaagacaagaaagactcctctcaggtggaatcacacccaggaggaacaagatggaatccaacacaagaacagatagggatacttgaaatgttgtatagaggtgggatgcgtacacccaacgcacaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactaggggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttggttccttttctttta

SEQ ID NO: 10607 - DNA, 653 bp, Lycopersicon esculentum
  Predicted polypeptide sequence is orthologous to G2989, G2990
cacacatgcttttggctctaagcgctgggttttccggggagaaaaatcagaacctccccacatcgactacgccaatggcggtagcaaattctaacgggaggaagcgtttcaggacaaaattcactccagatcagaagattaaaatgctggaattcgccgaaaaagttgaatggaaaatgcagaagagagatgaagatctggtgaacaatttctgcaacgaaattggagttgaaaaaggggttttaaaggtatggatgcacaataacaaaaccacctctatctccggcaagaaattagatcaaccgaacaccgacaacggccacaaccaccagaatggtaactctaactatactgttaatgggttttgtattgttgatagaaataatactactcatcatcacgacaacactgactcggaatttcacattcaccatgaaagcagcatgaacgatgacaacaagaaagaaaattcaagttttggtgctaataatgtcgttgtcactaatgggtcttcttcttcatcttgattttagattagtttgaataatgtttcaattagtagtaattagtgcaaggaagagaaaaactatgaggctgcaactattttactatatatatatatatattagttacctttatttctttgttcctct

SEQ ID NO: 10608 - DNA, 773 bp, Lycopersicon esculentum
  Predicted polypeptide sequence is orthologous to G2997
gcttctttctcttatcttctcttctgatcttcatctttctcatcactaatcattttcccctttctctttttttttttcttctctcactatcaaaattctctaaatatacaacaaccccactttagatctattttttttctttaacttgagatgatgtagatttttatttttttgaaatagtcaattttttaaaattaattcataatatatataaagtgtgaaagaaaagaaaaagtgtgtagttaggtagttgagaagtgaaaattaagatggaatttgatgatgaccaagaagagcaggaacaagaaattggcgctgtgggagcggaaaattatgtaacgacggggaacaatagtggaagagaagaagggatttccactagtagtattggtagaaaaagtaatgttaggtatagagagtgtttgaagaatcacgcggtcggcataggtggccacgccctggatgggtgtggcgaatttatgccggccggtgaagaaggtactatggatgcacttaaatgtgcggcgtgtaattgccataggaatttccaccgtaaggaagcggaaggtgaggtatttcatcataccccacctccccaccttactcatcaccaccatcaccatccccaattttcacctttttcttcttatcgaaccacccaccatccatctggttacctacatgttaacccacccccacatcagcgccctttggcgctgccatctacttctagggacgacgaagatatgtcgaaccctaatattattgggggt

SEQ ID NO: 10609 - DNA, 701 bp, Lycopersicon esculentum
  Predicted polypeptide sequence is orthologous to G2998, G2999
cagaggccaagaaaaggatatgggcttgcctaatcccaatcccatgagttataacccatctcaacttaaccagcaagaatcatcttcctctgcagcaaacaagttccttaccgcaccaaatagaacaacaaatgaacatgagaataccatttttagccctaaccaaaccctagatcagcataatattactcaaaattcagatccagatccagttcgacaactatctactagttcagcaagtgagaggaatattacccccgtccggtacaaagaatgtctcaaaaatcatgctgcaaatttgggaggatatgtactagacggttgcggagaattcatgccaagcggagaagaggagacactagaatacctgaaatgtgcagcttgtgattgtcaccgcaattttcataggaaagagactgaggacgaatcacaaacacctggtgtgcatagaaataaccaccgtatacccaaccaaactccgccttctcttccagctgtgcctacgcagcaacaacaccatcataaataccctcacagctatccaagaggtcacatggcaccagtaatgatgagtttcggcgggaacacgggagttgcagctgaatcatcaagtgaagatctgaatatgtttcacggaggacaaggggtaattcagccttgtaatttttcggcatcgaagaagagatttcgaacgaaattca

SEQ ID NO: 10610 - DNA, 1454 bp, Lycopersicon esculentum
  Predicted polypeptide sequence is orthologous to G3055
gagctttatgtttttgtatgcatattactctatttttatcagttttgggaattgaacattttggggtagtcagatctgctgtttaaatggattttacgggtgaagctggttttgctggagggaatgtgatccccgattccacagccggggttggtggttatgacagttggggtcctaatttttctgaccaggcagtttgggctactgaggatgattataaagcctggaacagtggtccctattgtgaaaccccttccaattccagtcaggatggtaggcattcacaaaaccggtcaggcagtgagcctcccaacaagaagtcaaggaatgtgcaggattcagatgctcgcattatagtcaccagtagctctaaagcaatcggaaagatgttctttaaaacgaagttgtgttgtaagttccgtgccggtgtctgcccctatgttactaattgtaactttgctcatggaatagaggagcttcgcaaaccaccacctaattggcaagagatagtagctgcacatgaaaatgagcggggagtaatggtggaactgagagaagaacaccagataccaatattgagctctcctgatttacgtggagagtctcaaaggtccgctaaagggaggcactgcaagaagttctacactgaagagggatgtccttatggagatagttgcactttccttcatgatgaacaatcaaggtctagagagagtgttgcaataagtgtgactcctactgttggtggatttggaaataatgctactggagcaacccaaaaaccttcaaactggaagacaagaatttgtaataagtgggagactactggctattgcccgtttggcagcaagtgtcattttgctcatggtgtggcagaactgaacaagtttggtggaggacctgcggaaacagatggcaaagattatgtctctgttcctccagaattaaagcagggcggggttccatcaagagcaacagaaagtacagtgccctcaaccattccagcactccacacagatgtttatcatctggggcagggtgttcaggtacaaaggccaactggcatagctgatagacctggccagaggttctttcaaaaatggaaaggcccggataagattagtaaaatatatggcgactggattgatgacatcgagtgaaggagttgtcataattagctactgatctgtttagctagacacaaatagccgaggttagctttcagccttgcattcaaaggaattttaccctagtgttttttcgcccctccgaaacttgttgtattagagctacaaactagatagctgctcgggcagtcgatgtttaatcacttttctgtattactcacaacttgtttgtaagaatgatgattggctataatctctatacttgagccttttgtcttgcgtggagatattcaaacataatttgtatttcaaaaaaaaaaaaaaaaa

SEQ ID NO: 10611 - DNA, 612 bp, Lycopersicon esculentum
  misc_feature (453)..(453): n is a, c, g, or t
  Predicted polypeptide sequence is orthologous to G3060
cattcgtctacttctactgctttgcttagggttctgcaggccgtagttatatttttcttttgttttttgttttcagagtttttttttgttcatttgttcgaatttgagtgttttaagtagctatggatttccggaagagaagcaggaatggagctggttcgaacttcaatggaggtttgaagaaatcaaagccagaaatggactccttatcgggtggtataggaagtaaaacgaagccatgcacgaagtttttcagcattgctggctgcccattcggtgagagctgtcatttccttcatcacgtccctggtggctacaatgctgtggcccagatgatgaacttaggatcagctccagcatcaagaaatgtggctgcaccacccatgtccaatggaaatgctcctgctgtgaaaaccaaactttgcaacaaattcaacacagctgagggatgcnaatttggagacgcatgcaattttgctcacggggaatggcaaattggtaagccgattgtgccatcacaggaagatccacgtgccatgggtgttggacctgctcctaagtcttttggtgggcgggacagagcctgctgtttctggacctgcttctagcttt

SEQ ID NO: 10612 - DNA, 566 bp, Lycopersicon esculentum
  Predicted polypeptide sequence is orthologous to G3061
ttaggcctgaatttatgggacttggattggaccctgcaattagtgatcatcatcaaccacagctcaataatgtggatggacaaaaaccaaggataccactttggttggacaataatatgaacccgaatccaggtaatgatttcttagtagcatcgtcaagctctactactagcaatttgcctcatcatgaattggtccaaatcgccgcacataacaatactcaacaatggttcattaatggtactggtgttggtgatgattctggaattggctcatcctcgtctcaacttccttcacgagtattgctaaaggaggaggaagagaacaaaagaaatatgtcggagacaataagttcaatgtactacaacaatcatcacaacgaaacaacagcaccagctactcatatgtcggctactgcacttttacaaaaagcagcccaaatgggatcaacgaggagcaattcagccctctttggtactggattcgggctaatgggctcgtctttttctaaaagcaatggacaaggacaatttgctactcatgatcagaattttaacggtttaatg

SEQ ID NO: 10613 - DNA, 559 bp, Lycopersicon esculentum
  Predicted polypeptide sequence is orthologous to G3061
tgatgtcggatgatggactttcttcattagctttcattcaagatccaaactcaaaccctactaataataatccaaaccctaactcaaatccatctgctaaacgaaaaagaaatctccccggaaagccagatccagatgcagaagtgatagcactatcaccaaagtcactgatggcgacgaatcgattcatatgtgaaatctgcaacaagggttttcagagggaccagaatttacagctccacagaagaggtcacaacttgccatggaagctaaagcaaaggaacaaaaatgaagttatcaagaagaaagtttatatttgtcctgaaaagacgtgtatccaccatgatccatcgcgagctctgggagatttaacaggtattaaaaaacacttctcgagaaaacatggcgagaagaagtggaagtgtgagaaatgttccaagaaatatgctgttcaatctgattggaaagctcatactaagatttgtggcacaagggaatataaatgtgactgtggaactctattctccagaaaggacagctttataacacatcgagcatt

SEQ ID NO: 10614 - DNA, 671 bp, Lycopersicon esculentum
  Predicted polypeptide sequence is orthologous to G3061
gttttcatttccttcttctgttaaagcagtacttcctcatcatcatcaagaacttcaaacagcaaaccctaaccctaaacctaatacttcttccaaaaaaagaagaaatcttccaggaacaccagatccagatgctgaagttattgcactttcaccaaagtcactcatggcaacaaacagattcatatgtgagatttgcaataagggttttcaaagggaccaaaatttgcaacttcatagaagaggacacaatcttccatggaagctaaagcaaagaaacaagctagaacaagtgaagaagaaagtgtatatatgtccagaaaagacatgtattcaccacgatccatcgcgtgcacttggcgacctaactggaattaagaaacattttagtagaaaacatggagaaaagaagtggaaatgtgaaaaatgttcaaagaaatatgcagttcaatcagattggaaagctcatagtaaaacttgtggaactagagagtacaaatgtgactgtggcacactcttttcaagaaggatagttttatcacacacagagctttctgtgatgctttagctgaggagagttcaagaatcacatcagttggggctaccaaatttgatcaacttcccaaaactgcaactttattgaaccaacacaagcaaattacatggcggat

SEQ ID NO: 10615 - DNA, 311 bp, Lycopersicon esculentum
  Predicted polypeptide sequence is orthologous to G3061
gtttttttttttttttttttaaaattaatctgattttcagataactacaacaaaaaagttactaactttatgaatgaaccttaaaaaacttcccttctccatcaaacttggaacatttttttttataaaagattcagttgcagaaaaaaaaacaagaaaactccactaaagggaacacaaattaaaatactttaacccaatgtataatataccttggaaactcaaaaataaaaccaaaaattgtgcaaatcccacaatttacatcaagaactcataaccccaattcttgttttttgctctttaatctgaaa

SEQ ID NO: 10616 - DNA, 1352 bp, Lycopersicon esculentum
  Predicted polypeptide sequence is orthologous to G3074
gaccttcgttttgcactttccccaaatcttctcctctctctctatctcacttcgaacaatgattgtcttcttctgattcttccaatttcagaaagaaatttgttcactagattctctaatttagtattttatatccttagattctctctatttttgaatggacagaatctgatttatcatgaggaagaaacttgatactcgctttcctgcggcccggatcaagaaaattatgcaagccgatgaggatgtcggtaagattgcaatggctgtgcctgttctagtgtcaaaagccttggagttatttttacaagacctttgtgaccggacatatgacataactcttagaagaggagcaaagactgttaattcactgcacttaaaacactgtgtacaaagctacaacgtgtttgactttcttcgggaagtggtcagcaaggttcctgattatggccattctgatgctgctggtgaaatgccaaaaagaaggaaagttgctatagaagaacatcatgacagtgaggatgaatacaaaaagagcaggacggagatgtctcctgttggcagtagtggtaggggaagaggtaggggtagaggaagaggtcgtggtcgggtaagccgtgctgataaggagctctcacgacctgatatgcaacttgaatcctgcacttctgctcagcagagtgttcaacaaaatccaaatcctggaactcagacagagaactgctcagaaccgaaagaatcacctacacaggattccactgtttgtgacaaagaaaactcagttgtaacaactcctaatctgaaggtcaatgtagatgataatactgataaaccagctgcaccggaaatagcaccctgcaatccatcaccaaggcctgtgaacgagaaagcagaggaaggccctcagtggtccctcgaaatggacagaatggtcattgaccctgctcatatgtcacaactgaatacaagtgtagcagaagaggaagaagattatgatgaagaagagtaggcagatgaaataacaaacaaatggcctatttgacatatgctatttattgattacagttgcctgtaggccttgacacaaagggcccttgtgatttattgacatattagtgtccgtctatttcttagttgtctttgtgactttaagtctttgtaatggtctctaacccttcccttttccactagtaataagtaggaagtgtgttcgttgctccaaccagcactccatgtatcaattactgtgtgaaattaggttaagtccattttgaatcttcactttttttattttataacctagaaatcgacgcggtagctgactaagtttcagtggcaaaaaaaaaaaaaaa

SEQ ID NO: 10617 - DNA, 618 bp, Lycopersicon esculentum
  Predicted polypeptide sequence is orthologous to G3074
ctttctgcaagatctttgtgaccgtacatacgagattaccctcaagaaaggagcaaaaacaatgaattctttccatttgaaacattgtatccagagctttaatgtgtttgatttcctgaaggatgtagtgagtcgggttcctgatctaggcgggtcagatgctggtgctgaatcggccaccaaaaggaggaaagttgctgaagaagatgatcatgacagtgatgatgataccaaaaggaatcatgcgaatgagactgcaaacaacagtggtactggaagaggacgaggtatgggtaggggtagaggccgtggaagaggttcacgagcagtagagaaaggtgactaccatgctcacagtgagaaactggaagacgctgctgctgatgtttcacatcaaaaggatgatgagaaccaaaaacaaaatgatgaaagaatggtagactatgtagcagaatcagcagtagattcaaagaacatttcagctgctaaatgctccccagaagtcgtcgcccctgctagaaacttcgatctcaacatagacttaaacgagagtgtggagtccacaccaatgccatctgaagtccctttatcatcaacggggacaccaacaccaacacc

SEQ ID NO: 10618 - DNA, 608 bp, Lycopersicon esculentum
  Predicted polypeptide sequence is orthologous to G3076
tgacgagccaagtagcggaaaacttcacaaaatactttgaaaattggatgatccaacttgaagagttgctgaaacaactcgttattgtacctagggagacgtcatacgtgaatgatcacgagttattggtgagtaaaatgacgacacatcacaagaactactacacagccaaatgggccgcagctcatgaagacatcttagcatttttcactccaatgtggcttagtcctttagaaatcgtctactcgtggatcacagggtggaagccttccatggcgtttcgattagtgagtggcggtggaggagcgttttcggatgaggaattgaagaatattgatggtttgagggtgaaaattcgcggagaggaagagaaagtggagagggaaatggagaggcaacaggttgcaattggggatagaaaaatggtggaattagcaaggattagaaatgataatgatgagttggtagaattggcgttgaaagggttaaggatgagtttagaaagggttatgaaaatggcagattgtgttaggcttaaaacgttgaaaggtttgttggagatattgagtcctttacagaatgttgatttcttggctgctatttctact

SEQ ID NO: 10619 - DNA, 789 bp, Lycopersicon esculentum
  Predicted polypeptide sequence is orthologous to G3091
atcggccgaattgattttccaaccatagctttttattttttctcttactgtcactaatacacaaagcgttactactttcgagaaatacaaatagttttatttttttttgttttacaaagctggcgatcgataatcaagacaccacttttcgtgaattcaagcctaagaataggcgaatcatgggagctggaggacctgatgaggaagataatagatggccaccgtggttgaagccattgttgaaggaacggttcttcgttcaatgcaagttacatgttgattctcataagagcgaatgtaacatgtactgtttggattgtatggatggtgctctttgttccatttgtttatctcatcataaggaccatcgtgccattcagattcggaggtcatcgtaccatgatgtgataagggtgaatgaaatacagaaatttctggatatcacttccgttcagacctacattatcaacagtgcaaaagttgttttcttgaatgagagaccacagcctaggcctggcaaaggtgtcaccaatacctgtgaagtctgtgaaaggagtcttcttgattccttcagattctgctctcttggttgcaagattgttgggacttcaaagaacttcgttaagaggccaaaacaatcgccggagaagaagaagtcctcgccggctgctgcagccgccgtctatgactcagaggattcctacagcagcagcagccatggccggcagaacagcacaagcaacaaggtccaccaaagtttcagtccgtcaacgccccctccaacttcag

SEQ ID NO: 10620 - DNA, 845 bp, Lycopersicon esculentum
  Predicted polypeptide sequence is orthologous to G3111
accacaccattgtcctctttcttctatattgttcaatttttattatgactcgtccttctagatttctgcttagcaccaactcatcttcaacgccggcggcggagccaccgtcgacggtgacagtggagtctgatttcgttgtaatactagctgcgttgctctgtgcgctgatttgtgtagtaggactcatcgccgtcgcgagatgtgcgtggctccggcgaggaatcggggccggcgggaacggtggtagtcaaccgtcggcgaataaaggattgaaaaaaaaagtgttgcaatcgttgcctaaattcacctacgatccaagtagtacggcgaacggtgcggcgttcacggcggagtgtgcgatttgtttggcggaatacgccgtcggaaatgagatccgtgtgctgccgcagtgtggacatagttttcatcttcagtgtattgatacttggctgggctcacactcttcatgtccttcttgtcgtcaaattctcgtcgttgctcggtgccggaagtgcggtgagttcccggcagtttcctgtaaatccgacggagctccggttacaactccggccgagtctcgttcatgcggtacatctactagctcaaataatttcttggtctagcgtaacaataaaaaagaggcattagttttttaagttatatactctgacaaatcggtgtaaacgataaatgtaatttacaccgtcagtgcagttttacctgtggtaacatgtcagttactgtgttgatgcaggttagggtaaagttacatgtaattaatcttaaattacatcgttgaaatgcaaaaaaaaaaaaaaaaaaaaaatgcctgtcggccgcct

SEQ ID NO: 10621 - DNA, 519 bp, Lycopersicon esculentum
  Predicted polypeptide sequence is orthologous to G3967
ttttgatgatgttttagcaacttttgttcttcatcacccagagcatgggcatgctgtagttcatccaattatttcatgcatcattgatggaacactggagtatgataaaagtagtccaccttttgcttcttttatatcactggtttgctcaagcagtgagaaggaatattctgaacaatgggctcttgcatgtggagagattttacgtatcctaacacactacaaccgcccgattttcaaagttgatcgtcaggacaaaggaacagatagaagcaccagtggaagccacacttcgacaagtgaatcttcctctagtgaacctggtgtgccctctatacaacatgagagaaaactgctgagaccattgtctccgtggatcactgatatattgcttgctgcaccactagggattagaagcgattacttccgctggtgtggcggtgttatgggaaagtatgctgctggagatctcaagcccccatcaagtgctgcttctcatgggtctgggaagcatccaca

SEQ ID NO: 10622 - DNA, 801 bp, Lycopersicon esculentum
  Predicted polypeptide sequence is orthologous to G3967
aaaatataggatgatttgcttatggcaagggtattaataacggacccaaattgtatggagaaaaaattgagcaattccgaatagtttaggggcaatttctggaagttttcccttctctgtcatatttttggcgttatcacatggcaaatacatttatgtttatggtacagtacctttccggttccagggtttcttagacttgcatgcattaatagttatcatcgctttgcttctagctgtaagtaggtcttcatcacaatatttgtttggtcactttcttgccaaactttacttgtcaggctgagagggaattgcaaccatggattgctaaagatgatgaagttggtcagcaaatgtggagaattaaccaacgtatagtaaaattgatcgcagaactgataaggaatcatgatatagcggaatctttggtaattctggctagtaaccctgacctccttttacgggccacagatgggatgcttgtcgatggagaagcatgcaccttaccacagctagagcttttggaagtgacagctagagcaattcaaccagtacttgactggggagaatctggacaatcagttgctgatggcctcacaacctattgaagtgtcgtttgcctgccacagttcgctgtgtttctcatcaagtgcacatgtccgtgctctcagtacatcagttcttcgtgacattatgtatggctggttcagtaaaaccaagtgcccaacaagcagcagatgttaatgccatccataatccctgcttatcagtaccttagcataagcatcattgactgggaag

SEQ ID NO: 10623 - DNA, 724 bp, Lycopersicon esculentum
  Predicted polypeptide sequence is orthologous to G3967
gaaattctctccagagcatcttcactgtataacctcattgatatccatagtaaagttgttgcatcaattgtcgacaaggccgaaccattggaagcacacctaatacctgttcctgttcttaagaaaagaagctcgggcttgaatgggaaaaaacataataaatatagcaattgcacctgcttaactgcagaacagtcatcattgctcgagtgcaaacactcaactgattgtaaaactttaactatgagtgagaaagttttacactcaagcgaggctgcacagtgcaccagtggtaaagggatcgcaagtttccctttagatgcttcagatttggcgaactttctgacaatggacaggcttataggattcaattgcaatgctgaagatcttataaagtccgtactcacggagaatgaggaattatgtttttctgttgtctcattgctgtggcacaagttaattgcatctcctgaaatacaaccaagtgcagaaagcacttccgctcagcagggatggagacaggtcattgacgcactatgcaacgtcgtatcagcattgcctgcaaaagctgcaacagccattgttcttcaggcggacaaggaattgcaaccatggattgccaaagatgatgatcttggtcaaaagatgtggagggataacaacgtattgtaaattgattgcagaaagtatgaggaatcatgatacaccagagtctttggttatt

SEQ ID NO: 10624 - DNA, 736 bp, Lycopersicon esculentum
  Predicted polypeptide sequence is orthologous to G3967
gttggtcacactgaatatttaatacatcatattttcacaatcatgttcatattcaggtgtacatcaaacataaactgaaccaaaaaaaaaagaaggtaaagaaaatacaaccagagaaggactacctatatttccatgatcatggatgtgtcaaaaggacactaatctcatttcctgactgtaactaaaagctctttctcctttctccatcctcatgccaatagatggtcactttctaatcttgtgaatttcatgtggcaaaatcatgggaagaaaactaatatactgcccccattatattaagttagatcaaatggatatagtacaccctaattccttagcagccatatcaagaaactgtgtacacattccattttcaattcggctgttagcttcccaagtcaaacacttctcaatatccctttgccagttaatagtgccaatgtttaagtacttataagcaggaccatggataccatttacatcagctcgattagctctagtttttattgaaccagtctgcataatggcacggagaagtgatatgctgagagcacgtaccagagcacttggatgagaaatacaacgaactgtggccggtaagcggcacttcaacaagtttgacagaccatcaacgattactgatccagattctccccactcaagcactggttgtacagctctagctgtcacttccaggagctccagctgtggtaaggtgcatgcttctccatct

SEQ ID NO: 10625 - DNA, 936 bp, Lycopersicon esculentum
  Predicted polypeptide sequence is orthologous to G28, G22, G1006
caaatacctcataaatcactagaaaaaaaaactaaaattcaaagcgaaatggatcaacagttaccaccgacgaacttcccggtagattttccggtgtatcgccggaattcaagcttcagtcgtctaattccctgtttaactgaaaaatggggagatttaccactaaaagtcgacgattccgaagatatggtaatttacggtctattaaaagacgctctaagcgtcggatggtcgccgtttaatttcaccgccggcgaagtaaaatcggagccgagagaagaaattgaatcgtcgcctgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttggatgtcaaattgaacaattgacaggtgtccatcaactattggtcatttaaaaagccgaatatttctccgaacgcaaaatactatatgatttttccaaatttattgtaaatacgtaatactctatgataacggagaaaatagaaagttgaattggaaaaatattgtgatagggttaatccaaagttgtaaaaagtttcattttcattaatattaatttacgtaattgattgaaa

SEQ ID NO: 10626 - DNA, 465 bp, Lycopersicon esculentum
  Predicted polypeptide sequence is orthologous to G28, G1006
ttgtactaaattcgcttcgatataaaaattcataaccaaaattcaaaatgtattcaaattgtgaactagaaaatgatttttcagtactcgaatcaattagaagatacttacttgaagattgggaagctccattaacgagctctgaaaactcaacatcctcagagttcagccggagcaacagcattgaatccaatatgtttagtaattcatttgattatacacctgaaatttttcaaaatgatattcttaatgaaggatttggatttggatttgaattcgagacttctgattttataatccctaaattagagtcacaaatgtcaatcgaatcacctgaaatgtggaatttaccggaatttgtggctccattagagacggcggcggaggtgaaagttgaaacaccggttgagatgacaactacgacgacgaagccaaaggcaaagcattatagaggtgtgagagtga

SEQ ID NO: 10627 - DNA, 545 bp, Lycopersicon esculentum
  Predicted polypeptide sequence is orthologous to G28, G22, G1006
gcaaatactcataatgtatcaacttcccacttctactgagttaactttttttccggcagaattcccggtgtattgccggagttcaagtttcagtagtctcatgccatgtttaaccgaatcatggggtgacttgccgttaaaagttaacgattccgaagatatggtaatttatgggtttctacaagacgcttttagtatcggatggacgccgtcaaatttaacgtccgaggaagtgaaactcgagccgagggaggagattgagccagctatgagtacttctgtttctccgccgacagtggctccagcggctttgcagcctaaaggaaggcattacaggggcgttagacaaaggccatggggaaaatttgcagcggaaataagagatccggctaaaaacggcgcacgggtttggcttggaacttacgagtcggctgaggaagccgcactcgcttatgataaagccgcttttaggatgcgcggtactaaggctctattgaatttcccgcatagaattggtttaaatgagccggagccggttagagtga

SEQ ID NO: 10628 - DNA, 935 bp, Lycopersicon esculentum
  Predicted polypeptide sequence is orthologous to G481, G482, G485, G1364, G2345
agagaaaagagattctttttatatatagttataaaaaaatttcagagttttctttgtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgacgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccatgtcatatttaaagtttgtaaattgaggagatgttttaagaaatattatagacatgattgtttgtagtaataatgaaaaccattacctagtaaaaaaaaaaaaaaaaaaaa

SEQ ID NO: 10629 - DNA, 1004 bp, Lycopersicon esculentum
  Predicted polypeptide sequence is orthologous to G481, G482, G485, G1364, G2345
agtgcttcaacatttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacgcgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattaaaaaaaaa

SEQ ID NO: 10630 - DNA, 808 bp, Lycopersicon esculentum
  Predicted polypeptide sequence is orthologous to G867, G9, G993, G1930
ttgaaatgttacgtaaacacacgtataatgacgaacttcaacatgccaagaaagtatataacaacaatactttcgagatgaatggaaggagcacatgccatactaatactaatatcgcgactttttcattagatactaatgaaaaagtcgcgaatatagctagtgaactgctttttgaaaaagtagttacaccgagcgacgttggaaaacttaataggcttgttattccaaaacaacacgcagagagatatttccctttggttgccaaagtaaataaaaatgataatacttctaaaggggtattattaaatttcgaagatatgaatgggaaaatgtggcgatttcgatattcgtattggaatagtagtcaaagttacgtattaactaaaggatggagtcgttacgttaaggaaaaaaagttgaaggccggagatatagtgagtttcaaacgatgttctggagttgaaatcgaagataaacttcttattgattcgaagaacagaataatacgaggcgaacaagtaaaaatggttagattatttggagtgaatatatgtaaggttcaagatgttagtaataatgttgttgttgagaaaaatatgagtgttggcaaaagaatgagggagatggagttgttggcatttgagtgtagcaagaaacaaagggtaataattgatgccttgtgaatttttcttttgtttgtaattttttttttttgtactttggtttttttagatgttttaatttatataacttccaattgtatattagtgttattaggaaaaaaaaaagggctcaaaaagagagc

SEQ ID NO: 10631 - DNA, 681 bp, Lycopersicon esculentum
  Predicted polypeptide sequence is orthologous to G867, G9, G993, G1930
cttcctaattttccttttctcatcaaaaaagacaaaacaacacacacaccaaaaaaaaaatggaaggaagtattagtagcatagatcaagagagtactactagtgactctctctccattgctccggccgcgtcgtcatcgacgatgattaaatcgtcgacgacgataaaactgccgccggagagtggtctttgccggatggggagtggaacaagtgtgataattgatgctgaaaatggtgttgaagctgaatcaagaaaactcccatcttcaaggtacaaaggtgtggtcccacaaccaaatggtcgttggggcgcacaaatctatgaaaagcatcagagggtatggttaggcacattcaacgaggaaaatgaagccgctagggcttatgacatcgcggcccagagattcaggggccgcgacgctgtaactaatttcaaacccttgcttgagaatcaagaaagcgatgacatggaaatcgctttcttgaattcacattccaaggcggagatcgttgacatgttacgtaaacatacgtatatcgatgagttggaacaaagcaagagattgtttggatttactaaagacggtatgataaaaaggaaagatggactagtaattagttcgttctttggtagtaaaaatgataaagtcaattgcaaagcgcgtgaacagctatttg

SEQ ID NO: 10632 - DNA, 246 bp, Lycopersicon esculentum
  misc_feature (240)..(240): n is a, c, g, or t
  Predicted polypeptide sequence is orthologous to G867, G9, G993, G1930
cagagacgctgactccacaaacggtgtagaagcagagtcgaaaaatactactattactaataataacaacaataagcttccttcttcaaagttcaaaggtgttgtccctcaaccaaatggtcgatggggtgcacaaatctacgaaaaacatcaaaggatttggcttggtacgttcaatggcgaagaagaagcagcaagagcttatgatatcgcggcacagagattccgtggtagagatgnccggtt

SEQ ID NO: 10633 - DNA, 534 bp, Lycopersicon esculentum
  Predicted polypeptide sequence is orthologous to G1073, G1067, G2156
ggtgaatctgacagtgatgctggtgcaagttctggaggcggagctcccaatcgccgtcctcgaggccgtccgcctggatctaaaaataagcccaagcctccaatcatcgtgacgagagatacgcctaacgcactccgatctcacgtgcttgaagtttcgaccgatgttgatatcatggaaagtatctccaattacgcaaggcggagagggagaggtgtttgtattcttagtggtagcggcacagttaccaacgtcaaccttcgtcagcctgctgcaagtgtagtcacactccacggacgtttcgaaatacttagcctctcaggtacggtgcttcctccgcctgcaccgcccgcctccagtgggatctctatatttttatcaggtggacaaggacaagtggttggaggatccgttgtagggcctttgatcgcatcaggtccagtcgtcttaatggctgcctcttttgctaatgctgtatttgaacgacttcccttggaggaagatgatgaggctcctgctaatgttcctactaca

SEQ ID NO: 10634 - DNA, 560 bp, Lycopersicon esculentum
  Predicted polypeptide sequence is orthologous to G1274, G1275
atcacatattctatcaaagactcttttaaagtctttcttctcaaaaataatagtattagagaccatgtttggctcttccacttcccaagaaacaacaaatgtcatttctcatcaacattatcaaaccataaaccctaatttttatgcttttcatgatcctcttatcaacatgaatcaagatcatgtccacaataataattataataagtatcaagattatgacacttcatttcttgatttgtttgttgatggtgatcaagaatattattccaattacacaaacaataatgcttcaatttatttagaaaatcccttcaagcaacaagagataagtagtagtacctatagtactagtggaaactcatcatcagctagttcatttgatgccacaccaacacatgttcacatgaataatgaaaatacaagcatagggattgagaaagaaaaaaaaggtgaaaaacatgcaattgcttttagaacaaaaacacaacttgagaccttggatgatggatacaaatggaggaaatatgggaagaagaaagtgaaaaccaacataaatc

SEQ ID NO: 10635 - DNA, 740 bp, Lycopersicon esculentum
  Predicted polypeptide sequence is orthologous to G1274, G1275
ttttttttttttttttttttttttttgcgattaacttatctatatatttagcacttgaaaattcgtgcacaacttttttaaaacatatgtcgaaaatgttcaataaaaacactttatcatataatcaaagtgctccattagaacctaccataatacaaatatataactaaactttactgacacgtttaagaggttctaaaggtgaagattgtgaagggcaatattgttgggagggaattgtgtgtagtgaagcacatgaggactctcgtggttgtgaatcccttcataagtagtaatgacatagcttgaatctttattgtccctttctactcttttcttcacattgcatcccccacttgaacatttgtagtaattccttggatttggattattcttgaccatctttttgccatatttcctccatttaaatccatcatccaacacctccaactctgatctaaatctaaatgcaaccttagactttgcatccaccttctttatacctttcatacattttatgttatgacttgttggagtaggattatttgaatatgaaccactagtatcggaaacactttgaacaatttcattttgtgacaaaaaatcgtcactcgatccatcatcgagaaaaagataattataatcggagagctcaaaattctccgatgcgtcgataaaattagggttagggtttgatgagctatagggaaaattttccatagttgaacggaacgaaaaag

SEQ ID NO: 10636 - DNA, 585 bp, Lycopersicon esculentum
  Predicted polypeptide sequence is orthologous to G1760, G152, G860
ctctagcaaattgtttctaccttgtgttaaattacaggtttatggaaacagagatgcaaatggagtgagcagaagtccccttgttgcgaacagtttaagcatcaatgaggaccttcatgctcctgttcatctccagcttagccagccacagcaacagaactatgagacatcaggaactactgaattggggctacaactgcattcgcagtgaaaaccagactcgtaagagtttttagttctcgtgttgaagaagcagctgtgcttacagagctatgttttaattttttaatggtagcaatgatatagaacccagagatgtcaggaaaaagtcttcagttcaaatggttaatgacatcaagtttgacaagtgtgaggtaatccttagcacaactactaaaaagtaagataacaacaaataaagtaatacattggcacagtatctctacatatctttatctttcttggcacttcatgcttatgatgtgtatgcctatatactaggattgtacttgatgacgttttcaaatagctataaatagttgactacttgatcaaaaaaaaaaggaaaaaaaaaaaactcgaggg

SEQ ID NO: 10637 - DNA, 955 bp, Lycopersicon esculentum
  Predicted polypeptide sequence is orthologous to G1760, G152, G153, G860
gagaatattttaaattcattgaacatacagatatttttttctttctcctcctcctcctcctcctcctccattgttctaccaaatcactatttattgtcccacgttccacatcatggtattaatgcttgatcagatttgttagatctttggtgctgagtccagaaagttcttcacccaaaagctgcctgtggttcataaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaactaaaacctggtatagggcattgtccaatctcaggtgttcctttgatattcccagtccactcttgcgaccaaagaaagaacacaatgaagtaggttaaggtcagctaaaggatttgatggggctaaggatggttccaaaaagagcagctactttagatgaacgctactgtggttgcactatttatttgcatgcatgaaattgacatacgtgtatcctgttcgctcgagccatgataaagatgggtgaattcgatatcaaagggatgaaaagaagctgatagcataatacatgagtaggttggccaagaataaccttgatgatcaagagaactttactgaccatccctaaatcccaacgaaagccttctaccggggctttgctgggaaaacctgcttaaaaaaaatggacatgtgtgaagaccaagagcggttattcacttttcttcttccttagtctaagcaatcaatttgtgagataaattaattctccatttgtagttagatttttgcgtttgtataaccttttttttcgagttctaccttgaaaggaaacctacaatgagattgtacccgaaaaaaaaaaaaaaaaaaaa

SEQ ID NO: 10638 - DNA, 566 bp, Lycopersicon esculentum
  Predicted polypeptide sequence is orthologous to G1760, G152, G153, G860
gagagagagagtatagagttctatattttcttgatgaataagattgccctgtagaagcaatattaatcatcttagtgcaaagataaaagacacatggaagttgttatagtttttctggtaagaccttctgatttagttctctgatttcatccatcagaatctgctcctgcaagaaagtaacacatttaggatccttataataaaaaaaggagtaatacgtttgggagaaatcgtagacttgattttagcataagtttcatgaacacagaagaatttaggattttaccttttgctttcgtactcctttcaaactcatttcaatttggttttccagatttgttagatctttggtgctgagtccagaaagttcttcacccaaaagctgcctgtggttcataaaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaact

SEQ ID NO: 10639 - DNA, 391 bp, Lycopersicon esculentum
  Predicted polypeptide sequence is orthologous to G1760, G152, G153, G860
cagactgaacccaaaacgacgattgcgaagtcttcttttgtcttctccatcaacagcaacttttttgcccctctctctctcgatcgaaaaattcctccattgatttgttcttctgcttcttctcgtgaatgaaatttctctgagagaggaagtagagagagagagagagagtgagtgtgtgtgtgtgagagagatcggcgatggggagaggtaagatagtgataaggaggatcgataattcgacgagcaggcaagtgacgttctcgaagaggaaaaatggattgttgaagaaggcgaaggagctagcgattctgtgcgatgcggaggccggagttattatcttctccagtactggaaaactctatgaatattcaaacaccagcatgaagtc

SEQ ID NO: 10640 - DNA, 1308 bp, Lycopersicon esculentum
  misc_feature (1287)..(1287): n is a, c, g, or t
  misc_feature (1297)..(1297): n is a, c, g, or t
  Predicted polypeptide sequence is orthologous to G1945, G2155
gaacacaaacactatgtttggtaaaattcatcaccaccaccaaaatcaatctcctcaatcttttcaacaccaccaccaccttcaccagcagcagcagcagcagcaccaccacaattttcaacatccaccgtttcagctgacgcgagaatgccagacttcggaggaagcagacagtactgcgaacagaaacgatactttaaaccctcaaccggttaatgcagtagcaccgccgtcgcagcagcagcaacccgccggtaacgacggtgctacgattgaggttgttcgccgtccccgtggccggccgcctggttcgaaaaacaaacctaaaccacctgttatcattactcgcgatgcggaaccatctatgagtccttatatacttgaaattccgactggtgttgatataatcaactctgttaccaaattctgtagaaaacggaatatgggtctctgtgttcttaacggttcaggtactgtaacgaatgtaactctccggcaaccatcaactacgccggtttcgacggttacctttcatggcagattcgatatattgtcgatttctgccactgttgttcagccgaatgcgaatattccatcgaacaatgggatagcaaatgggttcacaatttcattagcaggtccacaaggtcaagtagtaggtggtggtgtagttgggcctctagttacggccgggacggtttacctaatcgctgcaacttttaacggtccgtcttttcatcggttaccggcggaggaggaattagcaaggaataattctggtggtggaaatgaagatggatcgtctccgcagcagcatgcggaggtttccggtggaggagatggtggacatccaccgtcaacgacggcgccggaaagttgtgggatgtcgatgtacagctgtcatttgccgtcggatgtgatatgggctcctactgctagacaaccacaaccaccgccttactgaaaattcttgggatctgtgctctcttatgctgtcaaattttcttcactaatctgggtttttgtaatttgggacttttttttttttagttatttatttagttgactttagtttatttttgttatcttttatgttaatcaaaaaacaaatgtactgtggattagtccttttttaaaaaaaaaaatttgttgtttattttagtagggaaagaggagaatgttttggtactaattgaagtagtattattgttgaaacacattagccatgagatattttattgattactcaaaatattatttcgatcatatttctatctcgtgaaaaanaaaaaaaaanaaaaaaaaaaa

SEQ ID NO: 10641 - DNA, 527 bp, Lycopersicon esculentum
  Predicted polypeptide sequence is orthologous to G1945, G2155
ccgcagcgctgccgtcctcctccgccaacgatggcgctaccattgaagtcatccgccgttcacgtggccgtccacccggctcgaaaaacaaatccaaatccaaactcaaacccagtttcatcatagcaacacgtgatggtcacgtggaaaaacccactatgagtccttacatcctcgaaattcccatcgggattgatattatcgattcgatctatcgattttgcgggaatcaaaatttgggtctatgtattctaaacgggtcgggtactgttactaatgttacacttaaacagccttcaattaacccatctgattctacaattaccttccatggaagcttcactattctttcgatttcagctacaattataccgagtgatttttctccgattccgaacgggttcagtatttcattagccggtccacaaggtcaagttgttggtggaccggtaattggaccgcttttttcagctggaccggtttatttaattgcaacgacgtttaataatcctttttatcacaaattt

SEQ ID NO: 10642 - DNA, 625 bp, Lycopersicon esculentum
  Predicted polypeptide sequence is orthologous to G1988
ctcattcctcttcctcctatatcttttctctccgccccattttcactatcacaaatcaaagcttccaaaatttagaaattgtatacaaaaatggaacttctgtcctctaaactctgtgagctttgcaatgatcaagctgctctgttttgtccatctgattcagcttttctctgttttcactgtgatgctaaagttcatcaggctaatttccttgttgctcgccaccttcgtcttactctttgctctcactgtaactcccttacgaaaaaacgtttttccccttgttcaccgccgcctcctgctctttgtccttcctgttcccggaattcgtctggtgattccgatctccgttctgtttcaacgacgtcgtcgtcgtcttcgtcgacttgtgtttccagcacgcagtccagtgctattactcaaaaaattaacataatctcttcaaatcgaaagcaatttccggacagcgactctaacggtgaagtcaattctggcagatgtaatttagtacgatccagaagtgtgaaattgcgagatccaagagcggcgacttgtgtgttcatgcattggtgcacaaagcttcaaatgaaccgcgaggaacgtgtggtgcaaacggcttgtagtg

SEQ ID NO: 10643 - DNA, 1660 bp, Lycopersicon esculentum
  Predicted polypeptide sequence is orthologous to G2
ataagctgctttaggcttattcttccgaaactagcctcgtctatatccatcatctctctcttaatttttattttttttctttccccaacaacttcaacttctctataagtcataacttccatctttctttcaatttacaacaaaaaaataaataaatcattcttttcttcatttcatacatcaatataggtcacttgcaaccaaatatcgaaaaatacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccaggtaaaatattcggattttcgattaaagaccacaatttggaatcgccggtagttacccggcaattttttccggtagataacgagtctaccaattttccaagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggttttccaagaggaagttccaagtatagaggagtcactttgcataaatgtggtagatgggaagctagaatgggacaattcttaggcaaaaagtatgtttatttaggcctatttgatactgaagttgaagctgccagagcttatgataaagctgctatcaagtgtaatggaaaagatgcagttaccaactttgatcgtagcatttatgaaaatgaacttaactcaaccgaatgtactgataatgcaacggaccacaatcttgacttaagcttaggaggttcaagccaagaaatgggggacaataggggtcaaaattcttcatctaatttgcaattggatggccattggggccaccaagggtcatcaaggcataataataaggttcagactccgagcagcaacaatgtaggccaaattggtggaacaagtaattttcaaaataattatgagataattgcaactgctgcagcatcatcaggattcccccagcagataataaggactcaaaataatggcttccatcattattttatgagaccttgaccattcattaatttcttcatgttcttttattaatctttgtaaagagtaaaatcaattaatgttgagattataattaatattctcaaaacataaacaaacagattatattggtagtatataaaatggttgggaggaaattccaacttcttgggaaaagttaagtgtaccttttttttttttttttggtaaatttattattattattggg

SEQ ID NO: 10644 - DNA, 630 bp, Lycopersicon esculentum
  Predicted polypeptide sequence is orthologous to G2
ttttttttttttttttttgagaattatgtattggtaaataacaacatataagtcacaagatagaccaccaaaaaattaaaaacatttatttagtagctgtacttgtggatggtataaattggcagcttacatgagtaagaaatctagttcaatatctcttcttcagttagctttgtaccaactatatccatagagttggaatctctcaaaagcttttttttaccatcaagattaacccttgtaaatattatattacattatagtttacatcacaaccctccttcaggtgcgtgcggttcgctaactctcttagacgcaaaatattccatgcatcgatcgactgtctcgatagaaaattaattggatggtctggtgagagagtagttaaagccacttttgtgaggccagttttgatgtcttaatatctgctgagggaatcctgatgatgctgcagcagttgcaaataggtgaggaggaggaacagtattgctttgccattgttgagtatctcttctattgctgctgcttggaaactgaacttgataatttgaggaggtgaattgtggtggaatcatttgggagtcaccagctctcatatattggccaaacctttgcatttcattgctattt

SEQ ID NO: 10645 - DNA, 1228 bp, Lycopersicon esculentum
  Predicted polypeptide sequence is orthologous to G2
tcagaagaaggtaaaggtgttggatccatttcaaattcaagttcatcagctgttgaggaattatacggttcagaggaagaagatgaatttctcgaacaaaatggactaaaaggcaagaaaaagaaaaatattcctagtaaaatatttggcttctctatgattgctccacctaataataacaatcacaacgacgataacttgtcgtcggagagtgaaccgccggttacccggcagttttttccggttgatgagtcggaaatcggaagtggcaattttaatgatagatcttgtagatttccaagggcccattgggctggagtgaaattctaccaaccggagccatctgctaattcgccagcactattggggaagggtagtgagttgtcgcaacaagtgcagccaatgaaaaaaagccggcgtggtccaaggtctagaagctcacagtaccgcggtgttactttttatcggagaactggccgctgggaatcacatatatgggattgtggaaagcaagtttatctaggtggatttgatactgcacatgctgctgctcgtgcgtacgatcgggcagcaataaaatttcgtggaatggaggcggacataaactttaacctcgaagattatgaggaagatttaaaacagatgaagaatttaacgaaggaagaatttgttcatgtactgaggaggcaaagtactggttttccgaggggaagttctaagtatagaggggtgacattgcacaaatgtggtagatgggaagctagaatgggtcaattgttgggcaaaaagtacgtttatttgggactctttgatactgaaaatgaagctgccagggcttatgataaagctgccatcaaatgtaatggcaaggatgcagtcactaacttcgatccttgcatttatgaaaatgaacttaattcatctgaatgtagtaataaagcagcagatcacagccttgacttaagcttaggtagttcgagctcaaagcaaaacagccgtgaaatggaggatactaataagaatcaaaattatccttctatccaatttgatgttgattggcgacaccaagggtcgaaacccaagcaacctagtccacttgatatggagtatgggcgaagaagaaatgtgtacaatgagacggaaacgttgcaactctttagccaaacgcacctacattctccgggatccttcaagacaaatagcaatgaaatgcaaaggtttggccaat

SEQ ID NO: 10646 - DNA, 554 bp, Lycopersicon esculentum
  Predicted polypeptide sequence is orthologous to G2
tgagattgaagctgccagagcgtatgataaagctgccatcaagtgtaacgggaaggatgcagttacaaattttgatccaagcatttatgagaatgaactaaactcaattgaatctaccgataacgtggctgatcataatctggatttaagtttgggtggttcaagctcaaagcaaggaagtcaagaattgggggataatagaggtcaaaattcttcatcaataatgcaattggatattgattggcagcgccatggtttaaggcctgagaagcaatctgccttaattgatgctcgaagaagagaaaacaggtacaatgaaacagaaacgttgcaacttttaagccagacgcacttgcattctccagcctccttgaagcataacaataataataatagtcaagtgcaacggtttggccaatttatgagacctggtgatcaatcccatatgattcaaatgtttccacagcaatttggctcatcaaattatcaaattcaatttccaagtggcagcaatggtggaagaattggagctacaaatgtaagagatctatcgc

SEQ ID NO: 10647 - DNA, 989 bp, Lycopersicon esculentum
  Predicted polypeptide sequence is orthologous to G2
gttttttttttttttttttaataaattatagtatttcaaatactacatgagaagctagagcccaaatgtatacaagttacaatgagagagaatgggccaaattggcagttcatagtcagaataaactaatacaagtctagttgaaaagcttgccgatcagttagtattggacaaattaacgaggagacatattttccaaaacattttgtctaccttttttttttcttttctaatttcaaaccaagagccttaggtaatatatatggagtattaagaatatcaaccctttaatctacacattatcttaaaaaaaacacaaatagaaatatggcaagttattaaatgagtcaagaaggtctcatgagtgaatgatggaaaccattttctgaggaccaattctgaggtcttactatctgctgagggaatcctgatgatgctgcagcagctacaaatatctgaggaggaaaattggattgccattgtgaagaaccattactcgtcgccgcaagcgatagatctcttacatttgtagctccaattcttccaccattgctgccacttggaaattgaatttgataatttgatgagccaaattgctgtggaaacatttgaatcatatgggattgatcaccaggtctcataaattggccaaaccgttgcacttgactattattattattgttatgcttcaaggaggctggagaatgcaagtgcgtctggcttaaaagttgcaacgtttctgtttcattgtacctgttttctcttcttcgagcatcaattaaggcagattgcttctggaaattaaaacatgtttgcatcagaggtaaaaattgaatttcacaacgaaaacaagatatagctattgatcgtgtaaatatacctcaggccttaaaccatggcgctgccaatcaatatccaattgcattattgatgaagaattttgacctctattatcccccaattcttgacttccttgctttgagcttgaa

SEQ ID NO: 10648 - DNA, 558 bp, Lycopersicon esculentum
  Predicted polypeptide sequence is orthologous to G2
gaaagaaaagaatagagatagagagagaaaatagaggagaatatttaaaagtctaggaaactcaaaacaagtccttttgtagcaatagccaaaaaattaaattgttttctgtttttataatttggattgggtattttttgtagagagaaaaatgtgggatctaaatgaatcagaagaaggttgttcttcaccgatagagtttgaaggcgatgatgagaaaggtaaacgggtcggatccgtttcgaattcaagttcatcagctgtagctgttgatgatatatctgaagaggaattagatggagaaagagggaagaaaaagagaggtaaaattttcggcttctctatggtgggtctgggtaacggcgatgaagaacagccggtgacccgacagttttttccggttgatgagtcggaaatgggtggtgttgctgctgaaaatggatgcccgaattttcccagagctcactgggttggagttaaattttaccaaacggagacacttggcaacacgggattggccaggcctgtagatatggttcagcagcaacagcagcctat

SEQ ID NO: 10649 - DNA, 596 bp, Lycopersicon esculentum
  Predicted polypeptide sequence is orthologous to G2
tcggcacgagggttagttttaccctactgatgacagtgtcgcaatagtaattcaacctagtacgagaggaaccgttgattcacacaattggccatcgcgcttggttgaaaagccagtggcgcgaagctaccgtgtgctggattatgactgaacgcctctaagtcagaatccgggctagaagcgacgcatgcgcccgccgtccgcttgccgacccgcagtgattatcatgatgatttaaagcagatggggaacttttcaaaggaagagtttgtgcatatacttcgacgacagagcactggtttctctagaggaagttcgaaatacaggggagttacgttgcacaaatgtggacgatgggaagctcgaatggggcagtttcttggaaagaagtatatctatcttggactgtttgacagtgagatagaagctgcaagggcgtatgataaggctgcaataaaatgcaacggaaaggaagcagtcactaattttgagctaagcacatatgaaggtgaattaagtactgaggctgaaaatggaggtgcagaccataatcttgatctgaacttgggaatagccccctctgtattagctgatga

SEQ ID NO: 10650 - DNA, 542 bp, Lycopersicon esculentum
  Predicted polypeptide sequence is orthologous to G2
ttttaccggaagactggccggtgggaatctcatatatgggattgtgggaaacaagtgtatttaggtggatttgatacagcacatgcagcagctcgatattgcggagagactcaaggttttggaatgtgtgatacagtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggttttccaagaagaagttccaagtatagaggagtcactttgcataaatgtggtagatgggaagctagaatgggacaattcttaggcaaaaagtatgtttatttaggcctatttgatactgaagttgaagctgccagagcttatgataaagctgctatcaagtgtaatggaaaagatgcagttaccaactttgatcgtagcatttatgaaaatgaacttaactcaaccgaatgtactgataatgcaacggaccacaatcttgac

SEQ ID NO: 10651 - DNA, 575 bp, Lycopersicon esculentum
  Predicted polypeptide sequence is orthologous to G2
tacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgt

SEQ ID NO: 10652 - DNA, 1366 bp, Lycopersicon esculentum
  Predicted polypeptide sequence is orthologous to G4
gagagaactagttcgagttttttttttttttttttttttttttttttttttatgaaaacaaggatacatacttacatatatcaaacgagtaaattttgaataaattaatacaacacatatatagtcttttagtttggtgataaacgtaaacgcaggcgcaaacttcactcaaatgaagcgttatttacaaaacttagcaagggaagatgtgtatgcagcttagtaggcacctcccattaaagaaggtacatcatcgaaggaccaaaggtccatggcgtttccaccatcctgaattgcacttgtattgaggaaggcatcaaccgatgcatcccaatttccctcgagatatgggatctgcaagaacttcatctgggattcaaaagccgatagctcttcagatagcgtgttcacagtgttaccgtcaactgtcaatgaagtgctggaacaggacttcagttttttctctggtctggaatcatcatcaaaatgagtctcattggtttccagaacttccgacagaacagatgagatctctggagtccttgcacacggttcagggtttcctcacgaagtgccttttggggattttgcttaatagcacgtcttgaaacagacactggagcttcatcaggaaagttcaccttagctttcttgcctctgatccttcgcgcctcagcatcataagctctggctgcctcttcggctgaattgaaagtaccaagccagactcgaatacctttccttggatcacgtatttcagctgcccacttaccccaaggacgctgtctgatcccccggtactgattcttcctctttctcttggaggatctgtcagcttcgcagtttgaatcaccagatctcacggatttggggcctttagaatttaaaaagaattaaccatctcagttagtcataaatgaccaaaatttggaacaatcaatcagataaattgacaaacagataccatgaaagtgagaaacatagaatacgcacgaaaagcaggttcttttatatcactagtactaaagattaccaaaatcaatttatttgaaagttatctatcagtgatcaaaactaaggtaaccaaaatcaatttattcgaaagttatctatcagtgatcataactaaggagagaaatcaagatcaaaatacatgcaaaaatatgttctctgctgttatttacgccaaattatttctctttagctatcaacatcacgtagcacattctccggagataaaaagtttatcatccagagaatcagagttcatcatctagaaaatctgctatatgaatgaccatatcacagtcaaattgagttcaaattaggaaactatgatccaaaaatctctgactcttttgggggc

SEQ ID NO: 10653 - DNA, 1226 bp, Lycopersicon esculentum
  Predicted polypeptide sequence is orthologous to G4
gttttctcttcaaattgagctttttctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggccccaaatccgtgagatctggtgattcaaactgcgaagctgacagatcctccaagagaaagaggaagaatcagtaccgggggatcagacagcgtccttggggtaagtgggcagctgaaatacgtgatccaaggaaaggtattcgagtctggcttggtactttcaattcagccgaagaggcagccagagcttatgatgctgaggcgcgaaggatcagaggcaagaaagctaaggtgaactttcctgatgaagctccagtgtctgtttcaagacgtgctattaagcaaaatccccaaaaggcacttcgtgaggaaaccctgaacacagttcagcccaacatgacttatattagtaacttggatggtggatctgatgattcgttcagttttttcgaagagaaaccagcaaccaagcagtacggcttcgagaatgtgtcttttactgctgtagatatgggactgggctcagtttccccttcagctggtacaaatgtttacttcagctctgatgaagcaagtaacacttttgactgctctgatttcggttgggctgaaccgtgtgcaaggactccagagatctcatctgttctgtcggaagttctggaaaccaatgagactcattttgatgatgattccagaccagagaaaaaactgaagtcctgttccagcacttcattgacagttgacggtaacactgtgaacacgctatctgaagagctatcggcttttgaatcccagatgaagttcttgcagatcccatatctcgagggaaattgggatgcatcggttgatgccttcctcaatacaagtgcaattcaggatggtggaaacgccatggacctttggtccttcgatgatgtaccttctttaatgggaggtgcctactaagctgcatacacat

SEQ ID NO: 10654 - DNA, 1330 bp, Lycopersicon esculentum
  Predicted polypeptide sequence is orthologous to G4
gcaattatacattttccgtcaaaacataaatcatgtgtggtggttctataatctccgattacatagaccctagccggacttctcgccggctcaccgccgagtttctatggggtcgtttcgatctcggtaagaagcaaaaaaatcccaacaattatcactctaaagctaagcatttgcgatctgaagttgttgacgactttgaagccgattttcaggacttcaaagagttatccgatgatgaggatgttcaagtcgatgtcaagccatttgccttctctgcttccaaacactctactggttccaaatctttgaaaactgttgattcagacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagcagtgcttctgcagatacgggatttggttcgttcgtcccttcagctggcggtgatatctacttcaactctgatgtaggaagcaactcttttgaatgctctgattttggttggggagagccatgctccaggactccagagatatcatctgttctgtcagctgctattgaatgtaatgaagctcaatttgttgaagatgccaattctcagaaaaagttgaaatcatgcaccaacaaccccgtagctgatgatggaaacaccgttactatggtacctgaagagcttccagcttttgaacctcagatgaatttctttcatctcccatatatggagggaaattgggatgcatcaggtggtaacttcctcaacacaagtgcaactcaaaatggtggtgaaaatgctatggacctgtggtcctttgatgatgttccttctttaatgggaggtatcttttaagtcaacatgccttgagttttgtaaataaggcttcatgtgagtgattttttgctgttgtataatgtacttagtgcaaatatttgatatgttaatttgatctccgttaacttgttaaaaaaaaaaaaaaaaaaaaaaaa

SEQ ID NO: 10655 - DNA, 613 bp, Lycopersicon esculentum
  Predicted polypeptide sequence is orthologous to G4
ttttttttttttttttttgaaatattaaagcattttgaaccatcaattatcatccacattgatgcaaaatttggaaacttcagcttgttgtcaacagttgttaataaactaattacccacctattggtctatacaaccaaaacagctactcagtacaccatccatggaatcctaaacatgcttgaatggttgtcaacttgtcatcctcctccttaacacagacaccttatcttcacatgaagcccttatttacacagaatctgcaggtaacacatttctcagatgcctcccattaaagaagaaagctcatcaaaggaccaaaggtccatagcattttcaacaccctgagtagcatcagcatcgaggaaggcatcgactggtacatccatatttccttctgagtatggtgtctgatagaacttcaactgggattcaaaagttgaaaatacttcaggtggcttgtgttcagtgttcacattattaggcaccaaattgttggtacaagattttggtttctcctccaggtcgacaccttcaataaattgagcttcatcgcattctatagcagctgacagaacagatgatatgtctggagtccttgaacatgtttctc

SEQ ID NO: 10656 - DNA, 677 bp, Lycopersicon esculentum
  Predicted polypeptide sequence is orthologous to G4
ttttgacagtacttttcacttctcatcggtaccggaaaaagcatgtgtggtggtgccataatctccgattggataccgccgtctcgatcttcgagccgactcaccgccgaccagttatggggttgcgccgatctgcaaaacaagaagaggaacaagaagaagaggaatccttccaattatcactctaagcgcttgagatctgagaatgtagactttgaagctgattttcaggattttaaggatttttctgatgatgaagaagcttatagtttggatatcaaaccatttgctttctctgcttctgaactctctggaacctctgctggatccgaatcactgatatctgttgatgcaaacaaggaagttgagaaatctgccaagagacagaggaagaatcagtatagggggatcagaaagcgtccttggggtaagtgggcagctgaaatacgtgatccacagaagggggtccgagtttggattggaacttttaatactgcagaagaagctgccagagcttatgatgctgaagctcggaggatcagaggcaataaagctaaagtaaactttccagatgaagcttcagtgcctgcctcgaggcaagctggtaaggtgaatcctcggaaggttctttctgatgagagctctaacccaattccacccaacaccatgcttatgaa

SEQ ID NO: 10657 - DNA, 778 bp, Lycopersicon esculentum
  Predicted polypeptide sequence is orthologous to G4
ctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggtaatttctcctctcatctgttctttttttcagcttctagtaggtaggagttccttttagcttttgaaattgttaccatgattttctgaaagtgtgttttttatttgcgtgtctaaatacgtttcatgctctaaaaatcacctcgaaatgatttgattcaatgatattaggaaggatttttggtctgacctaacaagcttgagttggttaatgtggtatggttcatttgtagaacttaatttagttttaagtagtattttggtgttgaatatactgatttaggtgatttggggtttataatcgcggtttcgattgatttttcccctttttagtatgtgaatatacatttaagaggagaaaaaagataacttttgggtataagatgtttgcgaattgtaaaatgaagagtaagatgctgttgttcttcctaattggtcgagaaatgatattttagggcacagcgcatcctaagtaatt

SEQ ID NO: 10658 - DNA, 602 bp, Lycopersicon esculentum
  Predicted polypeptide sequence is orthologous to G4
caaaacataaatcatgtgtggtggttctataatctccgattacatagaccctagccggacttctcgccggctcaccgccgagtttctatggggtcgtttcgatctcggacttcaaagagttatccgatgatgaggatgttcaagtcgatgtcaagccatttgccttctctgcttccaaacactctactgacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagc

SEQ ID NO: 10659 - DNA, 2078 bp, Lycopersicon esculentum
  Predicted polypeptide sequence is orthologous to G5, G974
ccgggctgcacgaattcggcacgaggaagagagtgaggctgagagagatatactcatcaatatttttctcacacctgcacacaccacacacttaaaaattaaaaatatttcaaaatatttcttttgattttctttttttcttcttcttcttcttccccatttctgtaatcatcccgcttctttgatccctttctgtaaactatctgtgttttttcaagaagtttttctgacttttgagtttgtgattttcatgtttttgaacttaaaaatggagaaaatgcaaacttttaattagaggaaaaagattttttttacaaactcaggtgttttcagaatcgagatctagtaaagtataactcagtatagttcctttttttttctttttatgcataatcagattagagggctttattagttgtcccctatagtttgatttgtttttaaaggagaaaaatagaggttgttatttgaagacctctgtttttttttcttctgtttatagtgaaatcacttacctgtgttctttttatttgataagaaacaggttgtgtgaatttttatttttttttcgttgtttagatatggcagctatggatttttggaatagtacatgtgtagattttgaattatcatcagaacctgttacttctggtggtgaattaatggaagctcttgaaccttttatgaaaagtgcttcttcttctccttctcctccaccttctacttttcctcctgttttcccttcttcttcttcttcaacttttccttcttcagattttcaatcttttccttcatttcctcctccaactcctcccatttcatatccctacacttcttctttttacccatctactatgagctctgaggtttgttccacttccacagagatgaattcccaaatcttttcaactgggttttctgggtatggaatggagcaacagggttcaattgggctgaatcagttaaccccaattcagatccagcaaattcaagctcaaatcaactttcaaaaccaacaacaacagcagcagcagcagatgatgttacagactgcccatcatgcttccaccatgaatttcttggctccaaagccggttccaatgaagcaatctgggtcgccaccaaaacccacgaagctctacagaggtgttagacaacgccactggggtaagtgggtcgctgagatccgtttgcctaagaaccgaacccgcctttggcttggtacatttgacaccgctgaagaagctgctctggcttacgacaaggcggcgtatatgcttcgtggcgactttgctcgactgaacttccctcaactccgccacaacggcaacctaatcggcggcgactttggtgaatacaatccattgcattcctcagttgatgctaagctaaaggacatatgccaaagcttggcacaggggaagagcattgactctaagaagaagaaaaccaaagggttgtcggcggagaaagcggcggtggtgaagatggaggaagaggagagcaaaacagcagaagttggatccgaaagtgacgggtcccattccggttccggtggatcatcgccggtgaccgaactgatattcccggagttcactgaggaagagccaacttgggacatgtcagaaaattttttgttgcagaagtatccatctcatgaaattgattgggcctctctataaaattagaaaataattaagaaaaaaattagtagtaattatcaaattaagtctaggtttaatgaggtcttatgtattttttttttttttgtatttttgcattgtttataattgttaatggtggttctaggtcactaggtccatggaacattgagtcactgcaatggagtttttggcaattgcagggcaagttcctttgtagtttttttcttcttcatattttaggtttataaaaatccaaattggttaagctaatgttttttgtcttggctaggccagtggatttttgttgcaatgtaatgtcatggttgtaatctttatttagtgtcaatatttcattagtattaattctatcttagcaaaaaaaaaaaaaaaaaaaactcgagactagttctctcc

SEQ ID NO: 10660 - DNA, 1803 bp, Lycopersicon esculentum
  Predicted polypeptide sequence is orthologous to G5, G974
gagaacccccatcggagagtgaaaaaaaatcagtgaggctacctaaaatattgtgtgtgtatttacattttctttcccccccccccctctctaacatcccgcttctttagatccctttctgttgtcgtctgtctttcaatttcagaaattttatacaaaaatcaaactcccttttaggtgttttgtttttgaaagccaggtgatccagaacagagatcaacgttctctttttattttttaaattgttcaaacaaccacaagggtctgtttttcgtatccctaaaggttggtttttttgatttgtagaaagctttgtaaaaatctctacctgttgtgtagttttgatattagaaagaggtaatactttttgtgtgttttgatattaaccatggcagcagctatagatgtatacagcagcagcagtaacttgtcagatcctttaacagaagaacttatgaaagcacttgaaccttttatgaaaggtgtttcttattcttcttcttcttcaccttcaacttcgtcttcttctttctatacttttggtgagcctaatttgtatactgatttctgcacaatcccatcaacggctacccaaatgttttctcaagggtattcgtgttttgacaatatgggtgtagctgaaacaggttcaattgggcttaaccatctaaccccttctcagatcttgcaaatccaagctcagatccaatttcaaaatcaacagcaacaactacaactattacatcaacaacaacagagcttaggtttgttaacacccacttcaacatattctaagaatctgaattctactaactttcttggtatgaaaccagtcccaatgaagcaaacgggtgctacttcttcacagaaggctactaagctttatcgtggagttagacaacgccattggggcaaatgggttgctgaaattagacttcctaagaacagaactaggctttggttaggcacttttgatacagctgaagaggctgctttggcttatgacaaagctgcttataagctaagaggtgagtttgctaggcttaattttccacatctaaggcatcaattaaacaatgaattctctgatttcaagcctttgcattcctctgtggatgctaaacttcaagccatttgccaaagcttggctaatcccaaatcagatgactcgtgttctaaatctaattccaagccaagaaagtccaaaactgcagcagtttcagtggattcaaattcagctcaagaatcttcatcaaagtcagaaatcaccacagatgattcattgaaagaagaattcagctatccagaaaatggtactatcaagattgaggcttcatcatcatcatcaccccctacaccctctgaggaatcatcatcttcgtctgagtctgatattactttcttggatttcgctgaaccatctttcgatgaatcagaaaacttctttttacccaagtacccttccgtggagattgattgggcagctctttgatactttattgtagtattactttttttttttttggatatatcatgtatggtgtcaagtatggcctcctgcaatggtgtttttgacatttgcagaggttggtgtagtagtgaatagagtcatgtaatagtgaaggttgctcactctccgtcttgttcatgctttggtttttgtatatgcattgaaccaaaagggagagactttgcatcatgtatgtgtcttgttcatttcttaacttaatataatcatatctaatgttttagtatgtaaaaaaaaaaaaaaaaaaaaaaaaaaaaaaaaaactcgaggggggg

SEQ ID NO: 10661 - DNA, 506 bp, Lycopersicon esculentum
  Predicted polypeptide sequence is orthologous to G8
tttttttttttttttttttctaaaaattatccaatccacaaaaatgttattcatacaaaagaaatcaatgactatgtttatacctatattactagttacggataagtacatgttatggaagtggtaggcggggattaatctggtaaaagcactgcgaggcatttgttgaagttgctaatgcagatgttgatgaagtgatagaagtagtagatggaatgaagaatcctgatgatgctgccgtgcagaacattgtcaatgggctgtttgtatcaacctgactaggcatttgcagtgcccaatttggaggtccttgtgatgaacctgtgtcctttctcttgtcatatgctcttccctcatagctggaagagaaattagaatagattccagtccacaattgagcttgttgggacgacattggtagtcccttgagatgtgaacttccaactattactgaaccaggtttatccatcttaggttttgttgcgtcttgcatatcgtaaggatga

SEQ ID NO: 10662 - DNA, 625 bp, Lycopersicon esculentum
  Predicted polypeptide sequence is orthologous to G8
aggtggatttgacactgctcatgcagctgctagagcgtatgatagagctgcgattaagtttctaggtgttgatgctgatataaactttaaccttagtgattatgaggaagatatgaagcacatgaagaacttgagtaaggaagaattcgttcacgtgctacgacgccagagtactggtttttcgagagggagctcgaaatatcgaggagtaacgttgcataaatgtgggagatgggaggctcgaatggggcaattccttggaaaaaaggcgtatgataaggccgcaatcaaatgtaatggaagggaggctgttaccaacttcgagccaagtgcatatgaaggggaaataaactctaaccctcacagtgaaggtagccagcaggatcttgatttaaacttggggatcgcaacttcttctgcgaaggaagttgaaaggtcttcgagtttccagtatcatccttatgatatgcaagaagcatcgaaatcacagatggacaaatctggttcaccgatagttggtagttcacattacaaagcattacctgcagtaacatctgaacaagctcacttgtggaatggagcatatgccaatttaattcccaactatgaagaaagagtatccggg

SEQ ID NO: 10663 - DNA, 722 bp, Lycopersicon esculentum
  misc_feature (697)..(698): n is a, c, g, or t
  Predicted polypeptide sequence is orthologous to G12, G24, G1277
ggcttatgatacggcggtctattatctaatatgcccttcggcccgattgaattttcccgagttgttagttggtgatggtgggcttaatgatttgtctgctgcttcgattcgtaaaaaagccatagaagttggtgctcaagtagatgctgtacagaactcgcttgcaacccatcataaccatacagaggaaaaggtgcactctgagacggcaagcccctcagaattgaagccttgttggtttcaagagaagcccgatttaaacttgaagcccgagcccgaagatccagaagtggattactggtaatatttagttaatatcgatattaccaataacagtatctctactagtgtaatttttaattatttttttggctttttgttggttgggggaagaggaagtgctttggtaagaatacaagcgccgctccaggttgtgtagcttggtagcctaggattgttatattcttaaaaagaaaaaactatcacctctttctttaattttactttatttttaagaacaaattatcagctgaacagttttggtgttgtaagatgtaaaggggatttgtgttatcattttgtctaatcgcaattctggttgtacttttgcttggttggggtcttttagtggtgggggaaacaaatgttagtgtgaatgatggattatgcatattggtcatcttgaagactaaccaanngtttattatttggggaaaaatgat

SEQ ID NO: 10664 - DNA, 634 bp, Lycopersicon esculentum
  Predicted polypeptide sequence is orthologous to G12, G24, G1277
aaaaactaacaaaacaagtgaatatatttaatttttttcagtatgatggaaggagagaagagaaaacagaggcaacaccagcaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaatgtatagtggatgaccatgaaattcacgatctatcagctgcttctattagaaagaaagctactgaggtaggtgctcgagttgatgctctgcaaactgcgattcacaattctactgttaattctgttgaatcaaactgtaattcgaattctaaatctacaaggatgatgatgaagcctgatttgaatgaatatcctagcccggaaagttgcgacgaagataactgaatctctgcgagttaacagaggccaagagggggattatttttatgttgattagatatactgaggatccatgtatgaaatataatccgaagggattatatgttaatattatcaattatgatagttattaaaggaaatttaatct

SEQ ID NO: 10665 - DNA, 468 bp, Lycopersicon esculentum
  Predicted polypeptide sequence is orthologous to G12, G24, G1277
gtgaattctctataccatgtgttgctagataatggctagttcgctgtttaatgttctttttgtttggaaattgttctcacgatttcataagttgagtcgttcatttcaaaaaaaaagaacattaaacagcgatcttcattcacttccagcttttgccttttcatgggtattctttctctctctcccagtttagctctagattacagggaaacaaaatttttgtaattcagtccctgtaatttcacataataattattatacagtcaaagatggagataggtggtgggggtcaaagtggagttgctgcaaattcaggggtttgttgtggtgggaagagaaagaacgaaaagccctataaagggattcgtatgaggaagtggggaaaatgggttgcagaaattagagaacccaacaagcgttcgaggatttggttgggttcgtattcaacgccggtggctgcggctcggt

SEQ ID NO: 10666 - DNA, 498 bp, Lycopersicon esculentum
  Predicted polypeptide sequence is orthologous to G15
taagttcttttaatgattgtgaactgtcttgaactatataggagaagagaactatttgtaacggacaaaaacctcaacaactgaatgaagatgaagtctatgaatgatgatcgcagaagtagcaacaataatatcggtaataataaccgtgcggtagcttatcctaactggtggggtttttctctcacaccccacatgaaaatggaggttactaattcttctgatactcaacatcaacatcaatttgcacaaagttactatctttcatcttctcctcctccaccaatgaatgtatcaacaacctctgctctctgttatgaaaataacccttttcattcaaccttatctgtcatgcctatgaaatctgatggttctctttgcattatggaagctctatcaagatctcatgctgatgctatggtgcaaagatcttcacctaagcttgaggattttttaaggggtgcaagtatggggaatagtcaatatggaagtcatgat

SEQ ID NO: 10667 - DNA, 554 bp, Lycopersicon esculentum
  Predicted polypeptide sequence is orthologous to G15
gcctcgtgccgcggagttctagagagagagagagagagattgaggtcaaattgcttcatagttataatgagtaattggttggggttctctcttactcccgatttcagaatcgatgatgatgatgaagaagaagtaaaaaattacgaaaggcgaaacgaagctgctgaaaatacttctttgtcggtcatgcctttaagctctaatggttctctatgtatgatggatcctttcccacgctgtgaacccactgaagattgttggaggtatgagaatcatgaaatgagtactgctaataatccagaagaagagggtccgaaacttgaggatttccttggatgctgttactcaaattctcttcctaatgaagaacaacaaattgctgaaatcaacgttaatattccacccagcataaatcaatctgatcacgaacagcaccagttagaaattggagcgaacatgaaattgattccgtctccacagatgatgattcaaaatagtcaatttcagagctctcatcatgagtttgtgaactctactgatagtgtctatcatct

SEQ ID NO: 10668 - DNA, 329 bp, Lycopersicon esculentum
  Predicted polypeptide sequence is orthologous to G15
ctgtccacaggaaatccattgacacatttggtcagagaacttctcagtatagaggtgtcactagacataggtggacaggtaggtatgaagcacatttatgggataatagttgcaagaaggaagggcaaaccaggaaagggagacaagtttatcttggtggctatgatatggaagaaaaagctgcaagagcttatgatctagctgcactaaaatattggggtccttcaactcacatcaatttcccattagaaaattatcagaaagaacttgatgacatgaagaatatgaccaggcaagaatatgttgcacatttaagaaggaaaagtagt

SEQ ID NO: 10669 - DNA, 1101 bp, Lycopersicon esculentum
  Predicted polypeptide sequence is orthologous to G19
ctcgagactagttctctctctttcactcagaaaacaaaaagaaaaaaaaaagagttagaaaagatgtgtggaggtgccataatctccgattatgatcccgccggaagcttctaccggaaactttctgctcgtgacctctgggctgagctggaccctatctccgactactggtcctcttcttcctcatcctcaaccgtcggaaaacctgattccgctctgtcgccggtgactcactccgtcgataagcctaataaatcagattccggcaaaaaaggtaataagactgtgaaggttgagaaggagaagagtagtggaccaaggccaaggaagaacaagtacagaggaataagacagaggccatggggaaaatgggctgctgagattcgcgatccacagaagggtgtacgcgtttggcttggtacattcaacacagcagaagatgctgctagagcctatgatgaggctgctaagcgcattcgtggtgataaggctaaactcaactttccagccccatcaccaccagctaagcgacagtgcactagcactgtcgctgctgctgatacaccaccagcactactccttgagagttctgacaactctcctttgatgaactttggatatgatgtccagtatcagagccaaactccctactaccccatggaaatgcccatagttagtgaagattatgaactgaaggaacagatttccaatttggaatcgttcctggaattggagccatctgatcaattttcagggatcgtcgattctgatcctcttaatgtttttctgatggaggactttgcttcaactcatcatcagttctactgaacatgatcaaagtgttatttcgggagtattttatggctgagtagtttattaattagcttttgggtgtagtagtagtaatagtagtaatagagattagagagtacatatgatgataataataataagttgcgtgccttagcatgcaattgtaatagtattagtgtttgttgtcttgtgctgttgtttatgcttttctaaatcttggatttaccttataatgtttggtgcatgtattttaactatatatatatatatatatatatatatatatat

SEQ ID NO: 10670 - DNA, 571 bp, Lycopersicon esculentum
  Predicted polypeptide sequence is orthologous to G19
ctgaaactaaaacaaaacttttctatacatttttcatttctgtatcaatcaatattctttgtttctgctgttttgagtaaatcacactaagatgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtactagttaatcatatataaagcttaatttgttgattttgtttttatgctcatttaggcatttcaacaaacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaaca

SEQ ID NO: 10671 - DNA, 590 bp, Lycopersicon esculentum
  Predicted polypeptide sequence is orthologous to G20
ggcttcaaatgctactctgtttactttaatttcagcttccttaaattctttctgctccaggactgtgttgcttatggcttccctttcctctgagcctactgccaagactgagggtagcagtggcaatgatgctggtggtggagaaacatcagaagctatggggcatatagggactgatcaactgttattatatagaggactgaaaaaagcgaaaaaagaaaggggttatacagccaaggagcgcataagcaaaatgcccccatgtactgcagggaagcgcagctccatctatcgtggtgtcactaggcatagatggactggtcgttatgaagctcatctttgggataaaagtacctggaatcaaaaccaaaataagaaaggaaagcaagtgttattattgcatggacattgggacacttattgctgcttgatcgggatggacagtttatttaggagcatatgatgatgaggaggctgcagcaagagcatatgatcttgccgctttgaaatattggggtcctggaaccctcattaatttcccagtgacagattacacaagggaccttgaagagatgcaaaatgtctcaaga

SEQ ID NO: 10672 - DNA, 731 bp, Lycopersicon esculentum
  misc_feature (640)..(640): n is a, c, g, or t
  misc_feature (677)..(677): n is a, c, g, or t
  Predicted polypeptide sequence is orthologous to G20
accacaatcatgcttctatacattcttcataaactacatgtggagaactctatagcatggaatgataagactcttaaaaactcagatggacaaatggaattgctagagcaacattgcagcaacttgaaaaagataaataaactagagacttattttacaagtactggaacaacatttaggtctataaagttcataatggaccaaaagaaaaaaccctgtcaaaagataaaagtgtgtatgcctatgcttcacaagactgcaaacttacatgtacaggaaagtttgtatctcacttgtagaggcgaaggttaatcttcttgttgaaataaagtataatctgaactggcttcgctcttgtggacctcagcagtccgtgaagaacctgtatgaaaattaggaacaatagatgtccaaagaacagggtctgttaagggatctatgctgttgtagttagtgagaagtggtcctgacaggagtggagtaagtgggtgcaagtttctgttaatagataatcccccagcattgagaaatgcagctccaagcctctcacttccactatcaggacttgatttttctatcatcttcccacggtcgactctgttgatagtgcttttgttttcattctcatcattctcaactntttctttctttttagcaaccttctctactaaactctngtatgctgcagactgtgacaaaatgctcacagcaggataatgttgagcttttat

SEQ ID NO: 10673 - DNA, 575 bp, Lycopersicon esculentum
  Predicted polypeptide sequence is orthologous to G21
ttttgtttctattataatatatgatcctttctactttctttacttgctacaacaatacttcacaagaaagacaataagctacaaccactttagctaaagaagaaaaaagttatgaaaaatcaagaagaaataatcaacctcaaaaatcgtcatgatttcatttctaatggcttgagttttccttcaaatatcgcgacatcaccatcatcatcatcttcttcttcttctttttcctcgaataatgcattagtttcaaaaaagtgtcagagctcgaagaaaattgaagaagagaaaaagaaaaagaagataaataatgatgacgaagataagcacccaacctatagaggggtacgtaagaggagttggggcaaatgggtgtccgaaattcgcgaaccaaaaaagaaatcaagaatatggctaggtacttatccaacggctcaaatggcagctcgagctcatgacgtggcagctttagccatcaaaggatgttcggctcaccttaattttcctcatttggttgatcaatacccacatccggcttccacttgtcacaaggatatccaagcagcagccgc

SEQ ID NO: 10674 - DNA, 743 bp, Lycopersicon esculentum
  misc_feature (722)..(722): n is a, c, g, or t
  Predicted polypeptide sequence is orthologous to G21
catcaatctcccattattttcaataactatcaaacaatttcttcttcatctctaacaaaaagatcaatatccttgaaatcatcgaaacaacaaaccaatcaaaacaagaaaatcaaatccagtactgaaaaaaccaagaaaatggacgattcaaaacacccaatttaccacggtgttcgaaaacgaagctggggaaaatgggtgtctgaaattcgcgagccgaggaaaaaatcaaggatttggcttggtacattttctacagctgaaatggctgccagagcacatgatgtagctgcaattgccattaaaggtcacttagctttactcaatttccctgaattagctcatcaatttcctataccatcttcgaaatgcgctaaagatattcaatctgcagccgcaaaggctgcagctttgaatatttcaccaagaaattttatggaaaaacagagtacagatgagttaatggaaatgccctgttcttctgaagaaacagagtcagcagaatcatctttgacgagtaatagcgaagacccttttcttgatttgcctgatcttcttatggatctcactcaaaaatttgataaattctgttactataattcaccgtgggatttggctggagctgtaagcttttggcctcaagaagagctctattcgtgggattacaaccatgaaactgaaaccccactcgaagtttcacagccataatactataattnttcgatattccaacaattaaa

SEQ ID NO: 10675 - DNA, 440 bp, Lycopersicon esculentum
  Predicted polypeptide sequence is orthologous to G21
gccgccgctgccaaagctgcagccgccagcatatttcttgaggagaattcggttgagtcgagccagttaaccgggctgcacagctcgcattcctcgactaatttagcctcagataacgtacaagaattactaaattctccctcgatggatcacgatgacccgtttttcgatctaccggatcttatcatcgatagactcgaccaaaatgaccggtaccagtacccggtttcgacgtggcagctggctggagccgatagcgggatgtttcggcttgatgagccgtttttgtgggagtgctattagaggaaattataagtgtactcttgagaagagacctgtttatttttcttttcttcttttacacttgacaacaaaagtcataaaacatccatcgtgtgtgtatttctcaacgtatcataattaatgttcatatcatacgc

SEQ ID NO: 10676 - DNA, 394 bp, Lycopersicon esculentum
  Predicted polypeptide sequence is orthologous to G21
cacactccaatttcctctctcccaaaaatacttcaatttttgtctttttccatgtttcattcccattcttctctaaagtagaaattgacacatttgattatttttttctcccctgttttcataaaggaactcttcgatcctaatatattaatacagtatgtcagaattcaattgatcataaatatttctctttcttctcaacatccatcttataataattcgtatttataattataagattaaagttaaggtatttactattcgaggaaattatactaattaaatgtcaaagcgaataagagagagtgatgaaaaaggtaataaacacccaatttatagaggagttcgtatgcgaagttggggaaaatgggtgtctgaaattcgcgaaccgcgt

SEQ ID NO: 10677 - DNA, 1090 bp, Lycopersicon esculentum
  Predicted polypeptide sequence is orthologous to G25
ccaacccccctccctccaccactacaaatacctccccatttctccccacaccaaaaccaaaactgaaactaaaacaaaacttttctatacatttttcatttctgtatcaatcaatattctttgtttctgctgttttgagtaaatcacactaagatgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaacattgcttgtgatactactgttacttacaatcaagaatcaaataactgttaccccttttactcaatcgagaacgttgaacctgttatggaatttgcaagttataatggaattgaagatggaggagaggagatggtgaaaaatttgaataacagggttgtagaggaagaggagaaaacagaggatgaagtgcagatactttctgatgagctgatggcttatgagtcattgatgaagttctatgaaataccgtatgttgacgggcaatcagtggcggcgacggtgaatccagcggcggagaccgccgtgggcggtggctcgatggagctttggagttttgatgatgttagtcgtctacaaccaagttataatgtagtttaattattgttttgtttaaacttttcataattttattttatcgaattaggaagaattgagtttttataatttaatcaattgtgtaaaactatgtttctaattcattaatattatattggatatgttgaaattaaaaaaaaaaaaaaaaaaactcgag

SEQ ID NO: 10678 - DNA, 1397 bp, Lycopersicon esculentum
  Predicted polypeptide sequence is orthologous to G43, G46, G1419
ggttcaattaccaacaatatttttcaagaaaaaaaatggattcttcttcactagaaatgataagacaacatcttcttgatgatgttgttttcatggaaacttgttcttcttcttcttcttcttcattagaaacaacaagtagtacactttattctcaaacctcatcgaattcggaatctttagaatcattaacctctgagatcaaacttgaaagcaatttctctgtttatcctgatttcatcaatacacctcaaagttcaaatcttgaatctgtctctcgttttttcgataactcaactattgaattccaagctaaaccccaaaagaaaagaagtttcaatgatcgaaaaccttcgttaaacatttcgattccttctgttaagaaaacagaggaaccaaaaacaggggaagtaaaaacaggggaaccaaaaacagaggagccaaaaacaggggaagtgaaaacagagtactctgttaaggagaaaatggtagaaaattcggagaaaaagcgatacagaggagtgagacaaaggccatgggggaaatttgcagcggagattcgtgacccaactagaaaggggacacgagtttggttaggaacattcgatactgcaatggatgcagccatggcatatgacagagcagcatttaggctcagagggagtaaagcaatcttgaattttccacttgaggtaagcaatttcaagcaagaaaatcatgagattgagaaaaatgttgtgaatttgaattcgaatacgaattcttgtgggaaaagggtgagaggggaaatggagaatgatgacggaattgtaatgaagaaagaggtgaaaagagaacaaatggtggcaactccattaacaccttcaaattggtcttcaatttgggattgtggaaatggaaaaggtatttttgaagtgccacctttgtcaccattatcaccacattcaaattttggttattctcaacttttggtatcatagtgaaatccccaaaagaatccacttgagtatgttatggaatattatatagcggaactatactgccatcacgatccactgagatttagtcttttgttatgttgagagtttctaaaatgttatggcagaactatattactgtcacaatccactgagatttagacctttattgtgtcgatccactgaaatttagtcgagagtttctaaaatgaaatattttgaacaagtatgaagtgatttcaagttgtaataaggaatttacctcttggaaattttggataaaaatagcacatgtacaaatgaagaaacatggaatgatggagggagaatggaagtgttttgaatcatggatatttttaattattttttgatttcattgattaagctttttttttttccatgtgaatatgaattttaatt

SEQ ID NO: 10679 - DNA, 878 bp, Lycopersicon esculentum
  Predicted polypeptide sequence is orthologous to G43, G46, G1419
gcacacaaacaccttcactagaaaaaattcagattcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaattttgattaacaaatttgaattcctaaaaatgataatatgttattatactaaaaaaaaaaaaaaaaaa

SEQ ID NO: 10680 - DNA, 559 bp, Lycopersicon esculentum
  Predicted polypeptide sequence is orthologous to G43, G46, G1419
tttaaagaaaaaaatgggttctccacaagagacttgtacttcacttgatttgattaggcaacatctttttgatgaatctctggaccagacttgtttctcttttgaaacaactcaaacttcaaatcttgatgacatcgcaagcttctttaatgctacttcaaaaacagagtatgatggttttttcgaatttgaggcaaaacgacatgttatccattcaaattctccgaaacagagtaacttgagagaacggaagccatctctgaacgtagcaataccggcgaagcctgttgttgttgtagagaacgttgagattgagaagaagcattacaggggagttagacagaggccatgggggaagtttgcagcggagattcgtgacccaaatagaaaggggactcgagtttggttaggaacatttgatactgctgtggatgcggcaaaggcatatgacagggcagcgtttaagcttagaggaagcaaagcaatattgaatttcccactcgaagttgcaaactttaagcaacaaaatgatgagactaaaacagagatgaagtcgtca

SEQ ID NO: 10681 - DNA, 434 bp, Lycopersicon esculentum
  Predicted polypeptide sequence is orthologous to G43, G46, G1419
atctcccttatggtaaagtatataaaacatggagaacgtaatattcttagtcctgaaactgattgcatctattcaatatgttgtatctccatttagaagcaaaggacccatgagaacgcatctttatctgcatttgttaagtatttaaagatgatttgatttaggatatgtttatctgtttggttgggtcggtatttgtataaaccagttgcacgaatcgaccattggtttttagatatgctctcctgtgaaccgaactgataagatatcggttggttcggttttccgagcagtttgggtcggacatgaatctctgctgcaaatgttccccatggtctttgccttgcttactctcctctgtagcgtttcttctccaaggtatctttcactttatgaacaaagtactctgttgcttactccattttcttgacagg

SEQ ID NO: 10682 - DNA, 497 bp, Lycopersicon esculentum
  Predicted polypeptide sequence is orthologous to G45
cctaattatattttgtgtctaaaacttattatttcttctattacaaagaggataataaactatccaaataatcacttccaagatcctcaaactctaggatatccaagtcattaaaaagatcctcctccatgcttctcataattttcttctccataggcaattgattaatttcatccaaattttcatacatgttccaatcccttgatacccttttccttgaattatattgacttgatgatgaaaaggtccattctttttcacaaggaccattagatattcctatagcttgagcaaccatttcatgtggaaaattaagataggccttgggacctctaattctcaaagccgccttgtcataagccatagcagcttcttcagcagtactaaatgtccctagccaaaccctagctccttttcttgatgaatcccttatctcagccgcgtattttccccatggcctccttcttacccctctataatgcaccatcttcttcttc

SEQ ID NO: 10683 - DNA, 1406 bp, Lycopersicon esculentum
  Predicted polypeptide sequence is orthologous to G129, G136, G140, G146
gagatgaagaaaaatgaaaaatgtccaagaaatgagtgatcatccatcctctcattagataattcccaatttaaccatccttctatatagtgcttattcaaaacaaagataacataggaataaacagacaatgaaaaatcttagtttagataattagtagtagtaacataacataacatagttgttatatatatatatatatatataatataaaaataaaagtaaacactcttttactttataaatacctatcccttagtccaaagtctcttccattttctgcatctacaaaatcctcttcatatattatatactaatttgcaaccaaaaaacttaaaaatcttctctttcctttccttacaaggtgaagtaatggacttccaaagtgatctaaccagagagatctcaccacaaaggaaactaggaagggggaaaattgagatcaaaaggatcgaaaacacgacgaatcgacaagtaacattctgcaagaggcgcaatggtttgcttaaaaaggcttatgaattgtctgtgctctgtgatgctgaggttgctttggttgtcttctcaaacagaggcagactctatgagtatgccaacaacagtgtgaaagcaacaatcgagaggtacaagaaagcatgctcagattcctcaaacactggttcagtatccgaggccaatgctcagtattaccagcaagaagcctccaaactgcgcgcacaaattggaaatctgatgaaccaaaacaggaacatgatgggtgaagctcttgctggaatgaaactcaaagaactgaagaatctggagcaaagaattgaaaaagggattagcaaaatccgatccaaaaagaatgagctgttgtttgctgaaattgagtatatgcagaagagggaagttgatttacacaacaacaatcagtacctgagagcaaagattgctgaaactgagagagctcagcatcagcatcagcagatgaacttgatgccagggagttcatcaaactatcatgagcttgtgcctccacctcagcaattcgatactcgaaactatctacaagttaatggattgcaaaccaacaaccattaccctagacaagaccaaccccctattcaactagtctaatgtgcttgagagattgtcttctttctgatgtgatctacatataatccccaaaagaagactgctattaagcttgaagattaatggaacttaagtatgtataccatattattaattacttgttgcatgagctaagactcttgaatattgtatgttaattaagtggacatgtattttttttgcttggtgtacttccttttctgccagtgaactatgaagaattaagcttgttatattaagttcacaactgtttttctgtcccaaaaaaaaaaaaaaaaaaaaaaaaaaaa

SEQ ID NO: 10684 - DNA, 635 bp, Lycopersicon esculentum
  misc_feature (617)..(617): n is a, c, g, or t
  Predicted polypeptide sequence is orthologous to G129, G136, G140, G146
gagtctttggaagttgtgtgagttttcagaaagcctttgaagttcgccggaaaatagcaatattttcaattcaagccaatcagatgggaagaggaaagatagagataaagaggatagagaacaacacaaacaggcaggttacattttgcaagagaagaaatggattgttgaagaaagcctatgaactctctgttctatgtgaagctgagattgctcttattgttttctccacacgtggacgcgtctatgaatactctaacaacaacattaaggcaactattgaacgatacaagaaggcaactgctgaaacctctaatgcttgcaccactcaagagctcaatgctcagttttatcaacaagaatcaaaaaagctgcgccaacagatacaaatgatgcagaattcaaacaggcatctggttggtgaaggattaagttgtttgaacgtaagagagctgaagcagttggaaaatagacttgaacgaggcatcagcagaatcagatcaaaaaagcatgagatgatactggctgaaactgagaatttgcagaagagggaaattctactggaacaggagaatgcattccttagatcaaagatagcagaaaatgagaggcttcangaactaagcatgatgcca

SEQ ID NO: 10685 - DNA, 667 bp, Lycopersicon esculentum
  Predicted polypeptide sequence is orthologous to G129, G136, G140, G146
gcatatcttatccattcaactcactcagatcgatcgattcgatcgatgggtcgaggaaagatagagataaagaggattgaaaacaacacaaatcgacaggtaacattctgcaagagaagaaatggattactgaaaaaggcatatgaactttcagttctatgtgatgctgagattgctctcattgttttctctactcgtggtcgactctatgaatactctaacaacaatgtaaaggcaactatagaacgatacaaaaaggcaacagcagaaacgtctagtgcgtacactactcaagagctcaatgcacagttttaccaacaagaatcaaagaagttgcggcaacagatacaaatgatgcagaacacaaataggcatctggtgggtgaagggctgagctctttgaatgtgagggaactgaagcaattggagaacagacttgaacgaggcattacaagaattaggtccaaaaagcatgaagcaatactagctgagactgaggatttgcacaagagggaaattcaacttgaacaggaaaatgcattccttagatcaaagatagcagaaaatgagaggttgcaggaactaagcatgatgccatctggtggggaagagtataatgcatttcaacaatatttagcaagaaatatgctacagctcaacatgatgg

SEQ ID NO: 10686 - DNA, 884 bp, Lycopersicon esculentum
  Predicted polypeptide sequence is orthologous to G129, G136, G140, G146
gggtagattttctttctttctttctatacccaatctttgctatatcgccatttttttcttaattttaataatgaaaattgttgttttttcttcttttggatgctacaaacacatacacaaaaatatttttaatttttttttgttagactataatttccctgattgagtgtgtaatttagctaacgagatcgcgatatttgttttgcttttttcagttttttttttcttcttttcgatacaagacgatatggtttttcctattaatcaggaattacttgtcgatgagtcgtcttctcagttgagaaaaacaagtggaggaactggtggaggaggtagagggaagattgaaattaaaaggatcgaaaatacgacaaatcgacaagttacgttctgcaagcgtagaaatgggctattgaaaaaagcttatgaactttctgttctttgtgatgctgaagtttcactaattgtattttccagccgcggccgtctctatgaatatgccaataacagtgttagggcaactattgataggtacaagaaacaccatgctgattccactagtactggatctgtttctgaagctaacactcagtactaccagcaagaagcatccaaactgcgacgacaaattcgagatatacagacttataacaggcaaatagttggagaggcattgggcagtttaagccctagagacctcaagaatttggaagggaaacttgaaaaggccattgggtagagtccgttccaaaaagaatgaattgcttttctcagaaatagagctcatgcaaaagagggagattgagctgcagaacgccaacatgtatctacgcgcaaagatagcagaggtagagagagcacaagagcaaatgaacttgatgcct

SEQ ID NO: 10687 - DNA, 818 bp, Lycopersicon esculentum
  misc_feature (771)..(771): n is a, c, g, or t
  Predicted polypeptide sequence is orthologous to G131, G135, G155
attaaaacctctttctcctacctggggagatccttccacttcccaataacgatacagttttttaatttatcatttgccaaaaacaaagaattactaaacataaatatccatttccattacacaatatacatatatatacacacacaaagaagaaagaagaaagaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttgcatggaaaggattcttgaaaggtatgaaaggtactcatatgctgaaaggcagcttaatgctactgatattataaccccgggtagctggactttggaacatgctaagcttaaggccagacttgaggttttgcaaagaaaccaaaagcattatgcaggagaagagttggacacattgagtatgaaagagcttcagaatctggaacaccagctcgattctgctcttaagcacattcgatctagaaagaaccaattgatgcatgaatccatttctgagcttcaaaagaaggacaaggcattgcaagaacaaaacaacaatctttcaaagcaggttaaggaaagggagaaagagatggcccaacagactccgtgggagcaacagagtcatgatcatctcaattcatcttcgtttggntttgcacacccctttaacatcttcacataggggaagcatacccaaat

SEQ ID NO: 10688 - DNA, 1494 bp, Lycopersicon esculentum
  Predicted polypeptide sequence is orthologous to G131, G135, G155
ccacacccttctttttttttcttccgtctgtctccatttgatatgatatatatattacaacaacaattattcatagtatagaaaaaatatccgaaaaaatgggaagaggaagagtccagttgaagcgaatagagaacaaaattaaccgtcaagttaccttctcgaaacgtcgatctggtttgctgaagaaagcccatgagatctctgtgctttgtgatgctgaggttggtttgattgttttttctactaaaggaaaactctttgaatatgccaacgattcctgcatggagaggatacttgaaagatatgaaagatactcatttgctgagaaacagcttgttcctactgatcatacctccccggtaagctggacccttgaacatgcaaaacttaaggccagacttgaggttctgcagaggaaccaaaagcattatgtgggagaagatttggagtccttaagtatgaaggaacttcagaatctggagcaccagcttgattcagctcttaaacacattcgatcaagaaagaatcaattgatgcatgagtccatttctgtgcttcaaaaaaaggacagagcattgcaggagcaaaacaaccagctttcgaagaaggtgaaggagagggagaaagaggtggcacagcaaaatcagtgggaaatcaactcatcttcatttgttttgccacaacaactggactctcctcaccttggggaagcataccagagtactaatgtaatagataatggggaagtggaaggaggtagttcttcacagcagcaaggtgcagctaataatactgtgatgccacaatggatgcttcgtcatcttaataattaaaaggtatcattaatacttcaatataattaactaggtatataattttgatgccacaatatattaattaaaaggtatcattaatacttcaatataattaactaggtatataattttgatgccacaatatattgtctatgtgtacttgctttcaaagacatgccacaatatagatggattgttgtaaaaacattataatatatgttaaaaataaattttgatgtatgattccataatatcacgtaaaggattttgtagtaattatatagtaataacttttatattatatttaacgataacaataaatatgaatatttataattaacactttacataagtgttaaaggatttagtaattttgaatgtaatattattaactcatgttgtgagtatgttgtttttatgatagttaggagatatgataatatatataacttgatgaatgattgatgaataaattttttaatttattcgaaagatgcttttggttggttataggttgtcaattatttatccataaaactattgttctatagcataaaattaaatagatattacttaaaagatataaaacaaacggacaaaagacactgcattttctttgtcatcttttcttgattggtactaccaaaaaaaaaaaaaaaaaactcgagactagttc

SEQ ID NO: 10689 - DNA, 582 bp, Lycopersicon esculentum
  Predicted polypeptide sequence is orthologous to G131, G135
gatagtaaaccataattgtattgacgacacgtcaacaacaattctaatacaaagagaatggacttgattccatttacaattaagttttaacatacttaaaacattaatacatagaaattcataataataaggttctatacatgcatatcaatataaagacactcaatatatataattaagaatttctcaagcatagattaattaacatcatatataatttcctctcgcatagagtttttatcgctaatcgcttatactcatttgtctgtcctgatagtgagctcctttcaacgtttcaagcgattagcaaagagtgaaattattcatagatgtttattcatgttgtaaagtggatataatgaatcaagatttaggtcaagctcattattcctccttgcttctgctacttcatcttggtaattacctcccatatttaggcattgatgtggttgtaagaggaaagatgttgaagtagaaacttgattagtttgctggtgccattcaccttgctgttctactatcttatccttctccttaatcttcttgggtagcatgttattctcctctaggatagctctttcc

SEQ ID NO: 10690 - DNA, 650 bp, Lycopersicon esculentum
  Predicted polypeptide sequence is orthologous to G131, G135, G155
aatttatcatttgccaaaaacaaagaattactaaacataaatatccatttccattacacaatatacatatatatacacacacaaagaagaaagaagaaagaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttggtacgtatactatttattatatatgtatatatagttatttatttattttttcttgtttttttttttgtgtgatgaagtagattaaaataacctcaatattgcatgcaattacacaaaactaatttgttaagggtttaattttgatagaattaaaaacgtgtaccgagttttgtttctgaatttgatcttgtatagatctatttgaaaatggatacaacaaaattatttatttttgttaattaaaactaaacagatctattggaataataattcaagaaataattaattccatgcgcatcataattatgtaactgaaaaaaatggagaggtcatttcactaatgtaaaacaacta

SEQ ID NO: 10691 - DNA, 677 bp, Lycopersicon esculentum
  Predicted polypeptide sequence is orthologous to G131, G135, G155
aatttatcatttgccaaaaacaaagaattactaaacataaatatccatttccattacacaatatacatatatatacacacacaaagaagaaagaagaaagaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttgcatggaaaggattcttgaaaggtatgaaagggtagctggactttggaacatgctaagcttaaggccagacttgaggttttgcaaagaaaccaaaagcattatgcagggagaagagttggacacattgagtatgaaagagcttcagaatctggaacaccagctcgattctgctcttaagcacattcgatctagaaagaaccaattgatgcatgaatccatttctgagcttcaaaagaaggacaaggcattgcaagaacaaaacacacccaacaaaacagtgcttctgtgatgcctccatggatgcttcgccatctcaacggttaaattaaaacttaatgaagtataaacgccagcggacatattatgttatctattaatcac

SEQ ID NO: 10692 - DNA, 430 bp, Lycopersicon esculentum
  Predicted polypeptide sequence is orthologous to G131, G135, G155
gaaaaaagctcatgaaatttcagttttatgtgatgctgaagttgctttaattgttttctctcaaaagggaaaaatctttgagtattcttctgattcatgtatggaacaaattcttgaacgatatgaaagatactcatatgcagagagacgtttgcttgcaaataattctgaatcaccggtgcacgaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaactgcacaaacaggaaagagctatcctagaggagaataacatgctaaccaag

SEQ ID NO: 10693 - DNA, 587 bp, Lycopersicon esculentum
  Predicted polypeptide sequence is orthologous to G131, G135, G155
gtctctatctatgctaggtagcttatatgatttaatagttcgattaatttaaatacgcattaaagatagaggatgggaagaggtagggtagagttgaaacggatcgagaacaaaataagcagacaagtaacattctcaaagagacgatctggattattgaagaaagctaatgagatctcagtattatgtgatgctgatgttgcattgattgtgttttctaccaaaggcaaacttttcgagtattcctcaaatgactcaagtatggaaagtattcttgaaagatatgaaagatgctcatatgcagagagacagatgaatgctaatgattctgatcccaaggaaaattggagtgtggagtatccgaagctcatgtcaagaattgaacttttacaaagaaatataaggcattacatgggtcaggatctggaccctctcagtttgcgtgagctccagagtatagagcaacagattgatacttcattaaagagaattagaagcaggaagaatcaactgatgcacgagtccatttctgagctgcagaaaaaggagaaagcgctccaagaacaaaacaacttgattactaagaa

SEQ ID NO: 10694 - DNA, 961 bp, Lycopersicon esculentum
  Predicted polypeptide sequence is orthologous to G133
tttttttttttttttttttttttttttttttactttttttttttttttttttatataagatagtactaaaacattacattaaacattagaagatacacaacacttcaatccaaaaacaatagagtttttgacatccttatagtttttctttttttaggttttaacacactggattaagcaaaagtaggagaatagtctaaagagtcagtactctcatgcatgtctagtgaacaaacattgcatgtgattatttagaaagtatgacaatattacaataaggtgaaaattactactcaacctagagcaaaagtagtaatatcagagccacctccactgtgaagatgattatgataattgttgttgggttgaaggcgtaagtctaatatacgaggccctccagttggaaatccaagcacggaattgtagtctccatcatgctcaactaatccaccatatggatcctcttgtcttgcatcaaattcaagtaggagatttctatttatttcttccacattcctaacctttttcctgtaagtttcaatctgattgccaatcaccttaaactttctttcacgaataagcttcagagaattgtccacattttccatgagttcttccaactgttcatagttcagatcatttaggctttctcccatcctctgtctgatctcttttcgtagattcctattcacatcctttagcttccttagctgctcttgcattttctcatagtgagtagtccaaatatcaactccaatagtcttctggtacagatcgaacaattgtttggtcgtgatagagggacttataaactcatgaagttttccagtactagaaatcataacaattgaaactttagcatcacaaagaacagtaagttcattagccttcttgaatagcccatttcttctctttgaataagtcacttgtctatttgtttggttttctattttcttgatcc

SEQ ID NO: 10695 - DNA, 1097 bp, Lycopersicon esculentum
  Predicted polypeptide sequence is orthologous to G133
gcagttgctacccttcaatctttcttttcccgatatagcttctctactaacccaccccatatctcttcactttttcctctctttaacttcaacaatgaacatgacccttgttgattcacctcaatttctacttcttcaaaaatgggccgtggaaaaattgagatcaagaagattgaaaactcgacaaacaggcaggtcacttactccaagagaagaaacggtattttcaagaaagctaaagaacttactgttctttgtgacgctaagatctctctcatcatgctatcaagcaccaggaagtatcatgagtacacaagcccaaacactacgacaaaaaagatgattgatcagtatcagagtgcacttggagttgatatctggagcattcactacgagaaaatgcaagaaaacttgaagagattgaaagagatcaataacaagctaagaagagagataaggcagagaacaggggaagacatgagcggactaaatttgcaggaactatgtcacttgcaggagaacatcactgaatctgttgctgagattcgtgaacgaaagtaccacgtgatcaagaatcaaacagacacctgcaagaagaaggcgaggaacttagaagagcaaaatggaaaccttgtacttgacttggaagcaaaatgtgaagatccaaagtatggtgttgtggaaaatgaggggcattaccactctgctgtggcatttgcgaatggagtacacaatctttatgcttttcgcctacaaccattgcaccccaatcttcaaaacgaaggaggatttggttctcgtgatctacgtctctcctgaagatatcagttcacagtaatggcgttaaacattaatgctgagttacttattcaaatcaacttcccgaattatatcttattcctaaaaaaaattaaatattgcaagctgcaaacactactttatctaactaatttgctccgagtctggatttggttctgtgttaagcactctattattctaggtgtttcaactcctttctatatatgaattatgatgccttgaacgcatgttcaattaatcaattttccttttcgacttgaaaaaaaaaaaaaaaaaaa

SEQ ID NO: 10696 - DNA, 694 bp, Lycopersicon esculentum
  Predicted polypeptide sequence is orthologous to G133
gcaactacaacaagtgacaattgattgattcttaaattacttttatcaaattctgcaatcacctttcattgttttggcatccctttccatttttagtaactccatctttctaagactcttctcctcctccaatatcttatcacaaatcaaaataacaaaaaacatagaaaaataaatcaaaattgcacaataaaaagttaacttgaccttctagggtttgagtattcaagatctcaaaaaaaaaaaaaagaagaagaagttatggctcgtggtaagatccagatcaagaaaatagaaaaccaaacaaatagacaagtgacttattcaaagagaagaaatgggctattcaagaaggctaatgaacttactgttctttgtgatgctaaagtttcaattgttatgatttctagtactggaaaacttcatgagtttataagtccctctatcacgaccaaacaattgttcgatctgtaccagaagactattggagttgatatttggactactcactatgaggttttcatgtctttaatttcttccttctaagatctttaactttcccccttttttttggttaaattgtgtaacaaattcatcttaaaaagtgctttttatatttgtttttggaatcgatcacactttctatttatttggttatattttcaacatgccctttacggttagatttaattct

SEQ ID NO: 10697 - DNA, 742 bp, Lycopersicon esculentum
  Predicted polypeptide sequence is orthologous to G134
gtaaaatagagataaagagaatagaaaacacaaacaacaggcaagtaacttattcaaaaagaagaaatggtataataaagaaagctaaagaaattactgttctttgtgaagctaaggtttcacttataatctttgctagttctggaaagatgcatgaatattgtagcccttctactacgtaagtcaattttttattttatttaactttttaatgatttgttagtttgttgatttctatttttctttaaataatattaaggataagtgatatgttggatggttatcaaaaagcttctgggaggagactatgggatgctaagcatgagaatttgagtaatgaaattgatagaatcaagaaagagaatgacagtatgcaggttaagctcaggcacctcaaaggagaagatatcaatcaacttacccataaagagcttataattatggaagaagccttacaaaatggactttctagtatcagtgccaagcagtctgaaatcttgaggatggtcaggaaaaatgatcaaattctggaggaggaaaataagcaacttcaatatgctttgcaccaaaaggagatgggagccattggtggaagtggaaatatgagaggaattcatgaagaagtgtatcatcaaagagaaagggattatgagtaccaaatgccatttggcctacgagttcagccaatgcagccaatctacatgaaagaaatgtaaattatattaattcccactttaaatta

SEQ ID NO: 10698 - DNA, 873 bp, Lycopersicon esculentum
  Predicted polypeptide sequence is orthologous to G134
aatagagataaagaggatagaaaacacaaacaacaggcaagtaacttattcaaaaagaagaaatggtataataaagaaagctaaagaaattactgttctttgtgaagctaaggtttcacttataatctttgctagttctggaaagatgcatgaatattgtagcccttctactacgataagtgatatgttggatggttatcaaaaagcttctgggaggagactatgggatgctaagcatgagaatttgagtaatgaaattgatagaatcaagaaagagaatgacagtatgcaggttaagctcaggcacctcaaaggagaagatatcaatcaacttacccataaagagcttataattatggaagaagccttacaaaatggactttctagtatcagtgccaagcagtctgaaatcttgaggatggtcaggaaaaatgatcaaattctggaggaggaaaataagcaacttcaatatgctttgcaccaaaaggagatgggagccattggtggaagtggaaatatgagaggaattcatgaagaagtgtatcatcaaagagaaagggattatgagtaccaaatgccatttggcctacgagttcagccaatgcagccaaatctacatgaaagaatgtaaaattatattaattcccactttaaattaagaactctaataattttaatttgggtttctactatagctagaaacactaattaatcaattctagttatatgtaatgagtattagctaagactttgtttcatgttggaattattacctaattttatgggctcttcccatggttttaattaagtactgaaatgtagtgacatatttatatgaattgttctacttacctaaaaaaaaaaaaaaaaaaa

SEQ ID NO: 10699 - DNA, 709 bp, Lycopersicon esculentum
  Predicted polypeptide sequence is orthologous to G134
gaaaaagaaaaaaaaaaagaaaatgggaagaggaaagatagagataaagagaatagaaaactcaagcaatagacaagtaacatactcaaagagaagaaatgggatcttgaaaaaagctaaggaaattagtgttctttgtgatgctcatgtttctgttatcatttttgctacttctggaaaaatgcatgaattctcgtctacttctttggttgatattttggatcaataccacaagcttactggaagaagattgtgggatgctaagcatgagaacttggacaatgaaatcaacaaagtcaagaaagacaatgacaacatgcaaatagaactcaggcacctaaagggtgaagatatatcatctttgaattatagagaactcatgatattggaagatgcacttgaaaatggactcactggtatccgtgaaaaacagaatgagtttatgaggatgatgaggaaaaagactcaaaatatggagcaggagcaagatcaacttaactgtcaattgagacaactagagatagcaagcatgaataggaacatgggagaaataggggaagtgtttgagcagacaagggagaatcatgattatgggcaaatgccttttgctttcagagtccaaccaatgcagcctaatttgcaccaaaggttctaaatcaaacctcccatctatctatctacctatatctatgtttcttttttttttttt

SEQ ID NO: 10700 - DNA, 1146 bp, Lycopersicon esculentum
  misc_feature (1039)..(1039): n is a, c, g, or t
  Predicted polypeptide sequence is orthologous to G137, G145
gcaaagatagagaaagtcccagggtttccatatttccaactctctctttctttcatttattttgatttgtaccctcttttgttatccaaaagtagttgagcttgtaaccaataatccccccttcttttcttattttttttaaaatctctgaaaaaattgaagattgatttctcaatgggaagaggaagagttgagcttaagagaatagaaaataaaataaataggcaagtcacttttgctaagagaagaaatggacttcttaaaaaagcttatgaactttctgttctttgtgatgctgaagttgcccttataatcttctctaataggggtaaactctatgaattttgcagcacttcaagcatggtgaaaacaattgaaaagtaccaacgttgcagctatgctactttggaagccaaccaatcagttactgatactcagaataactaccacgaatatctgaggctaaaagctagagttgagctcctccaacgatctcagagaaactttcttggtgaagatttgggcacgttaagctcgaaggaccttgagcagcttgagaatcaattagagtcttccttaaagcaaatcaggtcaaggaagacacaattcatgctggatcagcttgcagatcttcaacaaaaggagcaaatgcttgcagaatctaatagattactccgtagaaagttagaagaaagtgtagctggatttccacttcgattgtgttgggaagatggaggtgatcatcaacttatgcatcaacaaaatcgtctcactaacacagagggtttctttcagcctcttggattgcattcttcttctccacattttgggtaattactattattattattaaaaataatttcaatttttttacttttatttcgattaataaatcaatgtgcaccaaggtatggtctaacataaacaaaaatgtggggaatgctccttaaagccctaacaaaagttaattggtacgtgtactaatgtaacgtactatatatcttacttgattagtggatggacagtactgggcacacancattgacataagttattataaggaaaaaaaaaaggcgaataatcaatatagtccaacattacattatttattataacaggtcactctagattaaatggtaatgaata

SEQ ID NO: 10701 - DNA, 931 bp, Lycopersicon esculentum
  Predicted polypeptide sequence is orthologous to G137, G145
ttttttttttttttttttttttatgaggaacataagtcaactgattaagcactcaaagaaatctagtttatgatttactaacaataacgggattgtcttatggatccccgttaggtccaggatgaaacattttctcaaacaacatacagaaattaggagatattcaatgtttatgatgataggaaaaccattgagcatatttataataatgttatgatcagaatcgtgagccttcaaggcaaccagccagccatgtagttattcacactaggccctgctcctcctactgtaattggatcattctgatacccaatttgcaaagtaggttcacaatccaaaggatgaaagaagccatcgccctgagtttgagttgtttgccggccatagcccacatcttgtgcatttggctgccactgcagatttagttggcttccttccatcaacctttgtttcaaggttctgttggcttcgttcaatgcatgttcctttctctgataatctgtaagttgatccaacattaactgagtccgagttgatctgatctgtttgagcgacatatcaagttgtctctcaagtgattcaagttctttgctgttcaaaggaccaagatcttcaccaagaagattcctctgtgatcgctgcaatgcttcgtaacgtcctttaagcttcaagtactcctgctggctactaatttccagtgcttctcgtgttgatatattcggttcaggtgctccatagttgcacttctggtacctctccaacgtctttagcatgctagaactactgcagaactcatagagttttcccctattagagaagatgattagagcaacctcagcatcacaaagaactgaaagctcataagctttcttcaaaagcccatttcttctcttagcaaaggtcacttgcctgttgatcttgttctctattc

SEQ ID NO: 10702 - DNA, 853 bp, Lycopersicon esculentum
  Predicted polypeptide sequence is orthologous to G137, G145
ggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagcaccatcaacacatgatgctactggagttgtacctggatggatgctttgaatttggagtatatggagagaaaaaatcctcttagttatacaagttatttatttttattaaaaaaataagttagatggagaattatatatatcatactttaaagaacttatattgtttgaatgttttagctagcaaacactttggattatatataatattgggatatatt

SEQ ID NO: 10703 - DNA, 1329 bp, Lycopersicon esculentum
  Predicted polypeptide sequence is orthologous to G137, G145
gcaccgaggtaaagctctaaggtatctaaatttggagtacctaagcaaatcctaaagttaaaacaatgaatccctaaagaagataggaagaaatgccatagataaaaacaacccatgttcactttttctctctctaaacattgaaattcaaccaaaacaaaaaacaaaagttgataagaatcctttctttctttctttgtgtgtgtgtgtgtctagctagggtttgcatttctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctttgtgatgctgaagttgctctactcgttttctctaatcgtggaaaactctatgaattctgcagcacaaacaatatgctcaaaacacttgataggtaccaaaagtgcagctatggaacattggaagtcaatcgatcaatcaaagataatgagcaaagcagctatagggaatacttgaaactcaaagccaaatatgagtcgctgcagcgatatcaaagacaccttcttggagatgagttggggcctctgactatagatgatcttgagcatcttgaagtccaactagatacttccctcaaacacattaggtccaccaggacacaaatgatgcttgatcagctttctgatcttcaaactaaggagaaattgtggaatgaggctaacaaggttcttgaaagaaagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtacgatccaataacaacttcaagccaaataacagcagtaacaaatgcccaaaacgtgaatggtatgatacctggttggatgctgtgaatgaaaaagtcctttatcttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaatcataatgtggatgttgctgaatataaaaaaaaaaaaaaaaaaaaaaaaaaaaaaaaaaaaaaa

SEQ ID NO: 10704 - DNA, 614 bp, Lycopersicon esculentum
  Predicted polypeptide sequence is orthologous to G137, G145
tgggaagaggaagagtagaactaaagagaatagagaacaaaataaacaggcaagttacttttgctaagagaagaaatggacttcttaagaaagcttatgagttatctatactttgtgatgctgaagttgctctcatcatcttctctagccgcggaaaactctatgagttttcaagtgcttccagcatgatgacaacacttgaaaagtatcaacaatgcagttacgcatctttggacccgatgttaccggttagtgatactcagatgaactacaatgagtatgtgaggctaaaagctagagttgagctccttcaacgttctcaaagacatattcttggagaggatttgggcacactaaactcgaaagaacttgagcagcttgagcaccaattggatgcatctttgaagaaagttagatcaaaaaagactcaatctatgctggatcagctggcagaccttcaagaaaaggagcaaatgctggaagaagcaaataaacaactaaaaaacaagcttggaagaaagtgcagctagaattccacttggattgtcatggggaaataatggaggacaaacaatggaatacaatcgactccctccacaaactactgcacaacc

SEQ ID NO: 10705 - DNA, 427 bp, Lycopersicon esculentum
  Predicted polypeptide sequence is orthologous to G137, G145
ttgaagattgatttctcaatgggaagaggaagagttgagcttaagagaatagaaaataaaataaataggcaagtcacttttgctaagagaagaaatggacttcttaaaaaagcttatgaactttctgttctttgtgatgctgaagttgcccttataatcttctctaataggggtaaactctatgaattttgcagcacttcaaggtattttttttttttattaacatcaaagattttattttttttttaaaaaaaacttaagtccttcattaccaaaacccttaattgatttacaaagtactttcattaaatttagttattctttttttttttatctctgacttcaattataatgcaagatctgtggtgtctttatatgaattgaattatatatggactggatttttactatatacatataagaaccc

SEQ ID NO: 10706 - DNA, 479 bp, Lycopersicon esculentum
  Predicted polypeptide sequence is orthologous to G138
tttttttttttttttttttttaaacaaaaatattagatacatatatatatcataaattccaagatgtcatagtgcatagttgagatggggccggcagttgttatttttataacaagttgagtgaattattctcctcactacttcaacaataattgtaagttgctaaatacagattagtggccaccacaaaaacaacattaattatattagttcatacaatacaagagaacaaatattactatgttaatccattagagcatccaccctggaataaatccattaatattatgagcagttgttgctgcattaacctcatgatcatttgcacccatatttggattgtatccgaattgaggcgatgaagaattcaaacggagaggttgaaagaaaggttgtgcagtagtttgtggagggagtcgattgtattccattgtttgtcctccattatttccccatgacaatccaagtggaattctagc

SEQ ID NO: 10707 - DNA, 919 bp, Lycopersicon esculentum
  misc_feature (16)..(16): n is a, c, g, or t
  misc_feature (881)..(881): n is a, c, g, or t
  misc_feature (883)..(884): n is a, c, g, or t
  Predicted polypeptide sequence is orthologous to G138
ggtgtgacccattgantcttttttttttttttttttttttttttttttttttttttttgggtttttttttttgggaagtttcaaatgttaaagtagcaacttatgcatacattacatttactggcctcgattaatcgatcgccgggataattcctgaagagggtttcgaaataaaatttgcaacaaaacaaaaaggggtgataatacatgcaatacattattactggataactgtttaaccaaacatggattagcttgttcgaattatcagattaaagcatccatccatgaataaatccattcatattgggggcagttgccgctgcattcacctcatttgtattaacaggattgtacccaaaatggggagaagaagaatgcaatccaagaggctgaaagaaaccctttgtgttagtgagaccattttgttgatgcataagttgatgatcacctccatcttcccaacacaatcgaagtggaaatccagctacactttcttctaactttttacggagtaatctattagattctgcaagcatttgcttcttttgttgaagaactgcaagcttgatcagcatgaattgggtcttccttggacctgatttgttttaggaagactttattggttttaaggtgttaagggcttttagctaacgggcaaattttcccaaaagtttttttggaagtgagggctaacttagttttagctcaaaatttggagtttttggataaaaccgatggtggttcaggagatattgaaggtgcttttatggtccctggctgaggtgaaatagggtcccttagaagttagccctgccagcacagtaagtttaaacctttctcaaggggttttttttttttttttttttcccccgccttantnntgcttacacctttttttaaaagaaaaagggggcct

SEQ ID NO: 10708 - DNA, 903 bp, Lycopersicon esculentum
  Predicted polypeptide sequence is orthologous to G142, G148
aaaaatggggagagggagagtggaactaaagagaatagagaacaaaatcaaccgtcaagtgacattttctaagaggaggaatggtttgttgaagaaagcttatgaattatcagtgctttgtgaggctgaagttgctctcatcatcttctctagtcgtggaaagctctatgagtttggtagtgcaggtatcactaaaacccttgagaggtaccaacgttgttgccttaatcctcaagacaattgtggtgaaagagaaacacaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaaggacaaggtgttccttttccatggagtaattgtaatgcatctttagatgaagcaggaagcagcacctttcatgtccaccattctcaatcaaatcacatggactgtgatttacctgatccagttcttcaaatagggtatcatcagtatatggctgcagatggagcctcagggtcaaggaacatggctgttgagagtaacattatccatggttggggtctttaatttctaattctaattatggattatactagtacaagttttttgcttttaagtttttcagattaaaaaactcaagtgacatataattatgatttgaaatgcatgttatatagtaatgtataattttagcaagtgtcatatacactcctgtttttaaaaaaaaaaaaaaaaaa

SEQ ID NO: 10709 - DNA, 499 bp, Lycopersicon esculentum
  Predicted polypeptide sequence is orthologous to G142, G148
caaaatcaaccgtcaagtgacattttctaagaggaggaatggtttgttgaagaaagcttatgaattatcagtgctttgagaggctgaagttgctctcatcatcttctctagtcgtggaaagctctatgagtttggtagtgcaggtatcactaaaacccttgagaggtaccaacgttgttgccttaatcctcaagacaattgtggtgaaagagaaacacagagctggtaccaagaggtctctaaattaaaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaa

SEQ ID NO: 10710 - DNA, 702 bp, Lycopersicon esculentum
  misc_feature (683)..(683): n is a, c, g, or t
  Predicted polypeptide sequence is orthologous to G147
gagagagtagagagagtaatccacaaactacttctttgtgagaaaatagtgtgcaagtaatattattgtaagttgtaagaaataaaagagtgttgaatagtagcattttgacactaccaaattttttatcaatattattgtattacttattcgggtatcatatttacccattttaatatttggtgtggcagttactctcttgttattgctatttagtttggacattatcctgggtgtgattatcatttttttgcaatagttacgccatattgtattgcatctgatcttgttcccaccatgtgagtgaatgaaatatgaagtttcaaaactcaagagatagctacatgtatgggggaggcgcaggaacaatgacactagatgaacttcattcacttgaaaagtaccttgaaatttggatgtatcatattcgttcagcaaagatggatatcatgtttcaagagatccaactgttgaagaataaggaagggatactggaagctgcaaacaaatatttacaggataagatagatgagcaatacactgtgactaacatgacccagaatttgactgactttcaatgcccactaactgtacaaaatgagatatttcagttttaacatatgctcactatgtaagttattcttattgtgaagcatctatgtaatttggtaaggagatgtaantatgatgattgagtaattt

SEQ ID NO: 10711 - DNA, 637 bp, Lycopersicon esculentum
  misc_feature (528)..(528): n is a, c, g, or t
  misc_feature (605)..(605): n is a, c, g, or t
  Predicted polypeptide sequence is orthologous to G151
gaaaaagataagcctattaataacgcttttttttttttttttttttttggactaaatgattcagattcagattcataatcagtaaaaatggagagctgaactcatctccatcttaaaatacactgtccagagatattgttcaaaatcaaaatgaaaccagcatttttatcttacttaagccatctaagtccctgacaaaatcactggtctagatgaacctgttttaaacatgaaaactggttcaatatcatttaacctgacatgtgcctaacaggttacaaaggaggggggatgagtcccgaaagacaatagtcactttgggccaacttgattctctgaattgcttgaaggagattcctgctctggtctctttctctttcgacaaatagttggaagccccaattgcaaagttgtgttggaatcttcatcatctactccatcttcacatgcagggtcggaatccagactctccttactctcttttaaaaatgaatactttcttttccgatgggcgatcatattcctcgngccgggaaatggattcgtcccttcccccatatttccaccgaagtaaaggtaaaccggggccatgggggctactcaanaatggggtgggattcggtactaacccttgtta

SEQ ID NO: 10712 - DNA, 776 bp, Lycopersicon esculentum
  Predicted polypeptide sequence is orthologous to G152
atcctgtatgggcaccaatcacaggtattaatctacaaccattttcattcaacacatttactgaagcaaaccttgacaagtcacaagtgataatccccatgttttattcctaatttaagttaaattactttacatagataacttctgcatcttcacataaatcataaaactctccaacatatctgcagagcatagtcttctcaggcttgatgaactttttccttctagcttgatcaagaatgggattcatagaagtgtctttagatgtaggtctagttgagaaaacagacgactatcgttcttctgtgtagtgcagttgtagcctgttttaaaagtaatagtggtggagttaatgtcacgttttctctattgctctctgaggtagggatcaaagtatgggagtgggggagaagctagagtttaaagcatgactaattcttctgataggaatttacccaagctgcatgacacttgttgatgtcccattcttctgtgtttgtggctggcttagctggagattgatcggtgcatgtaggtcatatccattgctgattgtatgtgtggcctgaacacccccatttggtgcacttccatatccttgctcagaaatctgaatatataacttttccttagattaagtcaaggacatctatgcgtgtggtaaaagttaatgaaaatcacatttttgtgtgcatactgcatacacaaacacagttggagatactctctaattagtacctctgcaatctgtgactctgtcgatgaggttacctttt

SEQ ID NO: 10713 - DNA, 675 bp, Lycopersicon esculentum
  Predicted polypeptide sequence is orthologous to G154, G627, G1011, G1797, G1798
gattccttaactattttcttttccatcctctttcctttttcccggaaaatcggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaacatgcagaagataattgagagataccgaggacgtgcaagagaaacaacgacggtggacaaaagcactgaactcgagcactacatggagaacttgaagcatgaaacagctaatatggcgaagaagatagagatcctcgaaatttctaaacggaagctaatggggcaaggattagggtcatgttcaatggatgaactagaagacattgacagccaactggagaggaccctcaaaattatcagggctagaaagactcaattgttcaaagaggaaatagaaagtctaaaagcaaaggagagactattgctccaacaaaatgcaagtttacgtgaaaagtgcgggcttaggccaatgctatcagagtcagcatctgcacccgaacccataccagcaccaccatcaacaccaccagctcaatcaaaagaaaggggaaat

SEQ ID NO: 10714 - DNA, 538 bp, Lycopersicon esculentum
  Predicted polypeptide sequence is orthologous to G154, G627, G1011, G1797, G1798
ttacatttgtaagtgtattgtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaag

SEQ ID NO: 10715 - DNA, 518 bp, Lycopersicon esculentum
  Predicted polypeptide sequence is orthologous to G154, G627, G1011, G1797, G1798
ttttttttttttttttttcggcgtaatttttataattacagagtaaaaaggacaaattattgtatacaagatcttaccctcaccttttgtgaggtaaatatgctatttctgatagaccttctcctctaactaatgattcaagacattaaaaaaaaactatatttaagtaatgtagtttatattattacaactctataaattataattacagtgttaatataaaacttgaaaccccaacaattttgacaattaaagtaatgtaggtagtgtgtttaaattaggacaatatgaactttttctagtctctggaagtcctataaagagctctgtctcaacttccattatttgtctttcaacatctttctctactagaggaactggtgttaaagtcaatggtagcacctgacacttttttttcaagtctacattttccttcaatagaattttttcctcttccttcagttgagcaatctgttccttgaataacagattctttcttgccctaatgttgcttaaac

SEQ ID NO: 10716 - DNA, 604 bp, Lycopersicon esculentum
  Predicted polypeptide sequence is orthologous to G154, G627, G1011, G1797, G1798
tttcgaggaaggaaagtagtattagaaaagtcggggagaaatcaatgctcttcatttttttccccctttttctaaactagggtttctataacaacaactatttgtgtcttcactctattataatttaacttataaagttttttctaatttctttttctcttcatctttcagatctaagaaaccataaagtttttatttttaggggttattatccacttcaagatttagaatctttctatttttggaaacttctcatgaattggtggaaagaggatatttctgaaggacgtctaatacgttaagggcattttttcgcgaagaagaaaatggtgaggggaataactgagatgaaaaggattgaaaatacaacaagtagacaagtgacattctcaaaaagaagaggtggactacttaagaaggcatttgaactctcagttctttgtgatgctgaagttagtctcatcatattttctcaaaaaggaaaactttttgagttttcaagttcaagtactaacaagacaatagaacgttatcaaaagaatgacaagaatttgggtcatgaaaatatattacttgaacaaactacaaagcatttgaaggggga

SEQ ID NO: 10717 - DNA, 413 bp, Lycopersicon esculentum
  Predicted polypeptide sequence is orthologous to G154, G627, G1011, G1797, G1798
aattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataatagagcgatataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtaccacagatagaaaa

SEQ ID NO: 10718 - DNA, 831 bp, Lycopersicon esculentum
  Predicted polypeptide sequence is orthologous to G156
aaaacacaagaagaagaacaaaggtgataacaataataataaataaatataatggggagaggaaagatagaagtgaagagaattgagaacaaaacaagtagacaagttactttctcaaagagaagagctggacttttgaagaaaacacatgaactttctgttctttgtgatgctcaaattggactcatcattttctcaaccaaaggcaaattgtttgagtacaccactcaacctcacagcatgggtgaaatcattaataagtatctgcaaactactggtgcctcacttccaattcatgatcatagggtggaacaatatgatgaaataacaaaaatgaaaagagaaacattgaatcttgaattaagtcttcaaagatacaaaggtgatgaattgaactcagcacaatatgatgaattaaatgaacttgagaagcagcttgaaaattctattaacaaaattagagccagaaagcttgaactcttgcaacagcagatggaaaacctgaagagaacagagaaaatgttggagaaagaaaatcatgatatgtgtcagtggttgatgaagtatgaaatgtacaagcaacagccagtagcaatgatggagcaacaagaagaagcagcaattactgaactgaatttacttggagaacaaccattgttgtctcaattttcattctttggagatcaacaccaacttggtactacaagtaattcttcagcatatcaccttcaaacttctcacccttttactccctctacctacgattgatgaggaggagctgcaattgctggggataattaattctacatttcctttggcatatttagaagc

SEQ ID NO: 10719 - DNA, 875 bp, Lycopersicon esculentum
  Predicted polypeptide sequence is orthologous to G157, G859, G1759, G1842, G1843, G1844
gagagaactagtctctattttttttttttttttttttttcacaaaaaaatcataacaataatgtgtagggtaatcaatttcaagtactccattatacaacttaaaaagagggaaaaataggcatataagtcaccctctagtaaatatgtcaaagtagagaagttaactttaatcatcatccattagaaacaagaacaaggatgaataattattagttttattgaaactaattttgcaggttcctctggtgcagaagcaaggcttttcgacgaatacgacgataatcactagaagaaattcagggtaactttttgttgtccacaaatcatgtggggtgctggaaggtcagacatttcattcacttttgtgtttttcttgatactagctatattgtcctccagatgtttcttttcctctagcagcagtttttccttctcatgaagaaccttagcagattcaagcatcaaatgtgtctttctagctctgagatgtattagagcagtttgaagttcgttttccaaatggataaggtcagtcaaagtgagaccatcagcatttgtttcctcgagttgcctttctgttgtttgtagcagttctcccattgttgtgaaccccgacacctctgcgacctggatttctgcattgatctctttttctgctccaacatggctttcatatcgtcgaagcatcgctgtcatactgttattgctggagaattcatggagtctaccacgatttgagatgataacaacagcaacatcgacatcgcagagaatagaaatttctttagctttcttcaataaacccttcctccgtttacagaacgcaacttgcctgcaatttttatcttgaattcgcttaatttctaccttccc

SEQ ID NO: 10720 - DNA, 1238 bp, Lycopersicon esculentum
  Predicted polypeptide sequence is orthologous to G157, G859, G1759, G1842, G1843, G1844
gtttaataaccatgggttatcctatttctgattcaatcctttacctagtaactgacttcaaaacatacagctccatctcctaatttctgaaaggaacttgtggtgtgttctttcgtaagcatttattaccctgttatcactgtttggcacaaaggcaagacttcttatttccccaaaagaaccaactcttccaacgacacttcaagatagaaaaccaacttttgggttattatgctcaaatagccaactaaaatttcagtggctttaataacctgtattttgtttatgactgggtttacagtgtaaaatgttgagttgtgttatttcttcatgcaatctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcgaagaaaatgagatggcaatgaatctaaataacatcgcaccaacccatatggattgtggacaacagagggagaccctgaattttctctagagtctagacacactaatggcatcacatatcagatagaagctcaatatataaataacagccttccaaaatatagcagagcagccactcctcgcgccatgggatatgtcctgccgaggttatatctggtgcatctaactagggagtgctactatgtagtcttctcttgtatgttgtcttggtatggttgaaacactgaagaactgtataaagggtaaataaataaagagatactgctgcagcgtctcgataacatgtgtgtaatgctatcatctaaatgactgtaaattagaggttattataatagtaagagggtgtagtccataagaatgacttgtccaagctgttcatgtttgatagtccgcatcggtctaattcatttcagcccattagaaaatgagacaaatgtggctatacgcagaggactattgcatcaacgaatgactttctagttaaaaaaaaaaaaaaaaaaaaa

SEQ ID NO: 10721 - DNA, 626 bp, Lycopersicon esculentum
  Predicted polypeptide sequence is orthologous to G157, G859, G1759, G1842, G1843, G1844
gtatgaaattcgtgaaagtgatggagatggaggtacaaatcttcttatattcggtcattttcatttgtgagaattagttagggtttgggagattgaagaaatggggaggaagaaagtggaaataaagcgaattgaagataagagcagtaggcaagcaactttctccaaacggagaaatggactcatgaagaaagctaaacagctctctgttctctgcgatgttgatgtcgccgtcctcgtcttctccagtcgcggacgcctctttgaattctccagtaccaacagtctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcg

SEQ ID NO: 10722 - DNA, 489 bp, Lycopersicon esculentum
  Predicted polypeptide sequence is orthologous to G157, G859, G1759, G1842, G1843, G1844
gacacacaaaagagaagagctgggtaggtgtaacgccgatgatagaagaatcttctagacatctgaaatttgtggattagggcttttcatcggcgaaaaaaaaaatggggcgaaggaaggtagaaattaagcgaattcaagataaaaattgcaggcaagttgcgttctgtaaacggaggaaaggtttattgaagaaagctaaagaaatttccgttctctgcgatgtcgatgttgctgttgttatcatctcaaatcgaggcaggctccatgaattctccagcaataacagtctgacagaaatgcttcaacgatacaaaagccacgtcgaagcagaaaaagagatctctacagaaatccaggtggcagagcactctaaatactcagggttcataacaatgggaaaactgctacaaacaacagaaaggcaactcgaggaaactaatgatgatgttctcactgtgactgaccttatccatttggagaacgaac

SEQ ID NO: 10723 - DNA, 682 bp, Lycopersicon esculentum
  misc_feature (617)..(617): n is a, c, g, or t
  Predicted polypeptide sequence is orthologous to G161
ttttaagctctactgtataaataatgtgtagtttcttgactatctaaactaatacttgctacttctaaaattttcatttcagggtccatagatcggtggagcaactggtaaaggctgaatctttttgtctttctttcaattcaagattgtctttttttcattctgctttgttcgaattgagttgatgggtgttttgtgttttctgattaaagaaaattgatgggtgttttgtgatatgggtcagtgtttttgtgtgtatacctgtctacaagactactaaatgttttgtttgtacctaaactgccttagtatttgtgatcatcaaccagcacaaattttgctcactgagtaggttgatagatggaaagaaatcacctttagcaggatctgaacccaatttgtttgttggttaactgtgctccttcccggttggtgaggattcgatttcccacactgtaatccctccaattcccccttctcctgtccctaattttttttataaaaaaaatcggtttcttatcaagtaataccaaatataccaggtgaaaagaaattagtttgctgactgctgtaggttgttcagttagctttctaaggaggaggttatgattatgtangggggttggattttagttagtcacactagtcctttttatatgagtgttttgtttgtttatgctgt

SEQ ID NO: 10724 - DNA, 511 bp, Lycopersicon esculentum
  Predicted polypeptide sequence is orthologous to G161
accttttcctcccaccatgaatattaataacgataccaactccgccgccaactccgccgccgtcgccgtcaagaaaactcaagggcggaggaaaatagcaattaaaccaatagcaaatcaaaacagtaggcacgttacctttagcaaacgccgtttaggtctcttcaaaaaagctagcgaactttgcattttaaccggcgctgaaatcgctattatggttcagtcgctaaaacgacagcgtttgttcacttttggtcatccgagcgccgacgccgtcattaaccggtaccttaccggaaaatcagaggaacaaaaaccggcggtcgatgatcagttgaactatgtgcaacagagcaatgaatattattctcagatctgtagagaattggagttggagaagaagtaaaggaggagattgttattgatgaatcgaagatggtgaatggtggtagtagtagtaataatggaggaggaggattttggtggaatgaatcgattgatgaaaatggga

SEQ ID NO: 10725 - DNA, 807 bp, Lycopersicon esculentum
  misc_feature (675)..(675): n is a, c, g, or t
  misc_feature (710)..(710): n is a, c, g, or t
  Predicted polypeptide sequence is orthologous to G175, G877
gccaatctagccctttttccacagagagagaaaaagagagagaaagagggagaaaggattgcttttgctttttcccatttgtttcttggaagaaagtctgtgggtggagttgggaaaagaaaataaattctaagttaatttggcgtttgagttgctcatgatactagtatcaacaattgatgggtggatttgatgatcatgttgccattatgggagattggatgcctccaagtccaagtccaagaacgtttttctcttcactgctaggcgatgatggtgggtcaagattatcgtttgatggcaccaatgaaactagtggaaacttagcttctggtcctcaagaacatgttggcaattcagatggagttgatacagcaccagctgcaatcagtgagccacaaccggtgaagttgagtgtgccgtctgaccagaaaatgaactctcgcggaggaggactcttggaaagaatagcagctagagcaggatttaatgccccaaagctgaacacggagagccttagacctgctgatctgaggcagaatcaaggagttcgctctccttatttaactattcctcctggtcttagtccaacaaccctgctagagtctcctgtttttctctccaattcactggtgcaaccatccccaacaactggaaaatttctattttcctcangcattgacaatagaaactcggcattgatgatggangatacagataaaaggaaagataatgctttagagagtatcaattcatcatccttttcttttcagccagttccagagactgctccatctctttttcctg

SEQ ID NO: 10726 - DNA, 654 bp, Lycopersicon esculentum
  Predicted polypeptide sequence is orthologous to G175, G877
gggttgcaggtgaacccgtccaatttttctcagcaaggatttccaaacattgaagtttcggttcattcccagaattcgcttgtatctcaccgtgtggaagctacacaaaacccgactcagaatggaacgcttcagcaatcatctgatttccctagattttctgctgagaaggatgtcatggctaataatgttaccctagattctaggacttttcagacagttggtagtgctgtggaccattctccacctctcgatgaaccgcaagatgaggacattgatcaaagaggaggtggagatccaaatgttgctggtgccccagctgaagatggttataattggcgaaaatatgggcagaaacaagttaaggggagcgagtacccccgaagttattacaagtgcacacatccaacctgtccagtcaagaagaaagtggagcgatctccagagggtcatattactgagattatatacaagggagcccacaatcacccaaaacccccacctaaccgtagatcagcccttggatccacaaattcacttggtgacctacaggtggacggtgcagaacaaggtgcaagtggtgttaatggtgatcttggtcaggcaaacttccacaaagcacctggtggtggaggaggttttgattggcggaac

SEQ ID NO: 10727 - DNA, 651 bp, Lycopersicon esculentum
  Predicted polypeptide sequence is orthologous to G175, G877
gaacaacaatcgtgatgcaaacttgggctccgagcactgcaacagatctgcccctttctctgctcagaataacactcgtttggaatcaggtgatgcagtagatgtgtcgtcgaatttttcaaatgatgaagatgaagatgatcgtggaactcatggcagcgtatcacaaggttatgagggtgaaggagatgagtccgagtctaaaagaaggaagcttgagacctactctgcagatatgactggtgctactagagccatcagggagccaagagttgtggttcaaactacaagcgaagtggacatccttgatgatggatatcgctggcgcaagtatgggcaaaaggttgtcaaagggaatccaaatccaaggagttactacaagtgcacaagtgctggctgcaatgtcaggaagcatgttgagagggcctcgcatgacctgaagtcagtgattaccacctacgaagggaagcacaaccacgacgttcctgcagctcgcaacagtagtcatgttaattcaggtgcctccaacactcatccagcttcagttactgcccctgctcaaaaccatttacataggccggaggctgctcaacttcagaatgctatggcgcgatttgacaggcaaccttcattgggctcatttggtctgtc

SEQ ID NO: 10728 - DNA, 1454 bp, Lycopersicon esculentum
  Predicted polypeptide sequence is orthologous to G184, G186, G916
gacaagtagtgcctaggcaatttatggatcttggcttagctgctggtgctggtggtactgcttctgaagcggaagaggcttccctgtcttcgtcagaggggccaagtggcagggaaaaatcgcgatcaccagtgaataacattgaatctagttccacatgtgggattgtaagagaagatagtcctgaaaaagtgtcacctggttggggtcctaataaaattccaagacttggtaatacctctactaataataaacctgctgatcaagctactgaggctactatgagaaaggctcgggtctcggtcagggctcgatcagaagctcccatgatcacagatggctgtcaatggcgaaagtatgggcagaaaatggctaagggaaacccgtgccctcgagcttattaccggtgcaccatggcagctggttgtccagttcggaagcaagttcaaagatgtgcagaggacagaacaatcttgatcacaacttatgaaggtactcacaaccatccgttgcctccggcagccatagcgatggcctcgacaacttcctcagcagcgaaaatgttgctctcgggctctatgccaagtgcagatgggctaatgaattccaatttcttcgcgagaactctccttccttgctcttccagcatggccacaatttcagcctcggccccgttccctactgttacattggacctaactcaatccccgaacccgttgcaattcccaagaccccctaaccaattccaaatcccattttcaaatccacctcacaacaacatcctagcaaatccagctgcacttttgcctcagatatttggacaggctttgtataaccaatccaaattctctggcctccaatcatctcaagatttagaaggacaacaacacccttcaacgatgccatcctcgattaatccatccaaccacaatcctgtagctgacacggtgaacgccttaaccagtgatcctaatttcaccgcagcattagcagcagccatcacttcacttattggcaatccggggcaaccaaacaatggtaccaacaacaccatcgccaccaccacaacgccagccaacaacaataacaacagtgtcacaagcaatggcaataacaacaacaatggcagcaacaataaagtgacgaattcgagttttccagcaaactgattgatagcttgtcaattaaactgctgcgcgcatattttcctttcaagaaagaaatttttttcttaaattaatttttttgcttaactagtaatcaggaaaactagattactatacaagttgataagattctttttgtgtgttttatacgtggcttaaaacatataatcttccattctttttgtggctgaataatgtaattcaagatttcttatcaatacaagaaaatatattggcaaaggaaaagtacagaaatgttcttccttctaaaaaaaaaaaaaaaaaaaa

SEQ ID NO: 10729 - DNA, 1365 bp, Lycopersicon esculentum
  Predicted polypeptide sequence is orthologous to G184, G186, G916
aagaactgaaaatacacatccccatgaggttgttggcgcaaattctgatgaagaaaagaaaaaagcgaataatgggaccatagttccaagacaattcatggagctaggccctagtggttccaaagttgacccaatggacgaaccatctcattctcgctcttcatcggaagaaagaacactctctggatcacctcggaacaacatggaattagtgtcaagggataaggcaattaaccgcgaagaaagcccagaatctgagagttgggctccaaacaaggcccctaaattgatgacttcatcatcaaagcctgttgaacagtcaacagaagcaaccatgaggaaagctcgtgtctccgttcgtgcccgatcagaagctcccatgattagtgatggttgccagtggagaaaatatggtcagaaaatggcaaaaggcaatccatgtccacgtgcttattatcgttgcactatggctgttggttgtccagtccgaaaacaggtgcaaaggtgtgcggaggacaggtcgatcttaataacaacatacgaaggtacacacaaccacccattaccaccagcagccatggctatggcatctacaacatctgcagcagcaaacatgttgctctctggttccatgccaagtgctgatgggctaatgaatacaaatttcctagcaagagcaatgcttccatgttcatcaaacatggcaactatttcagcttcagccccatttcctactgtcacattagacctcacagcccaaaatccaaacgcagcattgcctaattatcatcaaagaatcaaccaagcaaatcctcaattccaattccctttaccagctgggctaaatcacccgaatttcgccgcttcaatgtcagcaccacaaatgcctcacgttttggggcagcctttgtataaccaatcgaaattttcgggtttacaaatttctcaggaaaacattcatcatcaccacccatcaatttctcatgacacactctccgccgccacggctgctatcaccgccgatcctaacttcaccgccgcccttgcggctgccatctcctccatcatcggtggttctcatccgaacaacggcaacagtcccatgtccggtccctcaagcaataataataacactagtagtttcccagggaactaattaaataaaatattattttgttttgtaaaatttgctattgtagtctttcttcattcatttttttaaaaaatttgttaggacattaggggatgaaattggaatgaatttacatgttcatatcttttttctttgtattattaccgtggaggaaagagtataggagaaaaaaaacgttattttcattcttttattctgattttggttatacg

SEQ ID NO: 10730 - DNA, 639 bp, Lycopersicon esculentum
  Predicted polypeptide sequence is orthologous to G184, G186, G916
gggaagctactcatctcaaagtctttttatagcagcgtccattgcatctgctaaaaacttcttagactcttcaatttatcatatttctatctctaccttttgatcttccaacttttattttttttatggacaaaggatggggtcttacccttgaaacttcttcttctaattctgatagagctggtttcttcaagaacaagcctgtttttggttttaatttaagtcctaaatttaacgctgctgaaatgttttcctcctccgatgagaaacgtagcatcgttaatgaagtcgactttttcgccgataaaaagcctattgtaaagaaggaaaattctcagaccgataattctatcagaactgatgatcagtgtgttgtaaatactggtttgcaacttgtgattgcaaacgcgggaagtgatcagtcaacggtagatgatggggtttcatcggaagtacttgaggagaaacgagctaaaattcagcagttggcacaattgcaagttgagcttgaacggatgaattccgaaaatcaacgtttaaaagggatgcttactcaagttagcaacagttattctgcacttcagatgcatcttgttacactcatgcaacaacaacttaattcaagaactgaaaatacac

SEQ ID NO: 10731 - DNA, 644 bp, Lycopersicon esculentum
  Predicted polypeptide sequence is orthologous to G184, G186, G916
caacgacaaaacatttcaataactcaaaatacacatgaccacaattttcagattgtggaagcaaagttaaatcaagaaaaaatcgttccaagaagattcctggaattaggtcgaagtggtaacgatctatctcataattccaattcttcatcagaagaaagaacagtttctaaatcacctcgaaacgatacacaagttacaattatgcataataaaggcagagaagaaagcccagaatctgatagttgggtacctaacaaggtccccaaattgaattcctcaatgccaattgatccaacaacagacgcaaccatgagaaaagctcgtgtctctgttcgtgcccgatcagaagctcccatgattagtgatggatgtcaatggagaaaatatggacagaaaatggcgaaaggcaatccatgtcctcgagcttattatcgctgcactatggctgttggttgcccagtacgaaaacaggttcaaaggtgtgctgaggacaggacaattttgaatacaacttatgagggtacacacaaccaccctctaccaccagcggctatggctatggcatcgactacatcagctgcagcaaatatgttgctatcaggttcgatgtcaagtgcagatggtgtgttaatgaatccgaa

SEQ ID NO: 10732 - DNA, 513 bp, Lycopersicon esculentum
  Predicted polypeptide sequence is orthologous to G184, G186, G916
caacaacgacaaaacatttcaataactcaaaatacacatgaccacaattttcagattgtggaagcaaagttaaatcaagaaaaaatcgttccaagaagattcctggaattaggtcgaagtggtaacgatctatctcataattccaattcttcatcagaagaaagaacagtttctaaatcacctcgaaacgatacacaagttacaattatgcataataaaggcagagaagaaagcccagaatctgatagttgggtacctaacaaggtccccaaattgaattcctcaatgccaattgatccaacaacagacgcaaccatgagaaaagctcgtgtctctgttcgtgcccgatcagaagctcccatgattagtgatggatgtcaatggagaaaatatggacagaaaatggcgaaaggcaatccatgtcctcgagcttattatcgctgcactatggctgttggttgcccagtacgaaaacaggttcaaaggtgtgctgaggacaggacaattttgaat

SEQ ID NO: 10733 - DNA, 620 bp, Lycopersicon esculentum
  Predicted polypeptide sequence is orthologous to G184, G186, G916
cgggttcggggattgagttaggtccaatgtaacagtagggaacggggccgaggctgaaattgtggccatgctggaagagcaaggaaggagagttctcgcgaagaaattggaattcattagcccatctgcacttggcatagagcccgagagcaacattttcgctgctgaggaagttgtcgaggccatcgctatggctgccggaggcaacggatggttgtgagtaccttcataagttgtgatcaagattgttctgtcctctgcacatctttgaacctgtcaatgcagagaaattcacttcagtcaagagacttcctttttttccccttcattcaaatattcgttctccattaattcaactaatctagacttgctttgagaaagccctctaaagcaggtaaaacactgttttgtatacaattctttattgaagctcaaatctaagacttctggttgaagttatagacactatagagatactaacggcataatacatacatcggatcctaaacttggcttcaaaattctactttgacctccaacttttataatgcaaaaatatacacttttactttccaacttttaaataaatacacacatgagttctatgtggaacaataaac

SEQ ID NO: 10734 - DNA, 402 bp, Lycopersicon esculentum
  Predicted polypeptide sequence is orthologous to G184, G186
aatattgtttcatgattaattggtctcttatggataaaggatggggacttacacttgagaataagcctttttttgggtttaatcatatgatgaaccgtagagaagagcaattagtagctgatcatgacaaaaaagaagttgatttcttctctcatcataataggaaggctatacatcatgattttataaagaaggaagatttgaatagtactactattactacgccatcgaaattcattgtaaatactggtttgcaacttgtgactgcaagtgatcaatcaacggtagatgatggggagttaatactagaagaagaaagagctaaaaatgagttagcagaactacaagttgaattgagaaggatgaatgccgaaaatcaacgtttgagagggatgcttaccc

SEQ ID NO: 10735 - DNA, 772 bp, Lycopersicon esculentum
  Predicted polypeptide sequence is orthologous to G185
agtgctttggcttaaatctttccaattccccaaaaaaaaaaattgaatctttatgcatttttgtcattgaggaatgaatcttttgtcattcaagattgaatctttttgcatttttgtcactaaagattgaatctttatgcatttctgtcattgaggaatgaatcttttttgcatttttgtcactaaagattgaatctttttgcacttttgtcattgaagtttgaatcattttgctcttttggcattgaaatttgaatctgtttgcatttttatcactaaagattgaatctttttgctcttttgtcactgaagtttgagtctttttactctgttgtcactaaacattgaatcttttttgcaatttggtcactaaagattgatccccaaatggagaaagttaaagtttggaataaagaaagtctaattactgagcttactcaagggaaagagtttgtaaaccaatttgatcctctggcttcaccagaggaaaatgattttcttcttgagaaaatactttcctctatagacaaatcattgtcaattttgaattgtgaagtttataatggaacaaatgatccttttcctttgagggatcaaggccaaaataagaaaagaaagaaaatgcagcaatggagcaaacaagttagagtacatgggacagagcttgaaagttttaatcatgatgatggttatagttggagaaaatatgggcaaaaaaacattttaggagctattcatccaggggcttattataggtgcactcacaggaata

SEQ ID NO: 10736 - DNA, 1024 bp, Lycopersicon esculentum
  Predicted polypeptide sequence is orthologous to G192
ctctctcttaagccaaaagtcagcgccttcttttgttctctctgcatttcctctctctaaccaaaaagtcaaggccgtagccaagaaattaacaaaatggaagaggattgggatctacatgcggtggtcagaggctgcgccgctagttccaccgccgccgctgctgccgccaccaccacagccaccactaattcttgttgcagcagcttccaaccaagacaagatggcaacttttttagttttcaagatccatttgtcccaagatttgataaccccataagtgattttgaagagttgcataatctttacaagcctttcttccctaaagcacaacaaatacctctttctcctcaaaataatactaataatatacccatttcacctctctctgttcttggaggactacaagatctatcaccccaacaaacactaaaacaacaacaacatattcatcagctaaacagtacaagattaacacaacccaaacaatctcctctctctgcatatggttccacaactactagtgcttcacatgttcaaagcccaagacctaaaagaagaaaaaatcaattgaagaaggtatgtcaagtacctgctgaaggtttatcttctgacatgtggtcttggagaaaatatggacaaaaacccatcaaaggctctccatatccaaggggatattacaggtgtagtacttcaaagggttgtttggcccgaaaacaagtggagcgaaatagatccgacccgaatatgttcattgtaacttacacagcagagcacaatcaccctatgccaactcaccggaattccctcgccggaagtacccgtcagaagccggcgaattccgaagctggtactgtaagtgactctaacaaacccactagttcatcgccggtatcttcgccggcgtgtcattctccggcgacggagaagcaagaaagcagcagggatgaaagagaaacatttttgaagacgacgatgacgaatttggtagttcaaatatgggattagataacatggagcctgc

SEQ ID NO: 10737 - DNA, 569 bp, Lycopersicon esculentum
  Predicted polypeptide sequence is orthologous to G192
caaaaaagtcagcgccttcttttgtcttcttcttctctctaaaaaaagaaaagaaaaagtcaaggataaagcagagcaaaaacagagagagactatggaagaagattgggatctaaacgccgtcgtcagaagctgcaccgccaccacaaccgccggcgacatcagttttaccaacttccaaccaagaacaacagatgatgataataacagtaacaataactctgtattttgctttgaagatctggttctcaaacagagcctagtattgaatagaaataaaattagtgatgatttcgaagaattgcatcaactttgcaagccatttattaatcaaccatccgaaaaattaacggtcatttcatcacaatcaccgtcgcaacagcttactgatacgaaatcaattcaacccaacagaactttatcatgtaatttacatgctcaaagtcaaacaatcaaaagaaggaagaaccatttaaagaaagaatgtcaagtagctgctgatggtttatcttctgatatgtggtcttggagaaaatatggacaaaaacctattaaaggttccccatacc

SEQ ID NO: 10738 - DNA, 594 bp, Lycopersicon esculentum
  Predicted polypeptide sequence is orthologous to G192
gcttccccttgaacaatgttttcaatggctgaaaacgaaaatgattgggatttatgggcagttgtgagaagttgcggcaagaggaacaactctgttcatgatgatatgaacgttaataatacctctgttcttgaggatcctactcatgttactgatcgtgttggtgattttaccggcttggaacacaggcattactttgggttagatgaaattattagtctttccaataacctgaataccaccaattcaaaaattgaaaaccaaactgaaactattccaaacacaccactggtggttgtagaacatgaggagaagaagaagaagaaggtgagattctcgatgcaaatttcaagtactgaggcaggcaatacgtttagttaccgcgggaagagcactgaaagatatgaaatattagcggagaaattgagtgaggcagatcaatggagatggagaaagtatgggatgaagcgaactggtgattcgacttttctcaagagctactataggtgtaatgaagctaacgattgtccggcaaggagacatattcagaaaagctcaacaaatccaaacaaggtgattgtaacttacagaggc

SEQ ID NO: 10739 - DNA, 1180 bp, Lycopersicon esculentum
  Predicted polypeptide sequence is orthologous to G194
cttcattaatgaaaaaatggaaagctacaaagacattaaaatggaagatcatcatccaatgtatttcattgacaacaacggttttggagttactaataaccactcattcatctcagattacagcattaacccatcatctctgggtttcatggagttattgggttttcatcaagacttttgttcagtttttgagttacctaaagaagaaaatcactatcctgctgtttgtgtatctgaagaagaactaaagccgccatcatcatcatctgtagcagcagctgagaaacaaaaaagtagtactactactgtagttgctacaggtaacgtattgaatacgccatctacccctaattgctcctccatttcctctgaaggacatggagatgctgatggggaagtagaaaatcatgaccaaaaaaacacaaacgctaaacaacagttgaaagcgaagaaaacagtgagtcagaagaaacagaaagagccgagatttgcgtttatgacaaaaagtgaggttgattttcttgaagatggttatagatggagaaaatacggtcaaaaagctgtcaaaaacagtcctttcccaaggaactattatcgctgcacaaatgcaacatgtaacgtcaagaagagagttgagcgatgtttcagtgacccaagcattgtggtgactacctacgaaggaaaacatactcatccaagtcccatgaatacgatgatctcccgtcctaactgctatccaataaatccagtactcccttcacttggaacctacactctgccaatgcagttcaacgccaatcagtccttcaacgacaacttaacgagttctaatttagccatcaatcatcagcttgatcatgctgcttttgttgctcaaggaaggcgtttttgcagtactaacgaaattctggaagaccaggagaatgatctacagaatcttatgccttccgcggtgctaaaacatgactacaacagatgatgatgatgatgtatatagagggtttatatagtcgataagttaaaacaattatatgcattatattactttgttataatttagctagtggtactcttactcgcatttctaatgtattcatatcggaaatctcatgggtctaacattgacattttcggattctctatgcatgtgtatacttttctaaaaaaaaaaaaaaaaaaa

SEQ ID NO: 10740 - DNA, 677 bp, Lycopersicon esculentum
  Predicted polypeptide sequence is orthologous to G194
attatctctttcgatggagaaagaaaataatgtaagaacagagattacaaatacttcaaattggagctccaacgccatgtttgatatcgaaaaagattattcgttaagttttttattagaaacaatgtttggtgttgacgaacatcgaaattattgttatgataacactacaactagttctattttcgatttgctaatgattccatctcatcagcaacaacttcaacctcaacgttttattacttgttcgtcacttccagaatcatcatcgatattattatctgatcatttgattaataacgtaccagtaacaccaaattcatcgtcgatttcttcatcatcaactgaattagctgctaatgatgatcatcaacacaagtataagaaacagttaaaacctaataagaagaagcaaaagggggaaaaggagccaagatttgcattcatgacaaagagtgaaattgatcatttggatgatggttttagatggaggaaatatggacaaaaagcagtaaaaaatagcccctttccaaggagctactatcgttgcacaacatcatcatgtggtgtgaaaaagagagttgaaagatcaattcaagatacttcaatagttattacaacttatgaaggtgttcacacacattcatgccccataacgccacgtggatgggtcggag

SEQ ID NO: 10741 - DNA, 464 bp, Lycopersicon esculentum
  Predicted polypeptide sequence is orthologous to G196
gctcttctcttcgcacccctctcttcaccttatactactactttctgctggatttgtctctttgattgcagatttcgacaagttgcgaaaaatctggaataagggaagcagagttcgccggaggcggtgaagctagcgataccggagacttcaacgaattttggtccggagagctcattttctagttgaggcgaagtatcaatgtcgaaagagaagaatgttgtagatgattatggagattattatgctgttcctgacctggatagcagagaaatagttggtggttcagtttcaaatgtcgtcagtcactcttcaggtcatcttaagttggaaagatcaaacactgagccacctacacacagtagtcaatttgctgaagaggcagcaaatatctctgatgacagcgattctgaacaacagaagctcaagttgtgaagaggattgaactgtcaagacgatggaac

SEQ ID NO: 10742 - DNA, 1115 bp, Lycopersicon esculentum
  Predicted polypeptide sequence is orthologous to G197, G255, G664
ttctcaagcatcacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaaaaaaaaaaaaaaaaaa

SEQ ID NO: 10743 - DNA, 831 bp, Lycopersicon esculentum
  Predicted polypeptide sequence is orthologous to G197, G255, G664
ttctcttttagtaccaaaaactcaaatccttgaatactcaaaggacaaaaataaaaaaaattcaaagtatgggacgttcaccttgttgtgaaaaagcacatacaaataaaggagcatggactaaagaagaagaccaacgcctcatcaattatatacgtgctcatggggaaggttgctggcgttctcttcctaaagctgcaggattgtcaagatgtggaaagagttgcagattgagatggataaattatttaaggcctgatctcaaaagagggaattttacagaagaagaagatgaattgataatcaaacttcatagtttgcttggaaacaaatggtcagttatagccggaagattacctggaagaacggataacgaaatcaagaactattggaatacacatattaaacgaaaactcattagtcgtggcattgatcctcaaactcaccgtccactcaacaacaacgccactaactcccacaccaccaccaatatcaccaccgcagtcacaaccaaaaacatcaacttggatttcacaaacgttgaccaaaaacaacccaatattatgattgccacgtcatcgtcatatgatgaaacaaaatgcaacagtggtacaactgaggaaacaaagccactagaaattattattccaaaaataccctcacaagttatgattaatcttgaactttcaattgggttgccgttacatactgatcatatttcttcaccagagtcaacggcctcatacaacttcttgaccaccgtagcaccgccgccaactgcggcggtaccggcggcggagatgatggcgaagactgtttgtttgtgttggc

SEQ ID NO: 10744 - DNA, 692 bp, Lycopersicon esculentum
  Predicted polypeptide sequence is orthologous to G197, G255, G664
gagatcttccatttcttttgtctttttttttttttacacaaaaaaaaattgtctaaaaattaaattataaatttgtgaaggaattaggaatgggaagaaaaccttgttgttctaaagaaggtttaaagaaaggttcatggactaaaaaagaagatttgcttcttactgaatatattaaggaatatggtgaaggtactggatggagatctcttcctaaaaaagcagggctactaagatgtggcaagagttgtagattaagatgggtgaattatcttaagcctggactcaatagagggacctttacacccgaagaggacgaccttattgttcgactttatactcttttgggtagtcgttggtctctcattgccggaagaatacctggtagaacagacaatgacatcaagaattattggaacacgagtctcctcaagaaactcaaagctcaaggaaatgagcctcgagaacacaaatctcaagccaaaaaaaaggagaaggaaagaggaaaaagcaaatgtctcttcccaaattaatcgaaaaaataacaacgaaaataagaagaagatgaagaaggagaagattgtcgaaaaacataacattgaagatgaagaggcaacaaagatagaggagcaaccacatgcacaggatttcgcacaaccagtatcagatagtaatcacaatttcactagttc

SEQ ID NO: 10745 - DNA, 470 bp, Lycopersicon esculentum
  Predicted polypeptide sequence is orthologous to G197
aacttctccttctttgttcttcatttctccttcctccattgttctttatttttaaatgtacattcagaagaatgatgagatgcattaataaaggatgagaggttgtaaatagaaaaatcagtagctgtttgaaaaaaaaaaagggatcgaagacagagacaacaacatagctaaaagatgggagattttggacattagagttgattagtagttttaaatttttacctcaaagattcaatctttggttcttcatgtttcaatgaggatgatgttgataaaatcctaaagggtacatgaattgagtgtgtgttagttgtctcaaaagattcaatctttgattttttacattttgttcctctttattaatttttgcctcaagaattccttaatgagttattgaaaaattcgttggcgtggctgctggcgctgtcggcacggcgacagttgtcgctgtggcaacggctgttggt

SEQ ID NO: 10746 - DNA, 318 bp, Lycopersicon esculentum
  Predicted polypeptide sequence is orthologous to G197, G664
aattaccaacatagcccctcaaggtgttttgcatgcagtttgggtatacaaaatagtaaagattgcaattgcagtaaaaataatattgcaagttataactttttaggattaaagagtaatggtgttttggactatagaactttagaaactaagtgaatttttattataaatctttttttccctcgtgtatttgggttaaaaaaacaagaagagagaatcgagaaagatattcctattagtttaagttctttcgaattttctcttatttgtaaaatttcaagtattactatatacgatatattatattaagttgaaaag

SEQ ID NO: 10747 - DNA, 539 bp, Lycopersicon esculentum
  Predicted polypeptide sequence is orthologous to G198
ctttagtcttgcagctactcttttggcatcacaaaatgaaattaccccagaagtgttactacaaaaatatcaagaaaataatcaaatgttcaactctcaactacaaaaccaagaagggtctgaattgttgttacaaaaacttcaacaaaatcaaatattgaattcccaattgcaaaatcagactcaatttttccaattccaaaatcaaattcaagaaacaccaaatttcaccacacaaaatgttccttgttcatcttcattgtcacggccaatgcaattgggacacgtggaggaatcttatttgatgaatggccaaatgctacctccacaaaactatggttattgtaattctgatgcttctgataattcaaatttccagtcactcaacaacaacagcagcaatcagaatataagcttagattcagtgttatcgacacccacggaagacgaaaaagagagctattgcagtaatttgatgaagttcgaaatcccagagagcttaaattttgatgattttatgtaaatatcgaaccacattg

SEQ ID NO: 10748 - DNA, 465 bp, Lycopersicon esculentum
  Predicted polypeptide sequence is orthologous to G198, G1328
catggatatggtaattggaggactcttccaaagaatgctgggcttcaaagatgtggaaaaagttgtaggcttcgttggactaattatctaaggccagatattaaaagaggaagattttcatttgaagaagaggagactatcattcaactccacagtattttaggcaacaagtggtctgctattgctgcacgtttacctggtagaactgataatgaaatcaagaactattggaatacgcatatcaggaaaaggcttttgagaatggggattgatccagtgacacacagtccacgtcttgatcttcttgatctttcttccattttaaaccattcaatttacaataattcatctcatcatcaaatgaacctttcaagattgttaggccatgtgcaacctttggttaatcctgaactcttgagattagctacttctcttatatcatcccaacgccaaaacacaaacaac

SEQ ID NO: 10749 - DNA, 801 bp, Lycopersicon esculentum
  Predicted polypeptide sequence is orthologous to G200
tcaaaacttatcaggaacttggaaataggtgagaattaagcatttttttccccacacaacagagttctgcacaagaaagattgtaaacttgttaacatagcctaaatacataatactgtataaaaccaaaccatattaaatttgtatttctatgcagctggtcagcaatagctgcaaaattgcctggaagaacagataacgaagttaagaacttcttccacacacacttaaagaagcatcttggactgaaaaatcatgatgttccattgaaaactaggaaaatccgcaaacaaaccaaagaagatgagaagaaaattagtactcgaggaagacttgtacttgaaacgagcaataacagcaatttattaacaacagatgtttgttcaccctgcagcagcattactacatgtgaagaaaaccaaatgatggatccttttgtgaatttctcacaaacttttgaagtttgttataacaacattacttcacttgttgtcgatcaacaagtccccggcatggaacacacatgtataaatattggtgttgcccaaccacattccattccccatggtcctgctgttaactccttcgatcaattcgatatgaattcattctggattgatgtacttggaaatatctgaacatcttactttctaaaacatgttacaagttagaacccatgtgcaggtcctagtttttatccactttttattctctcacaaagcaataatctgtattaggtcctagttttattccacttttttgtctttctcacaagcaataattctaatcttctgtcttaaa

SEQ ID NO: 10750 - DNA, 508 bp, Lycopersicon esculentum
  Predicted polypeptide sequence is orthologous to G200
ggtccttggactcctgaagaagatatcattttagtatcttatattcaagaacatggtcctggaaattggagatcagtccctactaatactgggttgatgagatgcagcaaaagttgtaggctaagatggacaaattacttgaggccaggaatcaaaagggggaatttcactccacatgaagaaggaatgattatccatcttcaagctttgttggatgggcagctatagcttcgtatctacctcaaaggacagataacgatatcaagaattactggaacacgcatctgaagaaaaaactcaagaaattccaaatagaattggattcacataatttgactcttcctcctcctaatttagacaattctaacactaataactatgatcatcatcatcatcaattcacaaagttattgaactctccaaattcttcatcttcatcatcattatatgcttctagtactgaaaatatttcaagacttctagaaggttggatgagatcttcccctaa

SEQ ID NO: 10751 - DNA, 769 bp, Lycopersicon esculentum
  Predicted polypeptide sequence is orthologous to G201
ctttttctctctctctctcatcctcacaaagacaataaaaagaagaattttaagcaaaaaaaaaaatcaataaatcaaaggcaaaaaaatggagcaaaaaaatattttttttcttctttctcttatggttttactactaatttcctacacaacaacagctcgtttattgccaacaattaattctcaagaatctaatgggattattagtaataatccaatttcctcacaagtacaagaagatttcaatgatgtaagttctttctcttattttccacccttatatacggtatatgagcttatccgaatcgatatgatcagtgaaaattcatattatcgatttgagatttcacttctttcaaaaacaaaaaaaaattagctagtgagaagattttgtaattagtaaaaaaaattctttgttaattctatttagcgataaattatcaaaatattttgtttgctatgaataataaagcaataatttcaatttgtttttgtgtttaggcctagtaattttttagcctattgattttagctagctcgtatttgaatttttcttttttatggaaaagtaattttttatatatacgatataattttttttaaaaaaatattcagttgatcacctttcatttatttcggagttaagagataaaaaggggttcaatttaaatattttcttccaaaaagtatggcaaaaataattttttttgtacatatataaattgttgaatcgtctagatattacatataacttctaagaatatatata

SEQ ID NO: 10752 - DNA, 763 bp, Lycopersicon esculentum
  Predicted polypeptide sequence is orthologous to G202
gcaggacgcaccactaagttcaatgccagaaccctggggcattgccgcaatgtccatgataggatacgcatattgcgtgaacattggaatggttttcgaagaggatccttgaggcttccttctagcaaagtgactaatgctagtagtgctaaactaaaaccagtgcgtggtagcaattctgctgaacggcctttagtatgttgctcgagtcaaccaaggacttctcagccttccaatcaaaatagacctgacagtaaagggccaacagaggtgaagaaggcgtggaaaatgatgaatatggctaaggcaatagaacaaaatagtgtcgggaacaaaagttctgttcaggcctcaaaacattcagttcagaagaatactagctacaaagaagcaagtgaatcgagctcaacgtctatcaaaatgaagatcgaacagcatcggcctccgtatattcaaaatgttggtccaggtagtcattccgagaatgatgtttgtaagttggacattggatcaaaaggtgcttcaggtgtatataaaggctcttcaatgtcatgcagaccattatatagtgaacttgtatcttcgagggagtctcagaattcacttcagccatatgtttgtgatgcgaacaatggactaccatggaagaataagtcgtgtgctggggccacacatttgagttcttctatcaggttgacatcaatttctactactgtaggtcatgagaaagagatcagttcttcctcgaatagcattgtgaatc

SEQ ID NO: 10753 - DNA, 815 bp, Lycopersicon esculentum
  Predicted polypeptide sequence is orthologous to G206
gccaagtgaaaaatcaaaacaaagtatagagagagaaaaaataaaatggggagatctccttgctgtgagaaattggggttgaaaagaggtccatggagcaaagaagaagattatttactcatcaattacattaaaaagaatggtcatcctaattggcgtgcacttccaaaacttgcaggtctattaaggtgcggaaaaagttgtaggcttcgatggactaattacttgagacctgatattaagcgaggcaattttactcatcaagaagaagatacaattatcaagttgcatcaagttcttggaaacagttggtctgctattgcagcaagattacccggaagaacagataacgaaataaaaaacatttggcatactcgtctgaagaaaaaaaggaatgaatctcaacttaaagaaacccaatcggagcctgaaaatactaatgtagatgtacatttggaggaggccaacaattctaatgataaacattccgaaatatcgaatcttaaaataaacatcgaaatccaacaacaaccaagtccatcatcgtcagtatcatcatcaagtgaagattcatgttcaaatacaactgcaacgagttcagagtcgagaaatcaaataatgtccgataatttgttagaaattgatgacgatatttggtccgaggtagtatgggcacaagtcgatgacaattatgttgatttgtcattaatggaggataattaccacattaattctagctttgatgataattggttttgggatgatctttttacaagatctaatgagttgatgttagaattgcctgaattatgagc

SEQ ID NO: 10754 - DNA, 736 bp, Lycopersicon esculentum
  misc_feature (725)..(725): n is a, c, g, or t
  Predicted polypeptide sequence is orthologous to G206
ggatacatatgttatcccaaaggaggaagcttcaagtatttcaaggagatgggaaaatcagatgtcacacattgtatttgaacaaggtggataaaatagaagctcacatcatgtgaaaaacacgtatcatcgagacttagaaggaaagtccaatagggtggttattagacacactatgtagtatgaggcggagtgttgagtagtcaataattcacacattcagaagatgacaatagcggagatgaggatgcttagatggatgtgtgggcatagtaggagagattaaattaggaataaaaatatataaagcatcttcaactccccaaggatatgaccctatataaggaaggatggaagtcaaggattaaggtggaggtttacaagatggtcaagtgatttctttctcatgggagagcatggttctagcatagaacacttgtctactgcctctttttctcattagtattactccattattattttattcttctattgtattattactattgtttcttatacttgagttatcttaactattcttgtccgtattttcttctacaatattttcaccatagttcttctcttatatttgtcagatctgttttttttataacacttaccttcagacaagggttcatcagaaacaacctcgttacctcacacaaagtaggggtgaggtttgcatgcacctcctcctccctaaagcccattgtgggatacactangcatgttgttg

SEQ ID NO: 10755 - DNA, 271 bp, Lycopersicon esculentum
  Predicted polypeptide sequence is orthologous to G206
gcatcttcttagttctctctgttctgaaaatttttctttagaaaaaacacacacaaaaaaaaataaaaatgggaagagcaccatgttgtgctaaagaaggattgcgtaaagggccatggtctactaaagaagatttattacttactaattatatcaatcaatatggtgaaggccaatggagatctttgcctaaaaatgctggattgcttaggtgtgggaaaagttgtagattaagatgggtgaattatttaaagccagggattaaaagaag

SEQ ID NO: 10756 - DNA, 637 bp, Lycopersicon esculentum
  Predicted polypeptide sequence is orthologous to G206
cgatctttttttaagtttatttaataaatatatgtaaatccagatgggcagctatcgctggagaattgcctggaagaacagataacgaagttaaaaacttctttcacacgcatctaaagaagaatcttggacagataaataatattgatgcccctgtacagtgtaggagggtaaaaaaacagaagaaaaaggctcaagaaaagcccaaattatttgtggatatatcatcaccaacgatgggtagttcttcttcaatatcgagcattattacattcgatcaaaatgaaaagattgacatggaaaagacggttatcttggagagcaatccatcgttatcatcgtcacatagtaatatcgatggcttcgatcaatttgttgacacaacttcgttctggcttcatctacttaaccatgccaatcgtgaagaattatattatgaaaactcctaatccaaagtagagatggataatttaattaatgagatgaaattattttaccttattatcaaaatgtccaaaaggaattttaattatgtgagattcttaattcggaagataatgctacactaaatttaattttgatctaccataacgtcaattccattcgggtttcaatgtgtgtataggtaacttttgac

SEQ ID NO: 10757 - DNA, 489 bp, Lycopersicon esculentum
  Predicted polypeptide sequence is orthologous to G206
gcattaatcttgccaagggtacaacaacagcagcagaaaggtacgagcatggaggcgatcataaagaagggggcatggtctccggaggaagaccaaaaactgagaggttatatcatgaaatatggcatctggaactggagacagatgcccaaattcgcagggctttcaagaacggggaaaagttgtagactaagatggatgaactatctccgccctgatgttaagagaggaccctttaccacggaagaggttgaaattgtcatcaaaacttatcaggaacttggaaatagctggtcagcaatagctgcaaaattgcctggaagaacagataacgaagttaagaacttcttccacacacacttaaagaagcatcttggactgaaaaatcatgatgttccattgaaaactaggaaaatccgcaaacaaaccaaagaagatgagaagaaaattagtactcgaggaagacttgtacttgaaacgagcaataac

SEQ ID NO: 10758 - DNA, 1711 bp, Lycopersicon esculentum
  Predicted polypeptide sequence is orthologous to G207, G227, G230, G242
gctcaaacatagagagaaaccaaaaaataaattaaaatggcgattactacaaacagttctaagagagatatggatcgggttaaaggtccatggagccctgaagaagatgagcttttacagcaacttgttcagaaacatggcccgagaaattggtctctaataagcaaatcgattccggggagatccggaaaatcttgccgcttgcggtggtgtaatcagttatctccacaggtggagcatcgggcttttacgcctgaagaagatgagactattattcgggctcatgcccgattcggtaacaaatgggctactatagcccgacttcttaatgggcggactgataacgctattaagaatcactggaactctaccttgaagaggaagtgttcatcgcttagtgccgatgaagggaacgaactcgccgatcaactttttgagaatcagcagccgccgttgaagagatctgttagtgccggatccgctatgccggttactggttttcatttcagtccgggtagcccgtcgggttctgatagcgattcgagccttcatgttacgtcgtcgtcccaatctcaagtgtttaagcctgttgccagaaccggcggcgtatttccgccgtcgattgatatttcatctccgcctgttgatcctcccacttctctaagcctttcgcttcctggtgttgacttggctgaatcctctaatcgttcggccgattcgactcagtcgaaaaatccttttcagtggctgcttccaccgatgcagattcctccaccgccaccaccaccgccgcctccgctggcaacaacggtgccgttcgaacgagtttctgcaattcaacagtctcttcagaaccctgattttgggcaaaactcaggaggagaacagccagacaaggtatttgtgccgtttagccaggagttgttaggtgtgatgcaggagatgataaagacggaggtgaggaactatatgatgggagtcgaacaaaagcaacagtatcagcggcagcattatcaacaacaacaaccgcagcagtttcagcaacaaaaccatcaattgccaagtggtttagggcttggattgtgtatgcaacaagcttctgattgtttcagggatagggctgctaatcgaatgggactaagcaaattcgattagtgaatgggaggaagaaaccgcctttgtttcattctctctttgtttttagggcacatgttagctctttaagcttcaactgtggaatcgtcaaaagaagaaaatagttttggtggagtattgtacagggccagggagattataaaaccatgttccaatggcagaaatgcaaaggctgggactaataagagaaaaaaaatactaaaaaaaaaaaaaaaaaaaaaccttttgttaatttatattcaggcatatttagaaaccaagaaaaacttagtttaaagtaaatattatgttttgagaagacatctacggcaaaggctgggaaggatttgaatgaagcaaagttattaactttattattttccgaagttatttagtatctctttacctcttcaaattttggatgttatgattgacctgaaagtttcaaaacctgaattggagaggtacgaaatgtatgcaccaaaaattaagtttaactctatttttaaccaataaaaagaaatacttgttaacccataaaaaaaaaaaaaaaaaactcgagactagttctctctct

SEQ ID NO: 10759 - DNA, 1391 bp, Lycopersicon esculentum
  Predicted polypeptide sequence is orthologous to G207, G227, G230, G242
ggctccgcctcccaccaccgtctaatttgtaaatatattcgccggaaacttctctatccacgctttctctatatctatcataccctttttcttaattaatcggttgctattcctttgatggcagcgattacgcagagaaaagattcggatcggatcaaaggtccatggagtcctgaagaggacgagttgttgcagacgcttgttgagaaacatggacctagaaactggactttgataagcaaatcggtgccgggtcgatctggtaaatcctgtcgtctccggtggtgtaatcagctttcacctcaagtggaacatcgtgcttttactcctgaagaagatgatacgatcatcagggctcatgccaagtttggtaataaatgggcgactattgcccgtttgttatcgggtcggactgataacgctataaagaaccattggaactctactcttaaacgtaagtgtccttccatgtccgaagatttaagctttgaaacccctcaaccgcctttgaaaagatcgtctagtgttggtccctgtaccaatttttcttctgttatgaatccgggtagtccgtctggatccgacttgagtgattctagtctttcgggttttccccaatcgcatgtttacagacctgttccccgtaccggcgggattttccctcttcctcctcctcctccggttaagcagatcgaaattcctccatctgtacccgacccaccaacatctctctgcctttcgttacccggatccggatccggatccatcgaaaagccaacccagtcccctaaatcaccaccactaccaccgcctcctttgccggcggttgataaaccgattcccccatccgtacccgtaacttgtccaccatcggctttcatgggtcatcttgctcaatctaatcaaagttatgattttagtgctgcacccaaatcaggagagaaacagttttttactccagagttcttatcagttctgcaagatatgattagaaaggaagttaagagttacatgtctgggtttgaacaaaatggtctctgcatgcagactgatgcaataaggaatgcagtcattaagcgtattggcatcagcaagattgagtaatccatctatgattactgttgaactgttctatagtcatcaacaatggctgccgctgctcagcgaaatgacaccggagaagaaacaatggaagatcggagcagtcttcctcccccttttttttattgcttaattacttccttagaattccaatcaaaaaaaataattttgcagtaatgtacagatgaatgagaggatgagagaagaaaactaaatttaaaaatgcccgaaaagatgaaaaaattgagaaaaatctcattctcttgtctaatgtcgcatgatgatctcgc

SEQ ID NO: 10760 - DNA, 732 bp, Lycopersicon esculentum
  Predicted polypeptide sequence is orthologous to G207, G227, G230, G242
gcttcatcttcttcttctgaatcatcttcatcagaatcttcgctttcgggtaaaaacccgaataaatctgaaaggataaaagggccatggagtgctgaagaagataagattttaacgaaacttgttgagcgttacggagctcggaattggtctttgattagtaaatatataaaaggtaggtccggaaaatcctgcaggctccgttggtgtaatcagttaagccctaatgttgaacaccggcccttttctccggcggaggatgaagctattttagctgctcatgctaaatatggaaaccgatgggccaccattgcccgattacttccgggtcggactgataatgcggttaaaaatcactggaattcgacattaaagaggcgtcatcagcaattaattcagcagcaaaatcaaaaccccgttgggttttctgacgtgaaaattaatgggtcaggatccggatccggatctggattcgggtcgtgtatggagtatttgaatgtggatgagagtccaaaagtgaataacaataacaataattacgctgttacgaataattgtagcggtgaatttgatgatccgatgacgactttgtcactagcgccgccgggaatgagcggagatgagttgccggagaagaaacggagagttttccggcgggattttgggatgtgatgagaggtgttattgctagagaagtgagagaatatgttgcttctacggggtttcctaatt

SEQ ID NO: 10761 - DNA, 624 bp, Lycopersicon esculentum
  Predicted polypeptide sequence is orthologous to G214, G680
tgcaattctacgagggaacctgtgttgttgcaggatgaagaaaaaagctcgaaaagacttcggttggaaggagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatc

SEQ ID NO: 10762 - DNA, 677 bp, Lycopersicon esculentum
  Predicted polypeptide sequence is orthologous to G214, G680
tttttttttccgaggaactggtccaatcaaggtccattaaatttgctatgattgttgaagacatccacatttaggttcatacttcaaagtcccttgcatacaagtccaattaaaagagaacataaaaataatatggtacacacctacacgacaagtttcgtgtacattagaactagacaacgtaactgggaaaagataataacaggatagaatagagctctccgtgcaacaacacaggttccctcgtagaattgcacattgatacaacactaagtagaagcttctccttccaaccgaagtcttttcgagcttttttcttcatcctgacagttagaacttgtcaccctgctatcatttgcctccaatgagcacctcttgtaaggcttaaatccagtacggcgagctttcaaccttacttgtccaagttctatcattggtaggcatgtttctacatcttctttgttgccaattaataacacattgtcttccattgtttggtgactggaacagatattggatgccatatcattaagatctaactgcggtccacattgaactttctcgtctggcttttgcttcaacttttcaagaatgatctttcccttatttttcagatcaagtgaaggagaaaaactttgaggcaacacttctctggtgaaaagagcctggaaagctat

SEQ ID NO: 10763 - DNA, 586 bp, Lycopersicon esculentum
  misc_feature (307)..(307): n is a, c, g, or t
  Predicted polypeptide sequence is orthologous to G214, G680
gaacatggctttcttcgaaggtttaggcatcatgcggttcgttttgtagtgttacattatcaggttcttttgtacaacaccacggatagactatatttgatagtaactgatgttgtggggagaatcggaagaagatttgttctgtatcccctgtttgtccctgaggatttgaagcagagatagctagctttggttcctttattttgatggacccttattcctcacgggaggaacttgttgttaagacaaggaaaccttatacaatcactaagcaacgagagcgatggacggaggaggagcacaatangttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaagtcactcatcacaggtgggagcaaaaaatgggaaatattcgacaac

SEQ ID NO: 10764 - DNA, 511 bp, Lycopersicon esculentum
  Predicted polypeptide sequence is orthologous to G217
gaatagatgtccgtcaaaggaagagaaaaaggagaggtattgattacaatgctgaaattccctttgaaaagaagcctcctccaggtttctatgatgtcactgaggaagaccgtccagttgatcaacctaagtttccaactaccattgaggaactagaaggtgaaaggagagtcgataaggaagctcgcctaaggaagcaggatattgcgaggaacaaaattgcagagagacaggatgcccctacatccatattgcatgcgaacaaacttaatgatccagaagcagtgaggaagaggtcgaaactgaatcttccagcaccacagattccagatcatgaattggaggccatagcaaagataggtattgccagtgatctaattgggggagatgaactgtccgaagggaatgctgcaacgcgtgctcttcttgcaaattatgcccagacaccacaacatgctatgactcctatgcgaacacctcaaagaaccccttcaactaagcaagacgccat

SEQ ID NO: 10765 - DNA, 1092 bp, Lycopersicon esculentum
  misc_feature (1034)..(1034): n is a, c, g, or t
  Predicted polypeptide sequence is orthologous to G217
gcagaagagaagatcgaagaagacatgtctgataggattgccagggagaaggctgaagaagaagcaaagcgacaagcattactccgtaaaaggtcaaaagtattgcaaagggagctccctagacctcccattgcttctctagaactaataaagagttccttgatgagagctgatgaggacaagagctcctttgttcctcctacactaattgagcaggctgatgaaatgattagaaaggaacttgtgtccttgctagaacatgataataccaagtaccctctagatgagaagccagagaaggagaagaaaaagggggtcaagcgaaaaattgttgctgaacctgctattgaggattttgaggaagatgaattaaaagaggccgatggattgatcaaggatgaggctcactttcttcgtgtggcaatgggacatgagagtgaatctcttgatgaatttgtcgaaatacacaaagcaactttgaatgatatcatgtactttcctacccgaaatgcttatggtctctcaagtgttgctggaaacatggaaaagcttgctgctttgcagaacgagtttgagaatgtgaagaaaaaaatggacgatgatactaagaaagcaacaaaacttgagcaaaagatcaaagttcttactaatggatatcagatgcgagctggaaagctttggtcacagatagagtcaaccttcaagaaaatggacacagcgggtacagagcttgaatgcttccgagcattacaaaaacaagagcagctagcagcatcccacaggatcaacaatatgtgggaagaagttcagaagcaaaaggagcttgagcgtactttacagaaaaggtacggtgacctcatagcagatacgcaaaagatccagcatctcatggatgagtatagaatacaagatcaaatgcaggaagaagttgcagcaaaaaatcgtgctcttgagttggcgaaggcagaaatggcagaaaaagatagtgtaccatctgctgatgatgtggaaccttcaggtaccggacagaattnccatacagaggaaaattctgcttctgcctctcatgtgccaatagaagctgatgtgcat

SEQ ID NO: 10766 - DNA, 1540 bp, Lycopersicon esculentum
  Predicted polypeptide sequence is orthologous to G229
gtgcttctccattttgtgataataataataatgggaagaacaccttgttgtgaaaaagtgggcatcaagagaggcagatggactgcagaagaagatcaaattctcactaattatattatttctaatggagaaggctcttggaggtcgttacctaaaaatgccggattattgagatgcggaaagagttgtagactacgatggattaattatttgaggtctgatctcaagagagggaacattacttctcaagaggaagatataattataaagttacatgcaactttgggtaacagatggtctcttatagcagaacatttatcaggtagaacagacaatgagataaaaaactattggaactctcatctaagtcgaaaagttgatagcttaaggataccaagcgatgagaagttacctaaagccgtagttgatttggctaaaaaaggtataccgaagccaattaaaaaatcatcgattagtcgaccaaaaaataaaaagtcaaacttattagaaaaagaagcattgtgttgtacaaatatgccagcttgtgatagtgccatggaattaatgcaagaagatctagcaaagatagaggtgccaaattcttgggcaggacctatagaggccaagggaagccttagttcaggtacaaatttcgatgttttgactattttttattgtgaaatttgattttaaaaaatattttttgatattaaagtgaaaaataatattcaaaatttatttaagttgtgtttggttatgaatatgaattagagttgtttttttcattttttcctcaattatttcgagtaaaccttttttttttctttaaagaattgaaattttattgtcaaatatgattctctgagttttaactatcgaaaaaagcgaaaaagatcaaacaccctctaatagtttttattaatcaattaaatacattttcaatagtgactatgacgacataatatttatatattgaaatatatgattattttatcaaaaaacttaaaatttaattttcacgtctttcttttcttttgaaacgtcattttttatatgtaccttttagatccaatatctatctatggatagacgttgcgaagtactttttgttattttcaattattaggcacaaataattgaatctagcacctcttgtatgtacaaaattttaaactgtagcaataaataaatatattttttaatttttttaaatttttatttttttttgtctgagcagatagtgatatcgaatggccaagactcgaggagattatgccagacgtggtgattgatgatgaagataagaacacaaatttcatattgaattgtttcagagaagaagtaacgagcaataatgtagggaatagttattcatgtatcgaggaaggtaataaaaagatatcaagcgacgatgaaaaaatcaaattattaatggattggcaagataatgatgagttagtatggccaacgttaccatgggaattagaaacggatatagttcccagttggccacaatgggacgatactgacactaacttac

SEQ ID NO: 10767 - DNA, 431 bp, Lycopersicon esculentum
  Predicted polypeptide sequence is orthologous to G229
ccggattattgagatgcggaaagagttgtggactacgatggattaatcatttgaggtctgatctcaacagagggaacattacttctcaagaggacgatctatttataaagttacatgcaactttgggtaacaggtaattagtcaattacttgattggactttttagcttgctgattaaaccactcattttgtttctttttagtctaggtccagaaaaaaatgtctgctttacaatcgagtgctttcttcgtttaaaaaataataattttatttttatttagtctgttttataaagaatgactttttttttagtaatatgttaaatttaattcttcacatgacatctttaaaattataaaattagagatagtttgatacatttgacataactttaatgtagaatcacttctttcttttcttaaaatcccgtt

SEQ ID NO: 10768 - DNA, 873 bp, Lycopersicon esculentum
  Predicted polypeptide sequence is orthologous to G233, G241
gttgtgagaagatggggttaaagaaagggccatggactcccgaagaagatcaaattctcatctcttacattcaatcaaatggtcatggcaattggagagccctccctaaattagccggattattgcgatgtggaaaaagttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattttgaggggttaatttggttgttttcaaaacttgaagtagtggaatgcaactaatttagtggtgtttttttttttgggatcttttgg

SEQ ID NO: 10769 - DNA, 774 bp, Lycopersicon esculentum
  Predicted polypeptide sequence is orthologous to G233, G241
cttgttgtgagaaaatgggattgaagaaaggtccatggactcctcaagaagacaatattctcatatcttacattcaaaataatggacattccaattggcgtgcccttcctaaacttgctggactattgagatgcggaaagagttgcagattgcgatggactaattatttgcgtccagatataaagagaggaaatttcaccaaagaagaagaagacactataatcaagcttcatgaaaatcttggcaatagatggtccgcaatagcagcaagattaccaggacgaacagataatgaaataaaaaacatttggcacaccaacttgaagaaaaaactcaagaattatcagccttgtcaaaattccaaaagacactccaagactagtcatgtttccaacaagggtcctacaacttctgaatcctccaataactctgatcttagtacaagtactaaacaacacattaagattgcacctaactcaccacaactttcatctagtgaaatgtcaagtgtgacgttagttgttgatgataatcagatggtgattataaaggaagaaaaaatcgagtcatcatcgtcggagtattttccaaagatcgatgagagtttctgggcagatgaattatcgacggagaataatatgattattggtcatgatcaagaaatacaagtgagggaagaaaatgtagacatatttactactagttcagaaatggaggaggacatggacttttggtacaatgttttcataaagacaggggatttgccagaattac

SEQ ID NO: 10770 - DNA, 708 bp, Lycopersicon esculentum
  Predicted polypeptide sequence is orthologous to G233, G241
gctttctttccactgaaactgaagagtgagacttctaataatttctctcacccacaaaaatttggagaaaaaaaaagaagttaaaaagttattttttttagtctgtttcaaaaaaatgattgagaaaaaaaaatgggcagagcaccttgttgtgagaaaatgagcttgaagaaagggccatgggatcacgaagaagaccaaattctcatctcttatattaacaaaaatggccatggcaattggcgcgcgctccctagacaagctggattattgagatgtggaaaaagttgcagattgaggtggatgaattatttgagtccacatattaagaggggaaatttcaccaaagaagaagaagataatatcatcaatttacatgaaattcttggcaatagatggtcagcaatagcagcaagattaccgggaagaacggataatgaaataaaaaatatttggcacacccacttgaagaaaaggctaaaaaattgtcagtctcctcgaaacttcaaaagacacaataaaattaatcaaataaataattgcatgcatgctcctaactcaccagaaatatcgtctagcgagacgtcaatcatgacaaccaattcatcatcaagtggtactttcgatacgacgatcgacgatcaaatagtgattaaacaagaagaatggactcatcggagtatttcgccaagatcgatgagagctttt

SEQ ID NO: 10771 - DNA, 539 bp, Lycopersicon esculentum
  Predicted polypeptide sequence is orthologous to G233, G241
ggaaaattagcagcttatattactaaatatggatcatggaattggagacaactacccaagtatgctggcttagcaaggtgtggaaagagttgtagacttcgatggatgaattacttaagaccaaatgttaaaagaggaaactacacaaaagaagaagatgaaatcatcttgaacctccatgctcaacttggaaataagtggtcagcaattgcaattcacttaccaggaagatcagataacgagataaagaatcattggcacacaacactgaagaagcgcgctcattataactcaagtgaagtaagcaagaaatgcaataagaagaggagtgaaagtaatattactaaaagaaagagtaatgtggaaaatcaaaatgcaagtgctaataacattaataataatatgcatgagaatatagtattggaaagctcagaatggtcaccaaatgagtcatcaagtgaagcattatcctctattgattatcaacaagacatttttcaagaagaattggctaatttggaggaaattacaagtggaag

SEQ ID NO: 10772 - DNA, 575 bp, Lycopersicon esculentum
  Predicted polypeptide sequence is orthologous to G234
ttgtgacataaataatgtcacgagagggccatggtcacctgaagaagatgctaagttgaagtcatatattgagcaaaatggaactgggggaaactggattgctttgcctcaaaaaattggtcttaagagatgtggaaagagttgtaggcttatatggttaaattattggcggccaaacatcaagcatggaggattttcagaagaagaaaatatgatcatttgcagcctctacataagtattggaagcaggtggtcaataattgcagctcaactccctggaagaactgatgacgacataaaaaactactggaatactaagctaaagaagaagttatttgggaaacaacgccaaaagcagggatcaagaaaaggaaaagaaatcaactccatctcatcaatttctaatagcatcaacaacatgaaccaaaacccttgttggcctgagcctctcatcatgcaacaaccaatacaattctcaaataatgaccatacatccatcagaaagttattaatcaagcttggaggtaaattctcagaaaatgaccaattgacaaatgttgtgtcaccaaattctc

SEQ ID NO: 10773 - DNA, 492 bp, Lycopersicon esculentum
  Predicted polypeptide sequence is orthologous to G234
gctgtcgattaagatggttaaattatcttaggccaaatattaaacacggagagttttcagacgaagaagacagaatcatttgcagcctttatgctaacattggaagcaggtatatacatatttttttctactaaaatttcaatcactattaaattataaatcacataatttcgaaaatacgatgagttgattgttaagaatcttaaaaattcaaacacattaactgtgaatcgtgaatcaatttctaagtagcgggaattttgagaacaagttataaataattcgagtgaaccgctttaattacctccttttaacttcgtacctaaataggatgtgatataattacaaattaaactcgaaatgatgaatttaaattagcattatcctagaaatatactttgcatgcatgagtattacttttcaagaattaaagtctagttatttagtactcgaatatttagtcatgaaaaataattaagctaatctcgatat

SEQ ID NO: 10774 - DNA, 732 bp, Lycopersicon esculentum
  Predicted polypeptide sequence is orthologous to G249, G1322
atattctctcatcttcctctctctacttttttttttttttggccaactttatctcttcatctttttttttttttaaaaaaccacaattctcacaaaaaagatggattaaatctgcaactctcaagatgttgaactgaggaaagggccttggactatggaagaagatttaattctcattaactacattgctaatcatggtgaaggtgtttggaactctctagctaaatctgctggtctcaaacgtactggaaaaagttgtagactccgatggctaaattatcttcgacctgatgtcaggaggggtaatattacacctgaagaacaacttttgattatggaactacatgctaagtggggaaacaagtggtcaaaaattgcgaagcatttgcctggaagaacggataacgagataaaaaactactggaggactaggattcagaagcacattaagcaaggagagaacatgaatggacaaggaagttcagagcaaaatattgatcatcaagaaggaagtagtagtcaaatatcatcagttggtcaagcagataacatagagacttactctccaacttcatacaatggaaatttggacactaattttcaagcctcaaattttctcaatgaaacaaatgacaacatgtggagcatggaggatatctggtcaatgcaattgcttaatggagattaaatcaagtatgtttggaatatttaatttgagtaattaattaaaac

SEQ ID NO: 10775 - DNA, 567 bp, Lycopersicon esculentum
  misc_feature (545)..(545): n is a, c, g, or t
  Predicted polypeptide sequence is orthologous to G249, G1322
cttcacatcccattcctcttctcttctttattatataaaaaaaatggataaaagaacatgtgattctcaagatgttgaagttaggaaaggtccttggactatggaagaagatttgattctcatcaattacattgctaatcatggtgaaggtgtttggaattccctcgctcgatccgctggtttgaagcgtactggaaaaagttgtagacttagatggcttaattatctccgacctgatgttcggaggggaaatattacaccggaggaacaattgttgatcatggaactacatgccaagtggggaaaccggtgagttgatttctttttctagctagggttttgataattaaataaaatgatgaaattatataaaagaaaatttggaaaattgtagaaatttctccttcatttttttaaaaatgaaaaataaaaaaaatctcccatgtgtttgtatgtgttggatggataaagaggaattgtcccaaaatctcttagaactagatttgacatcatgaaagagagtgatggggaatttacaacgtgtntaatgtaacctaaagtttggat

SEQ ID NO: 10776 - DNA, 512 bp, Lycopersicon esculentum
  Predicted polypeptide sequence is orthologous to G254
ttacacgtggacgttcatgatcacaattttccctccatttgcaatgatgtcggttaatcatctctcacaatacatttctcttcaaataaatttccatttcataaacgaaacagaccatagagaacactcaaaaagctgaagtttctgttgctatatattgatatacataataacatatggtgtctgtatatccaacaccaccgggtcaagattttcactacatgggggatccgatgaaaacgggtcttatgggtttgcatccggtgcagtcgggtactagtatacatgggaatttgaatttggattcgaatacaggtttggtggtgtctgatgatcacagcaagaagacacggaagccttatacgattactaagtctagggagagttggactgagcaggagcatgacaagtttcttgaagctcttcaattgttcgaccgtgattggaaaaagattgaagcatttgttgggtcgaagactgttattcagatacgtagccatgcacagaaatac

SEQ ID NO: 10777 - DNA, 919 bp, Lycopersicon esculentum
  Predicted polypeptide sequence is orthologous to G256, G666, G668, G932
ctacttttttttcccaagaaaagaagaattccacaaaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtcagctttctgaattacgtgatcatcttatttaaaagtttaaaccgtcacataaagtcatagagcacatgacttttaattttcttttcaatttgtcttattttatcgcg

SEQ ID NO: 10778 - DNA, 1038 bp, Lycopersicon esculentum
  Predicted polypeptide sequence is orthologous to G256, G666, G668, G932
cttcactgaacatgaagaaaaaatgatcatccatcttcaagctcttcttgggaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgaccttagctgaaactaatgatttgttttgaagaaaaaaaaaattgtttactagtactcccttcgtttcaatttatctgccttgatttgaccgaacatgaagttgaagaaaaaaaataagtaaaacggataaattgaagcg

SEQ ID NO: 10779 - DNA, 553 bp, Lycopersicon esculentum
  Predicted polypeptide sequence is orthologous to G256, G666, G668, G932
aatttcctataaagagagtaaagcaatacctaaaaacgaaagatacatccttttattttcattgatcttcaagtcataaaaagaagaaaaagatcattttgttcctagatatcgatcgatcgtgtaggtagaatgggaaggccaccttgctgcgataaaataggggtgaaaaaaggaccatggacaccagaagaagatatcatcttggtttcatacattcaacaacatggtcctggtaactggagagctgttcccagtaatactggtttgcttagatgcagcaaaagctgtaggctcagatggactaattatctccggcccggaattaaacgtggaaacttcactgaacatgaagaaaaaatgattatccatcttcaagctcttctaggcaacagatgggctgcgattgcttcgtatctcccacaaaggacagataacgatataaaaaattactggaatactcatctgaggaaaaagctgaagaaacttcaagggaatgatgagaatagtactcaagaaggagaaagctcatcatcatcacaatccaatttct

SEQ ID NO: 10780 - DNA, 480 bp, Lycopersicon esculentum
  Predicted polypeptide sequence is orthologous to G256
caggttgaaagcaagccaaattttccgaacatgaattcggaaaatggatatttgtttcaagcggagagcaagccaagcttggaagattcacaagtcccgtttactttgctagagaagtggctatttgatgatgctattaatgcaccagcacaagaagatcagtttatggcgatgggtttgggtgaatctgctgactttttttgaagaaatgtttactagtaatcaagtcacaagctctagtaaatatttcttcagaaaaaacatttcagttcaaaatttggggttttctttaatatgtcctttcaatgtttgttaaattacagctttgtaatttagtttaataggtttacttacttagtagctagcctgagcaaaaattctaaaattagcaagagcaaagaaaagtgtatattacaagtaatcttaaatatatgcatatgtagtgaatagtagtaatatttaccagactctttacattct

SEQ ID NO: 10781 - DNA, 600 bp, Lycopersicon esculentum
  Predicted polypeptide sequence is orthologous to G258
gaaaacagagaagattgagaatgggtcatcactgctgcagtaaacagaaagtaaaaagaggtctttggtctccagaagaagatgaaaaactcattaaacacatcaagacccatggccattcctgctggagttctgttccaaaactagctggactacaaaggtgtggaaaaagctgcaggcttaggtggataaactacttaaggccagatctaaaaaggggctgttttagtgaacaagaagagaggattataattgacgtacacagaattttggggaacagatgggcacaaatagcgaaacatttacctggtagaactgataatgaagtaaagaatttttggaattcttgcataaaaaagaaacttatttctcaaggctttgatccaaacacccacaatcttctttctactaagaaaaaagccaacaaaaacaattataccaaatcatcaattttcactattgaaactagtttatcgtcatcatcaactaaagagttggtttcaatggacatgatcaaagcaagtcttgcagcattgtcaacttttcctaattacgctaataatatgagtatgcctcagtaccaaacaagtttgagtcggc

SEQ ID NO: 10782 - DNA, 630 bp, Lycopersicon esculentum
  Predicted polypeptide sequence is orthologous to G258
ggtccataaggaaattttacagcagcttaagagagaaaatatataagcacacccatatatatatatatatatatatatatccatcaaagtcgtgttcgaagtagagatattgcccgattcttggttgtcgttcgaattcaagtcatgtggtaaagacacatcccctgctcgcatcgtctctagctcgctgccccggagaaggtgaacttccttaatctcaactcactcgttattttattttgttatgtttctgcgagcatgaagttctccgttggtttttcctcctcttgctcgtttgttttccattctctgtgagttatctttgatagtgatgagagtttcatttggtttcgaatagcttgtttcgtgtttaagttctatatatgttgttgatgtgggctgctcgtcttcaaacacccatgaagattgaggatagaatgataggtctgtcggtcttgttcataggatttggataaggtatgttattgttggattgatttttgaaatcttttgagcttgttttcgttcattcacagtgatggactcgaatatatggtccaagaatgcatatgagggttgtgtatcttcttcggaatgttgtcatgagtggtcgttttcgtttcgcattca

SEQ ID NO: 10783 - DNA, 692 bp, Lycopersicon esculentum
  Predicted polypeptide sequence is orthologous to G259
ttcaaacatagcaacttttcaagctttgttcgacaacttaatacctatggttttcgtaaaattacaacaagtcaatgggagttcagtaatgataagtttaaaaagggcgaaaagaatttactccgtgaaattcgccgaagaaaagcatggacaaataggcaacaaccaaacaacaagaaagacaatattatagaagaagatcaaagatcatcatcatcaacttcatcatcatctgagtatataaatcttgtcgacgaaaataaaaggttgaaaatggaaaatggagtccttagctctgagcttttactcatgaaaaacaagtgcaaagaattaatgaatattgttacaatatttgctaaaaatccagagaaagaagaagatgaaaaaaaaccaatgttatttggagtaagattagaagttaaagaagaaatggagaagaagagaaaaagagttgaacttaatgaaatggctagtgtttttctctctcaattatgcaaataaagtagaaatttagagagaaaaaatctatatgtaatagttgtactatgctattttgtattatttcatccaaaaattaatggtcttaattagcatgtagtgactactaattaagtggagatatatacctaaagtgtattaattatgcaagttttattttcacgtgaaatggtaaataatcattttgcttttct

SEQ ID NO: 10784 - DNA, 1259 bp, Lycopersicon esculentum
  misc_feature (1214)..(1214): n is a, c, g, or t
  Predicted polypeptide sequence is orthologous to G261
gtgcatagtcatggataactgtaatggaggatcaagttcttcttctccggcgccttttttggtgaaaacttatgaactggttgatgattcgcatactaatccagttgtttcatggagccataacggacgtagcttcgttgtttggaatccacctgaattcgctagagatttgcttccgaaatactttaagcataacaatttctcaagttttatcagacaacttaatacttatgggtttagaaagggtgatcctgaacaatgggagtttgcgaacgaggattttttaagaggacgtagacatttgttgaagaatatttatagacgaaagccgatccatagccactctgctgcagcaggaacagggcaatctgtagctccattgacggattctgagagacaggagtatgaagatgaaatcgagaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttagaacgtcaacttaagccatctgataatcagattgagtgtaagaccagtaaaacatctgaattagtatcaaactcgggtaatgatgtattttggcaacagttcttaacagagacgcctggttgcactgagccacaacaagttgagaacaaagggataaacgaatcaacgcgtgatattagattaggggatagccatagatattggtggaatcgcggagttaatttagaaaatcttgctgaaagaatgggacatcttagtagtccagcaacaggaagctgagttgattcagtatttgacattttatagctattggtgnttttttttttttttcttctagttttgatgatcagatatgtcacat

SEQ ID NO: 10785 - DNA, 666 bp, Lycopersicon esculentum
  Predicted polypeptide sequence is orthologous to G261
tcaaagtaaacttcatctttctatgtgcttcttcttgttaaggactattcttgattttttcttacaggaaagttcggaaatttctgagttttagagggtgaaacggctatcttttgaattcaagctagcatttgtttgagcacttgtgggaactcatgatgggccgcaatctcttttaacaattctttagcaaatttgtgtgttttgaaagctatccagagctgggacttgaatggaaatgtgtatttgctaagaatttgtatgatcaggtgggagctgcttcaattgaatttatcgaaggaaatcaaggtgataacacttttggttggttgtatctgtatgttgggaatctgataagttgatcttccctgtcagtaaggatttgtcacttgtagttgagcttcgccttgtgagtttcatttcaaggggttgtgatttggatttgaatttaccatggatgaagctccttgcagcgtcaatgcactgcctccgtttattgcaaagatatatgaaatggtggatgatccctccactgatccaatagtctcatggagtttaaacaataaaagttttattgttcgtaatcctcctgattttgcaagagatttgttgcccagatactttaagcacaataatttttccagctttatccgacagctgaatact

SEQ ID NO: 10786 - DNA, 717 bp, Lycopersicon esculentum
  Predicted polypeptide sequence is orthologous to G263
ttattattataagtttctgactagacaaagcaaacttgagttgcatttgacttaatagcagtctgcatgtactatatatatataatttctagttggtttcgggtgtactactcttagtagtaatctaaaccctttttactactcatactaattaaattctctatttattttattcataaacatcgaacttgtaaatccaaaggaaattactaaatcaaaagggagaagctaatttactctgctccaacctcaacacataattcaccaacttcacctcagttacaaaccttgctgctttctccggccgtcgaagacattttcatccaaggaccattatagtccacagttttcatcattttaccacgtccaccacaagtctcaatattatcatccgggccccttttcttcttcttttctttcagcaacacaccaaatagtttcagagtatcacccttttcgtcatcgtcttctttatcatcgttgtcattataactaccctgttcttctaaatctttaacaccaccaacctccttgaccaactcttcaaggctggaccccgatggggttccttggctcatgatacggttgatcatatcgggtgcaaccttcacgtactggctcaagaaagcaaccaactcattgcattgtttcttcgcctgcaccagctctgagctcagcatctggttgtctttctttagcttctcattctcatccgac

SEQ ID NO: 10787 - DNA, 775 bp, Lycopersicon esculentum
  misc_feature (650)..(650): n is a, c, g, or t
  misc_feature (713)..(713): n is a, c, g, or t
  Predicted polypeptide sequence is orthologous to G263
aggataagagagagaaaacaaatcaagtttttttagagcaagaaaagatagttatggtcgtgttgttgttggtgaagattggcaaagttgtagccaatggaagattctaagattatcatcaatcgtcctaaaaataatcttgttcattctctagtctttcttttcggtttctattgttgggattgggaatttcttactgcccttttgcttttcagttattgctccttctaattaatttcttttaaatttgtaaaattcttataggatcttgtcaattaataagtaaaatccccaaaaggggaaatttgggtagatttagagaaagaggggatgtcgcaaagaacagcgccggcgccgtttctgttgaagacgtatcagttggtggatgatgcgaccactgacgatgtcatatcttggaatgaaatcggcacaacctttgtggtgtggaaaactgctgaatttgcaaaggatttgcttcccaaatacttcaagcacaataatttctccagcttcgttcgacagcttaacacctatggttttcgaaagattgtgcctgacaaatgggaattcgccaatgagaatttcaaaagaggacagaaagagctcctcacagctatacgccgtcggaagaccgtgacatcaatcccagnctggtggaaagtctgtggcagccgggacttcagcatctccggacaattctggggatgacatanggttcagttctacctcgtcccagactccaagaaccgggatctgtggacactccggaaagttg

SEQ ID NO: 10788 - DNA, 1743 bp, Lycopersicon esculentum
  Predicted polypeptide sequence is orthologous to G264
ggaagactcaaaagggagtgcaaaactttgaagtcaagttcggacggctaaagccttttgcctttaaaagttcattcgtcgtccgtcgccggcgtatttctctcagttcaataaaatggatgtgatttcagcggcggtggcggccggcggcggtggaggtccggcgccgttcttgtcgaagacatatgagatggtggatgattcgcaaactgatgacatcgtatcatggactccgactggtcacagcttcgtcgtttggaatcctccagaattcgctcgaattcttcttcctacttatttcaaacacaacaatttctccagtttcattcgacagctcaatacttacggcttccggaagattgatccagaaagatgggaatttgccaatgaggaattcttgaaggaccagaagcatctacttaagaacatccatcgtagaaaacccattcacagtcatagtcaccctccaggttccacagttgatccagaaagagctgcatttgaggaagagattgataaacttacacgtgagaagtctggactcgaggctaatgtctcaaggttcagacagcaacaatctgctgcaaaactccagctagaagaactgactgggcgggttggcagtatagagcaaagacaagagagtttactgatatttgttgagaaggcaattcaaaatcctgactttgttgagcgtcttgctcagaaactcgagtccatggatatttctgcatttagtaagaagagacgattgcctcaaatcgatagcactcaaccagtccaagaaagtatgtcggtggacaaccatagcagttctagagttgagtttgggaacctttcccatcaagacttctcaaataagctcaggcttgaattgtcacctgctgtttcagatatcaatgtgctttcatgcagcacccaaagttcgaatgaagatggcggaagccctgcacataggagaatatctgaaggatggtccagagaagtgcaacttcggacggtaggagctatttatacccctgaagcaatagaactatcagatacagggacgtcttttatgttgaagatggattcatctctacctcatgcttcaagcaatgctgaaagctcaagactgcattccttgccacaaagcctgacatccaacgaggaagttgacggtcacatttcctgccaactgaatctttctttggcttcatgtctttcacaagtcgataaaaatcaatactcagcgaggatgcctcaaataggtcaagagataggtaaatgtttcgaatcacagtctgatgccaatgacaaaatccctcctactgatgacaaatctttgccaccttcacatgatgcaactaccaacaagcaagtgcctgcagctgctcctgttcgtgtgaacgatgtcttttgggaacagttccttacagaaagaccaggctgctcggataacgaagaggctagctctagctacaaagggaacatttacgacgagcaagacgagagaaaatcaaatcaaggagtagctagtaacacaagaaaggtggaacacctcaccctttgagtatatgaagttgtcattaactatcaatccctgttaaagtttattttttcctgttgttgttgttttggaatatattattatatggctttgtatgcatgtatacaaataatattatgataaatatacttctgagcaaataagatatgtatttggtgatgaaaaaaaaaaaaaaaaaaactcgagactagttc

SEQ ID NO: 10789 - DNA, 479 bp, Lycopersicon esculentum
  Predicted polypeptide sequence is orthologous to G268
gctccctgaaattgcatttggccatcatgtccgagttgctttagatattggctgtggtgttgcgagctttggtgcttatttactatccaggaatgtgctcaccctgtctgtggctccaaaagacgttcatgaaaaccagattcagtttgctcttgaacgtggcgtgcctgcaatggttgctgcaattgcgacacatcgtttacgtcatccaagtcaggcttttgaactaatccattgttcaagatgtaggatcaattggactcgtgatgatgggattttactactggaggttaacaggttgctccgtgctggtggatattttgtttgggctgcacaacctgtttataagcatgaagcagccctggaagaacaatgggaagagatggttaatcttactactcgtctttgctggaatcttgtgaagaaggaaggttacatagctatatggcagaagcccttaaataacagttgctatttaa

SEQ ID NO: 10790 - DNA, 295 bp, Lycopersicon esculentum
  Predicted polypeptide sequence is orthologous to G268
gtttgtgtcctgacagtatgagggagtatattccatgtttagataacgtagaagcaattagtaagctgaaatcaactgaaagaggtgagaaatttgagcgacattgtcctgaaaaagataaaggattgaattgcttggttcctccgccaagaggttatcgagctccgattacatggcctaaaagtcgcgacgaggtttggttcagcaatgttcctcatgcacgtctagctgaggataaggggggtcaaaattggatattgatagacaaggacaagttcaagtttcctggaggtgg

SEQ ID NO: 10791 - DNA, 762 bp, Lycopersicon esculentum
  Predicted polypeptide sequence is orthologous to G268
ggcccgtacaccctttgccaaaggaaaaacaggcaataagtgggtagtaaggaagggtgacaagtacatatttccaggagacatgacacaattttcccagggtgtaaatcaatacttggatcagatttctaagatggttccagaaattgcttttggccaacgaacaagagttgtcatggatattagttgtggaatagcgagttttggggcatatctgatggaccacaatgtcagtacattgtctattgcaacaaaagatgtgcataacaatcagattcaatttgcattggaacgtggagtgcctgctatgttcgcagcatttactactcaccgtcttttgtaccctagccaggcatttgacatgatacattgttccagatgtagcataaattggacccgtgatgatggcattctgcttctagaggtgaacagaatgcttagggcaggaggatattttatctgggcagcagaacccgttcacaaacatgaagagaacttgtttgcaccacttaaagaaatggaggatcttactcgacgcctatgctgggagttattgaagaaggagggtgacatttatatttggaggaagccattgaataatagttgctatctcagtcgcgctccagcagttcaaccttctctatggtcagctggtgatgatccagataatgtctggaatgtaaatttaacgaaatgtattacccaattacctgagaatggctatggagctaacgtgactgcttggcctgcacgccttcactc

SEQ ID NO: 10792 - DNA, 568 bp, Lycopersicon esculentum
  misc_feature (544)..(544): n is a, c, g, or t
  Predicted polypeptide sequence is orthologous to G268
caaatttccagatctacacaggaacacttcttgctgtcactattttttagtataactctgcaatttctggttttgcttatgatgatttgattctgttaacttcattgtcgaagaagaaggagagaacaatgaagggagatgcattgaaatctgctacagtaatcaaagttttagcctttacgttactctctatagcttttttttacttcggcaaacactggtctgatggatctcaacagcttgttttcttcaattcacgtcaagattcagcttcactcacaaacccaacaaacccctcttctcaatttgtatcaatttcccctaatttcaacaaatctttcgatttatcgtccgtaattaatgacaccaccgtttctgataagccacaggaaaaaacgccgtcggtcgaagttgttttatctcctccaccgccaccaccgtcaccgcctccggcggttcagaagatgggggtgttggatgagaatggggtgatgaatgataattttgaagtgggggaatttgatccggaagttgtggataattnggggtgttgggaatgagacggagg

SEQ ID NO: 10793 - DNA, 605 bp, Lycopersicon esculentum
  Predicted polypeptide sequence is orthologous to G270
cctaaaccctcgaattccaaacttcactccgtttcctctattcaaacttcaattcctcaactcacctccttcatttcccataaagacttttcgctcccaaattcctcctcactctctcaacttctcccttcaaaacaactcacagcaaacccatttctctcgagaagacgaagaacatgtaatcggagactgtatagtgtttgaagaaggaattttcgacgacccttttgttcaaaaaccagacaacaaccaaaataagccacaaaacaacaataagaagaaatcaacagaaattcagtccgaaaatttaattcctgaagaatgggttgaagttcagagggaaattaatattactaagaaggaaaggcgtaagctttcacagcaattggagtttgggcaacgtgcggagaggaggaggcttgatttaatgccaattggtagtaacagtaatgtgagaggcagtagtattgaggattatttgaaagcgagagaagaaaaattgaagcaattgaagccgcttgtgcttgaaaacccagatttttctaaggttaaaaaggataagaatgagaagaagatgaagaagaagagtgatgctgaattgagtg

SEQ ID NO: 10794 - DNA, 438 bp, Lycopersicon esculentum
  misc_feature (385)..(385): n is a, c, g, or t
  Predicted polypeptide sequence is orthologous to G270
tatcttcaccatgtcaccagcagctatcctaaaccctcgaattccaaacttcactccggttcctctattcaaacttcaattcctcaactcacctccttcatttcccataaagacttttcgctcccaaattcctcctcactctctcaacttctcccttcaaaacaactcacagcaaacccatttctctcgagaagacgaagaacatgtaatcggagactgtatagtgtttgaagaaggaattttcgacgacccttttggtcaaaaaccagacaacaaccaaaataagccacaaaacaacaataagaagaaatcaacagaaattcagtccgaaaatttaattcctgaagaatgggttgaagttcagagggaaattaatattactaanaaggaaaggcgtaagctttcacagcaattggagtttgggcaacgtgcggagag

SEQ ID NO: 10795 - DNA, 641 bp, Lycopersicon esculentum; identical to SEQ ID NO: 10185
  Predicted polypeptide sequence is orthologous to G270

SEQ ID NO: 10796 - DNA, 2520 bp, Lycopersicon esculentum
  Predicted polypeptide sequence is orthologous to G274
gctggtgttgtgagtctgtcgggtgaatctttcatttttactgctcaatcagtgtaattgccaaatacccatttcttctctttgactattacttctactgatctactcgattgattcaaccccactgattttttttaaaaaaaaattctatctttttcaagaaacagtgcatttatagcatagtatgtggagggtgcttctcttctgttaaaacccccttagtttcagatctctcacttgtctagtgaggactgaggaaccttcacttcagatttctcacttgggagcttctggtgttgccgcaagcacataatggcgtccaagtatcatggaccaatcaacagaacacggcgaccgatctctatattaattgtaattggtctttgttgtttctgttatctaataggaatttggcagaaaagtggatccggaaagggagataaattagcactacaagtgactgagcaaactgctgactgcaatgtttttccacaaaccactctggattttgagtcacaccataattatgtggaaacggttgaaacttcagaactaacagttaaaagattcaaatcatgtgaagctaaatacactgactatactccctgccatgaacaagaccgagctatgaaattcccaagggaagatatgatatatagagaaaggcattgccctccagatgatgaaaagcttcgttgtctgattctagcacccaaaggatacacaactccatttccatggcccaaaagccgtgattatgcctactatgctaatgttccttacaaacacttgacagttgagaaggcagtccagaactgggtgcagtttcagggaaacgttttcaaatttccgggaggaggtacaatgttccctagaggagcagatgcatatattgatgaacttgcttccgtggttccaattggaagtggcatgatacgaactgctcttgacactggttgtggggttgctagctggggtgcttacttgctgaagaggaatattctggcgatgtcatttgcacctaaggacaatcatgaagcacaagtgcaatttgctttggagcgaggtgtacctgctgttattggagttcttggttccataagccttccattcccatcaagatcatttgacatgtctcattgttctcggtgtctgattccctgggcatcaaaagagggtatgtacatgatggaagttgatcgagttctgagacctggtggatactggatactgtctggtcctccactcaattggaagacctatcacagagtctggaacaggaccaaggagaattgtagagccgagcaaagaaggatcgaagagcatgctgagcttctttgctgggagaagaagtacgaaaaaggtgatgtggctatatggaggaaaaacataaatggaaagtcatgcagaagagcatccgccaacatatgtcaaacaaaggatgctgataatgtctggtataagaaaatggatgcatgcataaccccctaccccgacgtgaagaattctgatgaagtagctggaggagaattgaagaagtttcctgctaggctttttgcagttcccccacgtatagctaatgacttggtttctggggtaacagttgaatcttatgaagaggataataagctttggaagaaacacgtcacttcttacaagaggagcattagcctacttggcaccactagataccacaacataatggacatgaatgccggacttggaggatttgcagcagcactagactctcctaaactgtgggtgatgaacgttgtgccaactattgctgaaaacactcttggtgtcgtatacgagaggggcttaattggcatataccatgactggtgtgaaggcttctctacatacccgagaacgtatgaccttcttcatgctaatcgcttgttcactctgtaccaggacaagtgtgaatttgaagatattctcctagaaatggaccgtgttctgcgtcctgaaggcgcggtcattcttcgagatggagttgaagtcttgaacaaggttaggaaaatcgccgcgggcttgagatgggacactaaattattagatcatgaagatggacccttggtacctgagaaaatctttgttgctgtcaaacaatatttcgttgaaggcgatgaagaccaaagcacgccaaatgacgattgagtgatgccaatattcgattacatcgagagaaacctgagaattctgaattgggaaggtaagatctccaggcagagatatgaaggttttttttcttctcaaatatggcatacaacaagtagtgcaagttcccatgtagagcaattttagttatttttcctttaatgtgtgatttttggagatcttttttctccaaataatgaagcaaagcaagagttcattagagtgatatgtatgtttgggagcaaatttaatagttgtttccactaattacagagttgaattttgaacaattgtaaaccctatttttttttttaatcttggtaatttaatttatttaaaaaaaaaaaaaaaaaaaaa

SEQ ID NO: 10797 - DNA, 1681 bp, Lycopersicon esculentum
  Predicted polypeptide sequence is orthologous to G274
ggagcagataaatatattgatcagcttgcttctgtaatcccaattcaaaatggaactgttcggactgctctggacactggttgcggggttgcaagttggggtgcttatctttggaaaaggaatgtcatcgcaatgtcatttgctccacgagactcacatgaagctcaagttcagtttgctcttgaaaggggtgtacctgctgtaattggcgtcctaggaacagtcaaaatgccatatccatctagggcctttgatatggctcattgttctcgctgtctaatcccatggggagctgctgatggaatcctcatgatggaagttgatagagttcttcgacctggtggctactgggtgctttctggccctccgatcaattggaagactaattacaaggcctggcaacgccccatggaggaccttcaggaagaacaaaggaaaattgaagagattgccaaacttctttgctgggagaagaaatctgagaagggtgagactgctatttggcagaaaaggatggatgccgactcatgccgttctacgcaagaagagtctgaagctacactttgtaaatcgacagatccagatgatgtctggtacaacaaaatggaagcatgcataacaccaagcaaaggcaatggtgatgatgaaggtctaaaaccattccctgagagactttttgctgttcctccaagaattgctaatggactagtttctggagtccccgttgaggcatatctggaagacaacaggaaatggaagaagcatgttagtgcttataagaaaattaacaaactcatagacacaggaaggtaccgtaatatcatggacatgaattctggacttggaggttttgctgcagctcttcaatctcccaagttgtgggttatgaatgttatgcctacgatagccaagaaaaataccttgggagtcatttatgaacgtgggcttatcggaatttatcatgactggtgtgaagcgttctctacatacccaaggacttatgatctcattcatgctcatggtcttttcagtttatacaaggacaagtgcaactttgaagacattctcttagagatggaccgtattttgcggccagaaggcgctgttattctgagagatgatatagatgttctaattaaggtaaagaagataataggaggtataagatgggactccaaattgatagatcatgaagacggtccccttgttcccgaaaaaatactggtagcagtaaaacaatactggactgtgggggatgataattccacatccacacgataagatgccagtgaagacagtgatggtttaatggatcccaaggaccaattcttccataatcgaagttcagtgagtagcttattacagaaccttcaacacaagaaatttttggtcgatgagacgaggctatatggtgtctgtgtgtttaaccttttctattgatggatccatacattatattgtatgatattatgctttgtaaaacttgcattcatttatttttctttcttctctttgaagccccacactacatgatggatcttttctgaaacttttgatgtattcttaggagcattttcatctctgatgaaaaaaacagatgttgtaatgtgttcaattcaagtggggagaaaccacttagctttcctggtaaaaaaaaaaaaaaaaaactcgagggggggcc

SEQ ID NO: 10798 - DNA, 630 bp, Lycopersicon esculentum
  Predicted polypeptide sequence is orthologous to G274
gataaaatggaagcatgcataaaaccaagcaaaggcaatggtgatgatgaagatctaaaaccattccttgagagactttatgttgttcctccaacaatttctaatagaatagtttctgaagtctccatcgaggcaaatctggaagacaacaaaaaatggaagaagcatgttagtgcttataagaaaattaacatactcatagacacatgaaggtaccgtaatatcatgaacatgaattctccactggaggttttgctgcagctcttcaatctcccaagttgtgggttatgaatgttatgcctacgatagtcgagaaaaatatcttggaagtcatatatgaacgtggttctatcggaatttatcatgactgttatgactttctctcttctatgctcaattatatacttatgtggtatagttgtggctttgataacttatcaaggatttttccttcataggaagttcaagtactattgccactcgattttctctgtgtgattattaatcttgtatttttaagtctttgattttaaatgcaaaaaaccatcaaaggaaacctttgttcttcattaatgacttcagaaatgtcatatgaaaagacaccttgatctaaaaaaaaaaaaaaaaaaa

SEQ ID NO: 10799 - DNA, 737 bp, Lycopersicon esculentum
  Predicted polypeptide sequence is orthologous to G274
tttttttttttttttttttttcatatcagaaatcaactagatcaaatttccactttaattaaacaacacattacagagtctatatatcgagggaagaaatgtttataaaggactttcaaaaagcttcataataatcccatgtagctcagtttttagagtcattatctaacgagacatggaacagagaagaaaatgaagacagttataaacgctaaatcatctggtataatttatggatccatcaagactaaagatgtgccgtggagtcacctgtcaagggaccctgctcgatcaaaattcctaggggtgaaacgtcttgcataaccatggattttgtattcataagatgttggtcttcctgatccatacgagttcatatggtcagacaacatcttcggtggcatctcattgtgaggatgtggagttggtatcacccagagtccaatattgtttgacagcaaccagtattttttcgggaacaaggggaccgtcctcatgatccatcaatttgaagttccacctcatgcctcctattatcttcttcaccttgatcagtacatctacattgtctcttagaatgacagctccttctggacgcaaaatacggtccatctctaagagaatgtcttgaaagtcacacttgtccttatataaactgaaaaggccattagcatgaatgagatcatatgtccttgggtatgtagaaaatgcttcacaccagtcatgatagataccaa

SEQ ID NO: 10800 - DNA, 1332 bp, Lycopersicon esculentum
  Predicted polypeptide sequence is orthologous to G274
gcacggcttgaatcatgtgttagctgtgatctgtttatttaatcattggaactttgtgatttggatttgatttcttgtttagttgattcatttgacagggctgcaatggcgggcaaaaactcaggggataataggactaggacttctgtatcaatatttataatagctggtctatgctgcttcttctatttacttggagcatggcaaagaagtggttttgggaaaggagatagtatagcagtggctgtcaccaagactgctggtgagaattgcgatgtactaccaaatctcaattttgaaactcgtcatgctggcgaagcaggtggtactgatgagtcggaagaagtcgaggaacttaagccatgtgatcctcagtacactgattatacaccatgtcaagatcaaaagcgtgctatgactttcccaagggaaaatatgaactaccgagaaaggcattgtccacctcaagaagagaagttacattgccttattccagcacctaagggatatgttaccccatttccgtggccaaaaagtcgggattatgttccctatgccaatgctccatataagagcttgactgttgagaaagctattcagaattgggttcaatatgagggtaatgtgtttaggttcccaggaggagggacacaattccctcaaggagcagataagtatattgatcagcttgcttcagtcgtcccaatcgagaatgggacagttcggactgctttggacactggttgtggggttgcaagttggggtgcttatctttggaaaaggaatgtcatagcaatgtcatttgccccaagagactcacatgaagctcaggctcagtttgctctggaaaggggtgtgcctgctgttattggtgtactaggaacaatcaaaatgccatatccatctaaagcctttgatatggcccattgttctcgttgtctaatcccatggggagctgctgatggaatcctcatgatggaagttgaccgagttcttagacctggaggctactgggtgctttctggacctcctatcaactggaaggtcaattttaaggcctggcaacgccccaaggaggatcttgaggaagaacaaaggaagattgaagaggctgctaaacttctttgctgggagaagatatctgagaagggagagactgctatttggcagaaaagaaaggatagtgcctcatgccgttctgcacaagaaaattctgcagccaaagtttgtaaaccttctgatccagatagtgtctggtacaacaaaatggaaatgtgcataacaccaaacaatggtaatggtggagacgagagtctaaagccattccctgag

SEQ ID NO: 10801 - DNA, 550 bp, Lycopersicon esculentum
  Predicted polypeptide sequence is orthologous to G274
tgggtaagactgttggagaaccacctccaatagagataggaccaaagaggctgaaagtttggaggaagaactgaataactcataaaatccaacttcagtgacacccattttctccaatggagggacctaacaaaaggatgaaaagttaaatatttaggggaagcagctatgtaacttttaaccaaaacttagattcaggaagtacattctatgtacaggcctcaaaagggggcaaatggagcgctgatgattcttatggttctcaggccagggtgttttccgtctttggcaggagaacatatcaatctgcctcgtgggcagagttagctgatatttgtgctgctaggaggtagcaatacgtagtgtaatagccgataatggtactttccttcccttgccacgagaagatagtagattcaggttaggtacttcactcatgtacattttgttcattaacaaattggtcgattcttgtgaggtcaaatgtccaatatcaggtcaggtctctgatttaaatgtgacatctactatctatctccctgtcattatt

SEQ ID NO: 10802 - DNA, 585 bp, Lycopersicon esculentum
  Predicted polypeptide sequence is orthologous to G274
ggtttctgttcttgatttaatttgaaaggcatatctgagttgtggacttacaaagcaaaaataaagcaggaaagccagtaaaaggaagtattgattttttttttcatgccactggacagcaatggcaaacaaaagcatgggggacaataggaccaggacttctgtgtcaatatttattgtagctggtctctgtttcttcttctatttgcttggatcatggcagagaagtggcgtcgggaagggagatagtatagctttggcagtcaccaggagtggtgagaactgcaatatcctaccaaatatcaattttgagactcgtcatggtggccaagcaggtagtattgatgattcaggaacggaagtcaaaaaatttaagccatgccgtcctcgttacactgatcatacaccatgtcaagatcaaaagcgtgctatgcacctcccaagggaaaatatgatctatcgagaaaggcattgtccgcctccacaaaagaagttgaattgccttattccaccacctaaggggtatgtcgccccatttccatggccaaagagtccggattacgttccatatgtgaatgcccccta

SEQ ID NO: 10803 - DNA, 602 bp, Lycopersicon esculentum
  Predicted polypeptide sequence is orthologous to G274
tggtattgcagctcctttattgaaggtcctattgttggccgtgcctagttgctaattaagtaaaaaggtctaaataattgtgatatgataagagcaaaggtagcttaagtaaatatacactgatagtagatgatcatacacttaaaattttaggatagtaaccttctcagtatatggtataatgactgatatttgaagtaccgacagaagtttgcgtgtgttgtggctaaatccaccatcatttctcctttttgctgctgtgacttaatatgctgttattcgtaactgcactgttcttgttgaaatagaaatgccagctcgtcactctggcaactcatatctcccccgtctactgatccccagccaggaaaagaaaaaaatacccagttaaagggtgctacaggaagaaaaataattggtatcattgactaaattagcattttctaattttataggtgtgactttcaagacattctcttagagatggaccgtattttgcgtccagaaggagctgtcattctaagagacaatgtagatgtactgatcaaggtgaagaagataataggaggcatgaagtggaacttcaaattgatggatcatga

SEQ ID NO: 10804 - DNA, 789 bp, Lycopersicon esculentum
  Predicted polypeptide sequence is orthologous to G274
ggccaacattgctgcttctctgatatccagttgatcatggcaaccaaaaggaaatccaggggataacagaaataaaagctttttaccatcattacttgtcatagctgcactttgttgtttcttctatgttcttggagtgtggaaaagaagtggttttgggaagggagacagcatagcacttgaaataacaaagaaggcagaggactgcggtatccttcctaatttggagtatgaaactcaccatgggaatcaaagcacctcgttcgatgatcccaagcaagatgtcaaggagattgagccatgtggcgagcaatacattgattatacaccatgtcatgatcaaatgcgagcaatgacatttcctagagaaaatatgaactatagggagagacattgtcctccagatgaagagaagctgcattgtcttgttccagctccaaaaggatatgtcactcctttttcatggccaaagagtcgtgactatgtaccttttgcaaatgcaccacataagagcttaacagtcgagaaggcagtgcaaaattgggttcaatatgaaggagatgtatttagatttcccaggtggtggaacacagttccccaatggggcagatgcatatattgatcaacttgcttctgttataccgatggaaaatggtactgtaagaactgcattggataccggatgtggggttgcaagttggggtgcataccttttcaagaaagatgttctaaccatgtccttcgcacccagagactcgcatgaagctcaagttcaatttgctttggaaa

SEQ ID NO: 10805 - DNA, 1779 bp, Lycopersicon esculentum
  Predicted polypeptide sequence is orthologous to G275, G837
ggagtggcctacgagtagggaaaagatatggtaccacaatgttccccatacaaagcttgcagaaattaaaggacatcaaaattgggtaaaagttagtggtgaataccttaccttccctggtgggggaacccagttcaagcatggcgctctgcactatattgatttcatacagcagtcttttccagaaattgcctggggaaagcaaactcgggttatattagatgttggatgtggggttgcaagctttgggggttatcttttcgaaagagatgttttggccatgtctttagctcctaaagatgaacatgaagctcaggttcagtttgctcttgagaggggtattcctgctatatctgctgttatgggtacaaagaggcttccctttcctagtcgagtctttgacgttgttcattgtgcacgttgtagagtgccctggcatattgaaggggggaaacttctcctggagctgaatcgtgtacttcgacctggtggactttttgtgtggtctgctactcctgtctaccagaagctccccgaagatgttgagatctgggaagccatgcagaagttgacaaaggcaatgtgctgggatcttgtttcaaaaaccaaagatagagtcaatggagtaggggttgctgtatatcgcaagcctacttccaatgagtgctatgaacaaagatcaaaagacgctcccccgatttgtcaaggatctgatgatccaaatgcagcctggaatgtgcctttacaagcttgcatgcataaagctcctgttgccacatcggaacgtggatctcaatggccagaaccatggccagccaggttatcgaaatcaccttactggttattgagttcccaggttggagtatatgggaaaccagccccggaagattttactgcagattatgaacactggaaacatgtggtgacaaattcatatcttaatggaatggggataaattggtctactgtgcggaatgttatggacatgcgtgctatctatggaggatttgcagctgctttaagagacttgaatgtgtgggttatgaacgttgtctcagtagatgctccagatacactaccaattatttatgaaagaggtctttttggaatttatcatgactggtgtgaatccttcagcacttaccccagatcgtacgatcttgtccatgcagaccatctcttctccaagattaaaacaaagtgtggtttaccggcaatagttgctgaagttgaccgcattttgagaccaggagggaagctcattgtgcgtgacaaagaggagactataactgagttagaaagtatgctcaagtctatgcaatatgaaatcaatatgacctattccaaggacaaggaaggattgttgtattgccagaaaacaatgtggcgaccaaaggacgttgagacactaacttatgccattgcttagctgccttgcatgtgaaggatgctggttgtgttccgttcaagaggctttcatgccacggtgactagataattttctgattaaattcttgtaactttattcttgtcaggctatcgcgtaccatttccttagcaaattagtagtatcatcattaaatatttgtggatagtaaatgccttgaggttctgtattttgtaatatggaggaggtgaacgatggtaaatctcaaaagcaccacaatcatattcgttttcacattgaattgggcaacaggccaatactccctatactttgtattgttgaggaatatctgctttattagtcttcaaaattgcaaaaaaaaaaaaaaaaaa

SEQ ID NO: 10806 - DNA, 1075 bp, Lycopersicon esculentum
  Predicted polypeptide sequence is orthologous to G275, G837
gattaatgaagataaactaaatgaagtaggtgtagctatattcagaaagccaactacaaatgattgctaccagagtagaacacaaaatgacccacctatgtgtgaagaagctgatgatccagatgctgcctggaatataacacttcaggcatgtttgcacaaagctccagcagatgcatctgcacgtggagcaaagtggccagcaaaatggcctttgaggtcggagaagcttccttattggttgaaaagttctcaagttggagtttatggaaaagcagccccagaagacttcgctgcagactatgatcattggaaaaatgttgtgtcaaaatcatatttaaatgatcttggcattaattggtcttcagtaaggaatgtcatggacatgaaagctatttatggaggatttgctgcagcactgaaagacttgaaagtctgggttatgaatgtagttccgatcgactcacctgacacacttccaattatatatgaccgtggcttgtttggcatttaccacgactggtgtgagtccttcagcacatacccaagatcctatgatcttcttcatgcagatcatctattctccgatattaagaaaaggtgcacgatagaatcagtatttgcagaagttgacaggattctgaggccagaaggtaagttgatcgtgcgggacaatgctgaaactattcttgaaatagagaatatggctaggtcagtaaaatggaaagtgaagatgtcttactcaaagaatggtgaaggattactatttgttcaaaaatcattttggcgtccaaatcaagaacagatagtcaagtcagccattgcataagcagagaagaaaattttccacaattagatacaaatctgatgttccttttatagtttagtttacttccactaaattaatagagaataccatcatgatatagctatcaaccggtaagtacgatttattgttttatgtactgagttttcatcattttggccattctctgtataattacctcaactttgtgtttcatataatggaaaaagtatacatttgtgaaaaaaaaaaaaaaaaaaaaaaaaaaaa

SEQ ID NO: 10807 - DNA, 933 bp, Lycopersicon esculentum
  Predicted polypeptide sequence is orthologous to G275, G837
ggagaatgaagtttttccagctgctgatcaatcagagattttgaaggaagctacaacacaaaatgggccatggtcaactcaggctgctgagtctgaaaaggagaatgagtcacagggttcttcatcatcaacggatgacaagaaaggcgataagtggaagctatgcaaaactgatgctggaccagattatattccctgtctagataatgtgcaagctataaggaagctccaacacactagccactatgagcatcgtgaaaggcattgccctgttgaagcttcaacttgcctggttcctctgccttcaggatacaagaagtcaattggatggcctaggagcagggatcagatatggtactctaatgttcctcatggaaagctagccgaggtcaaggggcaccagaactgggtcaaagtaactggagagtaccttactttccccggtggaggtactcagtttaagcaaggtgctcttcattacattgatttcctccaaaagaccctgcctcaaatttcatggggcaaacaaacacgtgttattttggatgttggttgtggagtggccagctttggaggatatctctttgaaagagatgtactagcaatgtcacttgcccccaaggatgagcacgaagcccaagtgcaatttgcacttgaaaggggtattcctgctatatcagctgttatgggaactaaaagactacctttccctggcaaagtgtttgatgctgtccattgtgcacggtgtagagttccatggcatattgaaggtggcaaacttctcctagaattgaatcgtgtcttgcggcctggtggtcacttcatttggtctgcaacaccagtatatcggaaggatgaggaaaatgttggaatttgggaagctatgtctgaactaactaagtcaatgtgctgggaactattggaaattaatga

SEQ ID NO: 10808 - DNA, 1031 bp, Lycopersicon esculentum
  Predicted polypeptide sequence is orthologous to G275, G837
caaaattcacatggttcacttctaacacctgctccccttttttctcagatctgttcttggagctgctaaaaggtacatgggtggatagaggaaatttgtgaaggactgatagaagttaccggaaaaaatggcattaggaaagtactctagagtagatggaaggaagtcatcaaactattgctccactgtaactatagtggtatttgtagctctatgtttagttggggtatggatgatgacgtcatcatctgtcgttccagaccaaaatctagatttgtcctcacaggggaaaaagactgacctgtcaacacaggtaaccgaaggtaaagagagttacaatggtggcaatgagagtaacaataaagctggtgatgagagtaatccaacggatgagggaaaatcaaaacaatttgaggataccctcggtgatttacctgaggatgcaacaaaaggggatgcgttagttagtcaagaagaaaatgtttctaatccacaacagacagaatcaacttcagaagtgaaacaggaagagaaatcgacagaacagaaagaggatgctggagaatctgagtcagaaactcaatccgagaaggcaacagatggttcagatgacaaaaaggaagatggtccaaacaaagtagatgacaaggattctgaagctggggagaaaactgaaaataaatctgtcggagaagagatcaaagaaagttctgatgagaaaaaatcaatagaaaactcagttgaactgaatgataaaaaggatcaggaggtaggccaaagttctgatgagaagtctgatggtgagaagaaagacctgtcttcaagtgccgtattgagttcggggactcagtcggaccttttgaatgaaactacaactcaaaatggggcatttttaactcaagcgtcggaatcaaagaatgaaaaggaaatgcagaagtcttcggagtcagataaagaaagtagttacatttggaaactctgcaattccactgctgggccagattatatcccttgccttgataatttggaag

SEQ ID NO: 10809 - DNA, 515 bp, Lycopersicon esculentum
  Predicted polypeptide sequence is orthologous to G275
tgttcatcggaatccgccatggatgacgaaaacgagagctccaaatcagccggactcaaaaattcaaatctagaagaagaagaagaagataaaatcagcaacaaaatcgaaaattcctccgtacacaacgacgaaaacggtgacgacgatagagtaattgacggtagcagtggagctgagagtttacgagaatcaaagacgggagctttaatttcagaaaccctagctcatcctaatgcagaatcatccgtacaaattgaaattgatggccaatccgaattcgattcagagttttctccctcttatcaactttctgaagtaccagtggaatatgaactgccctcgtttggtttctcggaaaaaatcaaggatagaattagtgttaccaaacctggaactttgaatgctcaagcacgaacagaacatcaacgacgtgttcctgatgcagcatcctcattggagctgtcctctttatctgttgcacagtccatttcatcagtgccaagtgcaactct

SEQ ID NO: 10810 - DNA, 772 bp, Lycopersicon esculentum
  misc_feature (716)..(716): n is a, c, g, or t
  Predicted polypeptide sequence is orthologous to G278, G1290
gcttcctcctcttcttctctgtcccttttcctcccccaattcatcatataattcctaactagctaacaaccccttgttcaatttcttttctctccccaaattcaatggctctttcttccaaatgatccctctattccattccccctttctcccatgaacgtatgctctaatggatagtagaactgctttttcggattccaatgatattagtggaagcagtagtatatgctgcatgaacgaatcggaaacttcactggcagacgtcaattccctcaaacgtctatcagaaacactagagtctatcttcgatgcgtctgcgccggatttcgacttcttcgctgatgctaagcttctggctccaggcggtaaggaaattccggtgcatcggtgcattttgtcggcgaggagtcctttttttaagaatgtattctgtgggaaagatagcaacacgaagctggaactcaaagagctgatgaaagagtatgaggtgagttttgatgccgtggtcagtgtgctcgcctatttgtatagtggaaaagttaggcctgcatctaaagatgtgtgtgtttgtgtggacaatgagtgcttgcatgtagcttgtaggccagctgtggccttcatggttcaagttttgtacgcatcctttacctttcagatctctcaattggtcgacaagtttcagagacacctattggatattcttgacaaagctgtancaaatgatgtaatgatggttttatccgttgcaaacatttgcggtaaagcatgtgaa

SEQ ID NO: 10811 - DNA, 787 bp, Lycopersicon esculentum
  Predicted polypeptide sequence is orthologous to G278, G1290
ggatttgcgtatgaagctgttataccttgaaaatagagttggtctggctaaactcctttttcccatggaagcaaaagttgcaatggacattgcacaagttgatggcacgtctgaattacccctggctagcatgaggaagaagatagctgatgcacagaggacaacagtggatttgaacgaggctcctttcaagatgaaagaggagcacttgaatcggcttagggctctctctagaactgtggaacttggaaaacggttctttccacgttgttcagaagttctaaataagatcatggatgctgatgacttgtctgagatagcttacatggggaatgatacagtagaagagcgtcaactgaagaagcaaaggtacatggaacttcaagaaattttgtctaaagcattcacggaggataaagaagaatttgctaagactaacatgtcctcatcttgttcctctacatctaagggagtagataagcccaataatctcccatttaggaaatagattttgtattaggacatatgaggaagaaacacaggactctctttctttttcatcatttgatgcatacaaaacacatgtaccataaacttgtattgtgaaaaaaagataaaatttcattattagttgagaagcaatcatttgaaagtgaaaaaaaacaaaatggcccacctagaagataagatatgtaacaattgttaatagtattattattattattattatgagttaaatgactaataattgtggattttgtggctctaaaaaaaaaaaaaaaaaaaa

SEQ ID NO: 10812 - DNA, 1028 bp, Lycopersicon esculentum
  Predicted polypeptide sequence is orthologous to G280
gacactcttttctttcttgtagggacatctctagaacacacacacacactctctctctatccatggctactcaaagcttcaaccagttcccttcataccctgagatgatttatgaagctcttgatgaactaaatcaagaagggggtgcaaacaagtcatcaataagcaagtacattgaaacaaagtatggagatctgaatgaagatctttcaaagatgctacctttacatttggacaacatgaagcaaaatggagatctgattttcctcaagaacaattacatcaaacctggtccagatgttccagcaaagaggggtcgtggtaggccaccaaaacccaaagctccattgcctcctggtgctgttgaatctgttgaacctgcatcaccaaggccaagagggcgcccaagaaaagaccctaatgcaccacctagttccaagaagccaaagccagaatctgttgctggaggtcccaattcaacaaatcttggttctactactggaaggcctaggggtaggcctaggaaagttaggccacagcctgctcatgatgatgatgatgatgatattgaggaatgctgaaaacttttaagacttgttattggactcttgctgatggtgatgactctaatgacttagttgtcttaatatcctctttttttttaggtgttagtagtattatcttatgtaatagtttcagtttgagttgccctagtgtgactagggggtcatggtttcaaagttaagactgcgtagaatagactaattgtcgttatgcgactagggtcatggtttacagtgtgcaatagactaattgtggtccggttcttttctgaaccccgcacatagtgttagcttagtgcactggtcttttttattagtatgtttaatgcccctattagttatacaggttgttaggggtttgtgtgcttgtgtgttttaacactttgtttcaagattcactgtgtagtctgtgtaattgttgcacttttcattatgttgatgaatctttttgttaaaaaaaaaaaa

SEQ ID NO: 10813 - DNA, 830 bp, Lycopersicon esculentum
  Predicted polypeptide sequence is orthologous to G280
gagaactagtctcgagtttttgtttttctctgtaacaaaaatggctactgaagaacataatctaactttgcctagttatcctgatatgattatggaagctatagatgcgttgaatgaagaagaagggtcgaataaatcagctatatggaagcaaattgaagcgactcatggtacactaccaccagcgcatggtacactccttgcacatcatttgaatcaaatgaagcaagctgggcaattagttatgttgaagaacaactacatgaagccaaatccaaacgcgccgccgcgccgtggtagaggccgtccgccgaagccgaaaagttcagttccggtaccggatgggtatcctagaccacgtggaaggccaccgaaggagcgggatccgtacgcgccgataacggtacctatgaagaagacgagtgagggtagctctgggggaagtgggaagaagcgtggaaggccaaggaagtatccgatgacggaggatacgccggtggtgaagccaattggtgctccgagaggaagaggaaggccgccgaaggtgaaaactccggtagctgcaactgtaggggcttaattgaagaaagacgaattaaattagggacttgtatggcaaaatatgctaacttgttgtttttcactttttatctgttttgaattttcatgtttagtccctgtagttttgttttaattacaatttgtaggaagaattgtgtgactttgtgagtgatttttatcatgtaattgggccaatgtaaatccaaattgagggctttttatttatatataaaaaaaaaaggttcagtattaaaaaaaaaaaaaaaaaa

SEQ ID NO: 10814 - DNA, 829 bp, Lycopersicon esculentum
  Predicted polypeptide sequence is orthologous to G280
gctcactctctctctctctctccatctctttgtggggacatttctctctttctctctctgcaagtttcaatggctactgaatttgtcaacaagattcatcctgaataccctcagatgatttatgaagcccttgatgcattgcaacaaaaagaaggctcaaacaagtcatcaatatcaaagtacattgaatctaagtatggaaacatgaatgatgcacactcaaagttgataacttaccatttggatagaatgaaacaaactggtgaacttattttcctaaaaaacaactacattaaacctggtccagatgcaccccctaagcgtggccgcggccgaccacctaaacccaaacctatattgccacaaggaacagatattgcagctccaaagccaagaggtcgcccgaaaaaagaccccaatgcaccacctactcccaagaaaccaaaaccaacaagtgtccctagtgacttagctcctgtttcgaaaaccggaaggcctagaggtaggcctaggaagattaggccgcagccaccacaaaatggtttagagtgaagctgaaaatccgcagacttggttgatggtgacgacttttataactctgttgtgtttttaagttttcttggttgatgttgtagttgtaaggggttgtgtttcttctagctgtgtaatgtagattgttaggagatcctgtacttgttttaatgcttgttgattcgcgattcacagtagatagggaagttgagccacagccagcacagaatggtgtaaagtgaagctgaagatttgttgactttgttgatggtgatgactctcaatgactgtgttatgt

SEQ ID NO: 10815 - DNA, 678 bp, Lycopersicon esculentum
  Predicted polypeptide sequence is orthologous to G287
tatccgcaatcccaacgtttctgccgaggcgatcagaaaggctggcgccatgcaaacagtcaagttggctcaggagtttcccgaactgctggccattgaggacaccacctctttgagttatcgccaccaggtcgccgaagagcttggcaagctgggctctattcaggataaatcccgcggatggtgggttcactccgttctcttgctcgaggccaccacattccgcaccgtaggattactgcatcaggagtggtggatgcgcccggatgaccctgccgatgcggatgaaaaggagagtggcaaatggctggcagcggccgcaactagccggttacgcatgggcagcatgatgagcaacgtgattgcggtctgtgaccgcgaagccgatattcatgcttatctgcaggacaaactggcgcataacgagcgcttcgtggtgcgctccaagcacccacgcaaggacgtagagtctgggttgtatctgtacgaccatctgaagaaccaaccggagttgggtggctatcagatcagcattccgcaaaagggcgtggtggataaacgcggtaaacgtaaaaatcgaccagcccgcaaggcgagcttgagcctgcgcagtgggcgcatcacgctaaaacaagggaatatcacgctcaacgcggtgctggccgaggagattaaccc

SEQ ID NO: 10816 - DNA, 685 bp, Lycopersicon esculentum
  Predicted polypeptide sequence is orthologous to G291
ggatgaccccatctcggagtaccagaccattcctttgaacaaaatcgaagactttggagtacattgcaagcagtattattcattggatattacctatttcaagtcctctctcgattgccatctcttggacctactatggaacaagtattgggtgaacacactttcttcttctcctttgcttggaaatggagactatgttgctggacagatatctgatcttgctgaaaagttggagcaagctgaaaatcagctgtcccattcacgttttgggcacttagtggcagcccctcaaaggaagaaggaggaagaatctcagcttgctaagattacacgtgatagtgctaagattactgtcgagcaagttcatggcttaatgtcgcaggttattaaagacattcttttcaatagtgttggtaagtcaagcaagtcacagacggaaccctctgatcccgagcccatgatcgaaagctgagaagttcatattactatcaaattggatgtagaccaatttggtgcaatttctaggtttctttttgcagttgactatatacatctttgactctatttgtgcagcctacaaagaggtgatagtttacgatgattggctctcttagatatcatgacttttgctgttcaatgttatggaagatttcgtcaagtctttcacaaaaaaaaaaaaaaaaaa

SEQ ID NO: 10817 - DNA, 856 bp, Lycopersicon esculentum
  Predicted polypeptide sequence is orthologous to G291
gtatattcttaattctttaaattattaattttgtgatttttcacttgtataaaatcagagaagagagctctgcaattgcttcttccccgaagttcagttcccaatggacgctctgaattcttacgcatcgtcggcggcgatggcgcaacaaacatgggagttagaaaacaacatcgtgacgacggacgcgccatcggggtcggcaccggaaaactctgcgtcggatgcaatattccactatgacgatgcggcacagactaagttccagcgggagaagccgtggacgagtgaccctcactacttcaagcgcgtgaagatctctgctcttgctcttctaaagatggttgttcacgcgcgttctggaggtacaattgaggtaatgggactaatgcaaggtaagacggatggagatgctattattgttatggacgcttttgcccttccagttgaaggaactgaaactagggttaatgctcaagctgatgcgtatgaatacatggttgaatattcacagaccaacaagcaggctggtcggctggagaatgtggtcggatggtatcattctcatcctggctatggatgctggctctctggcattgatgtaactacacaaatgcttaaccagcagtatcaggagccctttcttgcagttgttattgatccaacaagaactgtttctgctggaaaagttgagattggtgcctttcgaacatatcctgaaggatataagcctccagatgaccctatctcagagtaccagaccattcctttgaacaaaattgaagacttcggagtacattgcaagcagtattattcattggatattaccctatttcagtcctctctcgattgccat

SEQ ID NO: 10818 - DNA, 406 bp, Lycopersicon esculentum
  Predicted polypeptide sequence is orthologous to G291
aagttacaatggactctctgaattcttacgcatcgtcggcggcgatggcgcagcaaacctgggagttagagaacaacatcgtaacaatcgacgcgccgtcggggtcgaaaccggaaaactccgcgtcggacgctatattccactacgacgatgcggcacagacgaagtttcagcgggagaagccgtgggcgagtgaccctcactacttcaagcgtgtgaagatctctgctcttgctcttctcaagatggttgttcacgcgcgttccggaggtacaattgaggtcatgggactcatgcagggtaagactgacggcgatgccatcattgtaatggacgctattgccctccccgttgaaggcactgaaactagggttaatgctcaagctgatgcgtatgaatatatggt

SEQ ID NO: 10819 - DNA, 388 bp, Lycopersicon esculentum
  Predicted polypeptide sequence is orthologous to G291
tggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaatgaaggagaaaaaatctggcatgcatatccctcttattgccgactggttttggctggttaggcaataaagggcaaatcaaagaagagatgggcacccatctgtggatcaccgctcgtatgttgcacgtttattccgttgctgcggcgatgggtcgacctggcgcttactcgttggttgatcacggtatcaaagccatgaacggcgcactgcgtgataaaaaatatggcggctggtatgcctgcgtgaatga

SEQ ID NO: 10820 - DNA, 712 bp, Lycopersicon esculentum
  Predicted polypeptide sequence is orthologous to G303
gatcaagctagccaacactattatcaataccaatttcagtattcaaagcctcatgttgctgtttcagctactgcttcttcctataataataaccatcacaatcacaaggatatgaatttctcaagagatgtcaaccagatgagatatcaccagggataagatctgtagatttgacaaccaggattgactattacaggcacttggaatttatttttagttttttctttaaagaaaaaattcttgaaaaaataggaaaagaaaatccaaaaagggtaaaaatcccagattttctggcaactttctccccctagaaaaaggtagtatatatcacagaacttttaacacctattccaagtccacaggaaattgaaagaatgaaaatattggagatgaaactttgaaagagactttagggtgtctgtgggtccatcagattatagctgaagagatgaaagaatatatatatatatatatatatatatatatatatatatatggtctacgtacactctatcctctgcgcactccacttgtgggattctgtcggggtattttgttgtattttggttgctactgtggagattctgcctgaagatttttgttagggggcttcatcataatcatgacaattgaccaaaactgaaggatagtaatagtgagaagaagaagaaagatggttcttttaccaagtggtgatggtagtggtagtggg

SEQ ID NO: 10821 - DNA, 604 bp, Lycopersicon esculentum
  misc_feature (584)..(584): n is a, c, g, or t
  Predicted polypeptide sequence is orthologous to G303
gggataagcagtgtacactctacttcatctcaatgaactaaagtgggtatgttgctgttgttgtactgagcaatttgtctacttacagatgtgagacttctttttcttccttcaagaactatactttttcgagaatggagccaaaatagttggaagctatccttctcaggcactgatcaaatagtaagatgagaatctgtagtgggcttaattgacttttagctaatctcaaccaatggaagatgagattctgcctgatcatgatgttgatttgaacatgttgcgtgcacaaaggttttagcatatctattcttgatttaatgtgacaagaactcagtcagattgaggttgctcatattgtcggatgagggttgttgtaggctgaaaacctgtgtaaaatttgtcaatttgggaataggagctaggagaggtagagataagtaaaaagagaaagtgattatgtgtattgctattttgttggctccttccctctattacttctcttttttctttttttctttttgtatgttgagtatttatcgaaaataataccttttatctgttgagataggaataaaatttgngtatatcctatccttcttca

SEQ ID NO: 10822 - DNA, 545 bp, Lycopersicon esculentum
  Predicted polypeptide sequence is orthologous to G307, G308, G309
gcttcggctcacaggaattcgtggccactctcagcctgaggacactaccgatgccttacaagaagttggtcgggagctcgcccaacttgcagagtcaacaggtgtagaatttgagtttcgtggattcgtggtccatactttagctgatcttgaagcaccaatgttgaatattagacccagtaatgtggaatcagtggccgtgaactctgttttcaagcttcaccgtctgttttccattccaggagcaattgagaaagtgctggatttgataaaacaaatagacccgaagattgtgaccattgctgaacgtgaagtgaatcacaatgagactgtttttatgaacaggattaaggaagcatggtattactattcaacaatgtttgatttgctggagaactcagagtggactaagcgcagcactatagacttggagattgcggcagagcacctagggagggagatctataatttggtggcttgtgaagggactaagcgagtagtgagacacgagacgtttggtcaatggcgagtgaggtttaattctg

SEQ ID NO: 10823 - DNA, 417 bp, Lycopersicon esculentum
  Predicted polypeptide sequence is orthologous to G307, G308, G309
gggtcatggaaaagcagtgcctagatgtaatggtgtcagagatctataatttggtggcttgcgaagggactaagcgaattgtgagacgtgggactctgggtcaatggcaagtgaggatctactctgcagggttcaacctggttcccctgacttcagatacttacaaacagggagctatgttattggcctctttcccaaatgcagagggatataaagtagaagtgaaagatgggtctcttatgctgagctggaatagtctccctctcatagccaactccacttggcggctatgtagccaagtctagggagtctggtcaatggctgaggttgctcggcagctgtcctggaatagcttgctgctctgcaactgtcctgcatcatccagtacgtagttttatatgtcaactaactcagagc

SEQ ID NO: 10824 - DNA, 387 bp, Lycopersicon esculentum
  Predicted polypeptide sequence is orthologous to G312
ggtaaggctgagcttttctcaattaaagctaagcacttctaacccccttttcaactctctccctcttcttggggctactctgttagtccactcaaaacttgctcaccaatttcttcttataactgttgttgttgaggtaatgtgtgagtagtgtagcttagtaagatttggtgtggagaatggcctatatgtgtacggacagtgggaatctaatggcaattgctcagcaagtcataaagcaaaagcagcagcaggagcagctccaacagcaagagcaacagcagcagcagcaacaacaattcttgggtgttaatcctttgtgtctcagcccatggacttccaatcaccagaccttaactaatagccccactttaggatatggactta

SEQ ID NO: 10825 - DNA, 994 bp, Lycopersicon esculentum
  Predicted polypeptide sequence is orthologous to G314, G2699
catgcacgtacataaaacaaaaccttacatatttttttaattccttatatataatacttagtcatacatcactccatcatgaaaaaggaaatcctatttcagtaagacttgatctgatcaatcgtatagtttagattcaagttggtcgttgcttccattttattgtgtttatcattatacatagtagagtcaagtttcaatgaactctacaaccattcccctccaaaaccctagttttttcaacaactctcaaagttctctagcaggagcactacaaggatgcattgggagccttgatggagcatgtttggagaaactattacttcattgtgcaagtgccttagagaacaatgatgtaactttggctcaacaagtcatgtgggtgctcaacaatttggcttcttctaatggagatccaaatcaaagactcacatcatggttccttagggcattaatttcaagggcttctagggtttatcctaatgccacaaatttacatggaagtagtaaccttgaaaggagattaatgagtgtgactgagctagcagggtatgtggatctcatcccatggcatagatttggattttgtgcatcaaatagtgttatttataaggccattgaaaggcaaacaaaagttcacatattagattttagtatcactcattgtatgcaatggccaactctcattgatgcaattgctaagaggcctgagggtcctccttctctccgaatatcggtgccttcatggagaccacaagttcctccattgctcaatgtgtcaagtgaagaagttggccaacgtttggcaaatttcgcgaaatttagagatgttccttttgaattccatgtgattgaagacttgaactatgacatgttctttgagccattgaatcccttcactcttcaaattagagatgatgaagctttggttgtgaattgcaaaattggttaaggtacttacatgatgatgaacaaattaagggtgcactttcgt

SEQ ID NO: 10826 - DNA, 374 bp, Lycopersicon esculentum
  Predicted polypeptide sequence is orthologous to G314, G2699
cgaacagctacgtgttcaaaatctaatacgtccggataatggcgaagcactagtaataaactgtcacatgatgcttcattacataccggaggaaacaacggtaatttccaactcattccgtgccatgtttcttaaggccattcggaatttggacccaacaattgttgtgctagtagatgaagacgcggattttacttctaataatctggtgtgcagattaagatcggcgtttaattatttatggataccttatgatacagtggatacatttcttccgcgagggagcaagcaaaggcagtggtatgaagcggatatttgctggaagattgagaacgtgatagctcaggagggaatacaacgactagaacggctgg

SEQ ID NO: 10827 - DNA, 863 bp, Lycopersicon esculentum
  Predicted polypeptide sequence is orthologous to G324
gataaaccaatattgcaggagaagtcaactctcaataaggtagtgagggactctcatcttattcaagcttcagatgttgaatcaatagaagagcgtgtcggatcttcattgcccttatatggcaatgacaagagcctacagaaagacacaagtggcattactgacagagaagagatcagttcctacagtttctaccaggcagttgatggtcagcaccttatcctccatccactgaacatgaagtgccttctgcattactacggtggctacggtggtcttcctaacagaatcagtggaaagattttacaaatggagtccgtgacgcaatcggaggccatgagaaggcgttaccgcttcctaagtcatttttctttgacaacaacatttcagctttgtgaaattgatctcagcaagataatgcccatggatgcactttctccctttatggaggaaatcagaagtagggaaaaacaaaggacgtggctagctaggaaggaacggcgtgaacaagttaaagctgaagccattggcatgtacttagagcctttgccttttagcttttcagaaccttctttcacagaacaacctactttcactagcaatgacttcgaagctttgggaagtacgagtgttactgtaacatcatcaagctcccctgtgcctggaggcaggcaactgttctccaatgttgcaaggcttggttttgctgctggatgtgatcctccagcgctgaaaatggatgagtctgcacgtggttcttctgttgcagctggaacgaggagtcctggaatcctgtcctttgcaaatgtaacctccaaagcaaaagctgttgaaggtcccaatgcttctaagtcaaatgatgc

SEQ ID NO: 10828 - DNA, 1277 bp, Lycopersicon esculentum
  Predicted polypeptide sequence is orthologous to G324
gcaaccaaccccctttgtctaatctaatctcccaggaggaatttcatgtccatcttgccctcccatagcgacaatcatacaacctcctcctcctcttcttcttcttctccaaaccctaactctaatcatggatccaaatccaaacaacagcagcagcagcaacccgacaacttctcaggaaacatggctaccgctgcatctacttctggtggatcctccaaaaaggtgaacaactccggtagcagtcgagaaagttcacgacatcataacagtgatataatctcactgcacggacaaggaaaaccagctaggaccaatgatccttccagcggaagagaccagtttggctttaacagtccccaaggagttgttacccgctcagcttcaagaagaacccagatggttagtggaaaccacttgctcaattttcagtatgatcccatttctcgtccacaatctaggttgcctcctcctaggagatacgtcaagaggaagccttacaacaaagacttgtttcttcaagcaaattacaagtttgttctgttggattcaggcaattacacgcctgactcgatggatccagacaaaatgttacagtgggaggatattgtttgtgtgagatattccactccatttcatgtgcaatgccccatatgcttagaggatcctctttgtcctcagataacttcgtgtggtcatatcttctgttttccctgtgttatgcaatattttatgatctccgaagaagatgaccataaaaataatttcaagaagaaatgccctttgtgttttatgatgatatcttcacaggatttgtacaccattcaaattgagaacgttaaacaacatcgtgtcagtgatgtaattgaatttttactcttaacccgtcacaaggattcatttactttatctttgaaaaataatgatggcattgttggtagagaggaggttcaaaagttattctctaaattcatatttacgtccgatgtcgacctttctgttcgagaggcaatgtctgatcttgatagttggttagctagagctgattcaggcttagttgatgacttggagaaacttccctttgtctgtgctgcaagggaactattggagcagaggaagacgtactggaataggcaacatattgctgttcaaaatagcaaatctgacgaagataatcgtttggagaagtgctcttatagttctcagcgactagaaagtgttcaggtccattctgctggacaatctactcatgtaatgccatacagtaatccagctga

SEQ ID NO: 10829 - DNA, 560 bp, Lycopersicon esculentum
  Predicted polypeptide sequence is orthologous to G326, G1337
gttcacaaagatattttcacattccaaccctaaaaaatagaaaggggattttggtagtcttctctgtccattctcatttctggatatatcttagaacaacaatcatcaagattcactagtactttgaattgtgataatgagtcccggggaaagccgtccctgtgatttctgcaatcagcagattgccgacctttactgcccttctggtacagctgagctatgtctctgttgcaaccatagtgttcattcagctaacgctctttctaagaagcatcttcgttctcagatctgtgataattgtggctctgaacctgtttctattcgttgtgataccgacaaacttgtactctgtcaagaatgtgattgggatgctcatggaagttgtgcagtttctggtgcacacgatcggagtcctgttgaagggttttctggatgtccttctgcttctgaccttgcttcaacttggggtttggatattgaattcaaaaaaactacatcagcagcattcccgttttggagtatccttcttggatgtctaaagatgctccttcttctgtttt

SEQ ID NO: 10830 - DNA, 833 bp, Lycopersicon esculentum
  Predicted polypeptide sequence is orthologous to G328, G2436, G2443
gcagtgctccaactacaagttttttacaacacaaaatagagagaaagaaaagagaaaactaaagttagtccaatgttgaaaaaagagaacagtaacaattgggcaagggtgtgtgacagttgccattccgcaacatgtaccgtttactgtcgggcggattccgcctatttgtgtgcgggctgtgatgcccgcattcatacagcaagtctcatggcttctcgccacgagcgtgtatgggtttgcgaagcctgcgagcgtgcccctgcagcctttctttgcaaagcggatgctgcctcgctttgtgcctcttgcgacgctgacattcactctgcaaaccccttggcacgtcgtcaccaccgtgtcccaattatgcccattccaggaaccatttatggtcctccagctgttcacaccattaccggtggttctatgatgattggtgggaccacaggggaaggcaccgaggatgatggattcttgagtttgaatcaagatgcagatgatacaaccatagatgaagaagatgaagatgaagcagcttcatggttgttgttgaatcctcctgttaagaataacaataagaataacaactatgggatgttgtttggtggagaagtagtggatgattacttggatcttgcagagtatggaggggacagtcaatttaacgaccagtacagtgttaatcagcagcaacaacattactctgttcctcagaagagctatgttgaagatagtgttgtgccagttcagaacggacagcgaaaatctctgattctttaccaaacgccacaacaaccaccaagtcaccacctgaattttcagcttggaat

SEQ ID NO: 10831 - DNA, 669 bp, Lycopersicon esculentum
  Predicted polypeptide sequence is orthologous to G328, G2436, G2443
tgcaggaattcggcacgaggctggaatggtaataattgggatacggttgtgacgatgtgccaaggggttggcataagggatgtcatcatcgcaggaggcacaaagtgaggcagcatccgccttgcaaagaaaggctgcaggggcacgctcgcaggcctcacaaacccacacacgcttgtgacgagaagtcaccagacttgctgcatgtatgcgggcgtcacagtctgcacacaaataggcagaatccgcctggcagtaaatggtacagaaatagatacataaagtcctaaggatctgaaagggcctcacacccacaacaaactgagaaatttgtgagctttgtaaaaagtgctgagtttcaggctttcagcgaatggaagagaagaaataggtactaaagtgtcatggatcaagagggacctcaaacttgaaaggtttagccaggctctattgacttctgtggaacaacttcaatgttcttgctgagatagaatctactcttttcacctttatgaattgctccatgatgaattgcttggctcttatgagctgcggaaaaagtgctgatgttcagcaaatggtatggcataaatagattgctaaagtacccatggaatcagagggacctgatccaacttgaaaggctcaggaataactcaaacaatctga

SEQ ID NO: 10832 - DNA, 134 bp, Lycopersicon esculentum
  Predicted polypeptide sequence is orthologous to G343
gagaaatttgccaattttttttaaaattatttttgtaatatttggatttttatggaaaccattttaacaggttgatgatatggacaatgttgaatggttatcccaatatgtggatgatactcgagtcggaattt

SEQ ID NO: 10833 - DNA, 635 bp, Lycopersicon esculentum
  Predicted polypeptide sequence is orthologous to G343
ggatagttttaggacggagttattgtctcccgctgctcaatcggttgttgatcactccatgtcgttagggtcgacatggaaactcaacacgagtgacttccatcttcctcaacaccgctcttatgatcatcattctttcaatttccttcatctacttcgcgctttcagtaatacctcctcacttcccttttcaaatactacatgcattttgatcaatatactttgtttggttgaatatgaaatttaaaaatactgcacactttgatatatatcaaagtaccactcttacacaaattttgttaaatatattgtgacatgttattaagagagaaactattaattgttatgacttgtgttatattttcttcatatgtaaatcttatatttgaattcatagtaaaaattagataatttgactcaatcatctcacataaaatgcctgttgagcgttattatatttatgttctacctgctctttgtgttgacaattaaattaatttattgatagttgcatttctaaagtatatcctcatgtgctcagaagatgttaactatgtaacacactggaaataacctaaacctaaataatggcatagatgaactattttcaaatagaaatggctgaatgagtccaa

SEQ ID NO: 10834 - DNA, 1002 bp, Lycopersicon esculentum
  Predicted polypeptide sequence is orthologous to G346
aaataaaaccaaaaacttgttgaaaattttatagaaaaaatttctttctatatttttactttttttttttttgaaaagaattttatgaaaatggaaactatgtactcaaaaacttgttttatggtagatgataatattcttaatttctctttagatgatgatgaagaaaaatatcaaacttcttcatcttcttttgaatcatcaaacacccttggatttcgtcaagatgatcacaacccttcatttcctgattatgtagaggaagaattggaatggctttcaaataaagatgcatttccagcagtagaatttgacctattctctgatcatgtcatatttgatcaccacagcccaaattcagtactggaaaacaacaacaacaattgcaacgtaaatctcaaggacaacgcgttcacaagccacgcctctagcctcctacaagtacccatgaaccaccccgttggtacgcgaagcaagagaaggcgaagaatcgccttgcagtgtgacaactcatgtgtatggggtaaccaagtgaagttcaacaacactagtactaagcaaggactaacattgctcaaaatatcaatggctaaagctaaaagaggtactagcattggtaggacgtgccagcattgtggggtcgataagaccccacaatggcgtgcaggtcctacaggacctaaaacattgtgtaacgcttgtggggtccgatataagtctggaaggttgttccctgagtatcgccccgcgaatagtcctactttttcagttgaattacattcaaattctcataggaaagttttggagatgagaaaacagaggatttaaatcaagtatataggtcagggctatttatagtttttaaatttttagcacaattagtatagagtctaggtttattttaggtttactaaaaccatattatttgtattgatttccatcaaaatctactagggtatttacatgttaacttggtttgatcaaaaaaaaaaaaaaaaaaaa

SEQ ID NO: 10835 - DNA, 510 bp, Lycopersicon esculentum
  Predicted polypeptide sequence is orthologous to G346
ccacaatggcgggcaggccctctggggccaataacactgtgtaatgcttgtggtgtgcgctataagtcaggcaggctgttaccagagtatcgcccggctaatagccctactttctcggctgctgcgcattcaaactcccaccggaaggttttggagatgagaaagcataagattggtgtgggaggaatgttgattcatgaagcttgtggatatagggtaggacagtagtgagtcatctgcagcgtcttttcagatatttttcttcatttactatagttagcatagactataggtttttgttgtaatggtcttgatggtcggtgatttgctttggttttccatcaaaatccactaggaattttgaactagtttgttttattatatgcttttaagatagaaatccagaaagaagagctcctaacaaagatttgggtgtttttttaatccttccttcttacctctgtcatttgcatggattggaaatgatacatttttgaatcttgagaatga

SEQ ID NO: 10836 - DNA, 746 bp, Lycopersicon esculentum
  Predicted polypeptide sequence is orthologous to G347
gcccaggtccaaaccagtttgctcatgtctactgcgggaactgccgtatgatgctgatgtatccatgtggagctccatcggttaaatgtgcagtatgccattatattaccaatgttaatgcaggagatggaagagcccatgcacctttgaaccctcctaacggcactgctactactgcttcaggatcctcttcaactgccaaggctcgttcacaaaatcaaactgttgtcgtccaaaacccaatgtctgtcgatgagagtggcaagttggtgagtaatgtagttgttggtgtaacaacaacatcatagctcgtctgctaaacttgctgttcgtggacaacaattgagagttttgctcgcaacaattggaaagaggagaataaagacagccgctgcatataaatatggtagtgtttagtgttaatactacaaccatacccctgtttttcttttgttaacattttgatattatgattgtggggtgattgaagctactactacaagtgttgtgactatttggagtctgtaattgataactacgcgttagatttgtggcgtgctatgcccaaagtcataagtgaagaatgttattatgtaccttatatgccatattattgtatatgactgtataccgtgaaccttactgcctaaacaccttgcttttgagaggcgaattcaggatctagagactagagttagtgagctttgaatgagtgcggtttttattagatgtatgcatcttttccc

SEQ ID NO: 10837 - DNA, 1423 bp, Lycopersicon esculentum
  Predicted polypeptide sequence is orthologous to G351, G545
attaaaacttgtagtttatttatttttacacgaatttaatttggtcagccttattaacacaaacatttggtaaataaaactacaatggctgctgataaccctggacaaattattaactttatttgactccaaaccacagtatatataaattgacaatttttttaattcttttttttgtatttgttcaaggaatctgaacatcagtttcataaatagagccaggtttccaataatctggaatcacagttttgtctgagttaatccatttggtctattcacataatatttttttttaacactctcgataactctgaacgaacaatttgaattaaattgatatcgaaatggctcttgaagctttgaattctccaactggtactacttcaaatccgcaaacgtttcaatttgagagcaaaggccagcagcagcttcggtaccttgagaattggactaaagggaagagatctaagaggtcacggagtatggatcgtcaaccgactgaagaggaatatttggcgctttgtttgattatgcttgcaaggagcgatggctctgttaatcacgtacggtctctaccaccgccggtgccagtgatgaaaattcacgagacggcggagaagatgttgtataggtgttcggtttgtggtaagggattcggatcttatcaagctttaggaggacataaagctagtcaccggaaactcatcgccggcggagatgatcagtcgactacctctactactacgaacgctaacggaactacaagctccggtaacggtaacggtaacggtagtggaactggaaggactcacgagtgttcgatttgtcacaagtgttttccgactgggcaagctttgggaggacacaaacggtgtcactacgacggtggtaacagtaacggtaacggaaatgctaacgctaacagtagcattagcgctagcgtcggagttacgtcgtcggagggcgtgggttcaacaatcagccaccgtgattttgacttgaacattccggcgttgccggaattctggcctggatttggttccggcgaagatgaggtggagagtccacatccggcgaagaaatctcggctatctctacctccaaaatttgaattattccaacattaatgtgactttaattgctaggatttacgaaatttgtagacaaattatatgtaattttttcttttcattgtgggtgggatcaaaattttaaattatatatgtatataggacctagctagctatagtgaaaattcaattgattgattaatttttcttggaattactttgttcacttgcactttggtttctttaataaaaacatataagttttagctaatcacactttaataataattttttgtttaattcaaattcatgtaatataaaaaaagttttctgttaaaaaaaaaaaaaaaaaa

SEQ ID NO: 10838 - DNA, 1212 bp, Lycopersicon esculentum
  Predicted polypeptide sequence is orthologous to G351, G545
gcaacttccaattctccaaaccctaaccccttatatatatcacacacttctctttcagtcctaattcactcaactttcatctcaattttactctctctctctgtatatctttgtacttttattctcgatgtcgattgaagctttgaagtcacccatggcggcgaagctgtcacccacggtggcggagctaccaccgcttgaagagattgatgatgattcacataatttggattcgtgggcgaaaggtaaacgatcgaaacgaccacgtattgaaaatccaccaactagagatcagtatttagcgctctgtttactcatgctcgctaacgatgacggtactggattcgggaaaggaaaaggaaacggaaccggttcgattggtgttgaacaaacggagaaaaaaccggccgagttgaagccggtttttattgaagagaaaacagagcaattactgaagccggttgttgataaagaaaaaacagagcaattactgaagccggttgttgttaaagaaaaaacagagcaattattcaggtgtagcgagtgtcctaaagtttttacttcttatcaagcacttggtgggcataaagcaagtcaccgtaaaattaacgttcccgccaccggagacgatgatagcaatccgtcgacgtctacttccactagcggcggcggcgttaatatctctgctctgaatccgagtggccgttctcacgtgtgctctatttgtcaaaaggcttttccaactggacaagctttgggtggacacaaacgccgccactacgaaggaaaactcggcggtaacaatcgttatatcggcggtggcggagaaggcggaggcgttcatagtggaagcgttgtgactacatcagacggcggaagcggcaacggcggcggcggcgcgtcgactccgattgcgcgtgactttgacctaaacatgcctgcctcgccgggatggcaattggatctgacaatcgactgcggaggtagaactcaacatccgattgaacaagaagtggaaagtccaatgcctgctaagaagccgcgtttatttttcgagtgaaaatttgattgaattctgttttaagtcaaattagttaattggttttacatgtgatgatattattttaatatatacattttagggaaaaaaaagtaaaaacattgataagtactactttttattattattattattatggatagaagcaaaca

SEQ ID NO: 10839 - DNA, 628 bp, Lycopersicon esculentum; identical to SEQ ID NO: 10207
  Predicted polypeptide sequence is orthologous to G351, G545

SEQ ID NO: 10840 - DNA, 668 bp, Lycopersicon esculentum
  Predicted polypeptide sequence is orthologous to G353, G354, G2839
attcaaactcagtatacgattatcgaaagcatcttatttgtatcaactcttcataatgataaaaattagagaagacaagggtgaagtggaagcacaagcaatggctaactgcttaatgcttttatcatccatagatcgagatcgtcgtaattcatttgaatgtaaaacctgcaaaagacgcttctcatctttccaagcgcttggtggccatcgaacgagtcataaatcaacgattgatatcggaaaatttcttcacggtaaaatatccaaaaaacgcaaggtacatgaatgtttaatttgtggaatggagttttctatgggtcaggctttaggtggacatatgaggcgtcaccgtgccccagtaaatgaaattgaacattcggccaaaaggataccagttttgaagaaatcgaatagcaacgagagaatattttgcgtggatcttaatttaactcctgatgagaatgatgactttcacttttggcctatgccacctgtacctccattcttatcctcttaggacttggctagaactataaatatcattcattttaattcttgtgggtagattcacaaattttgttatctatttaccttaattgatcggatttctttattgatgagtatatttattcacaataaattttattaaaaaaaaaaaaaaaaaa

SEQ ID NO: 10841 - DNA, 731 bp, Lycopersicon esculentum
  Predicted polypeptide sequence is orthologous to G353, G354, G2839
aaaaaataaaaaaaaatctcaaaaattgcaaaaaaaaatcatggtggttttaccaatgaaaagagaaagagaaggagaattcgatataacaaccatggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaatctttaggtggacatatgagaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttgtgatcaatcaataatattggatcggatcgcgaatctacgataggagttctacgagttcaaagttatcaatccaatcatttacatatgctgaactcgctgattcaaaattctgaattcatatcgatatatttttgcacatatatatctaaaacatctagatgtttcattattttaatttttt

SEQ ID NO: 10842 - DNA, 806 bp, Lycopersicon esculentum
  Predicted polypeptide sequence is orthologous to G355
ttctttccaacttctaacttcaaaaaatctttctttcaaagtagttctaaatttgatatacaatttgtaaaaatcttcaataatatgacatctatgaaaagaagcagagaagagaatatgcaaattgaagcagaggccatggctcactgcgccttaatgcttttgtctcgtttcaacaacaacacttgttcatcgtcatcatcagatcatcatcatcatattaatgattttgaatgcaagacttgcaataaacgcttcccatctttccaagccttaggcggtcaccgtgcaagtcataataaaaagccacgattaatgggagagtttcttgttgaaaccaacaaaaagaataataagatacataaatgttctatttgtggtgtggagttttctttaggtcaagcattgggagggcacatgcggcgtcatcgcgatgaaattaataaaacgataataccagtgttgaccaagtccaatagcagcaagaggattttttgtttggacttaaacttaacccctcgtgatgataatgttgctgatttcaagttatcgccaattgcatcccctgttctgagaatctttatttaaattcttttccttatacaattaggaaatatgctaccaatttattaattctttactgagatatccatgtcaacataaattgctatgatgaattcttttgttattcgaaattcactaatttaaatttgtgttccttactatatatataaaaaataatctaaacaacgttattctttttcaaaaaaaaaaaaaaaaaactcgagagtagttctctctctctc

SEQ ID NO: 10843 - DNA, 643 bp, Lycopersicon esculentum
  Predicted polypeptide sequence is orthologous to G355
cagttattcttcaacttctaacttcaattatttctttcaaagtacttctaaatttgatatctttgtaatatgacatctatgaaaagaagcagagatgagaatatgcaaattgaagtagaggccatggctaattgcgctttgatgcttttgtctcgttttaataacaacacttcatcatcatcagatcatcatcacattaatgattttgaatgcaagacttgcaataaacgcttcccatctttccaagccttaggcggtcatcgtgcaagtcataataaaaagccaagattaatgggagagtttcttgttgaaaccaacaaaaagaataagaagcataaatgttctatttagtggtgtggagttttctttaggtcaagcattgagagggcacatgaggcgtcatcgcgatgaaattaataaaacgataataccagtgttgaccaagtgcaatagcagcaagaggattttttgtttggatttaaacttaacccctcgtgatgataatgttgttgatttcaagttatcgccaattgcatctcctgtgctgagaatctttatttaattactccattatatattcttgtaagattaattagaagaagaagctggaatacttcagttgttaattcattcattagttcat

SEQ ID NO: 10844 - DNA, 817 bp, Lycopersicon esculentum
  Predicted polypeptide sequence is orthologous to G361, G362, G370, G1995, G2826, G2838
ttttttttttttttttttttttttttttttatttagaccatgcatgatcaagctctttaatttccaaaaataatctaaattagaacactacaaatattaatgaattctatctttaatttgctttgactaatacaatataatattacaaacttaatcccaattgaagatccaaatgtttacatgaacttttttgtttagtagatgaagaattatccaaaatagttgatggaggcttcatataattatttcctccatgtgtaagagtaaatgtacaattatttgaatcttgatgaaatggccaatttgttcctcccccttctgatgagacttgataatcataattagggttaaaactaatttgggattcttcataaacattaaattgaggatcatgaaattgataattaataatattgttgttgttgttgttgtaattttgattatgaaaaggctgaagatagcaacttaaacttgcttttcttgcttgaagttgtagtctttttttcctcattctttcctttttatgagcattttgatggcctcccaaagcttgagaatttgcaaattgtttcaaacaatattgacactcaaatttcttcattatttcttcatgatttgatgatattttttcttgattatgatgaatatttcctgatgatactgtggaagctgatgatgaatttacactttcttgatcttcttttgatgaattattttggactttttttggagatctttttggattatcaataagctcaaaaccaaatattttgagcttcttgttgttgttgttgttgttttctatacatgatttagc

SEQ ID NO: 10845 - DNA, 780 bp, Lycopersicon esculentum
  misc_feature (729)..(729): n is a, c, g, or t
  Predicted polypeptide sequence is orthologous to G361, G362, G370, G1995, G2826, G2838
gcttctttatcctttctctctcaatatactgtatcttcttttacacatggagaaaaccaaagataaagaaactcaagatttcatgaatgttgaatctttttctcaacttcctttcatgagaccaacgaaagaaaaagccgcgattaggctttttggtaaagaattactaggtactactattcgtcatgaagatcaatcaattgagattcatgatagtgttggagatactacagaaatcaacaataacaacagaaaatttgaatgccaatattgttgtaggaacttcccaacatcacaagccctaggaggacatcaaaacgcacataaaagagaacgtcaacatgctaagagagctcaatatgcaaaatatcagtacaacgcttattttaattcagcgttgtacaatactagtagtacaagtagtactactagtggtggtttgtatgtgaataataacggccatagccattattattcacaacaaattaatcgcgatataaatgaaaatcaccgttcattgtcagcgttatggagagtacctcatgttcatcatagtagtattagtagtagtagtaattcttactctcctaataatgtttctaattttgttaggccaatagtttataataatgttaatggagatttgaagaagattaacacaaagagtagctcaatttctttaaccagatttgggtatgaattgaaggaaggagtacatcaagatcatgntagttttagatctacacttgtaaagagtacaatccaagctatagtatcgac

SEQ ID NO: 10846 - DNA, 501 bp, Lycopersicon esculentum
  Predicted polypeptide sequence is orthologous to G361, G362, G370, G1995, G2826, G2838
gctcactttctccttcatttatttcacatttacacttgtagtcacacaaatatatatataaagaaaaaaaacatctatatggcggaactggaatatctcgcgggttctaatactaacagacgattaaaattatttggtttcaacgttatagaggatcaggaacaagaggttgagtctacaaaaacgtcatcgggatcaccggaatccggtgactttccggcgatcgatggccggaaatatgagtgtcaatattgttctagggaatttgcaaattctcaagctttaggtggacatcaaaatgctcacaaaaaagaaaggcaacaattgaaacgtgcccaaattcaagctagtagaaatgcttatatgaggaaccctattatttccgcgttcgctccgccatctcacctcctcactccgccgggtactgtagtgtacccggcagggtcaactccatcgtgggtttatgtaccacgcgctccaccatccttccacgtgtcacat

SEQ ID NO: 10847 - DNA, 715 bp, Lycopersicon esculentum
  Predicted polypeptide sequence is orthologous to G363
tgatcttatctcctcttcttctttttttcttctttctgttatcttttgtaattctgcctcaccatatttagtaaaaaactaaaaacacacacacaaaggaggagaagaacaacaagtcttgtcatatcattgaaaaattcatcaataaaattaaaaaagagaaaaaagcatgaagccaccgaatttcaatcttgaatcggaagacgagtccgaagtcagcagcagccaagttgcctccaacacttctgcccaagaaatttctcctgatccttacaaggataacacgaccaattcgtcctgtctgacaaactctctcaatcttcagcaggagtcgaaagccgttacacttgacttgactcttggcttcaacagcggtgctgataccgagtcgaagggcaatcccgaggctggcagtgaagtagtgcctcatcctccagctgcacaagtatcgaggatattctcgtgcaacttttgtaggcgcaagttttatagttcacaagctttgggaggacatcaaaatgcacataagagggagagaactctagcaaagagggcgatgcggatgggaatgctatcagagaggtacgctagcttggcatcgctcccccttcacggatccccatatcgatcacttggcatcgaagctcatgcctccgtacatcaacgtgcctctcaacaacaagaaaggcatatgcatgctattagaggcggggca

SEQ ID NO: 10848 - DNA, 505 bp, Lycopersicon esculentum
  Predicted polypeptide sequence is orthologous to G363
tttttttctcattctctctctatatctaatgatcttatctcctcttcttctttttttcttctttctgttatcttttgtaattctgcctcaccatatttagtaaaaaactaaaaacacacacacaaaggaggagaagaacaacaagtcttgtcatatcattgaaaaattcatcaataaaattaaaaaagagaaaaaaggttagtcaaggactggaagtcatcaccgctcagttatttttcgacttgttgttatctaagtatcaaatttgcactgcgttttttcgggagcagcatgaagccaccgaatttcaatcttgaatcggaagacgagtccgaagtcagcagcagccaagttgcctccaacacttctgcccaagaaatttctcctgatccttacaaggataacacgaccaattcgtcctgtctgacaaactctctcaatcttcagcaggagtcgaaagccgttacacttgacttgactcttggcttcaacagcggtgctgata

SEQ ID NO: 10849 - DNA, 527 bp, Lycopersicon esculentum
  Predicted polypeptide sequence is orthologous to G366
cagagctctccaagcttcctatctttccattccttcctaagcttcagttggtgtaatagtcccaccccagtaaggggaatccttcctaagaaagaattttttccgttttgttgaggcatgatgagagagggcggctccatgtcgttgttgttctgaagaaaatggaggcggaccatattactatttttgttgttacggtcggaggagtcggtggttgtggtggtggtggagaacatattacggcgagaagcggctctttcacgcttatgagcattctggtgtcctccaagagcttgagaagtgcaaaacttgcgagaacagtagaggcaagagaacattctagaagatggaacctttgcttttggtttagggatcatgggtgggtgctgatgatccaccatatctgtgggggaggcggtggaggaattacaggactggttccagaaatcgtaaacaagctggctggggtctgccattaattaattagttgtctcagggaggaggacagggaatgcatgtatgaaatt

SEQ ID NO: 10850 - DNA, 682 bp, Lycopersicon esculentum
  Predicted polypeptide sequence is orthologous to G374
ggtgcttcaggagattcatcctttacttttattcttgatgatcctgctggtaacagcttcattgacaacccgttagctccatctcctgatccctcattgacaatcacattctatgagcgaactcctgaacagcaggcagctttagggtatattgctgacccatcacagcttggaggacaaagtgatgaggtatccaatgaggggataaataatgttcctgatcgactgctaaatgaaccacacggatcagttggagcaagagcgggacgtcaggctattgctcagggtaacagtgcagaaatggctgaagctctatttcgatattcagctcctgaagaggtgatggtgtttccatcaacttgtggagcatgtatggcgaagtgtgattgtaaaatgtttgttaccaatataccatactttcaagaagtaatagttatggcatcctcttgtgatgcttgtggttatcgcaactctgagctgaaacctggtggtcctatatctgaaaagggaaagaaaattacacttcatgtggaaaacattaaagatctaagccgtgatgtgattaagtcggatagtgctggagtagaaattcctgagcttgaattagagcttactagtggcactttgggtggaatggtgacgacagttgagggtttaatcacaaagattagtgaaagtcttg

SEQ ID NO: 10851 - DNA, 577 bp, Lycopersicon esculentum
  Predicted polypeptide sequence is orthologous to G374
ggtattgaagagcagaagagaaggttgatttgaaagtaacaaaataaactcttgtttttgtctcaccctgtgactatttctgtactagttagtagttatagagaatgtcggcgccgaaggaacagataatggatgtgaggtcggtggtggaagcagttgcagccggcggagatgatgttgagattgataccccactttatgtggttgaaagcctctgtatgcgatgtggtgagaatggtacaacaaggttactcttaacactgattccacactttagaaagatattattgtcagcatttgactgtccacattgtggtgaaagaaataatgaagtggagttcgctggagagattcagcctcgaggatgttgctatagcttgcatgttccatcaggcgataaaaagttgctcaacagaacagttgtgaagtctgaaagtgctaccatcaagatacccgaactagattttgagatcccccctgaagctcagcgtggatcattgtcaacgatagaaggtatactggttcgagctgctgacggtttagaggctcttcaagatgaacggaagaaagtggatcc

SEQ ID NO: 10852 - DNA, 485 bp, Lycopersicon esculentum
  Predicted polypeptide sequence is orthologous to G375
ttaaagtctattatccacttataagaattatttgaaggagtccaaactgagcaaatattaattgttgcgttacattttgaagaaaaatattgcatacatattgtagctatagctctggcaattgaaaagaattaatgggaattacttctctacaagtttgcatggattcatctgactggttacagggcacaattcacgaggattgtgcaggaggaatggattcttcttcttcaccatctggtggtgatcacattaacaatttaatgacatgttcaaggcccataatagtagatcaaagaagactaagaccaccacatgaccattccatcaagtgtcctcgttgcgactctactcatacaaaattctgttactacaacaattacagtctcactcaacctagatacttctgcaagacttgtcgtaggtactggactaaaggcggcacgttacgaaacatccctgttggtggtggctgccgcaagaac

SEQ ID NO: 10853 - DNA, 893 bp, Lycopersicon esculentum
  Predicted polypeptide sequence is orthologous to G378
gtacaccttcttctctttgcctactcttatatatacatcgctactttcaaaaaaaacacatatatatttgctgctttcttggagccccagaatctttatactaataaggacaaaccccaagatttttctcgaatccatcatcgacctacaaaaaaagaatggacttttatgcatacccatctcgtgctttgccttcatcatcctctgtttctaatttttcaatcggagatttcgttgaaagggttaaatattgttttagctttgccgtatctacgatcgtcggcaatgtattctctgcaatcttcacctttttctttgcactagtgggcaccttattaggagcaatgactggagctttgatagggcaggagacagaaagtggatttgttagaggtgctgcagttggtgccatatctggtgctgttttctctcttgaagtctttgaatcatctctattactatggcagtctgatgaatctggtattggttgtcttctttacttgattgatgtaatcgcgagcctattaagtggtagactagttcgtgagcggattggtcctgcaatgctaagtgcagtacagagtcagatgggagccattgaatctgcgtatgacgagttccctaacattttcgatgtaggtggggcaaagggtttacctggagattctgttgaaaagatacctaagattgtaattactaatgataatgatgtggatgattcgggagagagagtctcctgttcagtctgcctacaggacttccaacggggagagactgctagatgtttaccacaatgtcatcacatgtttcaccttccttgcatcgatacatggctgttgaggcatggatcttgtccactgtgcagaagggatctgtaggtgattatactctgt

SEQ ID NO: 10854 - DNA, 949 bp, Lycopersicon esculentum
  Predicted polypeptide sequence is orthologous to G378
gctagttccacttttttcttgaaatcttttgaaaaaaatgaaggcagaaagactttttattttcgtccttccttgttggaagaaatagaatggagttcccttcagaataagcagttgatttatgtaaatcagaaaaaggccaagtcttttgttgttgatcgttcaaaagaatccatggaaatggaattctacgcatacccatctcgtgttttccctcttacctcttctatttgttcgttttgtataagggatttggttgatagggctaaagatttcattagcgttgcggtttctgcaatcattggcagcgtcttatctgcagtcttcaccttcttctttgcattagtgggcactttattaggagcattgactggagctttgattggccaggagacggagagtggatttgtcagaggtgctgcagttggtgccatctctggtgctgttttctctctcgaagtctttgagtcatctctgttactatggcagtcggatgaatctggaataacatgtcttgtttacttgattgatgtactcacaagcctgttaagtggtcgattggttcgtgagaggattggcccagcaatgctaagtgcagtccagagtcagatgggagctgttgaacttgcatatgacgaggtccctaacatttttgatacgggtgtggctaaaggcttgcatggagattcggttgaaaagatccccaagattgtaatcacaaaaggtaacaacttggatggttctggagagagagtctcttgttccgtctgccttcaagactttcaacttggagaaactgttagatgtttgccacaatgtcatcacatgtttcacttgccatgcatcgacacatggctgttgagacatggctcttgcccaatgtgcagaaaggatctgtaattgctccataaactataacaaggttaaataagttcttcatacttgcttg

SEQ ID NO: 10855 - DNA, 1974 bp, Lycopersicon esculentum
  Predicted polypeptide sequence is orthologous to G380
gatgatgatgactgcgaagtgatggagtgcaccccaacattcaagtctaatggacctggaaaagaacggatgtcaaccgccagtacttcttctgatccccttgctgggacttctgcaactaatgggtttctgagggatgaaagtgatggcagaccaggctgtacactggatggtcgacgcatggcttgtaagagaaaagcagttgaaggacatctgggacaatcttcgggaagtggaagtccagattatcttctaaacagcttatggcgttctatacctgctccaaataatctgactgcaggtgctaatagctctgcatcaacagaaagtagaagaaacatcaatttgccagcgcagataaatccaagacttgggctcactatgggtggcaccactatggaaggtccggttgcattgcctgcttcaaggagagcagaaagttaccgtagaaatttcaggcttaggatcaatggctctcatcagcaagttcctattcctggcaatacgtttcctactgtgggtaatgatagaaatgttaccatgtctgactgggacgcattgaggctgccttctaatcagtctttggattcgaggtctgtttctgctgcagataatgtaagtccccgaagccagccagttgtggggccggttccttctctgcgacgaaatgcacagaggtgggattcatctagttcaagagctggcagtccatcaagttattctgtttttcttgagaggaattctgcagcctatgaacaaccaagctcaagaagtgtgcccagaaacatttcgcagcatccaatgttcatacccgctagtgagttgagaaatttgaaccaaaatcctgtcaactggggtttagctggtggaaatatttccattgctggaaatgttgcatcttcttctcggagtggtcctagctcagtagccccttcctcttctcctggttgggtggaacaaagaaatcctcagcaatatcctcgacgactctcagaatatgttcgtagatctatgttgtcttcagctgtcagtgaacctggaagtcacaatggtaacactccgccacatttgagttctgctacctcacaggagatggggctttctggccatcccgggcatcgtccatcaagttcaaggtcagcattgttgttggagagacaactcgatggtgcaatgggagttccatattcctggaggactttggctgctgccggtgaaggaagaggcaggctagtttccgagcagattcgcaatgtgttggatctaatgcgcaggggagagagcttaagatttgaggacgttatgatcctcgatcagtcagggttctttgggatggtggatattcaggatcgccatcgtgatatgcgtcttgatgttgataacatgtcctatgaggaactactggcgcttgaggagcgcatagggaatgtctgcaccgggctaactgaagaaaccattttgaatcgtctgaagcaacggaaacatgttagcattagaacagaagaaaccaatgatgctgagccatgctgtatttgtcaggaagaatacaaggatggtgaggatcttgggaagctggattgtggccatgattttcatgccgactgcgttaaacaatggctcatgcagaagaatttgtgcccaatttgcaaaacaacaggactcaatacttcaggaaaacattgatccatggaagtttgatgtaccagttggaccatggaaggttgacacaaagcgtgtctacgcgtttggtccatgagttcattctgagtgagaaagatctatgtatttttctcattaattttattctgacctctgcttagagggagttattttagagatagaagaagcactagctacaattagggtcattaggcaagagttatacattatttgggttgtttggaaatttacattcttactttccaatttattgatacctttgaatattttaattaaaaaaaaaaaaaaaaaaaa

SEQ ID NO: 10856 - DNA, 476 bp, Lycopersicon esculentum
  Predicted polypeptide sequence is orthologous to G384
ggtggaattgttctgtttttgtgaagaaattttctcaattactgaaaaggggttctaaaattgtttgttttgaagccaaattcttcttcaatttcttcatttttatcattttttttgggtcttcggtgctgaaggaaattctaactgttaatggtggaattgagctgtttcagtgaagaaatttctcatttatgaaaaaggggttttgaaattgtttgcttgaaaccgaacccacctccattttcttctttttgatcttgtttttgtctctgttattgaagaaaatccaatttcagtgaagaaatttctcatttctgaaaaggggtttttgtagattttgtgaaatttatcttttttttttggtctttggtgcgctgaagaaagttgggaaaaaaaaatgaaattcaacacagatgatatggagtggcctacttttttggatgaatatgaaaaacttgtttttcgaatgactattc

SEQ ID NO: 10857 - DNA, 515 bp, Lycopersicon esculentum
  Predicted polypeptide sequence is orthologous to G384, G385
cgagaaggtattcaagatgtttaatagccaccagcacttgctcgatatatcgtcctcagctcaacgaacacctgataacgagttggatttcattcgtgatgaagagtttgatagcaactctggtgctgataacatggaagctcccaattcaggtgatgacgatcaagctgatccaaaccaacctccaaacaagaagaagcgttatcatcgccacactcagaatcagattcaggaaatggagtccttttacaaggaatgcaatcatccagatgacaagcaaaggaaggaattgggaagaagacttggtttggagccattacaagtgaaattttggttccagaacaagcgtactcagatgaaggctcaacatgagcgatgtgagaacacacagttgaggaatgaaaatgagaagcttcgcgctgagaacataaggtacaaagaagctttgagtaatgcagcatgcccaaattgtggagggccagcagctataggagagatgtcatttgatgagcatc

SEQ ID NO: 10858 - DNA, 562 bp, Lycopersicon esculentum
  Predicted polypeptide sequence is orthologous to G386
ggagagaactagtctcgagtttttttttgttttttttttttttttttcaacccaataagcacattcctcttataagatccatcccaataacatgtaagttcaaggactctaaccacacacaaattcacatttcatttgttaatcaccaaaaacatcttaagaatcaacaaaaagcaagtagaatgtatcactcacattaacttgcacaaagaaattctttggctcataacaactgctgatcttgaaaaaggaagaaaaacagatatttacaaagagagacgagaaaagtagcattgttcatgatttaccagcttttgtcccatcagaatacctctgtcatttcaatattcttttgattgcttggtacttgttcaatcacattgttgctatctttaactgatctcgatcctactgttcttgtatagcactgagttagaaccaaagaagcacatctaagaactacatttgcactatttgcaattatagagcttaaatatagccagtgttttctgactaaacgaacgattgagatcaaaaatacaattccacatatagcacctga

SEQ ID NO: 10859 - DNA, 1007 bp, Lycopersicon esculentum
  Predicted polypeptide sequence is orthologous to G386, G707
gatgtttgattgctagaacctcaacaacagatgttatatcaagtggtatgggtggaaccagaaatggtgcacttcagctgatgcatgctgaactccaagtgctttcaccattagtaccaattagagaggtcaatttcctgcgtttctgcaaacaacatgctgaaggtgtctgggctgtcgttgatgtatcgattgataccatccgtgaaacttctggtgcaccaacgtttccaaatagcagaaggcttccttctggctgtgttgttcaagatatgcccaatggctacagcaaagttacatgggtagaacatgccgaatatgaagagggtgcaaatcaccatctttaccggcagttaattagcgcgggtatggggtttggcgcacaaagatgggttgcaaccctccaacgccagtgtgagtgtcttgcaattctcatgtcatccaccgtgtctgccagggatcatacagcaataactccaagtgggaggcgtagcatgttgaagctagcacaacgcatgacaaacaacttttgtgctggtgtttgtgcttcaacggtacacaagtggaacaaactttgtgcaggtaatgttgatgaagatgtacgtgtcatgactcgaaagagcgtctatgaccctggtgaaccagcagggatcgtcttaagcgctgctacttccgtttggttgcccgtttcccctcaaagactctttgatttcctccgtgacgaacgcctccgtagcgaatgggatatcctatccaacggtggccctatgcaagaaatggctcatattgccaaaggccaagatcatggcaactgcgtctctctccttcgtgctagtgctatgaacgcgaatcagagcagcatgttgatacttcatgagacttgcatagacgcggctggggcgcttgttgtatacgcgccagttgatattccggcaatgcacgtggtgatgaacggtggaaattcggcttacgtggctttgcttccttcgggattctcaattgtaccc

SEQ ID NO: 10860 - DNA, 593 bp, Lycopersicon esculentum
  Predicted polypeptide sequence is orthologous to G386, G707
gtgcaatttctcagccaagacttcttcctcaatctcttgccaagaacatgttcaactccccaggactttctcttgctcttcaaacaggtatggaagggcaaagtgaggtaacaagaatggctgaaaactacgagggaaataacagtgttggtagaaggagtagagaagaagaaccagacagcagatctggaagtgataacttggaaggtgcatcgggtgatgaacaagatgctaccgacaaaccaccaaggaagaaaagataccaccgacacactcctcagcaaatccaagaacttgaatctcttttcaaggagtgtcctcatcctgatgagaaacaaaggttggagttaagcaaaaggctttctttggagactagacaagtcaagttttggttccaaaatcgtagaactcagatgaagactcaactggaacgccatgagaattcgatactaaggcaagagaatgataagcttcgtgcagaaaacatgtctataagagaggcaatgagaaatccaatttgtactaattgtggtggtccagcaatgattggtgagatctctcttgaggagcaacatcttaggattgaaaatgct

SEQ ID NO: 10861 - DNA, 362 bp, Lycopersicon esculentum
  Predicted polypeptide sequence is orthologous to G388
gaaggtgctaacagctgggatggcgcaattcagctaatgtttgcagaggtgcagatgttaacgccagtcgtggggacgagagaagtgtattttgtgagatattgcaaacaaatgagtgcagcacagtgggggattgtggatgtttctgtcgacaaagttgaagccagcattgacgcttctctccttaaatgcagaaaattaccctcaggatgcattctacaagaacaatccaatgcacattgcaaggagacgtgtgtggaacacttggagtgccaaaaaaacatagtggactctctgtaccgtgtaactgtcaacagcggccaagcttttggcgcaaggcgctggatggctactcttcagca

SEQ ID NO: 10862 - DNA, 585 bp, Lycopersicon esculentum
  Predicted polypeptide sequence is orthologous to G388
gaatacaccaaggagtttcctcctatagacaaatctgttataacaggttgtgactctagtaatattgctgcgttaccttcgggattctcgatcctccctgatggtctagagtcgaggccttttgttatcacttctagaccagaggacagaagttcagaaggaggatccttgctaacagttgcttttcagattctaactagcaattctacaacagcaaaactttctaaggagtcggtagaatccatcaacaaccttttgtcgtgtacgttgcacaaaatcaagacaagattccaatgtgacaatggatattagttcttctaggtagagagatgctaatttcattatacagattatatagttttcctccatccttttcatctgaatagactgatgaaaaggattcaggaacaacgcgttcttaccccgttattgtaattcccctcccatccagatagtaaaggaaactcgttcaaacacaaaagtttacatactataagaattttcctactctcatgttaattttctttccttctcttcttcatgctttatgttctatgtgcagtgaatttaaagattaacgtgttc

SEQ ID NO: 10863 - DNA, 1323 bp, Lycopersicon esculentum
  Predicted polypeptide sequence is orthologous to G390, G391, G438
gtgatggttggacaattatgggtagtgatggtgttgatgatgtaacaattgctgtaaactcatcaccaagtaaattccttgatgcacaatacaacaccttgtcaattctccctacttttggaggagtactgtgtgcacgggcatcaatgcttcttcaggatgtttgccctgctttgcttgtccgtttccttagggagcaccgttcggagtgggctgactatggagttgatgcttactcttctgcatctcttaaagccagtccttatgctgtcccttgtgccagacctggtgtcttccccagtagccaggtcattttaccgcttgctcagactgtggaacatgaggagtttcttgaggttgttcggctagagggtcatgctttctctccagatgacatagctttatcgcgggatatgtatttgttacagctatgcagtggagttgaagagaatgccacaggtgcctgtgcgcagcttgtttttgcacatattgatgaatcttttggtgatgatgctccattgcttccatctggtttctctgtcattccactggagcctaaatcagattctcctagtgctgctcggactttagatttagcttcaactcttgaagctagaactggtgggacacggccagctggtgaagttgaaggaagcagttacaaccatcgttcagtcttgacaattgcattccagtttgcctttgagaatcactatcgagaaaatgtagctgctatggctcgccaatatgtacgaaacattgtaggctctgttcagagagttgctatggctattgcaccctctcgactctgctctcagttgacacctaaatccttccctggttcaccagaagctgtcactttggcgagatggatttgcaggagctataagaatcatactggtggagaattgctacagatggattctcaagctgccggtgatgctgttctgaagcaactatggcatcatactgattcaataatgtgctgctccgtcaaaatgaatgattctgcatttttttcatttgcaaaccaagcaggacttgacatgcttgaaaccactctaatagctcttcaggatataatgcttgataagatcctagatgaagctggtcgaaaggtcctcctttcagagttccccaagattatgcagcagggctttgcttatctgccagcagggctatgtgtatcgagcatggggaggccagtgtcgtacgagcgagctgttgcatggaaggtccttaatgatgacaactccaatcactgcctagctttcatgttcacaaactggtcttttatttaagttcaaaacatatgatctgcgt

SEQ ID NO: 10864 - DNA, 739 bp, Lycopersicon esculentum
  misc_feature (676)..(676): n is a, c, g, or t
  Predicted polypeptide sequence is orthologous to G390, G391, G438
gatcagatgtccctgcagcaactcggaccttggatttagcttcgactctagaagctggaactggtgggagtgggacacgtccagctggtgaaattgaagcaggcaattacaaccatcgttcggtcttgacaatttctttccagtttacttttgagagtcactaccaggataatgtagctgcaatggctcgccaatatgtgcgaagtatagtaggctctgttcagagagttgcaatggccatagcaccctctcgactcagttctcagttgacacctaaatccttccctgtgtcacctgaagctgtcactttggcaaggtggatttcccggagctatagggtgaatacaggaggagacctgttccaggttgattctcaagctggtgatgctgttctgaaacaactgtggcaccatagtgatgcaataatgtgttgttctgtaaaaatgaatgcatctgctgtttttacctttgcaaaccaggctggtcttgacatgcttgaaaccactttgttagctcttcaggatataatgcttgataagattctagatgaagctggtcgtaaggttctcctatcggagttctccaagataatgcagcagggatttgcctatctgccagcaggaatatgtgtatctagcatgggtaggccaatatcatatgagcaagccatagcatnggaaggttctcaacgacgatgattccaatcactgtctagctttcatgttcataaactggtctt

SEQ ID NO: 10865 - DNA, 1141 bp, Lycopersicon esculentum
  Predicted polypeptide sequence is orthologous to G390, G391, G438
tgcacgagggctgtttcccgcaactgcagtggggtagcagcacgtgcctgcggcctcgtgagtctagagcccacgaaggttgctgagatactcaaagattgtccttcttggtatcgcgactgccgttgccttaatgtactaagtgtaatccctactggcaatggtgggacaatagagcttatttacttgcagacttatgctccaactacattggcaactgctcgtgacttttggacattgagatacactacaagtttggaggatggcagtcttgtgatatgtgaacgatctctgacgacagcaactggtggcccaacagggcctcctgctacaagttttgttagggccgaaatgctaccaagtggttacctcataaggccttgtgagggtgggggctcaatgattcacattgttgatcatattgatctagacgcttggagtgtccctgaagttttgaggccactttatgagtcttccaagatccttgctcagaagacgactatggctgccttgcgacacatacgacagattgcacaagaaaccagcggagagatccaatactcagggggtcgccaacctgctgttttgagggcactaagtcagagattatgcaggggatttaatgatgctgttaatggatttgttgatgatggttggactattacggatagtgatggtgtagaggatgtaacaattgctataaactcatcttcaagcaaattccttggttcacagtacaacaccttgtcaatactccctacatttggaggagttttgtgtgccagggcatcaatgcttcttcagaatgttccccctgctttgcttgtacgtttccttagggagcaccgttccgaatgggcagattatggggttgatgcttattcttctgcatctcttaaagccagtccatatgctgtcccttgtgccagaccaggtggtttcccaagtagccaggtcattttacccctagctcagactgtggagcacgaggagtttcttgaggtagtacgtctagagggtcctgctttctcaccagaggacattgctttatcgcgggatatgtacttgttacagttatgcagcggagttgatgagaatgctgcaggtgcctgtgctcagcttgtttttgcacctattgatg

SEQ ID NO: 10866 - DNA, 1509 bp, Lycopersicon esculentum
  Predicted polypeptide sequence is orthologous to G390, G391, G438
gcttcaatgaggctcttaatggtatagctgatgagggctggtcaatgctggatagtgatggaatggatgatgttaccatccttgtgaactcttctcctgacaagttgatgggcttaaaccttccttttgcgaatggattttcacctatgagcaacgcggttatgtgtgcaaaagcatcaatgcttctacagaatgtgcctccggctattcttctcaggttcctacgtgaacatcgatctgaatgggcagacaacaatatagatgcttatgctgctgcagccattaaagttggtccctgcagcttacctggggctcgagttggtaacttcgggggtcaagtgatacttccactcgctcacactgttgagcatgaagagttgctggaggtcattaagttggaaggtcattctcctgaggacgcgataatgccacgagatatgtttctattgcaactatgcagtggaatggatgaaaatgctgttggaacttgtgccgaactcgtgtttgctcctattgatgcctcttttgctgatgatgcaccattgcttccgtctgggtttcgcattatttcactcgagtctggaaaggaagcgtccagtccaaatcgtacccttgatcttacttctgctcttgagactggcccagcggaaaacaaagcagccaatgatcttcacactagtggtggctcatcaagatctgtcatgacaattgcttttcaatttgcttttgaaagccacatgcaagagagtgttgcttcaatggctcgacagtatgtccgaagcattatttcatctgttcaaagagttgcattagcactttcaccatctcatttgggttctcatggaggtcttcgtttgccattggggactcctgaagcacatacattagctcgttggatctgccaaagttacaggtgctttttgggcgtggagcttctcaaattgaatactgatcaaggaagtgaatcaatcctcaaaagcctatggcatcactcagatgctattatctgctgctccgctaaggctttgccagttttcacatttgcaaatcaggctggtcttgacatgctcgagacaaccttggttgcacttcaagatattaccttggagaaaatatttgatgatcatggaaagaagaacctctgcactgagttcccccagataatgcaacagggttttgcatgtctacaagggggaatttgcttgtcaagcatgagcagacctatatcttatgagagagcagtagcatggaaagttatgaatgaagaagatactgctcattgcatctgtttcatgtttgtcaactggtcatttgtctaagttactgttctttagatctgttttaaagggatcagtacactaatacctaagaacccttaaatattttcctttcaaaatcaacattttgaactagttgtgtgtgttgaaaacttgtttattgttaaaacttatgctactcagtacctttatgctatgtattttttaaaaaaaaaaaaaaaaaaaaaaaaaa

SEQ ID NO: 10867 - DNA, 934 bp, Lycopersicon esculentum
  Predicted polypeptide sequence is orthologous to G390, G391, G438
tactggttcggtttctgcgggagcaccgttcagagtcggcagactttaatgttgatgcttttgtagctcctgcattgaagtcttgtcccgcatacatatcctgagatgaggcctaccagatttcccggtagccatataataatgccacttggccacacaattgagcatgaagaaatgcttgaagttattagacttgaagggcactctattggacaggaagatgcttttatgccaagagatattcaccttttacagatgtgtagtggcactgatgagaatgcagttggagcctgttctgaactagtttttgcccctattgatgagatgtttccagatgatgcacctttgcttccctccggatttcgcattattcctctcgaatcaaaatcaggtgatgcccaggatacgttgaacgcacatagaacattagatctagcatcaagtcttgaagtgggcccagcaacaaactcgactactggagatgcagcttcttgttacagtgcacgatctgtactgacaatcgctttccaatttccatttgaggacaatcttcaggacaatgtggctaccatggcccgacagtatgttcgcagtgtggtttcgtctgtccaacgagttgccatggcaatatctcctacgggaatgaatcctacactgggggccaagctttctccaggctcaccagaagctgtaacattgtcgcattggatctgccagagctatagttatcacatgggaacagagttacttcgagctgattctagtggcgatgaatcagtactaaagaatctctggcaacaccaggatgcaattttgtgctgctcattgaagtcgctgccagttttcatttttgctaataaggccggactcgacatgctggagacaacattagttgcattacaggacatttctctagataagatatttgatgaat

SEQ ID NO: 10868 - DNA, 723 bp, Lycopersicon esculentum
  Predicted polypeptide sequence is orthologous to G390, G391, G438
atccttgttctgttgtaacctttaaaatgcactctttactaaactaggtgattgtggaggtggtacatatgtttacatgttgctggaggtcattaagttggaaggagtttgccattccccagaagacgttataatgccaagagatatgtttctattgcaattgtgcagtggaatggatgaaaatgctgttggtacctgtgctgaactcgtttttgctccaatagatgcctcatttgccgatgatacaccactccttccttctgggtttcgcattattcctttagactctgctaaggaagcctccagtccaaatcgcacccttgatcttacttctgctcttgaaactgggccagtaggaagtaaggtggctaatgatctcaagtcaactggtggcacatcaaaatctattatgacaattgctttccagtttgcatttgaaagccacatgcaagagaatgttgcatcaatggctagaaaatatgtacgaagcttcatttcatctgttcaaagggtcgcattagcactttctccatctaacttcggttccctgggaggccttcgtctgccgctggggactcctgaagcacatacactggctcggtggatctgccaaagttacaggcgatttctgggtgtggagcttccaaaattgagtagtgaaggaagtgagtctctcctggatagcctatggcatcactcagatgctattatctgctgctctgc

SEQ ID NO: 10869 - DNA, 503 bp, Lycopersicon esculentum
  Predicted polypeptide sequence is orthologous to G390, G391, G438
tagaaacttcatgctttttagacacagactttttctgcctttcatctttttgaaatttatagaatatttatggtgcattgaaaagtttattagcatctgaaggtgcaattttttgttttagaagtccccgtcatttgaatactgtcatggatatgtggattaatttcttaccttattcttacagtttagtattgctactacttataatgcagggttctcctagtgctgttcagatttgagatttagcttttaactcttgaaactagaactggtgtgacatggccacctggtgaagttgaaggatgtagttacaaccatcattcagtcttgacaattgcattccagtttgttttttagaataactatcgagaaaatatcactgctacggctcgcaaatatgtatgaagcattgtcggctcggttcagagagttgctatggctattgcaccctctcaactctgctcgcagttgacaccaaaatctttccctggctcaccttaaac

SEQ ID NO: 10870 - DNA, 959 bp, Lycopersicon esculentum
  Predicted polypeptide sequence is orthologous to G390, G391, G438
gcttgattcaccacatttctctcaagcatcagcaggcctccttcaatggctacgtacgtcggattttcaatctgaagcatcaacaatttctcattctttcagtttgctctttcttgtacttcgaacttccaactgggtgcatacaggaggagacctgttccaggttgattctcaagctagtgatgctgttctgaaagaactgtggcaccatagtgacgcaataatatgttgctctgtaaaaatgaatggacaaacaccaagtgaagagaaagaaggagaagctctttgtacagatggtagcgagatatcaaatattgagactgaaatgaagtgaagaataaaacgtctctacaagaattgattggtgtagtatcctcttgcctatctgaaggtaaagaggtagttaaatagtgttcatgctattttctcattacttgaataggtagtcgtgcataaattacttgaacatgtagtcttgcataacaagtcgtcaggtagtccacaaaaacaggtgcttgcatatcccgcagtagcagatttttcactaattgttgttggaattcttcccttgaaaatattttggaggaaatccctttgataggcagaccatttcaagtgggccaaccgatgaacgtaaggtcgctgatccaaatatacaagatttggtttgaatgggaggttatggaaagaatggtcataaagaaaacggtaagaaactcatgtttagtgaaaaaggcaaagatacgaaaaaaagagtagcagaggtgaagcaaagcatagttgctggtatgcagattgatggtatttcacggaagagtatgaaatatttttttgaagaaagaattgttgaatctgctgttggggtaatctccatttctgccttgccatcatggctccctccgccaacacctgctgttggggcaatcttgagctcaaacctataccaagcaagttttaga

SEQ ID NO: 10871 - DNA, 538 bp, Lycopersicon esculentum
  Predicted polypeptide sequence is orthologous to G390, G391, G438
cactcagatgctattatctgctgctctgctaaggctttgccagttttcacatttgcaaaccagggtggtcttgacatgcttgagacaaccttggtcgcgcttcaagatatatctttggagaaaatatttgacgaacacggaaggaaaaatctctgctctgagttcccacagataatgcaacagggttttgcatgtctacaaggcggaatctgtttatcgagcatgggtaggcctgtttcttatgagaaagctgtggcttggaaggttctgaatgaagaagatactgctcattgtattggttttatgtttgtgaattggtcgtttgtttaaatttgttatcagtaaacttaagctacatacatatctacaaaccattttgaactagtttggctttttgtgcttttgttgctactcaatgtgacatgaaatcttttggaatgtgattacaagatgatgtctggtgtctgcatttgatcccacaaatttggatttgtgctaagtaagacttcattcggtggtaaaaaaaaaaaaaaaaaaa

SEQ ID NO: 10872 - DNA, 543 bp, Lycopersicon esculentum
  Predicted polypeptide sequence is orthologous to G390, G391, G438
gctaggaaggcaacctgctgttcttcgaacatttagccagagattatgcagagggttcaatgatgccatcaatggattcggtgacgatggctggtcaatgttaagttcagatggtgctgaagatgtcatagttgctgtcaattcaaggaagaacctcgcaaccacctccattcctctttccccgcttggtggcgtcctttgtgccaaagcatcaatgctactccagaatgtcccccctgccgtactggttcggtttctgagggagcaccgttcaaagtgggcagactttaatgttgatgcttttgtagcttctgcattgaagtcttgtccgtatacatatcctgggatgaggcctaccagatttaccggtagccaaataataatgccacttggccacacaattgagcatgaagatgcttttatgccaagagatattcaccttttacagatgtgtagtggcactgatgagaatgcagttggagcctgttctgaactagtttttgcccctattgatgagatgttgacagatgatgcacctttgct

SEQ ID NO: 10873 - DNA, 163 bp, Lycopersicon esculentum
  Predicted polypeptide sequence is orthologous to G390, G391, G438
tgagatgtttccagatgatgcacctttgcttccctgcggatttcgcattattcctctcgaatcaaaatcaggtgatgcccaggatacgttgaacgcacattgaacattagatctagcatcaagtcttgaagtgggcccggcaacaaactctactactggagat

SEQ ID NO: 10874 - DNA, 513 bp, Lycopersicon esculentum
  Predicted polypeptide sequence is orthologous to G390, G391, G438
tgcacagtagagtttggagaagttgcctcaggagaggaaaagagggggttactaaccacacatttgacagctcaaaaccactttaccaatccaaacaaaaaatcatcacattatccctcccttctctcctttctctattactctcattttccccaagtttcagacttgggaaggctgtgtaaacaaaaggggtgtttggattgtaaggaatcataatgtcaatgtcctgcaaggatggtaaatcaattgaagataacggaaagtatgtccgttatacacctgagcaggttgaagctcttgaaaggctatatcatgagtgtccaaagcccagttcaatgcgtcgccagcagcttattcgtgaatgcccgattctatctcatatagagcctaggcaaatcaaagtttggtttcagaatagaagatgtagggaaaaacagaggaaagagtcatcaaggcttcagggtgtgaataggaagctgtcagcaatgaacaagctattaatggaagagaatg

SEQ ID NO: 10875 - DNA, 588 bp, Lycopersicon esculentum
  Predicted polypeptide sequence is orthologous to G390, G391, G438
gcttgtggcctggttggtttagatccaacgagggttgctgagatccttaaggatcgcccttcctggtatcgtgactgtcgggctgttgaagttctaaacatgctgcccactgccaatggtggaaccattgaacttctttacatgcagctttatgctccaacaactttggcgcctcctcgtgacttctggctgatacgctatactactgttacggatgatggtagctttgtggtttgtgagaggtcattaggaaatactcaaaatggtccaagtatgccgcaagttcagaattttgtgagagcagaaatgctgcctagcggatacctgattcggccttgtgagggaggcggctctattgtccatattgtagatcatatgaatttagaggcatggagtgtgccagaagtgttgcgtccactgtatgagtcatctgcagtgcttgctcagaagacaacaatggcagcactacgccaactgaggcagttaaccttggaagtttcacagcctaatgtcactaactggggcaggagaccagcagctctacgggcattaagcaagaggttgaacagagggttcaatgaggctctc

SEQ ID NO: 10876 - DNA, 768 bp, Lycopersicon esculentum
  Predicted polypeptide sequence is orthologous to G390, G391, G438
ggttgctcaggagtagcctcgcgtgcttgtggccttgtgggtctagagcctacaagagttgctgaaattcttaaagatcggccatcatggtttcgtgactgccgagcagtggatgttctcaatgtgatgtccactggaaacggtggaaccattgaattgctatacatgcagctctatgcacctactacactggcaccagctcgtgacttttggttaatgcggtatacatctgttatggaagatggtagccttgtgatatgtgaaagatccctgaacaacactcagaatggtcctagtatgccaccggtgcagagttttgtgagagcagatatactgccgagtggatatctgatacgaccctgtgaaggaggtggttcaatcattcacatagttgaccatatggatttagagccatggagtgtgcctgaagtgttgcgtccactgtatgagtcatcaacattgttgtcgcagaggacaactatggcggcattacgtcacttgagacaaatttctcaagaaatttcacatcctactgtctctggctggggaagaagacctgctgcgttgcgcgcacttggtcaaagattgagcaagggttttaacgaggccgttaacggttttactgatgagggatggtctatgcttgaaagtgatggcgtagatgatgttactatttcttgtgaactcatcacccagcaaattggatgggtgcaaacatctcttatgccaatggatttccatcgatgagcagcgctgtggctttgtgcc

SEQ ID NO: 10877 - DNA, 591 bp, Lycopersicon esculentum
  Predicted polypeptide sequence is orthologous to G390, G391, G438
gcacacttgatcttgcatcaactcttgaggttggaccagctggaagtcgaccaactggggatcattccaagaattctggtagcgcaaaatcggttatgacaatagcatttcaatttgcatttgagattcatcttcaagaaagcatagctgctatggcacgtcaatatgtccgcagtatcatatcatctgttcagagggttgctttggctctctctccatctcgtattggttctctccctggtctaagatctccacctggcacacctgaagcccagactcttgcccgttggatttgccaaagttatagattcttcttaggcgtggagctgctcaaatctgctagcggaggaagtgaatccatcctgaaagaaatttgggatcactcagatgctctgatgtgttgctctatgaaggcactgccagttttcacattcgcgaatgaggctggacttgacatgctagaaaccaccttagtagcccttcaagatattagtctggaaaagattttcgatgacaatggaagaaaggctctctactctgagcttccacagataatgcagcagggttttgcatgtcttcaaggtggtatct

SEQ ID NO: 10878 - DNA, 706 bp, Lycopersicon esculentum
  Predicted polypeptide sequence is orthologous to G390, G391, G438
tcacatctaggaatatctgggaatgtgtagtgtgcgaaattgaggtttggttgatactttattatatcaaagacattaaggagtcagcagaaattttcaaaattgaactcagataagtataacttccaaaatttattttggcgtggactatgtaggaacatcaagggaagaagttgtgctttattttctcaaattttgaggctatgaaatttcatcaagcccattgtagcaggaggcattactctacactgatgctaagaccactttagtgggtaagtattgttatagtggcgtcgctagagtaggtatagtagagagagaaacaagatttatatggaaacaaccataaagaccctattttcgacacttcatattcttggacatgggaggggcaatttcggacggtcttcactatttttccatgagattcttcgttaaagattctattaaacaaggaactgaagaagcaaagagaaatggcagctgcagctaaggaggaagagaagaagacgtataactcgactattgagcaagcttctgattggattagcttcagcattgaggggatcaactaaatcatttctttcagatatatgttcctatcattctggctcatgcaagtgatttttggacgttgagatacacaaccaccctagacaatggtagcagttatgtcaaagattcctatctgttaccgggcttgacc

SEQ ID NO: 10879 - DNA, 748 bp, Lycopersicon esculentum
  Predicted polypeptide sequence is orthologous to G390, G391, G438
gaaagagggggctctcgttctcttggaggagagagcctgtgattgtatcttgtaatggccttgtgtttacagagaggagaaggagaaagtggaagtaaaaacgatatggataatggaaagtatgtgaggtatacaccagaacaagttgaagctttagagagagtttatgctgaatgtccaaaacctacttctttgagaagacaacagctgattagggagtctcctattctctctaatattgaacctaaacagatcaaagtatggtttcagaatcgaagatgccgtgaaaaacaaaggaaggaagcttctcgtctccagactgtgaacaggaagctgagtgctatgaacaagctgctgatggaagaaaatgaccgattacagaagcaagtgtctcaacttgtgtatgagaatggctacatgaaacaacaaataaatactgttagcagcacgaccacagatacaagctgtgaatctgtggtcgtgagtggtcagcagcaaagaaaaaacccaacacctcagcatccagaaagggatgcgaataacccagctggtcttcttgcaatagctgaggagaccctggcagagttccttggaaaggctactggaactgctgtcgactgggtgcagctgattgggatgaagcctggtccggattctattggtattgttgctgtttcccgcaactgcagtggggtagcagcacgtgcctgcggcctcgtgagtctagagcccacgaaaggtgctgaga

SEQ ID NO: 10880 - DNA, 1238 bp, Lycopersicon esculentum
  Predicted polypeptide sequence is orthologous to G394
caacaacaaaagttcccacacactttcctttttttttctttttctttctaataacacatagatgggttttgatgatatttgcaacactggcctagttttaggattaggcttttcttcaaccgccgatcacaaatcaaagaaaataaccacaacaccattagtaggcaaaggtccgtgtgttggctttgaagaaccttcactaactttaagcctaatttccggtgatcgtacgtacgaacaacaggcgatgaaaattagtaaagatcatcaatctgctgatttgtacagacaagatagtgctgcctcttcctactcaaatgctagtgtcaaaagggagagagatgttggtagtgaagagacaactactgaagtagaaagactttcctccagagttattagtgacgaagatgatgatggatctaacgctagaaagaaacttagactcactaaaccacaatctgcacttttagaggaaagtttcaagatacacagcactctcaatcctaaacaaaaacaggatttagccagagaactcaatttaaggccacgccaagttgaagtttggtttcagaacagaagagccagaacaaaactgaagcaaacagaggtagactgtgaattcctaaaaaaatgctgcgagacactgacagatgaaaacagaaggcttcacaaggaattgcaggaactaaaggctctaaaaatagcacaacctttgtacatgcagttaccagcggcaaccttaaccatgtgtccttcatgcgaaaggatcggcggcggtgttggagaaactccgtcgaaaaatgcttttactattgctcaaaagcctcacttgtacagtccattcaacaatccgtcggcagcttgttaatgataaatgccatatataaaatcatgtttagaaaaaagccgccactttttttggttaaaaggcttgtatgactagtgcagttgtatgtgtagagtaattagaattaaggtcactaatcaatatttttaatttgtttctttattatggtccatagtataagtctgtaaatcattaagcaaatatatacatatggatgaattattattatttataatagaactgcttttattgaaattcacggtctaatgatagagactaccggtaaattgaagcaggttcaaacccagattcgaatcacagaaaccgagaagaaacgtgcttattcgacattggaggaactgaaacagctgtctgatgacactaatacata

SEQ ID NO: 10881 - DNA, 519 bp, Lycopersicon esculentum
  Predicted polypeptide sequence is orthologous to G394
cccattaaaaaaaaaatgatgtgcaacacaaggcttagtttgagcttaggattatctactcctcctcctcatcaacataacaacaaggggaaattatcatctaatgatgatgataatcaagaattaacactttgtttatcaacatcatcagagttcacaaataattatgacaacaataataggattaatcctcaattattaggaggagttaattcatcagtttcttcattttctaacacaagtagtgttaaaagggaaagagatcatgctagtagttttgatgaagaagtagaaaatttggagactaaaaaagttttaattatttctccaaagggattagttgatcataatgatgatgatgattatggtaccaggaagaaacttagacttactaaggagcaatctgatgttttagaagatagcttcaaagagcatactactcttaattctaagcaaaagagagatttagcaagacgattaagcttacgtcctcgacaagtggaagtatggtttcaaaat

SEQ ID NO: 10882 - DNA, 615 bp, Lycopersicon esculentum
  Predicted polypeptide sequence is orthologous to G394
gctcttcaatttcagtttctttatttctctatttcaaccagaatatcaagtacaatttctctcttttcattttatagatttcaacaaaactcagaattactactaattatatttgatttctcgctgatcatggagagactatatgacagtgccggtcttgatttaggattaggttattcatcaacggtgaatcagacatcaagaaaagacggacaagctagctgcagttaaatccgatctcggttttgagccctctctgaatttaagcctttcttccggtgatcatcagatggtagatctgaagacggaaaataaggatcaattatctgttgcttcgtcgtattcaaatggcagtgtgaaaagggaaagagatattggtagtgaggtaacagaagtagaaagagtaatttcttgtagagtaagtcatgatgaagattattatgaagatgatgatgcttcaaatggaaagaagaaacttaagctcaccaaagtacaatctgctctgttagaagaaagcttcaagcaacagagcactctcaatcttaagcaaaaacagaacttggcaaggaagcttaacgtaaggcctcgtcaagttgaagtttggttccagaatag

SEQ ID NO: 10883 - DNA, 1597 bp, Lycopersicon esculentum
  Predicted polypeptide sequence is orthologous to G409
ggtcacatctcttctctgctccaacacaccctctttgctctgctttattcccaaaaaaaaataaatcaacaaaatttctgtttttggttctggaacttggctatcttttttttttggttcataatcatatccttgtattgaatttgtaagcaagggtgatgatgtttatggtgatcggcagtaggtgctctcacacttcccacatcactgaaatcataatcacaagcttctttcgccacaagctatagatctttactaattccatatagtatatagttttaatacaagaaaacaatatatatatatatatatatattaaaggggggtatttatcaagaaccccaaattcttaattacataacgaaacgagcggatatgggtgtttcttgaaaagatctctgttttataatttaaaaaaatttgtctgtagaattcgaagctatgatggctccagggattctctacggtggttcttctaatttcgatggcgtttttactcaaaaacagagagacgtgttttcttcatctactgcaccgaaagggcatcttggttccctttttgcccctgcctcttcttcttctaatttcttgggatccagttctatggtgagttttcgcggtgttaatggagggaagagatcattctttgattcgttcgatcaggatgacaatgaagctgatgaattgggggaatatcttcatcaagcggagaagaagaggcgacttactgacaaccaagttcagtttcttgagaagagttttggggaagagaacaaacttgaaccagaaagaaaagttcagcttgctaaagaacttggtctgcagcctcgccaaattgcaatttggtttcagaatcgtcgtgcgcgatggaagactaagcagctcgagaaagattatgatgaattgaggaatagatacgatactctgaaatcaaattacaataatcttctcaaggaaaaagaagatcttcgaactgaagttttccgtctcaccggtaagctgtttatcaaagagaaaggaaatgggcaattggatttgcgcgatgaacacaaacactccaatgcattggcaaaagaaaccgtggttgatccaatgtccaatgtaccagctctggttgttaagcaccagcaggaagatttaagctctgctaagagtgatgttttcgactcagaaagcccacgttacaccggtagaatgcattcctcagtcgtagatcaggatgattctgctcgcgcatttgaaactgatcagtcggattcatctcaggatgatgatgaaaacttcagcaagaatatgctttctactgccaacctacttggcaaagacgcggatgatgattatcccgcgacatcatcaaatttgagttactttggatttccagttgaagaccaaggttttggtttctggacttattaagttaaaaaaaatgtttgtatttgattagtagtaatgcagaatactatttaatgtgtcctagtaatatgtcatatatttggagacattgtatagaaagcacatttctgtaataaataaagtccaagaacagtaatgagttctggtcacaaaacagtttggaactaaaaaaaaaaaaaaaaaa

SEQ ID NO: 10884 - DNA, 1009 bp, Lycopersicon esculentum
  Predicted polypeptide sequence is orthologous to G409
cttatttcctctttcatctacttatgcatactcattttcttcactcaattttttaactcttttttttttcttggataatggcactgacccttcttcattctccccttaattatcacataaaaattttccaaatttcaagattcaatcaaaaaaccccatttcccactgcttaaacaaaccccacatagtttttttgttttcacaattcttgcaccttagagaacttaagggttgaaagtaaaataaatatggaagttggaagggttattaatgaaaaactttctcattgtctctggatgtccaattcttccccatcttttcatggttctgtatcaatggttaatttcgaagatgttggtcgaggagaagtgtctaaagagaggtcatttttcccaggaattgacaaagaagaaactagcaatgatgattatgatagctgttatcatcagccagagaagaagagaagacttttgcctaatcaagttcagtttcttgagaagagttttgaggtagataacaagcttgaaccagagaggaaagttcaattggctaatgaacttggcttgcagcctagacaaattgctatttggtttcaaaataggcgcgctcgatacaaaactaaagtacttgagaaggattatgatgctttgaaagctagctttgataagcttaaagctgattatgacacccttttcaaagagaacgaggatttgagaaatgaggtccatttgcttacacaaaaattgcatataagggagaaaggaaaggaaaactcagagcaaagtgaaccaattagtccaatagacacacaagaggctcaaaaagcaacaactccaattgttgttacctcaaatgtaccaaagttaatgtgcaaacaagaagatgcaacatcagcaaaaagtgatgttattgattcagatagcccacattacactgatgggaatcattcatcaaatgtatttgaacaagagccatctgatttttctcgagatgaagatgacaacctaag

SEQ ID NO: 10885 - DNA, 1452 bp, Lycopersicon esculentum
  Predicted polypeptide sequence is orthologous to G409
gtacaaaacagcacatatatatagagacaaaatcacataatacgccctcgccggaatcttattttcactgtcgccggccgttaaaactttttttttctagttcggaggtcaaataattaacctccgatcggaagaagtagttattctaactgcttctatttaatctgaaaacgggaaaacccctgagctggttaaggtggatttcgtgatgggattttgtatttgtcctttggaaactcctgctagattactgtggagtactagtttcttccgccacaagcttatgctcttctaaaacttagtcaactctcttttttcatacacatccctgctaaaaaagaagaactctgtgctggagtttttgttttcctttttctgtttcgccggaaacatataaataatcttctgtgtgtaaataggcgattttccagatagttgaaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggccaaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttacaggggaaagtggttggaggagcagggggaaatgaaaaatctgacatcttggaggtggatgctatgacgatccttcaagtgaaggtgaaggctgaggaccggttgagcagtggcagtggtgggagcgcggtggtagatgagcatagtccacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaattgaattttagaatattatattacagtttttcttatctacgcgcgctttgtatgatgaaataagtgtcgtaattccaacttcttatttaaacatctattaatatgcttttgcagcttttattctcttaaaaaaaaaaaaaaaaaaaaactc

SEQ ID NO: 10886 - DNA, 964 bp, Lycopersicon esculentum
  Predicted polypeptide sequence is orthologous to G409
ttccttgtctacttctacttctttttctcaatattaaatgtgatcctcatttatagtactcatcacaaactttcttagtaacaattcaatagtccaatttttcctattcttgatcctcctctcaactccaaataccaaaaaaataaaatttagaggataaaaaatggaggtagcaagagttcatgaaggttctaacaatggctttatacttccaaatgaaattcttcctcctacttctaattggatatctaattcttcctccattttccatggctctgtatcgatggtaaatttcgatcaagatcgagtacagaagtctaaaaagaggtcatttttagcacaacttgatcaagacgacagtagtagcaatgatgacaattacaattatcatcaccaaagtgaaaagaaaagacgattgttaccaaaacaagttgagtatcttgagaaaagtttcgaggtagaaaacaagcttgaacctgaaaggaaagtacaattagctaaagaaactggattgcagcctagacaagttgctatttggtttcaaaatcgacgagcacgatgcaaaacgaaacaaattgagaaggattatgatgtccttaaagctagctttgatgaattgaagactcaatatgattgtctcttcaaagagaatggaagcttgagaaatgaggtacatttactcaaagagaagttgatcaacagagtaaaagggaaggaaattttagaatttattagtccacttgatcatgtagaacctcaaaatccttctattggagttgattcaaatttagcaatggtgaagtgcaagcaagaagatgcaaaaagtgatgttcttgattcggacagtccgcgttttactgacggagattacacttcatatttggagcctgctgattcttcaaatgtatttcagacagaacactctaatttttctcgagaaatgacacattatgcttgccaaaac

SEQ ID NO: 10887 - DNA, 718 bp, Lycopersicon esculentum
  Predicted polypeptide sequence is orthologous to G416
gacaaaaccgtgtcaagctactagtcctacaacatcagtaggatgtacacccgagactgtgaagggtgaaccagcagatcatatttcgtcaagtgatgcagaagaaaatgcagcccaggcacctaatgaagaaacatccaacttggttatccgtccttccaagaaaaagcatgacaaaaaagcagtaataacatcaatagatagagtagagacacttgtagaatctggtgatgacgtgagcctgaaactactgcgagacagagcaaaaaagcaaaggagaaaactaatttccaaggagagggaaaagatacaagaagctgaagctgaagctgagatgcaggagctatgtagaatcaaggacaaaatagcaagactccaggacattttacgaaggtttccaaatcacagatgtagaagagcggacacttctagtttagacgaatcattgattgtctttgtacctgttgcacagttgcaggagaaaaggtgactaatcacttcaacctttttttttccttcctaaagttgtgttcctccatttttcacaaatcaacaaagacaaacaaggaggttgaatgaggcatatacagaagcaaaattcttcttttcatgttatacatgtatagttttccatctttctttaaggacttgcaactaaatagaatgtaaaagattgtacaatagatcagtttcagttatgttaattggcacaatcccc

SEQ ID NO: 10888 - DNA, 468 bp, Lycopersicon esculentum
  Predicted polypeptide sequence is orthologous to G416
catggttcaatgaaaaattgttgatatttaatcttaaggatcggatccctctttattttttaacgagttaattaattacatcttaaatatgtaagagataattgtttagttttattcttcgagaaaacattttgtgattatttctgtttcagtcaataaatttaacaagttattattttttctgaaaaaaaattatgattttaattaaatatatcttttaatcatttaactttaatacacaattaatcacaataactaccgcttaattgtatgcaagtatatcaaatgagcaaattaaggaacattaatgggtcctcgtataagatttcaaatcagctctaccttttttttctttaactaaatataaaagagtgaaatgtttcattctgtgaagacgaaaattaaactataatttttatgaccagaattttattcattaactcgagaaattgttgttaggttcgggag

SEQ ID NO: 10889 - DNA, 518 bp, Lycopersicon esculentum
  Predicted polypeptide sequence is orthologous to G418, G965
gttggaagaggtaaattgaagaagaataacaacaaagcagcagccaataaccctagtggtggcgctaacaatgaagcttcttcaaaagatgttcctactttgtccgctgctgatagaattgaacatcagagaaggaaggtcaaacttttatctatgcttgatgaggtagataggaggtacaatcattactgtgaacaaatgcagatggttgtgaattcgtttgatttagtgatgggtttcggggcagcagttccttatacagcactagcacagaaggcaatgtcgagacatttcaggtgtttaaaggatgcaataggagcacagttgaagcagagttgtgagttattaggagagaaagatgcaggaacttcgggattgactaaaggagaaactccgaggcttaagatgcttgaacaaagtttgaggcaacaaagggcgtttcaccaaatgggaatgatggaacaagaggcttggagaccacaaagaggcttaccggaacgttctgtcaatattttaag

SEQ ID NO: 10890 - DNA, 572 bp, Lycopersicon esculentum
  Predicted polypeptide sequence is orthologous to G418
ccccaacttagtgattcaattaatgatattttggatatttattaaatcatcctaagttttgcttgtgattgattgtttgtgtattggatttgttcaaagttacatttaaatggggaaaaagagataaaaacttttgggggaggagcaagtgtagtgttgaagattaatcattcttttattatactagtttaggtgttggttcctcctccgttaagaagaaggtaaaaaggaagggaaaactgttgatcaatgaattgtttaagtaacatgacttgcgctcattcctctgctattcataaaacaaggatcactcgacttttccctctatcccctgtccatcctttcctttcttcatacatacatacatacaagttctttcctttgaaaacttttctataagtaagtgattattcatatttgttgtgataatgttgcctattcaaaagtctataacaagagagagtatcacaattcgcaagtgtcggcgaactagtctctcatgaaaagtcgttacagtcacaatcacttccaatttttgttttcttactacattattattattattattattg

SEQ ID NO: 10891 - DNA, 635 bp, Lycopersicon esculentum
  Predicted polypeptide sequence is orthologous to G418, G965
atcaaattcatgttggatacgcagcatcatcaccaagaatatcaaatgctctaagaaattcgcgatatgtaaaagctacacaagagctacttgaagaattttgctgtgtaggtaggggaaatttcaaaaatcaaagggtgaagaaattagacgatgatcaaaaccctaattccaactcggagagtgaagatcatcgtggtccctccaaagataatcatcctccattatcagctgctgagagatctgaatatcaacggaggaaaatcaagttgttatctatgctcgatgaggtagatgcaaggtacacgcgttactgtgagcaaatgcaggcgatggtgaattcattcgattcagtaatcggttacggtgcagcagctccatacacagcgttagctcagaaggcgatgtcgaggcatttccgatgtataaaggatgcgattgttggtcaattgaaacagacttgtaagtatttgggggagaaagatgtgacgggaacgagtgggttaacaaaaggggaaacaccgaggttgaaaatgcttgatcagaaattgaggcaacaaaaggcattacatcaaatgggaatgttggattctgatgcttggaggccgcaaagaggattgcctgagagatctgtt

SEQ ID NO: 10892 - DNA, 263 bp, Lycopersicon esculentum
  Predicted polypeptide sequence is orthologous to G418, G965
gcatctgttggcaagacagactggtctctccagaaatcaggtatcaaattggttcattaatgcgagggttcggttgtggaaacccatggtagaagatatgtatcaacaagaagccaaagatgaagatgagaatagccaaagccaaaacagtggcaataatataattgcacaaacaccaacgcctaatagcctgactaactcttcatctactaatataacaacggcaacagcagcagcaacaacaacaacagcccctacaacta

SEQ ID NO: 10893 - DNA, 881 bp, Lycopersicon esculentum
  Predicted polypeptide sequence is orthologous to G419
gaggagttgctcagtgagttctgtagtcttggaataaagaagaataatgatcattcttcttcaaaactacttctaaagcaacatgacactactgctactacttcaaaaaagcaacttttacagtctcttgaccttttggaacttcaaaaaagaaaaacaaaattgcttcaaatgcttgaagaggtggatagaaggtacaagcattattgtgatcaaatgaagggtgttgtatcatcatttgaagcagtggctggaaatggagcagcaacagtttactcagccttagcatcaagagctatgtcaaggcattttagatgtttaagagatggtattgtggcacaaattaaggccacaaaaatggctatgggagaaaaggacagtactactactcttattcctggctcaacaagaggtgaaacaccaagactcagacttcttgatcaaactttaaggcaacaaaaggctttccaacaaatgaatatgatggagactcatccttggagaccgcaacgcggtctcccggaaagatcagtctccgtcctccgcgcgtggctctttgaacactttctccacccgtacccaagtgatgttgataaacacattttagctcgccaaactggtctttcaagaagccaggtgtctaattggttcattaatgcaagggtaaggctatggaagccaatggtggaagaaatgtacttagaagaaacaaaagaagaagaagaagaaaatgttggatctcaagatggatcaaaagccctaattgatgagatgacaattaataaccatcaatcatcacacattgatcaaaagccaaatcttgtaagaattgagtctgaattatcttccatcataaatcatcaccctcatgataaaaatga

SEQ ID NO: 10894 - DNA, 910 bp, Lycopersicon esculentum
  Predicted polypeptide sequence is orthologous to G427
ggggttacaaggaaaaactagtggatattagagaggaaattcttcgaaagagaagggcaggaaagctccctggcgataccacctctgttttgaaagcttggtggcaatcacattcaaagtggccataccccactgaggaagataaggcaaaactggtagaagaaacaggtcttcaactaaagcagataaataattggtttatcaaccaaaggaaaaggaactggcacagtaatccttcctcttctacagctttgaagagcaaacgcaaaaggtgaatctgaaaatactactcatcatgtcagagaagttgttagcaagcttccttggatgagctacgtacctagtgtccagctactatctctacgtagtatatagaaagatggactcattcagttaaagcaacaggtcaattatttcgcaactgcaggacaactacaactattacagacagatcctacttgatcaaaagatggattgatatgatgatgtgttgaggaaaggctagttatttacgtaatagtctgatggggagggtgtacggtgactaatatatgtcaatcgcagtcatctataatttaatcacaaattagttgggatcgactgcatctgtcatctgtatcagttttgtgtgcacttgaatagttggaaacttcagtgactcaatcatgcagcttgcagaaatcactaccacatttttgtttggggttagatatgggggtgtacagttgaataatctcagttttatcaatacttttcttgtcgttatgtaagaattaagattgtgtaggtattcttagctctatgtatagatggttcatgtcatatatcatgttattgtttacaatgtgatgaaaaaaataaaaaagaagaaagagatattttggttggatacaaaaaaaaaaaaaaaaaa

SEQ ID NO: 10895 - DNA, 441 bp, Lycopersicon esculentum
  Predicted polypeptide sequence is orthologous to G427
gagaatagtctgagttttttttttttttttttgtttgtttgtatgatacttttctactttagaaaaaacatggaaacgctaaacaattaccagtattacaagaaaaaatgtcaatactccagagctcaaaagtactgttagtttgtataatactgaaaatgtcaatacatgtataccaattctgagtaccatatatattacaatccgtcctaatctacgcgaattacctaacatttttcccatgtcatagagatcacgattgacagttcagaattcttcatatcaccatcatcatacctatatatgtgttgcttcattttgatcgttcgttttcttatctcttgcgtttggactttagagatgtcacagactgtgaattgctatgccaattgcgttttctttgattgatgaaccagttattgatttgcttcagctgtaatc

SEQ ID NO: 10896 - DNA, 1824 bp, Lycopersicon esculentum
  Predicted polypeptide sequence is orthologous to G427
tttttttcctctattctctttctctctttactttttcttctttgtgtaccaaaaagaaaataaaaataaaaatgaacagagagcattgaacaaacactctatcaaaaagccatagctatggagtttcaggaccacttttctcaagaaatggttcttcatcaacagcagcagcagcagcagcagcagcaaaacgcggtattgcgttccatgctacctgaatctcctcatcacgacgctcgaaaatcacctccgacttggctcaatacttctctccttcgtcaacaacacagtcagtttggtaacgcatcctcaccttcctcggctgcagctgcagctgccgtagccggagggaataatttccttcatctccagacatctaactccgactcgtcaaactctaaccagtggctctcacctactgcggcggctggaggtggaggtaacggcggtggaggtgggcataatgatgagttatcagagtcgatgaattttgcgaagaagatgagtcaacagcatagtggaggaggagaagaaaacaataataataataataataataataataataataataatgaagaggagaactcatgggagagagagaaatgtaaagcggatatattgaatcatcctttatacgatcagctactgtcggcacacgtttcatgcctgagaattgcgacgccggtggatcaattaccgaggattgacgctcagctagctcaatcgcaaaacgtggtagccaaatactctgtacttggacaaggtcaaccgcctctagatgataaagacctcgatcaatttatgacacattatgttctgttgctctcttcctttaaagaacaactgcaacaacatgtccgcgtccatgcaatggaagctgtcatggcttgctgggagctagaacaatctctacaaagcttaacaggggtagcaccaggtgaaggtacaggagcaaccatgtctgatgatgatgatgaccaggctgatagtgacacaaactttttggatggaggttttgatggaccagatagcatgggatttggtcctcttgtacctactgaaagtgaaaggtccctgatggagcgtgttaggcaagaactcaagcatgaactcaaacagggttataaggaaaaaattgttgacattagagaggaaattttacgcaaaagaagagcaggaaaactgcctggtgatactacatctgtgttgaaagcttggtggcaatcacattctaagtggccttatccaactgaggaagacaaagcacgattagtgcaagaaacaggtttacaactgaagcagataaacaattggtttattaaccaaaggaaaaggaactggcacagcaatccatcaacgtcttcttctcagaaaagcaaacgcaagagtgcaggtgaaatcaagcagtaaaaaaaagacatgatgaagaagaaaatgaaatttttgtgttctagcaaagcataaagattcatcacaaaacaaaaaacatgaatggctagaatttgggaaattgaattaatgagtttttggctgtgtgaagtaattgaccacagaaagttcccaagctgacctggttgactaagatatgctttagaaaaaaagagagtatagatacttgtgaaagtaatactagcactttcttatttttatgaggttaattttctatgttttaagccaaatattttaggacaacaggtttcagtttttataatttttgttttgtatcaagtattttggtggctatgttgtaattttgaattctagtgttactcatttttgtgaatagaagttgtagattataattacttaaaaaaaaaaaaa

SEQ ID NO: 10897 - DNA, 612 bp, Lycopersicon esculentum
  Predicted polypeptide sequence is orthologous to G427
ggcaatatataagttgtgaacaaaagcttcaataataacaacaatcatggagtttcatgatcacttttctcaagaattaggtctacaacaacaacaacaacaacacaacgtcgatgacgacgtttcggatcaatcgatgaatttctccgtaaagctaagtcaacaatatagggacgaggtcaataacaacgagcacaacaacaacaacaacaatagtaacgtttgggatcagagtgaaaaatacaaagcggatattttaaaccatcatttatcggaacaacttctttctgcacacgtggcttgcctgagaatcgcgactccggtggaccagttaccgaggatcgacgagcagttgacggagtcacagaatttggtggcaaagtactatgttgttggtcaaagtcaacggtctcttgatgataaagaacttgatcaatttatggcaaattatgttctattgctctcttcttttaaagagcaactacaacaacatgttcgtgtccatgcaatggaagctgtcatggcttgttgggatcttgatcaatctctacaaactttaacaggggtagcatcaggagaaggtacaggtgcaaccatgtcagatgatgatga

SEQ ID NO: 10898 - DNA, 803 bp, Lycopersicon esculentum
  Predicted polypeptide sequence is orthologous to G427
gaaagcacgattagtgcaagaaacaggtttacaactgaagcagataaacaattggtttattaaccaaaggaaaaggaactggcacagcaatccatcaacgtcttcttctcagaaaagcaaacgcaagaggtagattgatcaacattcttttctccctatgtttggtcgaactcttcaaaactattatcaggtatctgttgggttcttcaaaagcaattttgaaggatttgacacggtacggtgaagggtccaagcgacatagcttttcccttaatcacatgctatgttgcttgaagtcttccaaatgtcgttacatccctgttggatccgacatgcatcctgttacatagttaaagagtttaagcgacatatgtcacataattaaggatttaaggtcgatagtgtaaagaattttacactatcaatttgttgtactcccactgttcaatttgtttgtcttacttgccagcctgtttttttttaaaaaattcctttttcgataactctataatttcaacgttccacgtaatatatttaagatcactagattaaatgacattttggtacattctaggtatctttaatttaaaaccgcaagattctgaagtcttaattcactttcttgaactccgtgctaaatcaaaaccagacaaacaatttgaaacaaagggaaagggagtagtaacatggtctagctgttagcttagcttacttatcaggtcatattataattatcttttaagtacctggtcggtgtctttcacatgttactatcttttaggtgacttaatagtataaactag

SEQ ID NO: 10899 - DNA, 150 bp, Lycopersicon esculentum
  Predicted polypeptide sequence is orthologous to G427
gaagagcaggaaagctggctggtgacactacttctgccttagaagcttggtggaaatcacattctaagtggtcttatcccacagtaagtactactatactcattaagttacaagttcgaatcgtgaaattagctattaattgatgttggg

SEQ ID NO: 10900 - DNA, 611 bp, Lycopersicon esculentum
  Predicted polypeptide sequence is orthologous to G427
cctctattctctttctctctttactttttcttctttgtgtaccaaaaagaaaataaaaataaaaatgaacagagagcattgaacaaacactctatcaaaaagccatagctatggagtttcaggaccacttttctcaagaaatggttcttcatcaacaactgcaacaactgctacaaagcttaacaggggtagcaccaggtgaaggtacaggagcaaccatgtctgatgatgatgatgaccaggctgatagtgacacaaactttttggatggaggttttgatggaccagatagcatgggatttggtcctcttgtacctactgaaagtgaaaggtccctgatggagcgtgttaggcaagaactcaagcatgaactcaaacagggttataaggaaaaaattgttgacattagagaggaaattttacgcaaaagaagagcaggaaaactgcctggtgatactacatctgtgttgaaagcttggtggcaatcacattctaagtggccttatccaactgaggaagacaaagcacgattagtgcaagaaacaggtttacaactgaagcagataaacaattggtttattaaccaaaggaaaaggaactggcacagcaat

SEQ ID NO: 10901 - DNA, 660 bp, Lycopersicon esculentum; identical to SEQ ID NO: 10230
  Predicted polypeptide sequence is orthologous to G427

SEQ ID NO: 10902 - DNA, 712 bp, Lycopersicon esculentum
  Predicted polypeptide sequence is orthologous to G428, G1594
cttcccccaactaattactagtaacatagaagagtctggtctggtctttatcacctttttaaattttaaaagtaaaaatataattaaagtagctgtctagctagggcctttttccaggtgtcgatctatatatatatttttatttgggtttaaagaaacgtattccatatatatatatatatatatataccgctgagataacaactagagatttttaattgttcacatactgttttgatgatggatgaattgagcaaacttcattctgctattgtttgttcacacagtagacgacaacaagaggttgaggttgaggctgaggccgggccgacaattattaataacactactactagttttgctgctgttcatcatcattattgtcaattagaagcagcggttgctgctgatcataatcatcatcaaaataatactaaatccaccaccaatatgtcagatcttattaaagctcagattgctaatcatcctctttatcccaacttactttctgcttaccttcaatgtcgtaaggttggagcaccgcaagaaatgacatcaattctcgatgaaattagcaaagagaacaacttaatatccagctcacgtcacagtagtgaaattggagctgatccagaacttgatgagtttatggaatcatattgtgcggtactagtgaatacaaagaagagttttcaaaaccgtttgatgaagc

SEQ ID NO: 10903 - DNA, 838 bp, Lycopersicon esculentum
  Predicted polypeptide sequence is orthologous to G431
gaaaacaaatagaaaggaacaaaatttagagtgaagaagaaagtgtgtgagagaataatggagggtggttctagtggaaatactagtacatcttgtttaatgatgatgggatatggagatcatgagaacaacaacaacaacaatggaaatggtaatggaaatggaaatggaaatgtaacaatttgtgctcctccaatgatgatgatgatgcctcctcctcctccttctttaactaacaataacaatgcagaaacaagcagcaacaacatcctttttcttcctttcatggacaacaacaacaataatcctcaagaagacaacaactcttcttcttcttccatcaagtcaaagattatggctcatcctcactaccatcgtctcttgactgcttatctcaattgtcaaaagataggagctccgccagaagtggtggcaaggctagaggaaatatgtgccacgtcagcaacaatgggccgtagcagtagtagtagtggtggtggaatcattggagaagatcctgcactagatcagttcatggaggcttattgtgagatgctgacaaaatatgaacaagaactctcaaaacccttcaaggaagccatggtttttctttcaagaattgagtgtcagttcaaagctttaactcttgcacctaattcttctcatgaatctggtgtagctttgggcgaggcaatggatagaaatggatcatctgatgaagaggttgacgtgaataacagtttcatcgacccccaggctgaggatagagagctcaaaggtcaattgttgcgtaagtacagcggttacttgggaagccttaagcaggagttcatgaaga

SEQ ID NO: 10904 - DNA, 521 bp, Lycopersicon esculentum
  Predicted polypeptide sequence is orthologous to G435
ttcatttaaaatgtcacaagaaaagactcaaccaagatcaaatgaggctcttagagattagcttcagctcgaataacaagcttgattccgatagaaaatttcaacttgcccaagaactagggttgccacctaggcaaatcgcaatatggtatcaaaacaagcgagcacgatggaaaagtcaaagccttgaggttgactataagaccttgcaacaaagactagataatgcccttgaggataatgagaagttgaaattggaagttgagaggctaagaaaagagctaaacaaaaatcaagaagtgttgttgggattcaacaccacaactactaataattattcatcaatttcaagttcttgtgatgaagttgggagtacttcatgtttgcaacttcatgatcaatccaagcataatcatcttgataaggatttttatgcttgtttaattggtgatgaaggtcactttgggacacatgatgggcataatttctttgcttcatctttgtcttgataagctacatat

SEQ ID NO: 10905 - DNA, 687 bp, Lycopersicon esculentum
  Predicted polypeptide sequence is orthologous to G438
gatcaaacgtgtcatttattccagctcagaatcttgaaattcatgaaaaaaagttaaagtttttttttttttttgcttaagattccaaaaatttgagagttttgaagcaaaaatcaaagggctattggtagaaagttaaaagttctttttaatgatgatggagtttggaggtttgtgtgaatggaaatggtgtagtaaagtatcaaacacgagtaatttacagctgaagtgattttttttttttttgattttgttgtccttttctgccatatctttcgttgagcagttttggctgtaccttaatttgtaagtttagcgtgaagtgtatgtttgagccttgtgtagaaaccaaaagggggagaacctaggaatcttctagttcaatcaagatcgtccatttcatcttgtctgagatccctagaaaaaaaaagaacaaaagaaaaagataaagcctttgtttcagagaatcttagttctctgtatagatatatatacatatatatgtaaagctgctaaggaagtagtttcagggaatatatctacttgggggtgttttgaaaatcttgatttttttttctggggtttggatttgagggaaaatggctatggtggctcaacagcatagggagagtagtagtggtagtattactaaacatcttgatagtagtggaaagtatgttcgatata

SEQ ID NO: 10906 - DNA, 857 bp, Lycopersicon esculentum
  misc_feature (824)..(824): n is a, c, g, or t
  Predicted polypeptide sequence is orthologous to G440, G864, G1421, G1750
tggaatcggatccaaattggggccccaacctgttttgtctgcgtggtatatgtggcctttcagagctgtacattattgtcccatgcactatatatcttgagcggagtgttaaacccctgccttctctgtttatacttcctctcttttcttccctatttttggctttatacctctaattatattgttctaattatatggtagaaagatctacttcccgccaaaaacaacaaagaaagtaatctctttttctttgttcactcatcaacttgtttctcaaatcatttgtatcactgcaactttttccacacttaaaaactttttatacaataatattggtcactattcactcacttcaaccagttcttgattgttttagtactcctttttgagcttatgatgatttttttttgtgctctttgaaaaaaatatcttttaaatcgaactgtaactttaagtttttggtataccatgacggaaaattcagttccggtgattaaattcactcaacacatagtaactacaaacaagcatgttttttctgagcataacgaaaaatccaattcagagttacaaagagttgtgaggattatacttacagatgccgatgctacagattcttccgatgatgaaggccggaatactgtacggagagtgaagaggcacgtgacggagatcaaccttatgccgtcaaccaaatcgatcggcgacagaaaacgaagatcggtgtctccggattctgacgtcactcgtcggaaaaagtttagaggcgttcgtcaaagaccgtgggagtcgttgggctgcagagattcgggacccgacccggngaaaacgggtgtggttgggtacttatgacaccc

SEQ ID NO: 10907 - DNA, 487 bp, Lycopersicon esculentum
  Predicted polypeptide sequence is orthologous to G440, G864, G1421, G1750
aatcctcttatgctttgttgttctccgtgtgggactgactgtgggtgtgtttctcatcttttgatgttttgggtctttttttttgtcagtgaatgatcgtgttttaagcttctctttgacggttccattgctcgttctcatctattaagtgtgctactttttgtggtgtcactctcaaagcaatccatcttttatctttctttctttcctttttaatcaatcaggcttagcattgaaaaataaccaatcgaagatttattcgatggattatcattcgctgtgtccgatcaaatacactgagcatcggaatgttattagaaaagttactaaaccatctttggtgaaatcaaaaaaactctcagaagctgcaaaatcctctcagttgaatccctctgttccaaggactgttcggatttctgtgacagacccatacgcaaccgattcttcaagcgatgaagaagacctgctttttggacggcgacgggtg

SEQ ID NO: 10908 - DNA, 645 bp, Lycopersicon esculentum
  Predicted polypeptide sequence is orthologous to G440, G864, G1421, G1750
ggaaaacgggtgtggttgggtacttatgacaccccagaagaagcagctgtcgtttacgataaagctgcagttaagctcaaaggtcctgacgccgttaccaattttccggtatcaacaacggcggaggtaacggtgacggttacggaaaccgaaaccgagtctgttgccgacggtggagataaaagcgaaaacgatgtcgctttgtcacccacctcagttctctgtgacaatgattttgcgccgtttgacaatctagggttctgcgaagtggatgcttttggtttcgacgttgattcacttttccggctgccggattttgctatgacggagaaatactacggcgatgaattcggcgaatttgactttgacgattttgcccttgaagctcgatagtgtacgaggggctatttcgtccatttttgcaaatgggttcactggttagttgactagtgacgtggcatttttggcgggaatatatatatagtgattagcagtctctattcatacgaagactttgtgagagatttttgtttttatttttctgttaattgtgggtgaatattgtaatatgaaaaattttgtatggtgaaattgaattaattaacgatgaagataaggagagtgaaggggggatgtgtgtatttt

SEQ ID NO: 10909 - DNA, 568 bp, Lycopersicon esculentum
  Predicted polypeptide sequence is orthologous to G440, G864, G1421, G1750
atatatttccctcttctctctctcactctctctacaacactcattgactagtcgttaaactcatcaagacttgttcttccttttatttctctttacatctctcctataaactcactgtatttcactatcttccatgttcaaaaaatggaatcacaaaaaatcaaaaagaaattagtccacaaaactatcactactaagtatgatcatcacaacaagtggactcctaaagttgttcggatttgttacactgattgtgatgctactgattcttcaagcgacgacgatgacgacgagaggaatcgagtgaaaaaatacgttacagagattaaatttgagaagaaaatggctgctgcagatgtgaggaaatcgttgaattcgaataagaagaagaagaaagcgatcgatttgaagagagatgagaatgttaaaaagtttcgcggtgtcagacagaggccatggggaaaatggtctgcggagattcgagatccggtgaaaaaaacgagggtttggttaggtacttttgataccgctgaagaagcggctatgaaatataatatagccgctattc

SEQ ID NO: 10910 - DNA, 530 bp, Lycopersicon esculentum
  Predicted polypeptide sequence is orthologous to G446
gtggaaggcatactttaatatgctaaagctgttttcttacagagtcatcaacactcataaattacaacactactataacagaaacctagcgaatcatcttcttgttaagttgttcaacaacattacatttgcatgttgctccatgcaactctagtgatcaatcactgtgagctctcatagatcacttgtattgagcttagttcgggaattctgatgttgatccattgatgctttgcagtccaacagagtttaatagctgcattccttcctctcccatttgctggacttcagtacgcgataaaattctgatgcatcgaacacatcctacaaattcctctcaaggatcatccccaacaaggaggacatcattctcaaaatccacatataccaacttccagcttgagcctcgagtgtcattcataagcccctcaagtccaaacattctttcagtttcagaccgcagttctttataatttttgaaaccagagacatcaattgagcttcctacagatcctgacttttgaatcttt

SEQ ID NO: 10911 - DNA, 717 bp, Lycopersicon esculentum; identical to SEQ ID NO: 10238
  Predicted polypeptide sequence is orthologous to G446

SEQ ID NO: 10912 - DNA, 561 bp, Lycopersicon esculentum
  Predicted polypeptide sequence is orthologous to G447
gcacctagcccatctggtactaaggcggtgacacctccaccaactgaggaagtggtaagagagggtgaggatggggagaatgaacaagtgcagaatgaggaattgccaccccaacctacccaagagatgatcaatcaggttcttgcttaccttagcgggttatctgatcaaggccaagcacctccagtgttttctgcactagcacctcaggctccggaggtacaacatgcgcctactgtgactccccgcatcgatacctcattggaaataggaacgtttccccgtctgactacagggcctataatgacaaatgatcagcatgaactttttagtaagttcttgaaattgaaacctcaagtctacaagggtgttgaatctgaggatgcctacgattttctggttgactgtcatgagctactacacaagatgggtatagtagaacggtttggtgttgagtttgtgacttatcagtttcaagggaacgccaaaatgtggtggcggtcacatgttgagtgtcaaccaacagaggcaccacgtatgacttgggcatcattctctagc

SEQ ID NO: 10913 - DNA, 458 bp, Lycopersicon esculentum
  Predicted polypeptide sequence is orthologous to G447
cgtaaccgagtctcaatttgggagattgaaccagtaacagcgccgtctttcatgtggcctactccaccggtctttacatcaaagcggccaaggctacctggaatgccagatgatgattgctctgatctggatggcctgtttaagaggacaatgccatggctcggtgatgactttggcatgaaggatccgcacggtcttccatgcctgatcttagcccaatggatgaacatgcaacagaatcctcctttggctaactcaatgcaaccgaactacctgcattctttggctggttccgtgctacagaatgtaggaggtggagcagacctctcgcgtcagttatgtctaccagcacctcagcttcctcagcagaatactttgcagtttggttcccaaaggccatcccaacatgttcagcagctcgaccagcttcagaagataccaactaccacattgagtcc

SEQ ID NO: 10914 - DNA, 629 bp, Lycopersicon esculentum
  Predicted polypeptide sequence is orthologous to G447
taaatctcatgtatatggacaaaataattctgggtttatctttttgatcaacaattgtggttgtggatcttggatatacttggtaggaggataaagtttgaatcttgaagtgtttttgataatggtgtgattgaagtggttttgataatttgtgctttttttttggggggtttggtaatgtatgtatgatggccccatttggcagaattttgtgggttttatgtttgattgactaatgtgatgatgggaattgggtattgcttatttctttatttggtgattgagtaaagtttgaatcttgaagtgtttttgataatgatgtgattgaagtgattttgataatttgtgtttttggggtttgttaatgtatgtagcttgctccatttggcagaattttctgggttttatgtttgattgactattttggttttggagcttagattttggcttggatgggggaattgggtattgtttatttctttctttggtgattgagtaaagtttgaatcttgaagttttttgataatagtgtgattgaagtgattcaatcagtgataatttatgcctttttttgggtttgttaatgtatgcttgcttgcgcaataggcaaattttcttggtttatgttt

SEQ ID NO: 10915 - DNA, 1034 bp, Lycopersicon esculentum
  Predicted polypeptide sequence is orthologous to G450, G456
tttttttttttttttgttactattaactatacttatattatttttgcattttctctctcaatatttttctctctctctctctataatatttgcattgtactactactactacatattgaagaaaaaagagtttgatttttgatggatttgaaagaaactgagttgtgtttgggactacctggtggtggtggtggcggaggtgaattaattcgcgataataataataataataacaaggttaatgggaaaagagggttttctgagactgttgatttgaagctcaattttcatcaagctagtgatgatatttcttgtgctatggagaataataagatgaagagcagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgctgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctccttaacagttctgaatatgtaccaacctatgaagataaagatggagattggatgcttgttggagatgtaccttgggagatgtttgttgattcatgcaagcgtttacgcataatgaaaggatcagaagctattggacttgcaccaagagctatggagaaatgcaagagcaggatctaaggcaattgatggtgtgcaagctccatagataatgcttgaagttgaaggttttgtgagattaatatattgttgttttcatgtgcttgtatttttaattttaattagtatatagttattaattaaagaagtggtctttaatttggacaatatttgtaatgaacatgatgcaataaacttaaaac

SEQ ID NO: 10916 - DNA, 702 bp, Lycopersicon esculentum
  Predicted polypeptide sequence is orthologous to G450, G456
gagcactatccatacattattaatcccaaaactttgtgtgagtacatctctctctctattttcaatttccataaaccattgcccatatagtattattaatttgtatagtggagaagaaaaacaagtaatggacttgaaaactgagttatgtttggggctgcctggtggtggaggagatcacaatattaagaaaagaggattttctcaaactgttgatctcaaactcaacctccatcataatgataatattccttctatgaacatcaacaatcctccaaaggataattcctccaacaagccaccaactaaggctcaagtggtggggtggccaccagtaagatctttcagaaagaacatgttgtctcaaaaagggaataataataataataataatgaagaaattagtgagaaggatgaaaaaacaatagcatttgtgaaggtttccatggatggtgcaccttaccttcgtaaggtagatttaaagatgtacaagagttaccaacaactctctcattctttgaccaacatgtttagctccttcactatgggtaattatgggtcccaaggaatgatagattttatgaatgagaggaaactgatggatgtcctcaatagttctgactatgtaccaacctatgaagataaggatggggattggatgcttgttggagatgtaccttggcaaatgtttgttgattcatg

SEQ ID NO: 10917 - DNA, 900 bp, Lycopersicon esculentum
  Predicted polypeptide sequence is orthologous to G450, G456
ttttttttttttttttttacaaataaaaatacaaatacagtattaataaaatcaatcgtcttcactcacacgggaagcatcgtagcacaaaatacacttctaagtaattgcctaattatatattacttatcctataattaaagaacgcaaaaggtaaaaataaaaaaacttattcactcaagccagttggtatctgtacatgcagttattaagcttctttatttagcttcaactcgacgatctcccaggtgttcttggagctaatcctatagcctccgtgctcttcatcaatctaattctcttacacgtatcaacaaacattttccatggaacatctcctacaagcatccagtctccatctttatcttcataagtaggtacatattctacaccatttgtaaggtccataagcttgctttcactttgagaattacagattgttaggcaagtaaacatgttttctaaagcattcaacaacttctggtaactgtcgtacatctccagatctacttttctcaagtaaggagctccgtcaactgctaccttcacgtatttgcacttttctatcacgttttttctgtatgatctcaccggcggccatccaattacttgtgcctttgctggaggtttgtttccggtagagatttcgtttttcgagtgattaacttcgcagatatcacggcggcgttcaccggaagttgagcttcctaggcttaattccataccgtcggaatttccacgttttgcaccggagatttgcttccgcgattcgccgggtaagccgagagttagctcagtttcattgaaattaaggccggaattatttgtttccgtcaaaccgttcgctgatttggctgtctccgatgacattttccccctttttagatagtttggtgaaat

SEQ ID NO: 10918 - DNA, 438 bp, Lycopersicon esculentum
  Predicted polypeptide sequence is orthologous to G450, G456
gagagaactagtctcgagttttttttttttttttttacaaagaaacttttataaacaaaagtgagaccatttacattttctttcacaagccttggagactcaagcagtaacaatacagaaaaaaaaaagaacaacatactactatggctataaattggaatacttttgcatatattatgaatatatatgtaacacaaatagttatactaaagatttccaagacagaaacactcgaaatcctggcgtcgatcttcaaatccacagatttggtgatctaccttaacatgaataggaagaaacatgtgaatttcgacttctcattgcttatagagaattgattgaatgtttgcagcgaaagtactgcagattctaacgatctttgcacttctccgcccctcttggagctagaccatttgcatctgaactcttcatgatccc

SEQ ID NO: 10919 - DNA, 531 bp, Lycopersicon esculentum
  Predicted polypeptide sequence is orthologous to G450, G456
gcagaattaaagctagggttgcctggtggagcaagaaaaaatgtttatggtgataatgatacttgtaatgttaatggtaaaagaagctttgtagatttgaagcttaatctttcttctgatattaacaacatcaagaattcaacacacaaaaccccagctgccaaggcacaagttgtgggttggccgcccgtaaagtcctttcgaaagaatattttgacttctcaaaagcttgatcgagagaatgataatattttggtgaaggtgagcatggatggtgcaccttaccttaagaaagtggacttaaacatgtacaagagttatcaagaattatttgatgccttaaccaagatgttcaattccttcactattgtccaaggaatgaaagatttcatgcatgaggggaaactgatggaccttttgaatagttctgattatgttcctacctatgaagacaaagatggtgattggatgcttgttggagatgtcccatgggggatgtttgttgattcttgcaaacgcttgcgcatcatg

SEQ ID NO: 10920 - DNA, 723 bp, Lycopersicon esculentum; identical to SEQ ID NO: 10242
  Predicted polypeptide sequence is orthologous to G450, G456

SEQ ID NO: 10921 - DNA, 1106 bp, Lycopersicon esculentum
  Predicted polypeptide sequence is orthologous to G451
tctatatacagctctcttatttcactttctccttatatattacagcaagctaccatttagcatcttcaaaccaatcttggagaagaaaaatcatcagttttggagaaggaaacttgaattgcaatccaattttgtgaaaaagaaaaatggagtgtgttttggctcatgagaaagatttgaatctcaaggcaacagagcttagattgggtttaccagggaggacagatgaagaatctgacaaagaaattgtatttcatttcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttgaaatgttcttatcatcatgtaagaggctaaggataatgaaaggatcagaagcaagaggattaggatgtggagtttgagaagaagaataataacaagattatgaattcttctctgttttaaacaggaaaaaaaaaggggtctttttgagcttgggttgtcgaattgcaaagaagctggaaatttgttttacactgattgggaagtgcaaaacagaagaaagagcagtttttgttttgaaggggttgaaaaaaatgaaactcttattcctatatgttgtgcaggcttttagaaaccatggtggtttttatagatcctgcagtgtgttaaatagcatatgaagtatgaagaatgtatttgctctgaaagcaattgtatagacacagtattctcaaatgtaatgagtttttttcctttgtactacttttaatctacgggttttaacacaaaaaaaaaaaaaaaaaaaa

SEQ ID NO: 10922 - DNA, 814 bp, Lycopersicon esculentum
  Predicted polypeptide sequence is orthologous to G451
acaacttcttctgagatagtaaataaaggagcaatcttgatcaagaaagtgtttaaagaatttctgtgtgtgtgtgttttgagatttgaggatttcatttggtgttttgggtatttcaagattcaatttttaattttttttggaggagagaaagaaaatgacaagtatagtgggcaatcagaaagatctgaatttcaaagccactgagctgagattaggtttgcctggtacagaagatcaagaatctgaccaagaaatatcaaattccaagaataacaacaaaagggctttacctgaatcaactcatgatgaagaagattgtgaatctaagtcaagttctgatcatgtcaaaaccccaccacctgttgccaaggcacaaattgtgggttggccaccagtgagatctaacaggaaaaacatcatccaaccaaagaaaacagaatctgaatctggaatgtatgtcaaagttagcatggatggtgccccttatctaagaaaaattgatctgaaaatgtataaatgttatcaagaactactaaaagccttagaaaacatgttcaaactcaccataggtgaatactcagaaagagaaggctataaaggctctgaatttgcccctgcttatgaagacaaagatggtgatttgatgcttgttggtgatgttccttgggaaatgtttatgtcttcttgtaagaggctgagaataatgaaaggatcagaagcaagaggcttgggatgtggagtttaacttataaattataaaaattcccaaatagaatattatgatgatgaagaagttttttttcctcttttt

SEQ ID NO: 10923 - DNA, 729 bp, Lycopersicon esculentum
  Predicted polypeptide sequence is orthologous to G451
gattcaaatcaatcattctttctaaatcatgagaatttacgagaaggatatcaatgatcttgaggcaactgagctaagattaggtttgcctgggataataaacgatgaatcttcaacatcaactagtacttctaaaaatagcagaaaaagaccttcatctagtagtgtaaatgaaaatgaacaacaagactcagctcctgcaccaaaagcacaagttgttggttggccaccagttcgatcatacaggaaaaatcatgtgtctaaattatcagaatctgataataattcctcaggaatgtatttaaaagttagcatggatggagcaccttatttgaggaaaattgatcttcaggtttacaaaagttatcaagagctactcaaggctttacaaagcatgttcaagtgcactattggagtgtattcagaaagagaaggatataatggatctgattatgcaccaacatatgaagacaaggatggtgattggatgcttgttggtgatgtaccatgggagatgtttataagttcttgcaaaaggcttagaattatcaaaggatctgaagctaaaggtctagcatgtctataaaaacatggaaatatatataaacatacatacaaatctgctagggatgaacaagtttcagttttgtaaactatctcgatcttctattagtttcacgggatatatagatctagatctacatgtacaaatagttttatccttctttt

SEQ ID NO: 10924 - DNA, 384 bp, Lycopersicon esculentum
  Predicted polypeptide sequence is orthologous to G451
tcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttg

SEQ ID NO: 10925 - DNA, 1156 bp, Lycopersicon esculentum
  Predicted polypeptide sequence is orthologous to G464
ggtttgtcaaaaattggaaaaatgtgttcagagaataattcatcttacagtgatgaaactgggcttgaattgggcttgggcctaggcccaagtgttacaaagactaacaaatcatcaacaaaatggtgtgagtatggtagaattttgactgctaaagattttcctaatggatttattacaagaagatttaataatatttgtactgatgaaaatattggatctgcttctacaagtgccagtcaggttgtgggatggccaccaataaggacttacaggatgaatagttttaatcaatcaaagattacaaatgctgatcatcaacaagaagaaaatgtgaacaaagaaactgagagttcaaacaagaaaattaatcatggaattaataataccaagaataatgatgtagattttgtaaaggtgaatatggatggattgccaattggaagaaaagtgaatttgagttctcatatttgctatgaaactttagccaaaatcttggaggagatgttcttcaaatcaaccaaaactactaattgtggagaaaaagaacaagtaacaaagtcatgtaagctcttggatggatcatcagagtttgttctcacatatgaggataaagatggagattggatgcttgtaggagatgttccatgggggtaaagaaacatttcttttaatttagcgtttctatagttagttaaaatgtttgacgtatttagaacagagttatctgatatctattgctagtaaaatgtaacctaagtattctgtagagttagttaaagtacatgcaagttaggctagacaccacaactatataagaaaacaaaaatctttgactagaaatcattatcgttataaaaattcataaatttcgaatcctgaatgcgtctctgcttacctgttcgtttgtattgtcttgtaggatgtttttgagcaatgtgaaaagactaagaatcatgaggactactgaggccaaaggactttgtatgtagaaacatggagagacacaaagcaaattgatctagtttacttaattagcaaattatcaaatgagaacacaactttggaaaactatataagaaatagtacaagtagagaagcaaagagtacacattttggggagtactttttatagtttcaatttttgttatgcatt

SEQ ID NO: 10926 - DNA, 567 bp, Lycopersicon esculentum
  Predicted polypeptide sequence is orthologous to G464
taggattttaactgctaaagattttcctaatggattttcagctaagagatccattaatgttggtgtttctggtactaaaagagctgctgattttgctggttctacaactgaggttggatctcctcctactggtgcaagtcaggttgtgggatggccacccataagggcatacagaatgaacagcttggttaatcaatcaaaggttctaaatgctgatgatgagaagggagttggcgggaacgataagaaggagcactcgaagaagaagatcaatcatgggaacactaaggatgatgcagcatcggttaaagaaaaggggcatcttggttttgtgaaggtgaatatggatggtttgcctattggaagaaaggtggatttgaatgctcatacttgctatgaatcgttagccgaaaccttggaggatatgttctttaaatctaccaaaagcggtgaaaaggaacaagcaactaagtcttttaagctcttggatggatcatctgaatttgtgctcacatatgaggataaagaaggagactggatgcttgttggagatgttccattcgggat

SEQ ID NO: 10927 - DNA, 375 bp, Lycopersicon esculentum
  Predicted polypeptide sequence is orthologous to G464
agaaaatgtgaacaaagaaactgagagttcaaaccaagaaaattaatcatggaattaactaataccaagaataatgatgtagattttgtaaaggtgaatatggatggattgccaattggaagaaaagtgaatttgagttctcatatttgctatgaaactttagccaaaatcttggaggagatgttcttcaaatcaaccaaaactactaattgtaagttgacatatctatcatacctactaaaattatatctttgaaatgatttgatggtgctacttctcaaaagttatgttgctcgaacttttcaaaatgacaatgggggcatgtctgattcttcaaaagtctttcatttctgtaggatcacgcaaaagtgacta

SEQ ID NO: 10928 - DNA, 1631 bp, Lycopersicon esculentum
  Predicted polypeptide sequence is orthologous to G470
gcttgagacgacatgctgatgaatgcctcccccaactggacatgtctcggcagcctcccacacaggagttggtggccaaagatttacatggaaatgagtggcgattcaggcatatattccggggccagcctaggaggcatcttcttcagagtggttggagtgtctttgttagttcgaagaggcttgttgctggggatgcattcatatttcttagaggtgagaatggggagcttcgtgttggtgttagacgtgccatgagacagcaaggaaatgctccatcatcggtgatatccagtcatagcatgcatcttggtgtacttgcaacagcttggcatgccattcaaacaaaaacgatgttcactgtgtattacaagcccaggacaagccctgctgagtttatagttccatatgaccactatatggaatctgtgaagaataattactctattggaatgaggtttaagatgaggttcgaaggtgaagaagctccagagcaaaggtttactggaactattgttggcattgaagatgctgatccccaaaggtggcttgaatctaagtggagatgtctgaaggtacggtgggatgaaaattcaagcattccaaggccagaccgagtttcaccgtggaaaatagaaccagctcttagccctcctgcacttaatgtacctccagttgcaaggccaaaaaggcctagatccagtattttgcccacatctcctgattcatctgtccttactagggaaggttcatcaagagcgacagcagaccattcccaagccagtgggtttccgagggtcttgcaaggtcaagagttatcgacctttagaggcggttttgcagaaattaatgagacagacttgtctgagaaaccaatgatatggcaaacatcagtgaatgatgaaaagaatgatattcattctgcatcaaagagatatcttccagataaatggctacctttagggaggcctgagtcatctctcacagatttgttatcaggttttggctcctcccatgggttctgtttaccctctgcggaccaagctgcgtttggtgctagattggtgaagcaacaaacacaagatcaggaaaaggattttagcttattgggaaagccatggtctcttctgtcttccggtctctctcttaatctgatggattctggttcaaaagctcctggcatagggggtgatactccctatcaaatgcggggagatgctaggtatagtggttatggtgagttttcagtactccccggtcatagggttgcaaatcagcagggaagctggattatgcctcaaccagtgtcgccttacatgcagctctcctctcattcaagagaaatgatgcataaaccctctgtagtaaagcaacccgaggctgtgaaacccaaagagggtaactacaaactatttggcattcctcttacaagtaatgtttgcacagatgctgttatgatgcggaaaagttcattgattgatccagcaagtgacatgaatattggtatacaccctcatcaatcccttgccactgattctgatcaaaggtctgagcaatcaaagggatcaaaggtggatgatggagttgcagctaatgatcatgacaaacaatttcatacctttcatcttgct

SEQ ID NO: 10929 - DNA, 883 bp, Lycopersicon esculentum
  Predicted polypeptide sequence is orthologous to G470
cttttgtgtccttttctttttttttgctctctttctctctcatcactcacatgaagaagctcctacttctatccattgaagatagataaatgaacacgcatatacatacagtttttagagagagaaactagagcgagaaggctctgtaacttcaattttgagtgttgattgctgtttctagggtctctttggttaccagttttgcatgcttttgagctgaggaagagtttagtgctttttttctggtgaattttggagaaggaagttttattttgtgcttgttttatgaattgattagtgtggatatgagagatctgtgttgagaattagtgtacggaaatggctgcttcggaggtgtcgattcaaggttacagcgagccgagtgatggttctaggccggtttcagagactggtaggagtagttccggtgtcggaatagttgatgctgatacggcgttgtacacggagctttggcgttcatgtgccggtccacttgtgacggtaccgcgagagggtgagctggtgtactatttccctcaaggacatatcgagcaggttgaagcatcaactaatcaagtggctgaccagcagatgcctttgtataatcttccatctaagattctatgccgtgttgtgaatgtcctgttaaaggctgaaccagatactgatgaggtgtatgcacaagtgactttgatgccggagccaaatcaagatgagaatgcagtgaagaaggaacctatgcgccctcctccaccacgatttcatgtacactctttttgtaagactctaacagcctctgatacaagcactcacggtggattttccgtcttgagacgacatgctgatgaatgcctcccccaactggacatgtctcggcagcctc

SEQ ID NO: 10930 - DNA, 563 bp, Lycopersicon esculentum
  Predicted polypeptide sequence is orthologous to G470
gaaaaatctaactatctcacattattatactgaactcatcgagtattatcagccaaaattgctttgaactccatctgttctatatggtggcggagctacctaccaccgtcttcctgctcaatagagtggtcggagcaagaatgaagatatgaggtggcgatgaggattgtttgtacgaaaaggctctgattggtaaatcaaatgttcctttcgagatttgtgtcctccagcattatcgtcagattgtgtcgaagttcaactttaatctgatactatatgctccgtcactcaaatgagaataattatgtacttacagttttcggcatacagaatgaagcagtaagcactactttataatgtttaattgtttcttggtacatttatccattaggaagttgatacttcaaggacaaaaagaaacaaaatggaaaagaattgaaaaatgacgcaagaactaaattttcacatcattacttaacaaactactcttcttgacagagtaaacaaggagatcaagtcacactattggaccccatttgcaaatttgtttatattgaatttga

SEQ ID NO: 10931 - DNA, 799 bp, Lycopersicon esculentum
  Predicted polypeptide sequence is orthologous to G470
gcaaaacaatggtctctagtgtcttctggtctctcacttaatctgatggaatcaggattgaagggtgcagatactctgtatcaaatgcggggaacatctcgactcaattgttttaacgagtatccaaccttccctggtcatagacctgacaatcagcagggaaattggttaatgcccccgtccgtgctgccttatattcagatgtccgctcattctggagaaattatgcctaaacccatggcttcaccacagcccgaagccatgaaacccaaagaagggaactgcaaactatttggcattccccttgtaagtaaatgtgccaccatagatcctgtcatgttgcggaaaaattccccgattcactcaacaagtaacatgcactttggtatacatccacatcaattccctataattgaatctgatcaaaggtctgagcaatcaaagggatcaaagctaccagatgatggcttcatagttcatgatcaggaagaacaattccaaacctctcatcctggtactcgagatagagagggcaaaggccttgttcattcaacaaggagttgcaccaaggttcataaacagggtacagcccttggaaggtctgttgatcttgcaaagttcaacaactatgaagaattgatagctgaactggatcacatttttgattttaatggtgagctcaaggctcgtaacaagaactggctggttgtatatactgatgatgagggtgacatgatgcttgttggagatgatccatggcaggaattttgtggtatggttcggaagatttttatctaca

SEQ ID NO: 10932 - DNA, 939 bp, Lycopersicon esculentum
  misc_feature (15)..(15): n is a, c, g, or t
  Predicted polypeptide sequence is orthologous to G470
cgccatgatgatctnatgatgcttttttttttttttttttttattgtaaggcaggtacatacatagtagaatgggaatcttaattacagctacagctagagaaattggtatgtacaaaagtgagattggcagaagcaacgttaatgaccaacgctgataatttacatatactatgtatatagatagataaggggccagatattggctccaaataaaggctcaaaactgcaaatactgaagctgcatttatatgaagagaccatccccatccacacgtcaaagggagttgatattgtaggttatattcaaaaatccccaaaaaagtaacacctaggtggataaaagccatctcctcgctatcttataaacctcaattttggaggaaaacctaagattctgcttgaccagattcagaaggaagttgcagattcttcacttctttagcgtctgagccctcagcaacagaagaagtgtcctcaccttttgaattaagggtccctggattcatacgctgcacctcctcttttgtatagatgaaaatcttgcgaaccataccacataatttctgccatggatcatcttcaacaagcatcatgtcacccttatcatcagtgtatacaaccagccaactcttacttcgagcttgagttcaccattaaatccaaaagtgatcaagttcagaatcaattcgtcataattgttgaacttgcaggactacggactttccgtgctgaccctggaatgaccttgggcagtcttgagacacatgccttgcttctttttagccagagaaggtgaatgttgaagcttactgcacctacacctgtcttgtgcaacttgaagagaggaagatggagtgatcaatatgacttggaacagacttcttggctaggcctagccgccctttctttagattagcggaaggttgggttgaatcct

SEQ ID NO: 10933 - DNA, 326 bp, Lycopersicon esculentum
  Predicted polypeptide sequence is orthologous to G470
atctacacgaaagatgaggtgcagcggatgaaccctgggactctcaattcaaaaggcgaggacaattcttctgttgcagaaggctctgatgctaaagaagtgaagaatctacagcttcacattgattccagtccggaagattcttagataatagagaagtcctccttaattgaggtttattaaaatctgtggaaaatactatatccacccagctgttggcatttttagggattctggaaggtggttacccacatcaaagtcccttttagcttccggatggctggtctccccattgatgcagcttctgtaatttgcagtttcgaccc

SEQ ID NO: 10934 - DNA, 1397 bp, Lycopersicon esculentum
  Predicted polypeptide sequence is orthologous to G475
ggcccaataggttctcctcacagggatggaaactaacaaatgggaagggaagagaagcattactgaagctgaaaaggaagaggatgaacatggaagtgttgaagaggatagcaaaagaaaaagggtattgactctctctggtaggaagctagttggtgaagggtcggcacatccttcttgccaggtcgatcagtgcactgcagatatggcagatgccaagccataccatcgccgccacaaggtgtgtgagttccattcaaagtctccaatagtacttattagtggactccagaagcgattctgtcagcaatgtagcaggtaagtaacccctaatttctgatgattatccgtgccttccgagttgtatagtggagatatcttggaaactaattatgtgcactcatcaaacagtttttcttagatttaagtcatgaggaacattaatcaaaacatcaattagccaataaacaaagaagaaggtaatttaagcttgagtgttgattcattttgtgcaacatatgggaatcctaatatcaagaaccaataccaataacacaggcaaaaactaatacatagagacacgaaagtacaacagcaacaatcaattttatacaatatcctatgcatatcatttattttatcataaactgtgaaaaagcaaaagtgagtcttttaaatcgtgatataacaatgaatccaagacactactggatcttttaattaatccattgacatttctagactattaactttgaaatgtggttattaagattatggctacatccaattaagagatagttgttaacctctaggtttccttgttatggaacaaaagccaaatcaagcaatgatgatgacttcttagaattaatctcactgtccaatgggtcttcaagttgaccaaaaaaatgtgaataaatattgctaacatggagaatggtctgtatggttgcgatagggcttcttgatcgtcccttctttaggtagtagaaggtaagctttactccaactgaaattgtatacaaaagattcttttgttttctttgaagggagagacaaatactggtaagggaaagaattaacttttgcacatgcaaacagagattatccttcagacaaattttttgttccaaattcatccatctgacaacgaggtattctaaataagattctacttcctatgaaagtatgtagtgtatctaatcagccaagaaactgtagctgctgccacatccacagccatctcatgtattttctaatcagctgctttcagattcccaagtataggagtatatcattttctaatgagcaggggcaaaacagagcttttaatgtgaattttcaattgttcgcatgatgaggtgcagatttcatctgttagcagagtttgatgatgc

SEQ ID NO: 10935 - DNA, 761 bp, Lycopersicon esculentum
  Predicted polypeptide sequence is orthologous to G475
tcgagtttttttttttttttttttttttttaataataaaaacctcataaagtgagttggaatgtcaacatggatatgcattcatactacaaatatttcatttttcgaatactagcagacagtgccaacggcttattctttttgtccttccctttacacaagggaaatgaaagtactattagctagatacttgaaggtcacaaataacaatttgcttagaaatccgggaattgacagaagatagagagcatgcttaacccacatcttgtttatgttgcttcagaaagtaggttatttggctgccattgatgctgatgcttcttcagcccaaattttctccatgagagtcatatgtaattttacggcggcgctcattgtgacctgccaaacgccttcggcaactcctcttagcatcatcaaactctgctaacagatgaaatctgctacattgctgacagaatcgcttctggagtccactaataagtactattggagactttgaatggaactcacacaccttgtggcggcgatggtatggcttggcatctgccatatctgcagtgcactgatcgacctggcaagaaggatgtgccgacccttcaccaactagcttcctaccagagagagtcaataccctttttcttttgctatcctcttcaacacttccatgttcatcctcttccttttcagcttcagtaatgcttctcttcccttcccatttgttagtttccatccctgtgaggagaacctattgggccaaaa

SEQ ID NO: 10936 - DNA, 731 bp, Lycopersicon esculentum
  Predicted polypeptide sequence is orthologous to G475
ggagagaactagtctcgagttttttttttttttttttcccccccttcaaagagatggaaaataacaaatgggaagggaagagaagcatggaagaggatgatgatgaggaagatgaagatgttgtagaggataccaaaaggaagagggtcttgactcgctctggacggaaggtatccactgcagaggggtcaaggcaaccttcctgtcaagttgaggaatgcactgcagatatggtgaatgctaagacataccatcgccgccacaaggtctgtgaatttcatgcaaaggctccagaagtacttattgatggactccgacagcgtttctgtcagcaatgcagcagatttcatcagttggcggagtttgatgatgcaaaaaagagttgcaggagacggttggcagggcacaacgagcgccgccgtaaaagtgcacaagattatccaggagaagggtcaagttgaacgggcacctactagtggactgatgagaacttaagctccctctgaaaaatatagagtttatcacgctctctctcttctgtcatttgccatatttcctttttaacaaaaaatgttatcttcaggtatgcataaagtagtaatttcatttcatctgaaatgaaaatagtacgaaagaatgtttcattaacttttgtctgttggtacttcgatagtttgtagaccgaaaataaagctatcctgtgtttcacatgtaaaaaaaaaaaaaaaaaa

SEQ ID NO: 10937 - DNA, 766 bp, Lycopersicon esculentum
  Predicted polypeptide sequence is orthologous to G475
taatcaataacggaaaacatcaactttttcaataattacaactttttcaacaattacgagtgaatgaaggtgaatattatttacaatatccatcataccatcatttaatgtctttaaatctaaagttagaaaagagatcttatattaaaaataactatgcgccccctcacgagggtgctggtggacaagtggtcgggtttgtaatgaacaagagagcgagacaatattttccaagtgtcaacatggtgtaggaggccatcaacggcagcggtgcccaagtgccaagtggaagggtgtcacgtggtgctgattaacgggaaggcttatcatagacgacataagtcaggatcgaaaataagtaggtgtaaacgcgtaagatacttgtttgatgtactatttattttttatttattttctgtaattaaaaatactctaatttattaatatatatatataccccaccgtcatgaaaatttattcacaaagtgttactacaaaatattaattactctttttctctctctagatctctcatttctttctctctaaagttcttgcgttctttattcattaattgtgtgaggattcgatcctaacaagatataaaacacgtgaaatgcatgccaaagctccttaaagttgtgctacgtggccttcaacacgcttctgtcaacagtgtagcaggtttcattcagcaagtgagtttgatgagtcaaagaggagtcgtaggaggagattagcaggacataatgaggggaagaagaaa

SEQ ID NO: 10938 - DNA, 925 bp, Lycopersicon esculentum
  Predicted polypeptide sequence is orthologous to G477
ggagaactagtctcgagttttttggatatgacttcacaaaggagagtaccatttcttttcccagaaatatttcctggtagcttcttttatcaagaaaattatgaagataataacaacagcaagcaccctaaattagaacataagccatttggcatctctcaattggctatatctgtaaaaaatgagcaattccctgcgaaaagcatccagcatcagtacggaatgagaaaacaagatccgtccaaagttcacactggtgggacaacattgtctattcaagaattttccaaagggcaaaactcctcttgtgctctctctcttctgtcagcccactcacaaaaccttctacacaattcaacagacgtttcaccaactctacgttggacggttgaaccaaatcatcatgtatacgttaaagggcgtgatcataatcttgagaaatctcccagagttagtgttgtaaaaagcttgacaccgactgagttatattcatctgacgtagctgagcaagatgtggtcgttcaagttcctgattgtgaggctgtttcatttggaatccagagagatcacggacatgatcaaagatcaaactctataaattccaagaactgtctttctctggaaggtgggcctaccatggatttagtgcaattgtcttcgcacctacaaagggtcgagcagcagaaaaactccgtccaagtgaagcaggaaaatgatatcttttgttcctttacttccacctgaggcttataagagctacaagtctgaagggtcaacatccgcaatgaagaatcggaagataatatgaggagattaaactaattcacaagtgacctttccaacaagtcaaaaggcaaaggcagattaaataaatgattgatatcggtacatctttttgtagtgtcagccatagcttttctattgc

SEQ ID NO: 10939 - DNA, 802 bp, Lycopersicon esculentum
  Predicted polypeptide sequence is orthologous to G477
attttctggggaagataaatctagttctaaactatcaagctcagctgtggattcaatttccagagactcatcactgattgatttgaaacttggaagatttcctgatcatcatgtagatggaaatattttcaaatctgccaagactttgtcaagctctacttctgctgagtcaattcttcctgctaaaagaatgagagcaggaggtttgaactcccacaaaccattttgccaggttcaaggttgtggcaaggatctcagcccctgtaaggactatcacaagaggcataaagtgtgcgaggttcactcaaagactgctaaagttatcgtaaatggcatcgagcagcggttttgccagcaatgtagcaggttccatctactggctgagtttgatgatggcaaacgtagctgcaggaaacgtcttgctggtcataatgagcggcgaaggaagccccctcatactggtaccagatttcgtggaacttcttttgcaacgtcaccctttgcatgccaagacatacttagtagccgctatctgcatcagcctaaatatgagatgagtgactggtgtaagaatgtaaaagttgaagatggtgttgattatagccctcaacttgccatgccctttacaaatggacagttacaaccaaaatctcattttacatcatatcatgccaagaaagggtgtcattctttccatgatggactacctgctgtaacaacagcaaaattaacgagagtacaactcatctctgcatgatatgcgaggatcagattttgtttccccttctctggtcacacccac

SEQ ID NO: 10940 - DNA, 471 bp, Lycopersicon esculentum
  Predicted polypeptide sequence is orthologous to G478
ggtcggaatttgataacggaaaaagaagttgccggaaacggttagcagatcacaaccggagaagaaggaagaatattcagcaagaaaacaacaaaaagcagcctcagccttcatcaaagtctccagcagaatcaggagcacaatcatcaacagtgacagtggccatatcaccaccaagaattccagtggatggatttaggcaaagaacataccagcaagttacaacttcttcttcttttccaatgggtgactaaaatatttttatttttcaataattaattattagtatgattattatttcaaacttatgctttaatggccataacaatctagtatatgttagtactaattacattataggaaagttaatttagatatgaaattatgattaatgatgtaatggagaggatcaggttaatgttaaccctttctaagcttgtgtgctccacctaaaaaaaaaaaaaaaaaaaa

SEQ ID NO: 10941 - DNA, 549 bp, Lycopersicon esculentum
  Predicted polypeptide sequence is orthologous to G478
ccacccccacccccaccccctctgtatttgtggtatatagtttacatacatacataaacggtgacattgtctacttgtttcttgagaaagttctttttttttccatcctctcttgttgtatctatggctgcactgaatcctaatgcagaagagtttaaaccaactaataatgaaaaagaagtagtcccttttaatccacaaggcaatgaacttgttgtatatcagccaccattactgccatttcatgtttcacagcctcaatgtcatcacttgggttatttctactactatcaacaaaatgttcccttttattggattcacgatgatctttatcatcaacttgaaaatacacctcaaactcagtcatttcttgcaaaaggtgagatctttagtgatggggtgaaggagaagtgggtgtgggttgagaaaactcatcaagatcagtcttttgttgataaagatgaaatctttagtgatgggatgaacaaaaattggaaaaacaagaaaccctttttgccacctaggttgatgagaactcctgcaagtgtt

SEQ ID NO: 10942 - DNA, 744 bp, Lycopersicon esculentum
  Predicted polypeptide sequence is orthologous to G478
cttcttcattttcaaaaattcaatttccccactctatttatttggctatcaaagtgaggggaaaaaaaaattgagaaaaaatgttggactatgaatgggaaaatcaatctagttttatgtttacaagtgatcaaaacactcaagaagaaaatgaccaaaataacaatcaatttttggatcctcaagcacattttcctcatataacaagttaccaacacccgcagcagcagcaacaacaacaattacaaaatccgcattttccccaatttcaagcaacaccaaataacacccatttaattagctccatgtacgatccacgcgcttatggcgttccgtacacgcaaacacacgacacatccatgctttctctacaaccaacgggtggatttatggtagtgccgaagagcgaaccgcaatttggaggcggaattcatgatttttcaagtagcagtagtcggattgggttgaatttgggcgggagaacttattttgcttcgtcatcggaagatgattttgtgaatcggctttaccggcggactcgcgcggttgacgccggttcagtgaactcgcccaagtgtcaagctgaagggtgcaatgccgatctcactcatgcaaagcactaccaccgacggcaccaagtgtgtgagtttcactccaaagcctctaccgttatcgccgccggtttgactcagcgtttctgcaacaatgcagcaggtttcatgttctgtcggaatttgataacgg

SEQ ID NO: 10943 - DNA, 910 bp, Lycopersicon esculentum
  Predicted polypeptide sequence is orthologous to G484, G2631
ttgcaattcaccaaaattacatcatcccctaccaattctaggactatatattatattattatttcatgtcttctcacatattcccacaccttcactacttctacgtgcaacccacacctcaattaccattcacaaccccttgcttcctgagccacacgtcatcgctcgcgcgtggagatctctttgttcaacgcgctttgcagaaaaatttgccctagaccacttcccttctctatatccaccatgaacaaccaccgtcaaccactccgaccacggctgaattgccattaattttttgtagtaattcagatctcgttttctcaattctcgattttcccttcgcaagggctaaaagatggaacctatggatatcgttggtaaaacaaaggaagacgcttcacttccaaaagcaactatgacaaaaattatcaaagaaatgttgcccccagatgttcgtgttgcccgagatactcaagatcttttgattgaatgttgtgtagagttcattaatcttatctcatcagaatccaatgaagtttgtaatagagaagagaaacgaacaatcgcacccgaacatgtactcaaggctttacaggttcttggttttggggaatatattgaagaagtctatgctgcatatgaacaacacaagctagagaccatggacactgtgagagctggaaagtgcagtaatggagctgaaatgactgaagaagaagcattatctgagcaacagaggatgtttgctgaggcgcgtgcaaggatgaatggtggtgttacaggtccccccaagcagcaagattcagaagcagagcaaaccttgaatagctaactttactttttcgttgttgtgtaggaaaaaaacatctttagtatgttttagtagagcaagacctctcttgtattatgt

SEQ ID NO: 10944 - DNA, 1165 bp, Lycopersicon esculentum
  Predicted polypeptide sequence is orthologous to G489, G714
ctttgattgaacgctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcactagttattaaaagtcgagtgttcccttagtgtagctaaaactttacaccatgagcttgatgttcttggtgatgtttatgaacaaatatgtttttaagtgtgtgatttaaaagtaaaacctgttgtaggtatattatgggtttgaaaaacgtgtaataaaagaacactcaaga

SEQ ID NO: 10945 - DNA, 603 bp, Lycopersicon esculentum
  Predicted polypeptide sequence is orthologous to G489, G714
ctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatg

SEQ ID NO: 10946 - DNA, 1366 bp, Lycopersicon esculentum
  Predicted polypeptide sequence is orthologous to G502, G519
ctctagccacgtgtccctttcaccttctctatatttgcttctcctcctctgttttctacgtttcaactttcaaaaacacctctttctctctgtgtaattacaaaaacaaattaaatcaattctttttcttgaagacaaagtaatggtggaattgcaatttcctgctggatttcgattccatccaactgatgaagagcttgtgatgcattatttatgtcgaaaatgcgacgcacagccaattgctgttccgattatagctgaaattgatctctacaagtacaatccatgggatctacctgatttggctttgtatggtgagaaagagtggtatttcttttcgccgagagatcggaagtatccgaacggttcacggccgaaccgagctgcggggagtggatactggaaggcgacgggtgcggataagccgattggtcgtccaaagtcgatgggaattaagaaagctttggtgttttacgcaggaaaagctccgaagggagaaaaaacaaattggattatgcacgaatatcgacttgctcatgttgatcgatctgctcgtaacaaaaacaacagcctaagactcgatgattgggttttatgtcgaatctacaataagaaaggtacaattgagaagaatcaactgaatatccgaaaaatgaacggtgaaatgtcgccggcggtgagtgaaggtgatgtaaagcctgagatcgtgccgatttcagtttcaacaaacccatcttcgacgtcttatcacgtttacaatgacttcacgtactttaattcaccagattctcttacgaaacttcacgccgattccagctgctcggagcacgtaccttcgccggagttcacatatgagaaggaagttcagagtgagccgaagccgaaaccgagtgagtgggaaaaaactgcccttgattttccatttaattacacagatgccactgcttctgagttgcagagttgttatgagatgtcaccgctacaagatatattcatgtatctgcaaaagccgttttgagtgggcctcgcattgttgttcgcacgtgcgaatgagactgaagtcgatgacttggcacgtgccgatgatttgtaggaattgaaatattagtatttttgggttttttcatttgctttcacattagctatttttttttgttttggagaaaaaaaagcatatttggtcgtatatagttttattttttcgaagaaggaagaaaaattagtagaaaacaaagttgtgaaatgatatatttattggatttattagaatacttgtggaagttttggattagtactcataatttcatgtatgtatatgatttagaggtattacaaatgagctcaattagattttcttaaaaaaaaa

SEQ ID NO: 10947 - DNA, 1200 bp, Lycopersicon esculentum
  Predicted polypeptide sequence is orthologous to G502, G519
ttttcctattccttcaattctattcaaagaattcagaaaactctgtctttagactgaaataagaaatttatatttaaaagaaaaagaaaaaatgacagcagctgaattgcagttacctccaggattcagatttcatccaactgatgaagaacttgtgacgcattatttatgcagaaaatgcacttcacagccaattgctgtaccaattgtagcagaaattgatctctacaagtttgatccatgggatcttcctgatttggcattgtatggagaaaaggagtggtacttcttttcacctcgagatcggaagtatccgaatggttcacgacctaatcgagctgctggaactggatattggaaggctactggtgcggataagccgattggaaatccgaaagcggtgggaattaagaaagcattggtgttttattctggtaaagcacctaaaggagagaaaactaattggatcatgcatgaatatcgtctagctgatgttgatcgatctgctcggaagaataacaatagcttaaggctggacgattgggttctatgtagaatttacaacaaaaagggatcgattgagaagaacaggaaaatgaacactacctgctacatggataaagttggatctccagaagatcggaagccggagattctaccaccgctacctccacatcctcagccgcagcaattgcacaacgatttcttctacctgccgtccgattcagttccgaagatgcactccgattcaagctgctcggaacacgtgctctcacccgaattcacatgtgaaagagaagtgcagagtgagccgaaactgacagattgggagaaagctaccctcgatcttccatttaattacatggatgccactaccggcgccacaacggtggataatagcttgttaggttctcagtttcagagcagttatcagatgtcgccgctgcaggatatgttcatgcacctgcacaagcctttttgagtggggccaccaatggattattttcagccgcaagtgtcaaacgagactttaacgtccgtgactttgcacgtgccgccgtagtagaataataggagtagcatcttctgcgttcacattggcaaattgtgaaaacaacatttgtacatgtagtagatgatggggaaaaaaaatattattattagcaattaaaataaaattgcaaatatgaaaaaaaaaaa

SEQ ID NO: 10948 - DNA, 541 bp, Lycopersicon esculentum
  Predicted polypeptide sequence is orthologous to G502, G519
ctgaaactaacacaaagcaggagcaggagcagcaacaaacagagagaagaaaacagaggaagataagaggaaaatttatcgaattcgaatcgagagaaaaggggaagtgaagttgcgaagagtgagaatttcaaaggaaatgaacaaaggagcaaacggaaatcagcaattggagttaccggcgggattcagattccatccgacagacgacgaattggtgcagcactatctctgcaggaaatgcgccggacagtcgattgctgtatcaattatagctgaaattgatctttacaagtttgatccatggcagttgcctgagaaggctttgtacggtgaaaaagagtggtattttttctcaccaagggatagaaaatatccgaacggttcacggccgaaccgagcagcaggaaccggttattggaaggcaaccggagctgataaaccggtgggaaaacccaaaaccttagggataaagaaggcacttgtgttctatgccggaaaagcacccagaggtataaaaacaaattggattatgcacgag

SEQ ID NO: 10949 - DNA, 931 bp, Lycopersicon esculentum
  Predicted polypeptide sequence is orthologous to G502, G519
gtccttcttcagctttaattttttattttcggagatgagattcaagattcgagtaatatagtatggtaaaattactgagtttacgtgaactatactcacatctctaatagtgatatctcctaagatttacaatgtttcaaatgaaaaatagtggaagatttcactttaattatcaacaattaggtgtggcacccatttaacatatagtaataagtaaaataaaatggtcattatattctgtaacttatgagtgcaaaatacaatttgtaaattgtttattgattatgtgatttgacattattgcagcttgatgattgggtattgtgtcgaatatacaacaagaaaggcacacttgagaagcattacaatgtggacaacaaggaaactacaagctttggagaatttgatgaagaaataaaaccaaaaatattgcccacacaattagcaccgatgccaccacggcctcgatcgacaccagcaaacgactacttttatttcgagtcatcagagtcgatgactagaatgcacacgacaaactcgagctctggctcagagcatgtcttgtcgccatgtgacaaggaggttcagagcgcgcccaaatgggacgaagaccacagaaacacccttgattttcagctaaactatttggatggtttactaaatgaaccatttgaaacccaaatgcagcagcaaatttgcaactttgaccagttcaacaatttccaagacatgttcctatacatgcaaaaaccttactaaaattgtataaattcattggatctaaattgagtgtgatccatgacattttctttgttctttggtggggtaggtcaactttttattaagtagtttagagaagtacaaaatgctagtcaaatttggtgggctacagcacaaatgagccttgataagcatagccaaagagtcgtat

SEQ ID NO: 10950 - DNA, 816 bp, Lycopersicon esculentum
  Predicted polypeptide sequence is orthologous to G502, G519
ggagatcgatccgatcgcacctccaccgacgggaatggaagggcgccggggccgcggtacgatgtacaagcacgctcgagtttttttttttttttattaaataatatacacttagtattaaaaaactttcatatatacatacatatatcccctaattgagacaatcaaactttccccgaccacttatgcttttttttctccaaaacaaaaaaaaatagctaatgtgaaagcaagtgaaaaaacccaaaattactaatatttcaattcctacaaatcatcggcacgtgccaagtcatcgacttcagggtaattcgcacgggcgaacaacaatgcgaggcccactcaaaacggcttgtgcagatacatgaatatatctgggagcggagacatcgaataacaagcttgcgcctcagaagcaggggcatctgtgtaattaaatggaaaataagggcagttttttcccactcactcggtttcggcttcggctcactctgaacttccttctcatatgtgaactccggcgaaggtacgtgctccgagcagctggaatcggcgtgaagtttcgtaagagaatctggggaataaagtacgtgagtcattgaaacgtgaaagacgtcaagatgggtttgtgaactgaatcggacgacttagcttacaaccttactaccgcgcgcattaccgtattttggaatagtgatctttaatgacctctatggatcaataacccacatggctagcgtgttgacagcgggtaaaggagggatcggcaacatgtttttctgggttcggaaaacagttaacaggatgcgcaggtcc

SEQ ID NO: 10951 - DNA, 1295 bp, Lycopersicon esculentum
  Predicted polypeptide sequence is orthologous to G504, G1425
ttccagctgattttctgtatttttgtactactaactcacagcacacacaccatttctctctctcttctaagctgaattttcgtatcatacaatttactctttctttcttttttttttattattatttttattatatagttttataatcaggtcgctctgattaaatatatttgaaaatttttatcaaataatattgtggtcatggagagtaccgattcatcaaccggctctcatcatcaaccacaattgccacctggatttcgatttcatccaactgatgaagagcttgtggttcattatcttaagaaaagagttgcctctgttcctcttcctgtttctattattgctgaagttgatctttacaaatttgatccttgggaactacctgctaaggcgacatttggagaacaagaatggtatttcttcagtccaagagatagaaaatatcctaacggggcgcgcccaaatagggcggcaacttccggttattggaaggctaccggaaccgacaagccggtgctcaccgccggcgggacccaaaaagtaggtgtcaaaaaggcattggtgttttatggtggcaaaccacccaaaggggtgaagacaaattggattatgcatgaatataggcttgctgataataaaacaaataataagccccctggttgtgaccttgccaataaaaaatcactaaggctagatgattgggttttatgtaggatttacaagaagaataatactcaaaggccaattgatcatgaaagagatgatttgaatattgatatgatgatgggatcatcatcaattcatccatcatgtataccaaattcaatgtcaatgccaaatatatttggtcaaccaaaaataccacaactaaaatcttcaaattttggcactacattaattcatgatcaaaatgaccaaaatttatatgaaggtggatcacaatattcttcaaaaaggccactagcaaatttgtattggaatgatcaagatggaggagctagtaacgataattctcaatcaacaaaaaggtttttgacagaaaatatggaagatggattaaatatgaatgctcgagcagatgaacaaaatggatctatcgtaagtcttctcagtcaacaacaagttcttgggtctctaagtgaaggagtttttcgacaaccttattcaggcatgaattggtactcttaaaatatcgaattataatataaaaaaaatatacgatattattataccatacaaattaaaggtgtttgattattacaggatcctaactaattaagattgattaacga

SEQ ID NO: 10952 - DNA, 1451 bp, Lycopersicon esculentum
  Predicted polypeptide sequence is orthologous to G504, G1425
ctaaattccttcttgtttatcattttctctcttcccaaaaaaaaatcccaaaatttaatcataatacaattcgaatttatcaacctcgtactacgtacatatttttgttggtacgtaaaatactgaattcaggtcaactcaaacatcgtaaattgtgatttctttatggaaagtacggattcatcaaccgggacacgtcatcagcctcaactcccaccggggtttcgattccacccgacggacgaagaactcatcgtccactacctcaaaaaacgagtcgccggcgctccgattccggtggatattattggtgaaattgatctttataagtttgatccatgggaactccctgctaaggcaatattcggagagcaagaatggttcttttttagtccaagagatagaaaatatcctaacggggcgaggccaaatcgggctgcaacatcgggttattggaaggctaccggaaccgacaagccggtttttacttccggtggaacacaaaaggttggggtaaaaaaggcgctcgttttttacggcggtaaaccaccaaaaggggtaaaaactaattggatcatgcatgaatacagagttgtagaaaataaaacaaataacaagccacttggttgtgataatattgttgccaacaaaaaaggatctttgaggctagatgattgggttttatgtcgaatttacaagaagaataacacacaaaggtccatagatgatttgcatgatatgttgggatcgataccacaaaatgtaccaaattcaatattacaaggaataaagccttcaaactatggtacaatattgctcgaaaatgaatcgaatatgtacgatggaattatgaataacacgaacgatattatcaacaataataatagatccattccacaaatatcgtcaaagagaacgatgcatggaggtttgtattggaataacgacgaagcaacaacaacaacaacaactattgataggaaccattctccaaatacaaaaaggttccttgttgagaacaacgaggacgatggacttaacatgaataatatttcgcgaattacaaatcatgaacaaagtagctccattgccaatttcctgagccagtttcctcaaaatccttcgattcaacaacaacaacaacaacaagaagaagtattgggatctcttaatgatggggtcgtctttcgacaaccttataatcaagttactggcatgaattggtactcttaaagatataaaaaggcaaaaaatagttagccctgtaaaatcaatcgatcaatcaatcatagatatattatatatggatttcgttatattttacttttagttagaattaatatatagaatatcttctatctcacattaacaaataagaacatttataacaaatagtgaaactaaactatctaccattagatagacattttgttaaaaaaaaaaaaaaaaaa

SEQ ID NO: 10953 - DNA, 614 bp, Lycopersicon esculentum
  Predicted polypeptide sequence is orthologous to G509
caacactccttctctgtttataaataatctcatttgtccctttgaaattgataatttatcaaacatgaattgaatactatttatattctcctctcattttttctccaaactcacaaaaagataaattgttgaacatattttcaactcttttcttttattattatttattatcaaaaaattaaaaaaatggatttaagagatgttggagctacacttccccctgggtttaaattttgccccactgatgaagagttaatttgtcattatctctataataaaattgctaatgaaaaaggattggttcttaattttagtttagtggaaattgatcttcacacttgtgagccatggcagcttcctgaggtggcaaagctcaactctagtgaatggtacttcttcagcttccgagatcgaaagtattctactggctttcgggcgaaccgggccacaacttcgggttattggaaagctacgggtaaagatcgaatcgtgcttgatcctcaaaccagtaatgttattgggatgagaaaaactttagtcttttacaagaatagagctcctaatggcattaaaacagactggatcatgcatgaatttcgacttgaaattcccca

SEQ ID NO: 10954 - DNA, 647 bp, Lycopersicon esculentum
  Predicted polypeptide sequence is orthologous to G509
atatacctcctaaggaagattgggtattatgtagagtatttttcaaaggtactaaagatgaaaacatcaatagtactaacaatgagagtacaagtatcacatctttcaatatggacaatcatgaaggaactatgcctaagttattgtcctatggtggcggcgaatatcgcccatcgaccttgcctaatttttcaactaactctatctatcaaaatcagaactcgagcaataatcttcaattgtcacaagagataaacaaagttctagcaaatgaaataattcactcaaaatgtggcaaggaggatgagtttggtttcttgtttgacatgaattattttgaagaatcaagtttacaagatggaggggtgcattcttgccttgatggggatatgaaatttgaggatgaaaatagtttggtttttatataaaattattagtcatagtaattattaatttgttggattattgtttgtagagagagagaaaaaaaagaaatacattaaatattatttgtagaacatgtgaatgtatatgtgtatattttagtgtttgtttgtgagtttgataaggtaaaagttatgtgattgatttggggatatttgttctttttttcctttctattttttatttagaaattgaagtttcat

SEQ ID NO: 10955 - DNA, 740 bp, Lycopersicon esculentum
  Predicted polypeptide sequence is orthologous to G521, G2887
gagaaacttcgctgcattgaagtaaacgcgttcaataaaaccctatttcccaattttgatcctccttcctccctctaatcgtcgtctacgcgtccgccttctccttcgtttgccatcttcggttttgtattgcacaccagatgtctgttagcatcaaccagaagcatcactattttgtttgggctgcgttgaatcgaagaagacattggtgctctgggaagatattgtttaggcattggacttgactcttgtgtgactttcttttgttagaatttgcttcactgagacctactagtgctgtggtcttttcattttatttgtctgtgcggttttttactatttccaatggcgaagcttccaccagggtttcgctttcaccctactgatgttgagctgataatgtactatctaaagcggaagatcatggtgaaaaagatcctttttgaagtcatatcagaactcaacatttataagttctccccatcagatcttccagacaaatgttgctacaaaagtaaagatcttgaatggtatttcttttgcccaagtgagagaaagtatgcaagtggattcaagatgaatcgcactactgatattggattctggaaaattactggcagggatagacgtgttctttatgatgaaaagtttgttggatctgttaagactttggtttttcaccaaggtaaagcaccacgagtgcagagaactgattgggttattcacgagtatagatttga

SEQ ID NO: 10956 - DNA, 635 bp, Lycopersicon esculentum
  Predicted polypeptide sequence is orthologous to G521, G2887
gccgccttccccttcgcttcccccaccaccccatcatcgttttttcgccttctccggttcggtcggtatctgggtttttgattgtgcaccagatgtctgttggctccagcaagaagcaccatttctttgtttggagcgcattccttttcatgaaccgcagaaggttgtggtgctcagggaagatactgtttcggcattggacttgacagcagttgagattttttttgttttaggggtcggttggaggctctggtgtgttgtgcagatagctcgtttagtctagatttcgtcaggcgcaccccttttgggctgctttgaatttagttcctttttttttttgggatcatttgatggcaaggcttccacctgggtttcgttttcaccctactgatgttgagctgattatgtactatctcaaacgtaagataacaggaaaaaaacttcattttgaaggcataacggaactcaacatctacaagttctccccatgggaccttccagacaaatgttgctataaaagtaaagatctagagtggtacttcttttgcccaagggagagaaagtatgcaagtggagccagaatgaatcgcgctactgatactggatactggaaaactactgggaaagatagacct

SEQ ID NO: 10957 - DNA, 500 bp, Lycopersicon esculentum
  Predicted polypeptide sequence is orthologous to G521, G2887
ggaaagatatgacctgttacttactgtgagaagattgttggatcagttagagcacttgtttttcacctaggtcatcccccgcgagggaaaagaactgattgggtaattcatgaatataagtttgaagataaagaatcaattgatgcaggatttgctcaggattcatatgtgctttgtaaagtattccagaagagtgggccaggtccaaaaaatggtgcacagtacggagcaccttttaaggaggaagattgggaagatgacaagattcctgctgagccttgtacttcagatgtttttccagctccacctggtaggactgataaacccagcggctcaaatgcaatcagaatggttgacccaagaagcacatctgactggacttcaagtgaacagagtccatctcctattcaaccttctgttcaaaaactgcctttggatgagccagatgacgaggagttacctggtgaaccaaatctgtccaatgtatcttctatcaattg

SEQ ID NO: 10958 - DNA, 726 bp, Lycopersicon esculentum
  Predicted polypeptide sequence is orthologous to G522, G1453
gatttcatccaacagaggaagaacttgttggatactacctcaagagaaagattaattcactcaagattgatcttgatgtcatcactgatattgatctttatagaatggagccatgggacatccaagataggtgtaaactgggatatgaagaagaaagtgaatggtattttttcagccacaaggacaggaaatatccaacaggaactcgaacgaatcgcgcgacgggggccggattctggaaggcaacaggaagagataaagcagtgttatcaaaggagaaaataatagggatgagaaaaacacttgttttctatagaggaagagctcctaatggaaggaaaagtgattggatcatgcatgaatatcgtctccaaacttctcaacatggacctcctcaggaagaaggatgggtagtatgtagggcattcaagaagccaagtccatcaaacaacaattattatatgagaggaaccaacacaagttattcaactagaccacctccatccctttcacaaatgccaagttattatattactaatattaatcctctcaaccaaacatcaaatttcaatcatcaattccctttaaatcatcaaatctcaagccaaaataatattggttatgacaataatcaactactaattcatgaactcccacaacttgatagccctactaccatttcaacaagtttggctacaaatgatcatcaaagccaaaattccatca

SEQ ID NO: 10959 - DNA, 1326 bp, Lycopersicon esculentum
  Predicted polypeptide sequence is orthologous to G525
gaaagtatagagagagaaagccatcaagaaagaagtagatcggaacgctagcttttccagctttgatctatttcatcatctgtctaccatgcgtcctctgtctccgtcagcttcacctccaggcttgatgagttcctgtgggactgatggtgaaatctttttggtcctccaccagattaaccgtggatcgcccatccctgatgatttgattgagtttaatccctatcagtatgatccttcaaatttgccagatggagcatggttcctagtgagaaaaactgaggaaaaatcgacggaatatggactctggagagtgaaagattcagcctgtgaaatttttgcaaattctgatatcagtggttggagaaccacttatgaattttttcaagtccaagcctctatcgagcagaaaactgtctatataatgcatgagtataaagtaacaccgaaagggcagcgtgatctgaccaagtcacaggagtcttcaatttgtagattttttggtttgtggaatgatgcagagcacgacgatgtacgtcacctattgagctattttagctttatcccatcagttaacccagacactagcggtaacgatgggcaacgttcaattgctgaaccccaggtaaacggacagatagaaggggctgggtcatcactcgttgacaaatggatagatcagtctgagatagattgcattatgcgaggggactacctggaattgaatgaccttattgatggagcatcacatgattcgtctagttcagagaatacaagtcgccagagcttcgtatctgatgaatttttcaactctcgggcacttcttgcggaactagatgatgagaagaaggaagatttgagtggaaaaggttcacttcttgcagaactgaatgatgagaagaaggaagatttgagtggaaaaggttcaaccagcaatcatcataccataatgatgtgtcaaatagcaaatgatgtagttgtgcagcctggacctttagggtttgtatttatagggaatgatgctaaagccaaagaaactcaacaaactcctgataatcacaaatcgaaatctcaagatcaggctgttaagaaaatgaaggtggctaagaaactgaaggatgaaggtccatcacatgctcgtagagccacaacatcatccagcagcagcaacagcagcagtgatgaacctggacgtgcagctcgaagggaggagaaacgttcaaagaagctaatgaagttcctgtgttttatgcctttctagtttctacatacttgttgtttcaactcttactagtatagttttaaccaaaaaaaaaaaaaaaaaac

SEQ ID NO: 10960 - DNA, 680 bp, Lycopersicon esculentum
  Predicted polypeptide sequence is orthologous to G525
attatttcttgttgtttttttgaacggttaggtaattaacgacctgattattttttaaaaaaaagatcataaaaaagggtgtgtaggttgtttttgatgatgatggagaatttttctgcaagtgttaagatggatgatcaacagcagatggaacttccgccgggatttcgctttcatcctacagatgaagagctaattactcattatttgtctaagaaagtggttgatatgaatttctctgctattgctattggagatgttgacatgaacaaaattgaaccttgggagcttccatggaaggcgaaaattggggaaaaagaatggtactttttttgtgtgagagacaagaagtatccaactggtttgaggacaaacagggcaactgctgcaggttactggaaagctacaggaaaagacaaggagatttttagaggaagatctcttgttgggatgaagaaaactttggttttttacagaggaagggctccaagaggtgaaaaaacaaattgggtaactcatgaatatagattagaaggaagattatcactaaacaatcttcctaaaacagtaaagaatgattgggtgatttgcagagtatttcaaaaaacaactggtggaaaaaaaattcacatttcagggcttgtgagagctaattctgatgaaaatgaaatggtcaatac

SEQ ID NO: 10961 - DNA, 618 bp, Lycopersicon esculentum
  Predicted polypeptide sequence is orthologous to G525
gaattcaggagggaaaaagatagcaatctcaaatcttacgagaagcgatagtataacagataattcaaggtcttcaaatttgccaccattaatggacttgtcaccatacaacaagattacaacaacagcgagaagtagtggagagacatgtaattcacatgtgacgtgtttctccgattcaatggaggatcaaaaacctcaaacttatgatcatcatcatcttctatcaagttcccctgtttcagtcgatttcccccaaaacgtaccgaacgattcgatgacctacatgggaaatttccagtatggagattctggattgatgcaagataattcgattatgaggcttttgatagataacaattatgggtcagaatcaaaacaaagtttgagaggttacgaagatcatgacatcaatatcagttcaactggcccagtggacatcgattgtctatggaattattgatataaacatttagtgagggacttggaaaaaaatgcattagaaatagaaatgggaagaattgaatgtgggacacaggaattatgttaattattctcagatattgttttacatcatttgcaccagtactacatatctgttgtgtataaattcgtctc

SEQ ID NO: 10962 - DNA, 1149 bp, Lycopersicon esculentum
  Predicted polypeptide sequence is orthologous to G536
attgtaggagaaaggaagctaaaaaccgctctcactttctctctctagaaaaacaaaaaactctctccctctttctctctctaacatcaatggcgtcgccacgcgaggaaaacgtgtacatggcgaagcttgccgagcaagctgagcgttacgaggagatggtagagttcatggaaaaagttgtcgctgccgccgatggtgcagaggagttaaccgttgaagaacgaaatctcctctccgttgcgtataagaatgtgatcggagcacggagagcttcatggaggatcatttcctccattgagcagaaagaggagagccgtggtaacgaagatcatgttgcttctattaaggaatacagatctaagatcgagtctgaacttacctcgatctgtaatggaattcttaagctgcttgattctaagctcattggctctgctgctaccggtgactctaaggtgttttacttgaaaatgaagggagattatcatcgttacttggctgagtttaagaccggtgctgagcgaaaagaagctgctgagaatactctctccgcttacaaagctgctcaggatattgcaaatgctgagcttgctcctacacatccaatccgattgggacttgctctcaatttctctgtgttttactacgagattttgaattctcctgatcgtgcctgtaatctcgccaaacaggcctttgatgaggcaattgccgagttggacacattgggcgaagagtcctacaaggatagcactctgatcatgcagcttcttcgtgataacctcactttatggacctctgatatgcaggatgatggaactgatgagatcaaagaagctacacctaaaccagatgataatgaatgagcagcagtaaaaactggtgaaatttctttaggattgaaatatgctatgttgtaacttctttttcatttgtctggattcaactctttgttagttctagatcttgtgatttgtaatacctaaaatcaaccgtttcttgttaattgttgttcttgtttgtttctatgttgatttgctgttgtatttggattatttcctttttctcaaaggaatgacttactgggaagatggatgtaccttttaatccacaaatttgttagcttctccatttaaaaaaaaaaaaaaa

SEQ ID NO: 10963 - DNA, 1190 bp, Lycopersicon esculentum
  Predicted polypeptide sequence is orthologous to G536
gctcattccattttctaaacttactctctctaaaacccctctttctctctctagaatacagaaccatcaatggcgtctccacgtgaagagaacgtgtacatggcgaagcttgctgagcaagctgaacgctatgaggagatggtagaattcatggagaaggtcgtcgcggccttgaacggtgaggaacttaccgtcgaggaacgcaaccttctctccgtcgcatacaaaaacgtgatcggagctaggagagcatcgtggcgtataatttcatcgatcgagcagaaagaggagagtcgtggtaacgaagatcacgttgcctccattaagaaatacagatctcagatcgagaatgagctgacttcgatctgtaacggcatcctcaagttgcttgattccaaactcatcgggtcagctgctaccggagactccaaggttttctatttgaaaatgaagggagattactaccggtacttggctgagttcaaaaccggaaccgagagaaaagaagctgcagagaatactctttcggcctacaagtctgctcaggatatcgctaatggcgaattggccccaacacatccaatccgattgggtctagctctcaatttctcagtgttttactatgagatattgaattctcctgatcgtgcttgtaatctcgccaaacaggcctttgatgaggcaattgcggagcttgacaccctgggagaggagtcctacaaggatagcactttgattatgcaacttctgcgtgataacctcactttgtggacctcggatatgcaggatgatggaactgatgagatcaaagaaccatcaaaagctgataatgagtagtaacatcgtgagtgaaacttctttgcttagaattgacaaccgatgatgtaattttactcattgatcaaaattggctgtttgtagtccttatcctgtgatttgtaatacctattacctaaaggcgctgtttcttgccatttgttgttttcatcaaagattaccttttgtctacgtatttctcttgtatttggatgctctgatgaagctctcttatttcgtggaaatgaatatttattttcacgaagcaagtagtactttttatttcctttttctcgaagaagtagagcattgtggattgatcttaaaaaaaaaaaaaaaaaaaaaaactcgagactagttctctctctctctcc

SEQ ID NO: 10964 - DNA, 1063 bp, Lycopersicon esculentum
  Predicted polypeptide sequence is orthologous to G536
cacatatagaagagaatcatcatataattcaatcaacacagagaaaataggcagagagagagagagagagagagaagagaaatggagaaggaaagagaaaaacaggtttacttggctaggctggctgagcaagctgagagatatgatgaaatggttgaagcaatgaaggcgattgctaagatggatgtcgaactgactgttgaagagaggaatttggtgtcggttgggtataagaatgtaatcggagcaagaagggcttcatggcggatcttgtcttcgattgaacagaaggaggagagtaagggtcatgagcagaatgttaagagaataaagacttacagacagagagttgaagacgagcttacaaaaatatgcagcgacattttgtcagtgatcgatgagcacctcgttccttcgtccactactggagaatctactgtcttctactacaagatgaagggagattactatcgctatttagcagagttcaaagcaggggatgatcgtaaagaggcgtctgaacagtctcttaaagcttatgaggctgctactgccactgctagttcagatcttgctccgactcatccaatcagacttggactcgcattgaatttctcagttttctactatgagattctgaattcacccgagagggcatgccacttggctaagcaggcatttgatgaagctattgccgaacttgatagcctcagtgaagaatcctacaaggacagcacccttatcatgcagcttctaagggataatctcactttgtggacatcagatcttgaagagggaggtgagcattctaagggtgatgagcgccagggagagaactagttgaagttcaagaggtgtcggtgaatcattgtgatgctggctcctcaagagacatgttagcttgtggaaagtctttgttttcatataatgttcagggattcatgcctattggctttgtactttcttcctccatatacataaacattcccagagtacttctcattttcagtaaaaaaaaaaattgctgctattgttgcaaaaaaaaaaaaaaaaaaaactcgag

SEQ ID NO: 10965 - DNA, 1265 bp, Lycopersicon esculentum
  Predicted polypeptide sequence is orthologous to G536
ggcaaaaagggagagaatagagcaaaatctctctctgttttcactacaaaaaatctttgatttcaatttgagagagatcggaaatggcttcttccaaagaacgtgagaacttcgtctacgtcgctaagctcgctgagcaagccgaacgctacgatgaaatggttgaagcgatgaaaaatgtcgcaaacatggatgttgaattgactgtggaggaaaggaatcttctttctgttggttataagaatgtggtaggttctaggagagcatcttggaggatcttgtcctctattgagcagaaggaagaatctagaggaaacgagcaaaatgtcaagcgaatcaaggagtacctgcaaaaggtggagtcggagctcaccaacatttgcaatgatattatggtggtcattgatcagcatctaattccgtcatgctctgcaggcgaatcaactgtgttttaccacaagatgaagggagactattatcgttatcttgcagaatttaaagctggcaatgacaagaaggaggttgctgagctttcattgaaagcatatcaggcagctacaactgctgcggaggcggaattagcacccactcatcccattcgtctgggactggctttaaatttctctgttttctactatgagatcatgaattcacctgaaagggcatgccatcttgcaaaacaggccttcgatgaagcaatatctgagctggatagcctgaatgaggattcctacaaagacagcaccttgattatgcaacttctaagggacaacctcaccttgtggacttctgatcttccagaggatgctgaagatgcccaaaagggagatgccacaaacaaagctggtggaggtgaagatgcagagtgaatgggcctaatagttagaactactatgtgtatttggaggtgtgacgacaaggatacgccaagggggatgttagtttgttaagtcttagtagatacttctattatgggtctgtcgtgtcagattcttcacttgttaattggttgtctgcaactcagtgtgtaatttgtatccctgtgctatttccgttctccgtatagtgagttgtttcagtctttagataattgctggtctataggtggttttatttttcagatgactgccgcagccaaatggaggatatcagctatttgcttgtcctctcacccttattatctcaatatcactaaatttccattaaaaaaaaaaaaaaaaaatagtttggagctgagcatatatgctactctatgttggtgcaaa

SEQ ID NO: 10966 - DNA, 1285 bp, Lycopersicon esculentum
  Predicted polypeptide sequence is orthologous to G536
gaccccttagcacactaggtcttatttacctccatacatcatctacctctatttaaggcacgtctacattctctactttcatctcgctctctgcttccgtcaagagaaccaggtgtaatttcacatacaacaaaaatggctgactcttcgcgtgaagaaaatgtgtatttggctaagctggctgagcaggctgagcgatacgaggaaatgattgagtttatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaatactattaaagaatacagaagcaaaattgaggctgaacttagcaagatttgtgatgggattttgagcctccttgagtccaatttaataccatcggcctcaacagctgagtccaaagttttttacttgaagatgaaaggtgactaccataggtacctggctgagtttaaaacagggacagagaggaaagaagcagctgagaacactttgttggcttacaagtctgctcaggatattgctttggctgaactggctcctactcacccaatcaggctgggacttgcccttaacttttccgttttctattatgaaattctcaactcacctgatcgtgcttgtaaccttgcgaaacaggcatttgatgaagccatctcagagttggatacactgggtgaggaatcttacaaggacagtacattgatcatgcaacttctccgagacaatctcactctttggacttctgacaatgcggatgatgttggggatgacatcaaggaagcttcaaaacctgagtcaggcgaggggcagcagtgatgagagagtagcatagtcctgtagtcttttcttataggggatgttggtggagaggatatagcaagatcgtgaatttagatctccgatggttgtgtcactgttgaaacggttcaatataaaacatgtcttagtgttggtaagaatgtctggttgagtcgattgcgtagtgctatgatcattagagttgaattggttgcattacttgcttgtgttgataacttttctcgtaattttttgtctcatttgcatgtttgtgtgattgaatttgcatttgattatcctggcaatattttgttcttaaaatcttgaaacacttgcctgaaaactctaccccgtgggaattacatggaagagaaattgtattggc

SEQ ID NO: 10967 - DNA, 1063 bp, Lycopersicon esculentum
  Predicted polypeptide sequence is orthologous to G536
ttggagtttcttcttcttcgttagagacatcaatcaccaggtaactttatagacaacaaaaatggccgattcacgtgaagaaaatgtgtacatggccaagctggctgaacaggctgagaggtatgaggaaatggttgagtttatggagaaggttgcaaaggtagatgttgaagagctgactgtggaagaaaggaatcttctttctgtggcttacaagaatgtcattggtgcaagaagggcttcgtggaggataatatcttcaattgagcagaaagaggagagccgtggaaatgaagaccatgttagcagcattaaagaatatagagccaaaattgaggctgagctcagcaagatatgtgatgggattttgagccttctcgaatcccatttagtaccatcagcctcaacagccgagtccaaagtgttttacttgaagatgaaaggtgattaccataggtacttggctgagtttaagacaggggcagagaggaaagaagctgcagagaacactttattagcctacaagtctgctcaggatattgcattggctgaactggctcctactcacccaatcaggctgggacttgcccttaacttttcggtgttctattatgaaattcttaactcacctgatcgtgcttgtaaccttgcaaaacaggcctttgatgatgccatcgcagagctggatacactgggtgaggaatcttacaaggacagtacattgattatgcagcttctccgagacaatctcacactttggacttctgataccacggatgatgccggggatgagatcagggaagcttcaaaacaagagtcgggtgatggacagcagtgacaacttagtagcctagtcttgtactccttattttgtgattttcgactactcttcgtatttactgctgaagttgtttgatattagaacaggttttagtctgataaaagaaacatgtttagtacaatttgttgtgatgctatttccatcgccatttaataattagagttggaatacagctatttcttgtatactgatgtgttggcttgtgtcgaaaaaaaaaaaaaa

SEQ ID NO: 10968 - DNA, 1025 bp, Lycopersicon esculentum
  Predicted polypeptide sequence is orthologous to G536
aaaaacttcaaaacagcaaaaggaaaaaagggaaaaaaaaaagaaattctccggcggaaattaccggcgattgacgatggccttgcctgaaaatttaaccagagagcagtgtttgtacttggcgaagctagctgagcaagctgaacgatatgaggagatggtgaagttcatggacaagctcgtaatcgggtcgggttcatcggagttgacggtggaagagagaaatcttctttcggtggcgtataagaacgttatcggttcacttcgagcagcgtggaggattgtatcgtcaattgagcagaaggaggagggtaggaagaacgatgagcatgtggttctagtgaaggattacagatctaaagttgaatctgagcttagtgatgtttgtgctggaattctgaagattttggatcagtatttgattccttcagcttctgctggtgaatccaaggtgttttatttgaagatgaaaggggattattatcgttatttagctgaattcaaagttggaaatgaacgcaaggaagctgctgaggatactatgcttgcctacaaagctgctcaggacatcgctgttgcggagcttgccccaacacatccgatacgacttgggttggctctcaacttctcggtgttctactatgagattctgaatgcatcagaaaaagcatgcagcatggctaagcaggcatttgaggaagctattgctgaactggacactttgggtgaggaatcctataaggatagcacacttatcatgcagttgttaagggacaatctcacgctctggacttccgatatgcaggagcagatggacgaggcttgacatgatagcgctcctccaggagggtgagttcaaatgtcacaacaacagtctgtaaaatctacctatgcaattgatagcttttgtaatttttatatgccctgcttactttgatgattttcttgttcaaacttccgtttgatacttcttatgattttaattttatttctttagcttcccttttaaaaaaaaaaaaaaaaaa

SEQ ID NO: 10969 - DNA, 1031 bp, Lycopersicon esculentum
  Predicted polypeptide sequence is orthologous to G536
gctagattcactctataaataaaagaaaaaacaaaatcctaaaatctctctactcctctcaattcaaaaaaagccctctttctctcaattttaaattcaattcagaaaatcgaaaaactctctcatttcattcagatctcaaaataattatttccgagcacacagaaggaaaaaaatctaaacatggcggtggcaccgacggcgcgtgaggagaacgtgtacatggcaaagctggcggagcaggccgagaggtatgaagagatggtggaattcatggagaaggtctccaactcccttggctcggaagaactaaccgtggaggagagaaaccttctctccgtcgcgtataagaatgtgatcggagcgcgtagggcatcatggcgtatcatttcatcgatcgagcaaaaggaagagtctagaggaaatgaggaacatgttaactctatccgcgagtacagatctaagattgagaatgagctctctaagatctgtgatggcattctcaaattgcttgattctaagcttattccttcagcaacatctggtgattccaaggttttttacctgaaaatgaaaggagattaccaccgctatttggctgagttcaagaccggtgctgaacgtaaggaggccgctgagagtactctcacagcctacaaagctgctcaggatatcgcatctgctgaacttgccccaacacatcccatccgacttggactggctctcaacttctctgtgttttattatgagatcttgaactctcctgaccgcgcttgcaatcttgccaaacaggcctttgatgaagcaattgctgagttggatacattgggagaggagtcttacaaggatagcactttgatcatgcaacttcttcgtgacaatctcactctctggacctccgatatgcaggatgatggtgctgatgaaatcaaggaagatcccaaacctgaagaaaaaaattgaggggaattgaaaccctctaatttgcttttcacttctcccctaattgtttttattgggagaagctgatt

SEQ ID NO: 10970 - DNA, 696 bp, Lycopersicon esculentum
  Predicted polypeptide sequence is orthologous to G536
tttttttttttttttgattgaaacccggttgctgagtatcacttggatgtaccattttatatatccagttcacaaatacaactgaaatgctttcatagaaactaagcaccagcaagaaccacattaaggtacagatgaaacaattgaacatcaatattcaaagttgttcgttgccacggataaaaagggaaacccgaaagacaggagaaaggaaataaaaaagaagcagcttctcccaataaaaacagccaggaagaaagaagccaaatgataatctgaggaccagttccctcactgttgttcattgtcgtttttggtttccttaatttcatcggcaccatcatcctgcatatcagaggtccagagagtgagattgtcacgaagaagttgcatgatcaaagtgctatccttgtaagattcttctcccagtgtgtccaactcggcaattgcttcatcaaatgcttgtttagcaagattgcaagcacggtcaggagagttcaaaatctcataataaaacactgagaagttgagagccagtccaagtcggattggatgtgttggggcaagttcagtatttgcaatatcctgagcagctttgtaggcggagagtgtgctctcagcagcttccttacgttcagctccggtcttaaattcagccaaataacgatgataatcacccttcattttaaggtaaaa

SEQ ID NO: 10971 - DNA, 674 bp, Lycopersicon esculentum
  misc_feature (66)..(66): n is a, c, g, or t
  Predicted polypeptide sequence is orthologous to G536
ggggcaagttcagcagatgcgatatcctgagcagctttgtaggctgtgagagtactctcagcggcntccttacgttcagcaccggtcttgaactcagccaaatagcggtggtaatctcctttcattttcaggtaaaaaaccttggaatcaccagatgttgcctttagattcttaaaaacaaagctgaattatatggaggcaaataagtctatggtgaagttggttgctttcttgataattcttgtatcatcatgctttcaatctctcactgctcaagatttggaaatcgaagttagcgatggcttaaatgtattgcaagtacatgatgtgtctcaatctttttgtccaggtgtgacaaaggaaagttggccagaacttcttggaacaccagctaagtttgcaaagcaaataattcaaaaggaaaatccaaaattaacaaatgttgaaactctactgaatggttcagcttttacagaagatttgagatgcaatagagttcgtctttttgtaaatttattggacattgttgtacaaactcccaaagttggttgaacaaaattaattgatgttatatcatatgtatctagcctccacaaaaataaattggagatgtatggttaaaatttccactatatttggtgataaataaatgtggcttttaatattaaaaaaaa

SEQ ID NO: 10972 - DNA, 1171 bp, Lycopersicon esculentum
  Predicted polypeptide sequence is orthologous to G536
tcggcacgaggaagaatcgatttctcattcgcctaaattttctctctacttcatccatggcggctctaatccctgaaaatctcagccgtgaacagtgtctttacttagcaaaactcgctgaacaagccgagcgctatgaagaaatggttcagttcatggacaaactggttctcaactccacgccggccggcgaactcactgttgaggaacggaatctcctctctgtcgcttacaaaaacgtgatcggatctcttcgtgctgcctggcgtattgtttcctctattgaacagaaggaggaatcgcggaagaacgaagaacatgtgcatcttgttaaggagtatagaggtaaagtcgagaatgaactttcgcaggtttgtgctggtatactcaagttgcttgagtcaaatcttgttccctctgctactaccagtgaatcgaaggtgttttaccttaagatgaaaggtgattattaccggtatcttgctgagtttaagattggtgatgagaggaagcaggctgctgaagacactatgaattcttataaggctgctcaggaaattgcactgacagatctgcctccaacacatcccataaggcttggtcttgcactcaacttctctgtcttttactttgagatacttaactcatctgacaaagcttgcagtatggcaaaacaggcatttgaggaagcgatagctgagctggacactttaggtgaagaatcatacaaggatagcaccctcataatgcaactcctacgagacaatctcacactttggacctcagatgctcaggatcagttggatgaatcttgattggcatggtctctatttaggaatgggctataaatgttgtttgctttgttgtgctgacttattgtataagaaaagacagcttcggttgacctatgttatgtttgataatttgacttgtggtggtttggtacttggaaatctagttgttagattatttatctcttatgtactgtgtattagaaaaaacttaaattaatgcttgtgtctttgagaatgatgtttcaaaaggtatcatcatgaaaatgggatacaaatcttttgtgaatggtgctattgtaaactgttgatggctcacccaattgagaatggtgaattttagtattaaattactatcaaacttcaacaaaaaaaaaaaa

SEQ ID NO: 10973 - DNA, 1146 bp, Lycopersicon esculentum
  Predicted polypeptide sequence is orthologous to G536
gaaaaatggatgggttccttgcttggaattcgagacggtacacaaatccgtgctcaaacaaaagaagaaagaagataaaaatctccatttttttttttcaactcaaagagaagatcggaaaatggcttcatccaaagaacgtgaaagcttggtatacatcgccaggcttgctgagcaagctgaacgctacgatgagatggttgatgcaatgaagaatgttgcgaatctggatgttgaactgacagtggaggagaggaatttgttatctgttggttataagaatgtggttggatctaggagagcgtcatggaggatcttgtcttccatcgagcagaaggaagatgctagaggaaatgagcagaatgtgaagcggatccaggggtaccgccaaaaagtagagtcagagctcaccgacatttgcaataatatcatgactgtgattgatgagcatctgattccgtcatgtactgctggtgaatcaactgtgttttactacaaaatgaaaggagattattatcgatatcttgcagagttcaaaacaggtgatgacaagaaagaagtttctgatctgtctttaaaagcatatcagacggctacaactactgcagaagctgaattaccaattacccatcccatccggttgggtttggctttaaatttctctgttttctactatgagataatgaactctcctgaaagggcttgccaattggctaagcaggtttttgatgaagcaatatctgagctggatagcctcaatgaggacaactacaaagatggtaccttaattctgcagcttcttagggacaatctcaccttgtggacgtctgacattccagaggatggagaagaggctccaaagggagatgctgcaaacaaagtgggtgcaggcgaggatgcggagtgatgatccaaacgagtagaatgtaccatgcgtatttgattaaagaggccggtgaaacatctggtggattgtttgtcaagtgctaatagataattgtaaggcacaccaacaaatgaatagatacttgtttattggatccgtcttgctgaagattgttttcacattaattgatgaatgcatatcatttgatttgcatccccattgttcttttctcaaaaaaaaaaaaaaaaaaaaaaaaaaaa

SEQ ID NO: 10974 - DNA, 432 bp, Lycopersicon esculentum
  Predicted polypeptide sequence is orthologous to G536
aaaaaaaaaaattgcattttcataaaaaagaaaagagatcccaaaatattgaatccattatggctcgtgaggagaatgtgtacatggcgaagcttgctgagcaagctgaaagatacgaagaaatggtgcagttcatggagaaagtttcaacttcattaggctcagaggaacttactgttgaggaacggaatcttctttccgttgcttacaaaaacgttatcggggctcgtagagcctcgtggcgtattatctcttcaattgaacacaaggaggagtcgaggggaaatgaggaacatgttaaatgtataaaggagtatagatctaagattgaatctgaactttcggatatttgtgatggaattctcaagctccttgattctaatctcattccttcagcttctaatggcgattctaaggtgttttaccttaaaa

SEQ ID NO: 10975 - DNA, 478 bp, Lycopersicon esculentum
  misc_feature (452)..(452): n is a, c, g, or t
  Predicted polypeptide sequence is orthologous to G536
tccctgaaaatctcagcccgtgaacagtgtctttacttagcaaaactcgctgaacaagccgagccgcctatgaagaaatggttcagttcatggaccaaactggttctcaactcccaccgccggccggcgaactcactgttgaggaacggaatctcctctctgtcgcttacaaaaacgtgatcggatctcttcgtgctgcctggcgtattgtttcctctattgaacagaaggaggaatcgcggaagaacgaagaacatgtgcatcttgttaaggagtatagaggtaaagtcgagaatgaactttcgcaggtttgtgctggtatactcaagttgcttgagtcaaatcttgttccctctgctactaccagtgaatcgaaggtgttttaccttaagatgaaaggtgattattaccggtatcttgctgagtttaagattggtgatgagaggaagcangctgctgaagacactatgaattctta

SEQ ID NO: 10976 - DNA, 599 bp, Lycopersicon esculentum
  Predicted polypeptide sequence is orthologous to G536
ggtataagaatgtaatcggagcaagaagggcttcatggcggatcttgatttgtattgaacagaatgaggagagttagggtcatgagcagaatgttaagagaataaagacttacagacaacaaatggacaaccaacttcccaaaatatgcttggacattttggttgagatctataatcacctaaatttcttccttcactacatggagaatctactgtcttctactacaagatgaatggagattactatcgctatttagcagagttcaaagcaggggatgatcgtaaagaggcgtctgaacagtctcttaaagcttatgaggctgctactgccactgctagttcagatcttgctccgactcatccaatcagacttggactcgcattgaatttctcagttttctactatgagattctgaattcacccgagagggcatgccacttggctaagcaggcatttgatgaagctattgccgaacttgatagcctcagtgaagaatcctacaaggacagcacccttatcatgcagcttctaagggataatctcactttgtggacatcagatcttgaagagggaggtgagcattctaagggtgatgagc

SEQ ID NO: 10977 - DNA, 343 bp, Lycopersicon esculentum
  Predicted polypeptide sequence is orthologous to G536
tgtcgcaaacatggatgttgaattgactgtggaggaaaggaatcttctttctgttggttataagaatgtggtaggttctaggagagcatcttggaggatcttgtcctctattgagcagaaggaagaatctagaggaaacgagcaaaatgtcaagcgaatcaggatacctcaggtggagtcggagctcaccaacatttgcaatgatattatggtggtcattgatcagcatctaattccgtcatgctctgcaggcgaatcaactgtgttttaccacaagatgaagggagactattatcgttatcttgcagaatttaaagctggcaatgacaagaagaggttgctg

SEQ ID NO: 10978 - DNA, 429 bp, Lycopersicon esculentum
  Predicted polypeptide sequence is orthologous to G536
gccgagttggacacattgggcgaagagtcctacaaggatagcactctgatcatgcagcttcttcgtgataacctcactttatggacctctgatatgcaggatgatggaactgatgagatcaaagaagctacacctaaaccagatgataatgaatgagcagcagtaaaaactggtgaaatttctttaggattgaaatatgctatgttgtaacttctttttcatttgtctggattcaactctttgttagttctagatcttgtgatttgtaatacctaaaatcaaccgtttcttgttaattgttgttcttgtttgtttctatgttgatttgctgttgtatttggattatttcctttttctcaaaggaatgacttactgggaagatggatgtaccttttaatccacaaatttgttagcttctccatttcatat

SEQ ID NO: 10979 - DNA, 564 bp, Lycopersicon esculentum
  misc_feature (533)..(533): n is a, c, g, or t
  Predicted polypeptide sequence is orthologous to G536
gctactgccactgctagttcagatcttgctccgactcatccaatcagacttggactcgcattgaatttctcagttttctactatgagattctgaattcacccgagaggttagataacaactgtatggacagaagctaaacatgttatgactagacaaaagatgttaacttaccattgtccatcaagtacaccccttgtttcttcttccccatttcataatgaaacgagcttggagattctaactggagaacttttgaaaatgattttctcatcaaactgtgaaattgtgaatcggaagatgatattgagctgttgccttttctagtataattacacatagagttgaagagtagtgaggaatcaatcttgtgtaaagagcgtcaacggataattttggtagtctatgagtatttgacatattagccatcctgctttgaaatcttttcttctgagctgaaagtctattgggcgcaacctctctaccccacaaaggtaggggtaccccacttttaggactacactggatatgtcgntgttgttgtattgattatttgacatttcttc

SEQ ID NO: 10980 - DNA, 602 bp, Lycopersicon esculentum
  Predicted polypeptide sequence is orthologous to G545
caggtcacgcgtgcggatccgagtcgggtcgggtttactaaaaagttgaaaacatttcgtttaaattctgttatcaactaattaattgaaaatattttttggccatttaataaattaaataaataattaaaacaaattttgtccaaaaaataatctctcgatcgatcatttgccgaagccgaagcgagcgacgacgacggcgcgaggagggtccctctttccaacccttttaacaattaataggagtttttatgtatttaaacactcctatttttttttttcattaccgatgagggacaattgctttttcattaaagcataagaggacttttcaatttcccaactcttcaagttctcaacttttcaaattcctctccttccctctattttccgttaattcttgctacatacccagcagtatgaggtgggcatagctacatattagtaatgtctctcttagttggttccgttagccttgatataacacttattttttggtcaaattcgaatgaaattgttgtcacatattgagcagaagtactgcaactcttcttttttttatggggcgggggggatttgagtgaagttgttgttacattttg

SEQ ID NO: 10981 - DNA, 731 bp, Lycopersicon esculentum
  Predicted polypeptide sequence is orthologous to G549
gatttcttgtgtatctaatgcattgtgcatatgtttcggttgtcggtcctcactggctctgtttcaatgcaatgcaaacagagtacatgttcataatgccagcaagaggaaacaatgaggctatgatgatagttttgctgagctctttgagtcgggcataagagttctgtagctgctgtggcggggcaatctgaatttctggaaatttgcagctatggctgggcacaaagaactcaaagcccgaagacataatctgagcctcttgcatcatttctccattaccaaaaccaacagccctcttctagtccttttcctttcttcactatagaaaacagagggagcattaacatcagcagcagcagcagcagtagttggacctcattctgatttatgagctcaggtccaaagcatctcaaattccccgaatcctatgctaccagaatcaacgaagcagatgatatttgcttatcttggcttaaaaaaaggttgttcgggtttacagacaagtagatctgtatcttggcttggcaaaaacccatgatggtatgtgatttgagactcctcgatcacatgcaactggttcttttgcagctatggcgttgtctcctctctctctttgaccattcattagtagccagctgcgagtgtcaaaattgccagtaattcttctggacattgtttgatggggaaatcgttaaatgagacatcattgatgagaaatgtgaaataat

SEQ ID NO: 10982 - DNA, 777 bp, Lycopersicon esculentum
  Predicted polypeptide sequence is orthologous to G550
gaaaaggttaaaggcgtatacatacagtttgtataatatgacagaccccgcaattaaactcttcggcaggacaattcagttgccggatattccggattcttctggagctcagggagatgattctttgccgggagacaataacggagaagaagacgaagaagctgataaggatgactttggaggaaacctggatgatgacgaggaagagatggaaattttgactggcaaggagttgcaggatcagaattcagaaccaactaaaactgatagtataaaggagctgcctgttgataacgactgttcaacaagaccttcaaaaagtgaagaagagcaaggagaagcaagtaattcgcaagagaaaatcctcaaaaagccagacaagataattccatgtcctcggtgcaacagcatggaaaccaaattttgttatttcaacaattacaatgtgaaccagcctagacacttctgcaagagttgccagagatattggacagctggtgggaccatgaggaatgtgcctgtaggtgctggtcgtcggaaaaacaagaactctattccacattaccgtcaaatatctgtctctgaaacactttcgaatgcacaaacagattatccaaatggaatacaacagcctattcttgcatttggctcccctacacctctctgtgaatcaatggcttcagttttgaatattgctgacaaaacaatgcataattgctcacaaaatgggttccacaaaccacagggagcccggggttccagttagttacgtagttg

SEQ ID NO: 10983 - DNA, 721 bp, Lycopersicon esculentum
  Predicted polypeptide sequence is orthologous to G550
caagaaacacaaactacttttaataaaaataaaaaaaatcaagaattgtgaagaggaattcaagaaaatgtctgaagttagagatccttctattaagctgtttggtaaaacaattggtatgacacaacaagaaaccaattgtgtttatcttcatgatgatcatacaacctcatcccctctttcaattgatgatgaaaagatcaatttagaaggagaagttacacaaagcaaacaagttgatgaacttgttgatccagctgcagactcgtcgattgaaccagaaacatcatctggtataagcgatgacatcaagatgcaggacgcagataaagagacgttatcctcaaaatctgtcgaggaggaggattcgagtgaggagaaggcactcaagaagcctgataaattgattccatgtcctcgatgtaatagcatggaaacaaagttctgttattacaataattacaacgtcaatcagcctcgttacttctgcaagaactgccagagatattggactgctggaggtacaatgagaaatgtgcctgtgggatctggtcgtcgtaagaacaagagttcttccatatcgaattatcctctttcagcaggtcgagttgaagcagcagctcacggaatgcatcttcctgcttcaggacaatggaactgtcccttacattggatcagataaacccctttgtgactctatgggttctgcattgaacttagc

SEQ ID NO: 10984 - DNA, 313 bp, Lycopersicon esculentum
  Predicted polypeptide sequence is orthologous to G550
tcggaacaaagaatgcctacaatcgggaatgatcaatcaaatggaagttgtagtacagcttcaagtgtaactgacaaagaaagcagtgctggtactcatgatttagctaattggagtaatttccagccatttcctcctcaagtaccgtactttcagggcgctccgtggccttattctggctttccagtatcattctatccagcagcaccgtactggggatgcaccgtgtcaaacccttggaacgtaccatggctttcatccaatcaatcagtccataacaacagtcctacttcaccgacattaggaaaacatt

SEQ ID NO: 10985 - DNA, 686 bp, Lycopersicon esculentum
  misc_feature (594)..(594): n is a, c, g, or t
  Predicted polypeptide sequence is orthologous to G557
tgaataaaatacgaaactgtacttttcccttaatttagtgtttttttcaagtgtagagaaaaatgcaagagcaagcgacgagttctattgccgctagttcactaccttcaagtagtgagagatcatctagttcagctttacatcatgaactcaaagaaggtatggagagtgatgatgagatcagaagagtgccggagatgggcggagaagcgacggggacaacgtcagcttctggaagagatggagtatcggccgccggtcaagctcaaccatcagctgggactcaaaggaagagaggaagaagcccagctgacaaagaaaacaaaaggttaaaaagattgttgagaaatagagtatcagcacaacaagcaagggagaggaagaaagcatatttgatagatctggaagcaagggtgaaggaattggaaacaaagaatgcagaacttgaagagaggttgtctactttgcaaaatgagaaccaaatgcttagacatatactgaagaacacaacagcaggtgcacaggaagggaggaagtagacatatgatcgatcttatgtcgatatgtcagcattcttgtttagatcctatgtangcactgaagagaaattctcttctggatttgagaatgcatgctagtttcgggtggattgttctgatttgatgcattgcatacttgctactctt

SEQ ID NO: 10986 - DNA, 1184 bp, Lycopersicon esculentum
  Predicted polypeptide sequence is orthologous to G558, G578, G629, G1198, G1806
gatggatgcaatgggtgatagcgaaggccataggattgtgagctctactgcgttgtggaggggtgaccgccggccagcccaaattgtccaggtatcgcagttggagcaggacattgaacgagcacctcaacagggagaaagtgggcccgtagcatttgatacagattatattcgatggttagaagaacacgacaaacacatcaatgagttaaggaacgctgtcaaatcacatgcacgtgatcctgaactgcgaagaattgcggataatgtcactgcacattacgatgaggtctttaggatgaaaggaaatgcagccaaggcggacgtagtccatgtcttgtcaggcatgtggaaaacccctgctgagcgttgttgtatgtggattggtggtttccgcccctcgttactgcttaagcttctagtcaatcagttagatcctctgagtgagcaacaagtagctgactttaacaacttgcagctgtcatcccatcatgctgaagttgctctctcacaaggtatggaggcgctgcagctatcattgggggagacattagccatgggatctccatttactgaatcagggaatgtagctactacttatatgtgtcaaatggcaatggctatggggaaattaatgactcttgaagattttctccgtcaggcggacagcctgcgtcaactagtattgcaacaaatatatcgcatactgacaaccagacaatatgcccgtgctcttcttgcaataaatgattacttctcaatttttcgggttctcagctctatttggctagccagaccacgagagcaataagcacaaaaaccattgcagtattctgctgaaattcggacactactttgatacactggccagtatatgagatgcagctaagttgctatattttgaagtggtggtactgtatgtgccttgtggaagtacaaaatttgtttttcaaagtatagagaaatttagcaggggtggttgtcatttagatagttttcccaaagtggtgtatattgtgcttttgttccacttctttttgtgtggggtgaaacatttaattttgttgaattaaccttctggactctctaatatatcttgtgatattattttctgtacgaattgtaagaacaattgcttaattttatttttcaaaaaaaagttgatgtaaaaaaaaaaaaaaaaa

SEQ ID NO: 10987 - DNA, 1585 bp, Lycopersicon esculentum
  Predicted polypeptide sequence is orthologous to G558, G578, G629, G1198, G1806
cttgggcataactctacccaaaaacctagttcattcggtgagagttgctgaagaccatataaagaaggtcccctatttaattctacatctgcagctaatccagcagtgggatttgacgtctctgggaccatcaataggaatttagctccttcaaatacaagtttgtctactgctgctccaggatctcatgtaatacaattgcaatcaaacttagttcctgcagctggcactcatcctgagaattggggcgagtccaacatggcagattctggttctcgcactgatacttcaactgacatggatggagatgatagaaatcaaaggattgagacgggtcaatccagggctattgcagcttctgattccagtgacaaatcaaaagaaaaagtcttggatcagaagacattgcggagacttgcccaaaatcgtgaagctgctagaaaaagtagactgaggaaaaaagcatatgtacaacagctggagaatagccggttgaagctatcacagttggagcaggaccttcagcgagcacgtcaacaggggaagtacatctcaaacatggcagatcaatcaaatggagcgggcgccagtgggaccttagcatttgatgcagaatatagtcgatggttagaagaacacaacaaacacatcaatgaattgagaaccgctgtcaattcacatgcaagtgaccctgaactgcgaagtattgtgaataatgtcactgcacattacgatgaggtctttagggtgaaaggaaatgcagccaaggcagacgtattccatgtcttgtcagggatgtggaaaacccctgccgagcgatgttttatgtggattggtggcttccgcccctcggaacttcttaagcttctagtcaatcagttggagcctctgaccgagcaacagttagctggcatttacaacttgcagcagtcatcccatcaagcagaagatgccctttcacaaggtatggaggcgttgcagcaatccttggcagagacattagctaacggatctcctgctactgaagggtcatcaggagatgtagctaattatatgggtcagatggcaatggctatggggaaattagggactcttgaaggttttctccgtcaggcggacaacctgcgtcaacagacattgcaacaaatgcatcgcatattgacaaccagacaatcagcccgtgctcttcttgcaataagtgaatacttctcacgtcttcgagctctcagctctctttggcttgccagaccacgagagcaataagtatgacatgcattgcgatattctactgaaactcagatatactacttcgatacactggccggtatatgagatccagcaaagttactcttatgtataaagtggtattgtatgtgcttgtggaagtgcagaatttgttttctttctccttaggtttatagaatgccaaaattttactttgtgacttaggaaccaataatgtacctgtgtttttagttttacaaggaaaaagtttagggatttttaagaagtgtaatagatatttttagaaagttttatgcttaatcaaattatagcttgtgactaaaaaaaaaaaaaaaaaaaa

SEQ ID NO: 10988 - DNA, 1614 bp, Lycopersicon esculentum
  misc_feature (1558)..(1558): n is a, c, g, or t
  Predicted polypeptide sequence is orthologous to G558, G578, G629, G1198, G1806
gcttcttggaaataagagatttgacactttgtgaccaaaaagtcaaaattggctggtaagagagagaaggagagctgacaaggtataggacgtcatcccattttagcaactttcacctgcttctcatctgggtacttccggcactgcttgatttattgatttggtgattctaaacttcagttgatttctcactgattcactgaaaagctgagggacacagaagggctaaagaaattgaagggggaaaaaaccccaacagaaaattacaagatttgatgattctattgtcttattttagctttctggcaaagcttgagccttttgctatagacccttttcgtttcttgaactaagatactacatctgatttgtgttccaatttcaattgattatccacaaagttggctatagtccacgatggctgatatcagtcctagtacatcaacagatgccgatactgaagataagaacaggttcctaaatcaacaactgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggcaacagggaatatttatttcaggttcaggagatcaatcgcagtcgatgagtggaaatggagctttggcatttgatgtagaatatgcccgatggttggaagagcagaaccgacgaattaatgaattaaggggagctgttaattctcatgctggtgatgctgaacttcgcataatagtcgatggaatactggcacactatgatgacatattcaggataaagggggatgcggcgaaggctgatgtttttcacatattgtcgggcatgtggaaaactcctgcagaaagatgcttcttgtggcttggtggattccgttcatctgaactactcaagctgctcattaatcagttggagcctttaaccgaacaacaattattggcgatcaacaacttacaacagtcatcccaacaggctgaggatgctttatcccagggaatggaggcattgcagcagtctttggctgagacactcgcagggtctcttggaccttcaggttcctctgggaatgttgcaaattatatgggtcaaatggccatggcaatggggaagcttggaactcttgagggtttcatacggcaggctgataaccttcggcaacaaacattgcagcaaatgcatcgcatattgacaactcgccaatcagctcgtgctcttcttgctatcactgattatttctctaggcttcgagcactgagctctctctggcttgctcgtccccgggaataacatccgctttcttctaatacactactctaaagacccttggtaacatttgtaaatgagaaacctctttgttggaaagctgagctgctgagttttaatggatacatatatttatataatggtatttgtaacattgtttcatatttaactaagatagtgtgtgatcagngaattgttgttgtattttagtatatctaatggttccagttaggttaatggaaatga

SEQ ID NO: 10989 - DNA, 1071 bp, Lycopersicon esculentum
  Predicted polypeptide sequence is orthologous to G558, G578, G629, G1198, G1806
gggggtttcggccatccgagcttctaaaggtactcacaccacatcttgagctcttgacagaacaacaactccgggaggtttgtaacctcaggcaatcgtgtcagcaagcagaagatgccttatcacaaggaatggtaaaacttcatcagattctcgctgaggctgttgcagctggtcaattaggtgaagggaattactctcttccgcagatggggcctgccatcgagaagttggaagctcttgttaggttcgtaaatcaggcagatcatctccggcaagaaacacttcaacagatgtcccgcatcctgaatacgctccaagcagctcagggcttactcgccttgggggagtactttgaacggcttcgtgttctaagctcacactgggctactcgtcttcatgagccggcctaatgaagctatagaagatccctcaatacaccattcgacgagttttgccttcagaaactatactatgtaagctaaaatttagctcttgtttatgtcaataaagctctcaatatgaatataggacattatactagttgtacaaagggtctccaagagtctattgtggcttatgtttccgagcaacttttgaacgcgttggagatgagaaattgatatgtatataacatacgtcgagcaatggcatgactaatatcatgttgtgatttctcgtgagaatgttttttcgaagatttgcatctaaatatttacttttacaggttttggttaggaaagagtgttgctcacttagagagacagatccaggatttgaacttaatgagttcagcctcgcaatgaactcatacaagtaaaattatggatttgatccaagtacgtttgttgagttttttactaggttttaagttttaatcgtatacatatatgaactccgtgacgaaaattatggaccgtgtcaaaagttatggattcagataaacatcgtagccaattggctacgtccgttttgctcgcttggtaattggtagggtgtgcataatcaagtcgatcgaatgttatgtttgtgccatttcttataagtattattatctcactatgtttttgc

SEQ ID NO: 10990 - DNA, 1065 bp, Lycopersicon esculentum
  Predicted polypeptide sequence is orthologous to G558, G578, G629, G1198, G1806
ggagagaactagtctcgagttttattgtttttctctgcctctaaattccatttcttttttttcctttcttctttgtataatttcataattcagttttaattattttgaaaaactccaatttgtagaagagtttctttgtacttatgaacagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaagtcgggatatacttctagtgaccaacttataccatctggctctgaggataatcaagcaggaaagagtatttcagacaaggtacaacggcgtctagcacagaatcgtgaagctgcacgtaaaagccgtatgaggaaaaaggcttatgttcagcagcttgaaaaaagcaatttgaagctagcacaacttgaaatggaacttgagagagctcgacagcagggactatacattttaggttcaaatggtaatatggggctaagttcaacaattaatccaggaatagctgcatttgaaatggaatatagtctctgggttgaagagcaacaaaaaaagaacgtagagttgaggaacatattgcaatcccatgtaagcgaaatggagcttcagttgctggtagaaaccgtcttaaaccactactacaatctattccgaatcaaagctgatgctgcgaaagctgatgtgttttacttgatgtctgggatgtggagaacttcggtggagcgttttttcctctggattggaggattcaagccatctgaactcataaatatcgtgatgccacagcttgagccattgtcagatcagcagatcgtgaaaatctgtaatctacgacactgttgtcagcaagccgaggatgctctcactcagggaatggataaacttcagcaaactctggcacagaacatcctaactatgaccactggaatgggaagttacagttctcaaatggtttctagtatggaaaagtt

SEQ ID NO: 10991 - DNA, 420 bp, Lycopersicon esculentum
  Predicted polypeptide sequence is orthologous to G558, G578, G629, G1198, G1806
tggctccgcaccaatcagctcagggtctccttgccttaggagattactttaaacgtcttcgtgctcttagctcactttgggctggacgtctttctgaacctgcttaaagaggtaagaaagaacctgtgggttttcaactttgccaatcaaagctgtgtgagctaagtaacaagtatgagttggcgctcatttgaaatgtgtatataagttctggtatgctgtaattgaaacattttcttttgttatcacattggttttgatgattgtaaatcaatatggtagaggttattgttactccaagttgtgcctctctttgtctatgatgggagccaagcaattttgaatgctttgcagatgtaacaaaatgagccaatattttattgtgcaaaattaaattcatgtttgcaatcaaaaaaaaaa

SEQ ID NO: 10992 - DNA, 841 bp, Lycopersicon esculentum
  Predicted polypeptide sequence is orthologous to G558, G578, G629, G1198, G1806
gcagtttcccagatagcttgattcttgaagtcgagaattgcctcgagaatgagatgcctattatggagaaaagactagagaatgagatagaggaaccatcacaagtgacagttggaacgtctaacagatatgaacctgaaacaactaaacgtattgataaggtgcgtagacgccttgcacaaaaccgggaggctgctcgtaaaagtcgtttacggaagaaggcctatgtccagcagttggaaaatagtaaactgaagctgcttcagctggaacaagaactagaacgtaataaacaacagggtttgtatgtcagggatggtttagatgctagtcagataggttgctctggaaccgcaaattcaaatagcttcttttgaaatggagtacggccattgggtggaagagcaagatagacaaacagatgatttaaggaatgctctgaactcccaaatgggtgaaatagaattgcgcattcttgtcgaggattgcttgaatcactattttgatctctttcgcttgaaagctacagccgcaaatgccgatgttctctaccttatgtctggcacatggaagacatcagctgagcgcttcttcttgtggattggggggtttcgcccctccgaacttctaaaggttctcacgccacatgtggaaccattgtcagatcaacaaatccaggaggttagcaacctcacccagtcttgtcagcaagcagaagatgcgttgtcccaaggaatggtaaaactccatcagattcttgctgaggctgttgcagctggtacactaggagaaggagttatccttccacagatgactgctaccattgagaagttggaagctc

SEQ ID NO: 10993 - DNA, 792 bp, Lycopersicon esculentum
  Predicted polypeptide sequence is orthologous to G558, G578, G629, G1198, G1806
ggcattgggaaatgtgcagcattttgagaattggggtgattctggtagtgcagaccatagccagcagactgacacttcaacagatgttgatactgatgaaagaaaccatcagggccaaggtgttcagcatggtgcattaatagctgtggactccatggacctgtccaaagtaaagcttggagaccagaagacacttcgcaggctggctcagaatcgagaagctgctaggaaaagccgattaaggaaaaaagcatatgttcaacagctggagaatagtaggctcaaactgtcacagttagagcaagagttaaaacgagcccgccaacagggcatatttattgctaatggatatgcaggagatcagagtctttctgctggtggaaatggggcattggcatttgacatggattatgcacgttggctagatgaacatcaacgacttatcagtgatctccgatcagctgtaaattctcacaggggcgataatgaactgcgtcatctcgttgatggagtaatgtcacattatgacgaaaaattcaagctaaagagtgtaggtttaaaagcagatgtttttcatatgctgtcaggcatgtggaagactcctgtagagaggtgtttcatgtggttaggtggatttcgttcttctgagcttctcaagattcttggcaaccatcttgaaccgtttacagagcagcagctcataggcatatgtaacttgcaacagtcttctcagcaagccgaggacgcgctatcacaaggtatggaagcccctgcacaattactcattgatac

SEQ ID NO: 10994 - DNA, 834 bp, Lycopersicon esculentum
  Predicted polypeptide sequence is orthologous to G558, G578, G629, G1198, G1806
ggacgagcactagtgacactatagacgagctatgacgtcgcatgcacgcgtacgtaagcttggatcctctagagcggccgccctttttttttttttttttttttttttttttttttttttttttttttccaaccaatatagacgctggatagtccttccagcattaatgtacttgtattcttattgctaatacaattgcacaatatgtcaatcatgaatccatgataacttacaagttaaatgcaagctttaccctaacttgtacaacactgaagcgcaatatgagaccagaggatgttaatacaacttgtacaaagagaactgaccctccagccatttgcaaatgcgttgcgagtttgcagccagcagccccacatttacagatcggcccagggagggactccaacgggggtgatgcttcttttgcggcctagcgagccaaagagaacttagggcgcgtaacactgaaaagtagttcgtttattgcaagaagccccccagcggctttgccaattgccaggaagccttgcatttgaagcaaggtttgttttcgaaaattggtaacccgacaaggaaattttcagggggccagttttccaagggccatggcatttccccttttggttggcacgtttccgaaaccccgtggcccaaggaccctcccgtttttgcaaggtttgtgaattgttcatcctttaacaagattctatcttgtgggggttgtggaaatggtccctatatggttttgttggggtaagttttaaaggggtggatttgaaagtggggagtttttttgaaaatccctttgagtcgatttaaaaaaccctcttagaa

SEQ ID NO: 10995 - DNA, 597 bp, Lycopersicon esculentum
  Predicted polypeptide sequence is orthologous to G558, G578, G629, G1198, G1806
gcaaaattataacaagttgggatggttgcacatcatgattatttttttgtttgtttggttatatcaagaattgtaaatattaggatttttctgccattaatttgattcaaaattgaatcttgataagattttcttttatcttcttctcacaaaattgaatccatttgggttttttcagttgagctgagattttgctgtttggcctttaaaagtctgtacaaatgaattcttcaacatacactcagtttgttgcctcgagaaggatgggcatatgtgagccgatccatcaaattggcatgtgggatgatttcaatgctagttgtccgagtacatcgacaaccatgattctagaagttgagaaatgcctagaggaccagataccgatgatggacaaaagattagacattgagacagaagatacttcgcatggaacagtagggacttctaatagatatgaagcggaaacaagtaaacccatcgagaaggtacttagacgtcttgctcaaaaccgtgaggctgctcgtaaaagccgtttgcggaagaaggcctatgttcagcagttagaaaatagtaaattgaagctgattcaattggaac

SEQ ID NO: 10996 - DNA, 569 bp, Lycopersicon esculentum
  misc_feature (286)..(286): n is a, c, g, or t
  misc_feature (471)..(471): n is a, c, g, or t
  Predicted polypeptide sequence is orthologous to G558, G578, G629, G1198, G1806
gattatacatgttaggttcaaatagcaatatgggactattaggaacaattaatccaggaatagctgcattcgagatagaatacagtcactgggtggaagagcaacaaaaaaagaacgcagaattgcggagtatattgcagtctcctgtaagcgatatggagcttcagttgctagtagaaaatgtcttaagccactatttcaatctctttcgcatgaaagctgatgccgccaaagctgacgtgttttacttaatgtctggggtgtggagaacttccgtcgagcgctntttcctctggattggaggattcaagccatcagaactcataaatgtggtgatgccacaactcgagcccttggccgatcagcaaatcattaaagtgtgtaatctgcgacactgttgccagcaagctgaagatgctctcacacagggaatggataaacttcagcagactctggctcagagcatcctanatatgaacacgggagctggaaattacacttcccaaatggtttcttctatggaaaaattagaagcattggagagctttgttaaccaggcagatcacctt

SEQ ID NO: 10997 - DNA, 503 bp, Lycopersicon esculentum
  Predicted polypeptide sequence is orthologous to G559
agttagacatcagcatagccagtccatggatggttcaactacaatcaagccagagatgctcatgtcaggagtggaagagccttcttgaggtgaaactaagaaagccacgtcagctgcaaagcttgctgaacttgctcttattgatcctaaacgtgccaagcggatttgggccaacaggcagtcagctgcaagatcaaaggaaaggaaaatgagatatatagcagagcttgagagaaaagttcagactctgcaaacggaagcaactactttatctactcagttgaccctattgcagagagatacaaacggcctgaatgctgaaaacagtgaacttaaactgcgtttacaaacaatggaacaacaggttcacttgcaagatgcgttgaatgatgctttaaaggaggagatacagcatctgaaagtgctaactgggcaaggcatagcaaatggtggacctatgatgaacttcccagcaacctttggaggcaatcagcagttctact

SEQ ID NO: 10998 - DNA, 544 bp, Lycopersicon esculentum
  Predicted polypeptide sequence is orthologous to G559
ggtttgtatggataaggataagtcttcttcaagccatataggaggttcgttgcctccatcagggagatactcattattttcacctcccggtagtagctccaatgtaaagtcagaacaacctggattagcaaatttacctcccttaggacctggaaatgcttcagaatcaggtcattttggtcatggtttgtcggcagattcaagcctgtttagtcttgatataagccgaatgtctgataacccaccaagaaaatttggtcataggcgtgcccactcagaaattcttactcttcctgatgatattagctttgatagtgatcttggcgttgttggactagatggaccgcctctgtcagatgagactgaggaggacatcttgtcaatgtaccttgacatggataagttcaattcttcaactctgacttctgaattccaagcgggtgagtcttcttcagctgctccaggttcatcacaaacaacagcaatggcttcaggaacaaataaatctgctcctactgttagtgagaagccaagagttagacat

SEQ ID NO: 10999 - DNA, 506 bp, Lycopersicon esculentum
  Predicted polypeptide sequence is orthologous to G559
gtgagagagatataagtgattgatgtccaaaaaaactaccaccaacaatattggtaacatgaagaaaatcatgttgatagttgacaaaatgacatatgcatagaatgggatttgaacaatttcaactaaaagtcaaatgaccctacaaaagtactaaaatgcagatgaaggagctaactgaaagcaagagaacctgagctagatgttgtttcaacacgtgatgattttgaaacacaaaaatgagctgctagatgggaaaacacatgatgatttttaaaacatacaccatctcctgtctctctggccatcagctgttcaatcctttgctacagaactaacatcagaagcgttttcattttgaggagatgacagagaacctcttgacatcacatctccggcttgtgaaagttgatcttgcagctggactgcctgttggcccaaatccgcttggcacgtttaggaatcataagagcaagttcagcaagctttgcagctgacgtggcttt

SEQ ID NO: 11000 - DNA, 823 bp, Lycopersicon esculentum
  Predicted polypeptide sequence is orthologous to G561, G562
ggttgccttggcgctcctcctctttcttccccctttcagtttctctctctactatcttttgctcacgccacacgccctttctctgttctttttttgaagttccttttagagagagaaaacatacacagagaatgcacaaacactgaaacttttcactactaaaatttgcctctctctttctgctactctcttctacagttttttgaagggttgcttttctgaagctagttgggacaacactcttatcagtgactataaaaggaaattctgattgcacctctaatttagtacgacatcgacttggttcctattacatgggaaatagtgaggatgggaaatcctgtaagcttgagaagccatcctcgcctgcagcggaccagagcaatcgccatgtctatccagattgggcagccatgcaggcatattatggtcctcgagtagctgttcctgcatatttcaattcagcagttgcacctggtcatacccctcacccttatatgtgggggccacagcctatggtaccaccttatggtaccccttatgcagcaatatatgctcatggtggggtttatgcacatcctggagttccaattggatctcatcctccaggtcatgtgatggcgacatctcctgttgtcagccaagccatggatggtgcttctttgagtttagatgcgtctgcgaagtcctcgggaaattctgatagaggattgatgtctaaactgaaggaatttgaggggctggcaatgtcacttggaaatggcagcactgacaatgttgagggtggaacagacattgcacattctcaaagtggggaaactga

SEQ ID NO: 11001 - DNA, 974 bp, Lycopersicon esculentum
  Predicted polypeptide sequence is orthologous to G561, G562
gctgagaaggcaatcgttgttgcagcgaaaatgacgggaacagtactttctccttgcatgacaactttggaaatgagaaatcctgctagtgcacatatgaaatctagcccaactaatggtggttcaccactcagccctgcactgcctaatgaaacctggttacagaatgagcgtgagctgaagcgggagaaaaggaaacagtctaatcgggaatctgcaaggcgatcaagattgagaaaacaggctgaagctgaagaattggcaatacgagttcaggctttaacaggagagaacttgacactcagatccgagattaacaaattaatggagaactcggagaaactgaagctagacaatgccactttaatggagagactgaaaaatgaacagcttggacagacagaagaagtaagtttaggtaagattgatgataagagactgcaacctgtaggcacagtaaacctgctagcacgagtgaacaactcatgttcctcggatacaacgaacgaggatggtgaagtttatgagaacaacagctctggagcaaagcttcatcaactacttgataccagccccagaactgatgcagtagcagctgggtgatcccctaaatttaatttgagatgttaaaacttagtctgattgtgtaattttggcgtaattttaagtccaaaattgctactaactacgggagaggaacaggtgaataggattacgagatttctaattttacctacctaattgtagtttacaggtcagtagaaccgatgtgtgctcttttttctgttttgcatttctgagttgaatgaatgtggctataatagcgtatgtaaagtttaatgttcgacatactaaagacttgatttgaggaaatactatagaaccgaaatgttttcggtttggacgatgaaagtgaacttcatatttgataaataaatgtggtatgtttatgatgttaaaaaaaaaaaaaaaaa

SEQ ID NO: 11002 - DNA, 737 bp, Lycopersicon esculentum
  Predicted polypeptide sequence is orthologous to G565
gctactccattacttaaatccaccgctaaaacctcctcttcctacattggggctctactgtctgaatctcccgcagatatcgcctcaaaatgcaagatccgtccaatccaaactccaagcagctcaatcagacgccaccattttccgctacattcaggccatcgcaccaccgcagagctcactccgaggtgaacttccggctgcctgaggatctagatctggtatctgacccattcgatgcgtctgccggaagttttgaggagatcggatccgaggatgatttcttctccacttacatggacattgaaaaactaggctctggatccaaccctacagatgttccagggttcaacaatgccggcgctggaagtagtggactggtagctgactgtggtgatggagaaaggaatttcaccaggcctcgacacaggcatagcaattcagtggatagttccagcttgttattaagtgagagtattgaagctaagaaagctatggctcctgataagcttgctgaactttggaccattgatccaaaacgcgccaaaaggattttggcaaatcggcagtctgcttctcgttcgaaagagagaaaggcccgttacattactgaacttgagagaaaggttcagacccttcaacagaagcaaccactctttctgctcattaacccttttccagcgggatacaacccagtttactaatgaaaatacagagctcaagctccgtttgcaagc

SEQ ID NO: 11003 - DNA, 483 bp, Lycopersicon esculentum
  Predicted polypeptide sequence is orthologous to G565
agctcgccagtggatctaatctcactgatatcgatgctgctgctgctcgagtgggagtcgagagtagtgatggagagaagaagccacgtcataggcatagtaattctgttgatagttcaagtttgttgatgacggagagtattgaagctaagaaagctatggctcctgataaattagctgaactgtggactattgatccaaaacgtgccaaaaggattttggcgaatcgacagtctgctgctcgttctaaagagagaaagactcgttatatatctgaacttgagagaaaagttcagacccttcaagcagaagcgaccactctttctacacaactgacccttttccagagcttaagctccggttacaagcaatggaacaacaagctcaattacgtgatgctctgaacgaagcactgaaacaggaagttgaaagacttaaaatagctacagggcagatatcagcttcctcagatgcatacagttc

SEQ ID NO: 11004 - DNA, 402 bp, Lycopersicon esculentum
  misc_feature (376)..(376): n is a, c, g, or t
  Predicted polypeptide sequence is orthologous to G568, G580
caagaatccaattatgtggtcatcaagcagtgataacaggggactctctgcttcttcttcttcatcttcatcctcatctcattcaccattttctccaagactcaaaacaatggaagaagtgtggaaagatattaatctttcttcacttcaagatcacactacgaattactctagagatcatcatcatcttcatgatcataatcatcaagctgctaattttggtggaatgattttacaagattttttggcaaggccttttgctaatgaatcttcaccagcagcagcagcagcagcagcctcccctgtttcagctacaactatgctgaatttgaactctgttcctgagcttcatttctttgataacccattgaggcanaactcaatcttgcaccaaccaaatgc

SEQ ID NO: 11005 - DNA, 569 bp, Lycopersicon esculentum
  Predicted polypeptide sequence is orthologous to G571
ttcggcacggggagagaactagtctcgagtttttttttttttttgcaaaatcgttgggtggtttccctcagtccaatttatttttggttgaataccttcttcttcttccgtttcttaatcaataacaacaccaatctcggtttatctgtctttatttttattatataaactactcattcatcatgtaaacgagctctcacaagcttgatttacacctcaaaagaagagaaaaaaagacgaatggattcttctaaccatcaaatttctttcatcaatcaacaccagttttttcacgatcctcgtcaacaacaacaaatggaaaatcataagaatcatcagatctcttttggattatcgtcagctaatcctgggaacttcataaacaaagagaataatggtggagcttatgatttaggtgaactagatcaagcactatttctatatcttgatggacaagatccttcctcttcatcaattcaagatcatagacagaataattatggaatgaggccaccaactctcaacatttttccatcacaaccaatgcatattgagccatcttcaacaaa

SEQ ID NO: 11006 - DNA, 601 bp, Lycopersicon esculentum
  Predicted polypeptide sequence is orthologous to G571
gtttgatgatctggaatttgaacatttttttttatctatgaactattttttatctatatcaacacaaaaaaaaaagagtaatagaaacatttaaggaggaaatataggtgattgaaattaagattacaaaaggctaattattaactagctaactaattattcgtgacgagggacgcgtcagccaaagcgagctgagggctcgaagccgatggaaataatcgccgattgctataaaacacctcgcggcttgacgagtagttaaaatttggtgcagccgatgaatcgtttggtgcctcaaattatcggcctgtctgaggaaggcttcaacagtggagagttggttaatagcaagagccatgtagtttcccatattttcattattattacccaatattaatgcatctgaggcaattattgtatctgataatgactggttcaaagtctctaatccttgtgacaaagcatcctcagcttcttgtgttgatttttgtaatccacacattcccaacaattggttttctgttagtgcctctatttgacacattataattttgagaattttggatggacgaaaatcgcctatccacaagatgcatcgttt

SEQ ID NO: 11007 - DNA, 477 bp, Lycopersicon esculentum
  Predicted polypeptide sequence is orthologous to G571
gcacgagaagacattaaggagacttgctcagaatagagaggcagcaaggaaaagcagaattaggaaaaaggcttatgttcaacagctagagacaagtagaataaggctcactcaattggagcatgaaatacaaagagccagatctcaaggatttcatgttggaggaaatgttcttctaggaggagaccaaggctttcaacttattaataggaccaatatcagctcagatgctgcagtattcgatttggagtatgcaagatggctggaagaacatcatcgactcatatgtgaacttagaaatgcagtacatgaagaacaattgcaggaggatgaacttcgtatttacgtcgaaaattgtgtggtacattatgacaatataatgaacttgaagggcatgcttgcaaaatctgatgtgtttcatttggtttctggcttgtggaagtctcccgctgaacgttgcttcttgtggattggcga

SEQ ID NO: 11008 - DNA, 935 bp, Lycopersicon esculentum
  Predicted polypeptide sequence is orthologous to G583
gtcacctgtttttttgctgtgtttatggaatgactgaatacagcttgcccaccatgaatttgtggaacaatagtactagcgatgataacgtttctatgatggaagcttttatgtcttctgatctttctttttgggctactaataattctacttctgctgctgtggttggtgtcaattcaaatcttcctcatgctagtagtaatactccctctgtttttgcaccatcttcttctacatctgcatctactttatccgcagctgcgactgtggatgcttccaaatctatgccgtttttcaaccaagaaacccttcagcagcgtcttcaagctcttattgatggtgctagagagacgtggacttatgctatcttttggcaatcgtcggttgttgatttctcaagtccgtctgtgttgggttggggagatggttattacaaaggggaagaagataaagcaaaaaggaaattatcggtgtcatcacctgcttatattgctgagcaggagcatcggaagaaggttctacgggagctgaattcgttgatttccggggcaccacccggaacggatgatgcggttgatgaagaagttaccgacaccgaatggttctttcttatctccatgacccaatcgtttgttaatggaagtgggcttcctggtcaggcgttgtatagttccagcccgatttgggtcgccggaactgagaaattggcagcttcacactgtgaacgtgtgaggcaagcacaagggttcgggcttcagacgattgtctgtattccttcagctaacggcgtggttgaattgggctcgacggagttgattgttcaaagttctgatcttatgaacaaggttagagtattgtttaacttcagtaatgatttgggttctggttcatgggctgtgcagccggagagcgacccatcggcgctctggctcact

SEQ ID NO: 11009 - DNA, 706 bp, Lycopersicon esculentum
  Predicted polypeptide sequence is orthologous to G583
gcagtagctcctcctccggtagacgttaaccaggtgcctttaggcctacaacagatgcttcaatatgttgtcaaaagccaaccagaatggtgggcttatgctattttctggcagacctctaatgacgacgagggaaaaaactttttagcttggggagacggatatttccaaggagatggtgtagttattaacaacaaaggcggcggcggtagcagcagcagcttaaagtcacaggctcagtccgagagaaaaaaagttattaaaggaattcaagctttaatggatggtaatggagatactgatctagtggatgatggtgatgtaactgacactgagtggttctacgtgatgtcgctggcccgttctttctctgccggagatggatctgttaccggtaaagcttttggaagtgatgattttttgtggataacaggtccggaccaatttcagcttcattacagctgtgaaagggctaaagaagctcagatccatgggattcagactctggttagtattccaacttcaaatggcgtgtttgaattaggctccactcaattaatcaaacagaatttgagcttagttcaacaggtgaagtctctgttcctctgttgtccccctattcaatttttagaaaaacaattagttttgccgatattggccttgtcaccggcttgcaacaagatgacgatgactataaattaagaga

SEQ ID NO: 11010 - DNA, 615 bp, Lycopersicon esculentum
  Predicted polypeptide sequence is orthologous to G583
ccccgggcttgcaggattcggcccgaggttcaaacaaattcaattccatctagtaatagtaataagcaaattgcttatggaaatgagaataatcatccatctggaaatggtcagagttgttacaatcagcaacaacagaagaatcctcctcagcaacaaacacaaggattcttcacgagggagttgaatttttcggaattcggtttcgatggaagtagtaataggaatggaaattcatcggtttcttgcaagcctgaatcaggagaaatcttgaattttggtgatagtactaaaaaaagtgcttccagtgccaatgtgaacttgtttacaggtcagtcccaatttggggctggggaggagaataataacaagaacaagaaaagatcagctacttccaggggaagcaatgaagaaggaatgctttcatttgtttcaggtacagttttgccttcttcgggcatgaagtcaggtggaggcggaggcgaagactctgaacattcagatctcgaggcttcagtggtgaaagaagctgatagtagtagagtggtagagcctgaaaagaggccaaggaagcgaggtagaaagccagcgaatggacgggaggagccattgaat

SEQ ID NO: 11011 - DNA, 660 bp, Lycopersicon esculentum
  Predicted polypeptide sequence is orthologous to G583
gtttctgttttttgtaaaattcttcaatttaattgaatgacggactatagattatggagtaataccaatactactaatacatgtgatgatactatgatgatggattcttttttatcttccgatccatcctctttttggcctgcttccactcccaatcgtccgactccggtgaacggagtcggagaaacgatgccgtttttcaatcaagagtcactacagcaaaggcttcaggctttaattgacggtgctcgtgaatcatgggcatatgctattttctggcaatcgtcagttgttgattttgcgagccaaactgtattgggttggggagatgggtattataaaggagaagaagataagaataaacggagagggtcgtctagttcagcagctaattttgttgctgagcaagagcatagaaagaaggtgcttcgggagctgaattcattaatatccggtgtacaagcttccgccggaaacggaactgatgatgcagtggatgaggaagtgacggatactgaatggttttttctgatttcaatgacccaatcgtttgttaacggtaacgggcttccgggcttggcgatgtacagttcaagcccaatttgggttactggaacagagaaattagctgcttctcaatgtgaacgggccaggcaagcc

SEQ ID NO: 11012 - DNA, 422 bp, Lycopersicon esculentum
  Predicted polypeptide sequence is orthologous to G583
tttcacaaaggagttgaatttttcgggttatggatttgatggaagtagtaataggaataaaactggaatttcttgtaagccggagtccagggagatattgaattttggtgatagtagtaagagattttcagggcaatcacagttgggtcctgggcctgggctcatggaggagaacaagaacaagaacaagaacaagaaaaggtcacttggatcaaggggaaacaatgaagaaggaatgctttcgtttgtttcgggtgtgatcttgccaacttcaacaatggggaagtccggggattctgatcactcagatctcgaagcctcagtggtgaaggaggccgttgtagaacctgaaaagaagccgaggaagcgagggaggaaaccagccaatggaagggaggagccattgaatcacgtggaagcgg

SEQ ID NO: 11013 - DNA, 385 bp, Lycopersicon esculentum
  Predicted polypeptide sequence is orthologous to G584, G1136
gctcaaggacttggacctagacgtgcaccacgctagtgtttgcgtggtgaatgatttgatgatccaacaagccacagtcaaaatggggagccggctttatgctcaagaacagcttaggatagcattgacatcaaaaattgctgaatcgcgatgaaattatgtccctagtgagctatgtataatgttatcttctaatgagcgagaattttcttctctgtatataaatgtgatgaaaccaatactagagatctcgagttgaggctttttagttcatgtaagattagatatatatatatgatgcagcttcatccttttgtattcttcatccaggaaataaatgagaaaccaataattggtggctgagaaaaaaaaaaaaaaaaaaaaa

SEQ ID NO: 11014 - DNA, 618 bp, Lycopersicon esculentum
  Predicted polypeptide sequence is orthologous to G584, G1136
tacgcgcttagagctgttgtaccaaatgtgtctaagatggacaaggcatcactccttggagatgctatttcctatataaacgagttgaaatcgaagcttcaaaatacagagtcagataaagaagacttgaagaagccaaatagaagaatttaaagaaagaatcaaggcgccccggtcctcctccaccaccaaatcaagatctcaagatgtctagccacactggaggcaagattgtagacgtggatatagacgttaagatcatcggatgggatgcaatgattcgtatacaatgtaataaaaagaatcatccagccgcaaggctaatggcagcgctcatggaattagacctagacgtgcatcatgccagtgtttcagttgtcaacgatttgatgatccaacaagccacagtgaaaatgggtagcagacattacactgaagagcagcttagggttagcgttgacatcgaaaattgctgaaacacactaaaccccttagaaaatagatagaaatcgtcgagggccatgtttaaattaaaatctctggtttctgctagctctaggtaatggtttttgtaaatgaaggtttgagatattaagacgaagactatctttcgtgtta

SEQ ID NO: 11015 - DNA, 955 bp, Lycopersicon esculentum
  Predicted polypeptide sequence is orthologous to G585
aagaatagcctttggagaccagaagttgatgacattgatagaaaccgtgttatttcagagagaaggcgaagagaaaagataaatgagagatttatgcatcttgcatcgatgctgccaactagtagcaaggttgacaaaatatcactactcgatgagacaatagaatacatgaaagagcttgaaaggagagttcaggagctggaggcgagatcagcaagacgatcaaatgatactgcagagcagacatctgataattgtggcactagcaaattcaatgacatcaggggatcactaccgaacaaaaggaaggcatgtgatatggatgaaatagaacctgaaagctccaatggattactgaaatgtagttcagctgatagtattgtcatcaatatgatcgataaggaagtctcgatcaagatgagttgtctttggagcgagagcttgttgcttaaaattatggaggcactgactgacctacatatggattgccatacagttcagtcttccaaccttgatgggattctatccattgctatcgaatccaagtcaaccggatcgaaaacactagcagtcggaacaattagagaagcacttcagagagtagtatggaaatcttgaagattagtcagtcaaggttggtcaattaagcccatatgaaaaagagcttggtcagtcctgtccttagtggatagttaaagcttgtgtatagtattgtacttatgcttttttcgaagatttgaaaagcctagggaaaaagtagtaatttggagtagctttctcctaatgcatcatcctctttcatgatcatcacttttttgtggtcctctaaaaagttcatgaaagtaaagttgctgaatcttgctattgatttctgtccccactaacaaagttgaaaggtcatctcaggaatggaaaaaagtttgctgtttgctttaaaaaaaaaaaaaaaaaaaaa

SEQ ID NO: 11016 - DNA, 698 bp, Lycopersicon esculentum
  Predicted polypeptide sequence is orthologous to G585
ggtcacggaatatcctaacctcattcagcaaataaaaaattggtttctagaggttgattactccgttattttgaagaggcctaattatgtctccaacgatgcaaaaaatgacacgaatatcggtagccaaaagcctgatcataatgcacttgaaaatgatgcttatccagttgaaataaattcacctcatgatagttcaaatggttttgtcgccaatcaagaggcagaagattcactgatggtggtagacggtattggggaaacttcacaagctcaaagctggaggttcatggatgataatatcagtaatggtgcgaataattccttgaattccagtgactgcatctctcaaaacaatgcaaattgtgaaaagttgtcccctctttcgagtggagagaaggaaactaagccttgcccactagaccgtcaagagaacgatcagaagaaaccgcatcttttagatcaccaaggagatgatgctcaatatcaagctgtcctttctactcttttaaagagttctgaccaattaactttgggaccacattttagaaatatgaataaaaagtcaagttttgctagttggaaaaccgatattcagatgccgagatttggaactgcacaaaaactattgaagaaggtacttcttgaagttcctagaatgcatgctggtgttatacataaattcaacagagaaaatg

SEQ ID NO: 11017 - DNA, 751 bp, Lycopersicon esculentum
  Predicted polypeptide sequence is orthologous to G585
ggaatatatgccaagttgtagcaagtctctatctttatgaggggtagctcaaaagggtgcttactacttagtcattaacattatccttgtgaaaaaatggctgttttggccttgtttcttgaaatctgaaactaaaaaattctctttgtatggtccaatatggttgtggtcctgagaactaagatcccatttgggatcaagattcaagatttatgctttcttggtgttttatgattttggtgtcgttttttagaattttgagctgattttttcttcactgtcattttggtgagacaaaagattgaagctttgaaaatggctatgggacaccaagatcaagatggagtcccaggcaacttgagaaagcaacttgctcttgctgttagaggcattcaatggagctatgcaatcttctggtcaactgcagttacacaaccaggggtgttgaaatggattgatgggtactataatggggatatcaagaccaggaagactgttcaggcgggggaagttaatgaagaccagctggggttgcatagaactgagcaattgaaagaactttatagttccctcttaacaagtgaaagtgaagaagacctgcagccacaggccaaaaggccgtcggcctcattatctccagaagatctcactgatacagagtggttaccagggaagaccttagcacaaatgaaactgtttggctgtgcaacgctcaccaagccgagagtaaagtcttttctcgttctttgct

SEQ ID NO: 11018 - DNA, 1020 bp, Lycopersicon esculentum
  Predicted polypeptide sequence is orthologous to G590
caaaaacccaaagcaacacgcatacgattcttctgagttttctgcagatgattgttttgtgatggtggtaattgtcaatggcggatccgtacagaacgaaccctcacgcttcttcatctctcgaatccgaagatatgtcttccttttttcttaattttcttcaaggaacgtccgcttcctcttctgcgactgctgcggctggtttttataaccgatcgggaccggcgccggtggctgagtcatcttctagcctcaatttctccgatcccggccgattttatgctgccgagttcaaggaaggcgttgagaatgtgtttgcttctgctggcctcggggaatgtgacggtatgaattcagctaataggagagagtttttggaagatgataaggttgataacttcggttttagtagcgaggaatgtgatggacttgacatgccatctgatccgactcatccacgttcttcaaagaggagtagatctgctgaagttcataatttgtccgagaagaggaggaggagtaggatcaatgagaaactgaaagcattgcagaacctaattccgaattctaacaaaactgacaaggcatctatgcttgatgaagccattgaatatctgaagcaacttcaactgcaagttcagatgcttaccttgaggaatggattgagtttatacccaggatatgttcccgggtctttgcagtcggtgcaacttccatctggtaatgaatttgatgggagaagttttatgctgagtgcaaatggaggagctacacttcctgtgaatcgagaaatgccacaaactgcatttgaaatttccaatcagaatccgtcaggcaaaccaacaataacctcacataacacagaaaacgctgtagctttagaaactacaattcagaatcattatggacttcttaaccatttagcatcttctaaggacatgtgccgagacaatacactatcaagattgcatttagatatgagttgctctggaaacaattcatcatcaggagtgtcgtctt

SEQ ID NO: 11019 - DNA, 651 bp, Lycopersicon esculentum
  Predicted polypeptide sequence is orthologous to G590
caaaattaacttgatctgctcaacactgaacttgattttgctggactataatggccaacaacaatgtttattatcacaatgctaatttttctttgactgatcctgatcctgaaccagatgatatttctgtgtttcttcgtcatattctacttccttcttcgtcttcgtcttcatcttcatctaattttatggccctgaagagtaatgaaatgcaatattcctcatcattacctcatcttatgcctaataataatcaacagggtaatttgtcatccatgatgaattcatcagcttgcggcattttctcgtcttcctatggggtttgtaatggtgcaactactgtttcttcctcatctgttgggaccatagattacgatccggatgagtatgaatgtgaaagtgaggatggtacagaggatttgggggcggaagcttcagttcaaccgccatctcgtaacacttccaagagaagcagagcagctgaagtgcacaatttgtctgaaaagaggagaagaagcaggattaatgagaagatgaaagcattgcaaaaacttattccaaattcaaataagactgacaaggcttcaatgcttgatgaagccattgagtatcttaagcagcttcagctccaagtacagatgttgacaatga

SEQ ID NO: 11020 - DNA, 737 bp, Lycopersicon esculentum
  Predicted polypeptide sequence is orthologous to G591, G793
ttccatttcagttcctcaaaacccttaacttcttctcgccgggaaaaaaattaatttcgccggataaatctccggcatggcagcaaaccaaccggaaggctatgccgacgatttcctcgagcaaattctcgctattcctccctactctggcttgccggttgctgatgttggcactccatcagagacgacgtcgtttacctcggcgtctgccgtatctcatcttaactctgccgctgctgctggcctacagcaacctttgtttccgctgggattaagcttggataacggccgtgatgacgtcggcgatgcaggtccttatgcagtgaagcatgaaagagatggaatgaatatcggaaatctatatgcaggtctagaacacttgcaatctcatgcagttcgtcactctgtgccttctgttcaccatgtccagccttttcaaggcccaccaacaacgagcacaacagtaactgtgccacacccaccttcaattcgtcctagggttcgagctcggaggggacaagccacagatccacatagcattgctgagaggctgagaagagagaggatatcagaaagaataaaggctttgcaggaactggtacccagctgcaataagacagatagggccgcaatgcttgatgagattctggactatgtgaagttcttaaggcttcaagttaaggtactgagcatgagtaggctgggaggagccagtgcagtggcacaacttgttgctg

SEQ ID NO: 11021 - DNA, 652 bp, Lycopersicon esculentum
  Predicted polypeptide sequence is orthologous to G591, G793
tagagagaggatagcagaaagaattagagcattgcaagagttggttcccagtgtcaataagactgatagagctgtaatgcttgatgaaattgtagattatatcaaattcctacggctgcaagtgaaggtgttgagcatgagtaggttaggaggagctggtgcagtagcaccacttgttacagacattccaatatcatcagtagaggaagagagcagtgaaggtggaaataataaccaaccagcttgggaaaagtggtcaagtgatggcacagaaaggcaagtggctaaactcatggaagaaaatgttggtgctgcaatgcaatttcttcagtctaaagcactatgtataatgcctatttctcttgcatcagcaatttatcactctcagccaccagatacatcaagtcttgttaagccagaaacaaatcctccttcatagatgaacacccttatagaaaaaggtgacataacatgctaatgaccttaaagaattttcttgcagtggatggttcctacttttatctattcaagtaatatttagctttttgttgaaaaaacagggttcttttttaaaaatatttatgtataaagtaaaccattttctatcatttatatatttgagtaggttttgttcttaaaaaaaaaaaaaaaa

SEQ ID NO: 11022 - DNA, 1339 bp, Lycopersicon esculentum
  Predicted polypeptide sequence is orthologous to G591, G793
gctcattttccgttcctcttaaagctcaataaacctatacgccggcaaactccggcatggcggacaacccaccggaggtatatgctgccgatgattttctcgagcaaattctggcgattccctcttatgctagcctgccggtaactgatttaaccgccggtgcctcatcggagaattcaacatctggtgtctctcagctccagcagcagccgttgttcccattggggttaagtttggataatggctttgctgacgccaacaacactggaggttttcaagtgaagactgaaagagaagcaatgaacatggggaatttgtatccaggtctagaacatttgcaatctcatgctgtttgcctaagtgttcctcaagttcaccaagtccagccttttcaaggccaccctacatcaagcgcaatagtaacaataccacaccaacctgcaattcgtcctagggttcgggcacaaagaggacaggccactgatccacatagtattgctgagcggttaaggagagaaaggatatcagaacgaataaaggctttacaggaacttgtccccagctgcaataagaccgacagggcagcaatgcttgatgagattctggactatgtgaagttcttaaggcttcaagttaaggtactgagcatgagtaggttgggaggaactagcgcggcggcacaagttgttgctgatattccattgcagtctgttgagggagacacctgtgaaagtcattccaaccagcacgtctgggagaagtggtctgattctgaaacagagcaagaggtagcaaagctcatggaggaagatgttggaacagccatgcagtaccttcaatccaaatcactctgcatcatgcctatttcacttgctgcacttatctatccgactcagcaaagtgacaaccaatcaatggtcaagccagaacaagcggccccattgtagacttctaaattactgcagtagatagctagcgatgtattataaaagaaaattgtcccagcttgcatttggtggactgtgcggggagaaagaaaccaagtttgtttgaagacaaagccattagtatacagaaactaaagatggaatgtttagggcttttctttttttggtgtaaccatagcttaatggatgatttagaatcaacttatgatgtactagattccttgtgagaagattaaggattaggagcttcttcatttctttatttctgttcttttgctcatctggatgtatatatgggggattacacaccctttgtgtagtttgttattaatacacaaaaatgttacctgttccctctctctctctctctctctctctctctctctctctct

SEQ ID NO: 11023 - DNA, 495 bp, Lycopersicon esculentum
  Predicted polypeptide sequence is orthologous to G591, G793
gatttaagcaaagctttaggtgactccctttcctttattttcttcatggctctcactgctctttagaaagtagcaaaacacacacacaaacaacccaaaacacacacttccatttccattttttgcctatatatatatatatatatgtaacaagtacttgttagagtactaatttgtacaccctcttatcaattccgttgtaaagaacacttttttaactagtatttgttcaattgaatgcttttctgaggaattaaggtggtcgaaaacagctccgatccaagaaagattgaatctttatagtttctgctatggctaacaacccttctgagggaccttctgatgatttctttgaccaaatcttgggatttcctgcttacaatggagcagaacctaatttggcgggaaatgatgccggagctataccgccggcgatgatgctccagcttaactctggtgatgggtcaagtcagtttactggagtgggtcttgggg

SEQ ID NO: 11024 - DNA, 1149 bp, Lycopersicon esculentum
  Predicted polypeptide sequence is orthologous to G592
gctcatacgccatttttccttcttcttcttcttcgataaaattcgaaaaaattgaagctataattccaaaaaagatattattagaatcttgattatgtttagctcagagccaatatctagagaaatggataagttgaatagtttctttttttccggtggtggtgggggttcttcaagcttcaaaaatggtgaaggaatggagtctgagttctttaggagcaaagaaatgatgggttctgatttttttcagcaacagtcacagtttcagcagagtaattccggtgggttaacgaggtacaggtcagctccaagttcgtttttcgccggaattcttgacggagacgggaataattccggtgaaaatttcattaccggtgatgggtcttcgagttctgattcggattccatgttcaccgccttattgaacaataacgacaccaccaacaacaatggtactcgagatatgaatgatcaaaaccagaagaatcagcttcagtttggtacttctttgaaacaggagattggtgaggagattgaatttgggaatgaaaatggtgtacaaaatagatatgagaacggtggtgtttcttatagtgtaggggtgcaaatgcaaactagagcaaatttgagtaatggaaatggtgactctgatctcatcagacaaaacagttcacctgctggattcttcaatggatttatgagagaagttgggaatttcggagcaagtgttgggactaacagggaagcaagtacatcaactaatggtttcaacaatcatataagttactcaactaatcaatcatctacctcaaacttcatgcctagcattgctgagaatgaatcttggaacgacgcgtcgtttaattccttgaagagaaatagagatggtgatctgaaaatgttctctactaatttcaatggaatgactaatcagaatgacgaatcaagaaactacacttcttctggtttatctcatcatttaagcttgcctaagacatcttctgagatggctgccatagagaaatacctacagttccaacaagattcagtgccttgcaaaatacgtgctaaacgaggctgtgctacgcacccacgaagtattgcagaaaggatgagacgtactcggattagtgaaagaatgaaaaaact

SEQ ID NO: 11025 - DNA, 882 bp, Lycopersicon esculentum
  Predicted polypeptide sequence is orthologous to G592
gagaagtatcattttccaatccaagcaggtttagtagtcaaacagctctcccatccggccaacctacttcttcggggctattagctccaatctctgaatttggagctaaaagcatagaagagagcagacgaggccatgaaagttttggtaaaggccataaaagtgatgagagttacatggcaggtttcgccttgccttcttgggatgattcacaaattttgactgatgatttcctacaagtaccagaagatgatgagtccggatcattctccaatgtaaatgcatctgataatcagagtagtgaaggtcgagctcgtcctcccactctattatctcatttgagtttacctcaaacatcagcggagttatccgccatggagaagctcttgcaagattcagtaccatgtaaagtcagagcaaagagaggctgtgccactcatcctcgtagcatcgccgaaagggtaagaagaacacgaataagcgaaagaatgaggaagctgcaagagcttgtccccaatatggacaagcaaacaaacacagcagatatgttggactttgcagctgactacatcaaagaactagagacacaagtcaaggcactatcggaaacgcgttcaaagtgtacatgcttgcatgaatagaagaccacattcaacatgataaggtagggcaatgctgtgcacattctagtgggataaaaaaaaggacttgacaatggaaatagcaaagcagataggtggattctttttggtacttgaaaaagaagagaatgggttgccatattttgggtgtgtaaaaaagatagattcagattcatctgatgtaacattataaataacctaaactgtacataaaatttccattgtccatttctcttggcct

SEQ ID NO: 11026 - DNA, 441 bp, Lycopersicon esculentum
  Predicted polypeptide sequence is orthologous to G592
ttttttttttttttttattactctttccaatcgatattatttgtcttataaagttttgaatcaactaataacatagttaaattccaataaacaacagcataatacaataatcatgtgctcctatacatctagattgtactcactagactgttattagatctaatcaaactcaataatacattgaaaactacacttgccttgttgcaaaataaaaacaaagtagaaccatatttccagcatattagggtagaaagagagtttatttactctccttttccatctaacttcacctattactatctgtacacaagactatttcatgttgttccatttgaatattgcagctgcttacttgtacacgagcatttcgcctttttatcggtcagtgtctggacttgtttctgaaggtctttaatgtaatcaactgccaaatctaacata

SEQ ID NO: 11027 - DNA, 784 bp, Lycopersicon esculentum
  misc_feature (337)..(337): n is a, c, g, or t
  Predicted polypeptide sequence is orthologous to G592
gaatgttgctggtttttttttttttttttttactctttccaatcgatattatttgtcttataaagttttgaatcaactaataacatagttaaattccaataaacaacagcataatacagtattgatgcgctcctatacatctagattgcactcactagactgttattagatctaatcaaactcaataatacattgaaaactacacttggcttgttgcaaaataaaaacaaagtagaaccatatttccagcatattagggtagaaagagagtatatttactatcctttttcatcttagttcacctattactatgtgtacacaagactatgtcaagttngtccatttgaatattgcagctgcttacttgtgcacgagcatttcgccctttttatcggtcagtgactggactcgtttctggaggtctttaatgtaatcaactgccaaatctaacatataggtgtgctgtgctgcttgtcaaaatgggaaaagatctgcacatttgaatcttgcactaaggagtgccgccaacctttgcattcttcggggtgcgtgtcaactcagcagtcgagcaacttgccagagttgtgggctgagactttaacgatctgtaatggggtttgggctcaagtacatacatttcggtgtttcacacatggagttctcaatgaacttgagttgaggttttgtttttagatttctcgtatagtttttggaaatgtgtaaaaaaaaaaaaaaaaaatggacctggggttttcacccctaaaatctttaagggggttcctcg

SEQ ID NO: 11028 - DNA, 525 bp, Lycopersicon esculentum
  Predicted polypeptide sequence is orthologous to G592
ggaattactctttccaatcgatattatttgtcttataaagttttgaatcaactaataacatagttaaattccaataaacaacagcataatacaataatcatgtgctcctatacatctagattgtactcactagactgttattagatctaatcaaactcaataatacattgaaaactacacttgccttgttgcaaaataaaaacaaagtagaaccatatttccagcatattagggtagaaagagagtttatttactctccttttccatctaacttcacctattactatctgtacacaagactatttcatgttggtccatttgaatattgcagctgcttacttgtacacgagcatttcgcctttttatcggtcagtgtctggacttgtttctgaaggtctttaatgtaatcaactgccaaatctaacatatcagctgtgtttgtttgcttgtccatatttgggaaaagatcttgcagttttttcattctttcactaatccgagtacgtcttatcctttctgcaatac

SEQ ID NO: 11029 - DNA, 644 bp, Lycopersicon esculentum
  Predicted polypeptide sequence is orthologous to G592
ccgcttctcaccaccttcgttttctattcctgattgtgttgattgaatggcaatttccaggctatgctacgttgaaaggcggtgctggaggttatagaatggcaactggtgccaatggagatccaaatccatcttcaagcaggttgaaagatcattttggcttctcatcagtgacaccttcttcattaggaatgttgtctcgaatctcagaagtcgatgatgagagcagcatagcaactgatctcgatgatgatgagaagcgtggaaatggcaactcagaacctcaactctacaatatgggatttccttttaattcttggagtgatcattcacagtttcagcagacactcacaggccacaaaagggagttggatagtgaggggaataagctatttgctaatgctcagattgaagagcttggaaaccggcccccaattttgtcacaccacctaagtttaccaaagacaccagctgatatagcagctatggagaagttattgcattttcaagacactattccctgcaagatccgcgccaaacgtggctgtgctactcatcctagaagcattgcagaaagggtatgacatacacaacatatttatacatatgtacctatatgtgtagacaatcttctaattcttggg

SEQ ID NO: 11030 - DNA, 475 bp, Lycopersicon esculentum
  Predicted polypeptide sequence is orthologous to G594
aaacattttacttctctgctatcactatttcgccgagtttcgttacagttgtttgcaaacatgttacaaatgagtgttcttgaaagacaaagagcagtgttggaacgtatttataatcattctaagcagcagctttcttctctagtacctcaacaagaacttgctcatttgattaccggctgcgttcaggggaattttaacatgtttggcgggggagattctaattttgttaattttcaagaaatggctcgtccctctttctccacaatatcgaattcatcgattacaacagtgtctccgccaccagagaaagaaagtgacttaagtagtatgatagctccaagggaaaatgttgtttctaccaagaagagaaaagcagagtttattgaggaagaggattgtgagaaaagcccggggaatgattcaaaggagaattcgaagacgtctgaggttcaaaaacctgattacattcatg

SEQ ID NO: 11031 - DNA, 1494 bp, Lycopersicon esculentum
  Predicted polypeptide sequence is orthologous to G597
gcggtgaatttggggggaaaaatcgatgaaaaatgtcggtaactgaggcaggtagtggagtaatgacgagtagagatcatttcagtgttgccggagttcaaaattctccgtcgaatgttccggcaacgacgccggtggttcagaatatgcatttgggttacagagatgaaaatacggctgtgtttgccccgccaccgtaccagtcggctgaaggttctgccggagctgggacatcgatgttgcagaacttgaacaataattcgtcggagccgatgaaacggaagagagggaggcctaggaaatacggtccggatgggtctatggcattgggattgaatccggctgcttcgccggttggtggtggttctcttggcggtagcttgtcgccccgagatccgggtaattctgctggtgctcagatgcattctggaggaccaggttcgccaaattcgtcgaagaaaggtagagggagacctcctggatccggcaaaaaaacagcaaatggacaatcttggatcaacaggatttggattcacaccacatattatcgctgtgaaaccaggagaggatgtggcatataaaataatgtcgttttctcagaatggtccaagggctgtgtgcatcttatctgccagtggtgcaatatcatatgtgactcttaaacaaactgccacgtccggtggaacggcaacatatgagggacggtttgagattttgtctctctctggttcatttatgctgtctgacattggtggtcaacaaagcagaacaggtggattaagtgtatcattagctggatctgatggacggattttaggcggttgtgtggcgggtgttctaacagccgcatcaccagtccaggttatcgtaggtagcttcattgcagatggtcggaaagagccaaaaacatcaaaccattttgaggttttacctgctccgttgaatgccaatcttggtgttggtggtggtttgacaggggccaatagcccaccatcacgaggcacttatagtgaatcatctggtggaccaggcagccccataaatcagaggggtccagtatgcaccaacgataacctgcaaggaatctcaagcatgccttggaaatgagttattaacgctctcttttctgaccaattgaactccgtgtcatcgactagttcactgaagaagactccaagtgaggattgttgtaattttaatcggtgtaatcgtagttgtgcagaaataaggttcacagacacttcttacctcaagttcaagaactggtgagaaacgtcgatttgctgatgcgtagttgttctgcattttctgtcttgttgatttaatttcttgtatttcatcagtcataggacatggtttggctttttttgttctatctagtaatcacttactcatattagccatcttccaactttagagtgtattttattgcaattctgtgatctagaataatatcaattatgtactttttaaaaaaaaaaaaaaaaaaaaaaa

SEQ ID NO: 11032 - DNA, 826 bp, Lycopersicon esculentum
  Predicted polypeptide sequence is orthologous to G597
gcttttgttgattccaatggagttcactcatcaatgcagaacttggtatcatcagatgctgctccgaccccctactaccctatcatgccgtcgatgccatctccacctccggcggcggagatttatcaagttcccacccctggctttaccgttcctcttcccgatctatcaggggtagcactccctaattcaattgaaccggttaagaggaagcggggaaggcctaggaagtatgctccagatggttctgccaactccgggatggtctctcctccatcggcggcgcagtctgccggtggattttcgcctacggagggaggagatgtaccgttgcggaaaaagggtaggggcagacctcctggttctgggaggaaacaacaattgggtgatttaggatctgcaagtgctgggactggattcaaaccacatattatcacagtacaagcaggggaggatgtatgggcaaaactaatgtcattctctcaaagtacctctcaagctgtctgcatcatgtcagctaatggctccatatctaatgtgacacttcagcaagcagcactgtctgttggaaatgtagcatatgagggtcagtttgagatcctgtctctgtctggtcactttctaccatcagaatctggtggcgagcgcatcaggacaggtgggtttgggtgtgttactagctggagcagatggccaggcactaggtggtggtgtggcaggagttcttactgctgcatcggctgtacaggttattgtaggcacttttggtatgcaagggcaaaagcagttgaaattggataattctgatggttttggcgtgccatcc

SEQ ID NO: 11033 - DNA, 361 bp, Lycopersicon esculentum
  Predicted polypeptide sequence is orthologous to G598
tttttttttttttttttatataaatttaaaagaaggaacgttttgttggagctctaccaacagctctcatcaaattggctaattcaacaactctagctacttttgttcctctttttgcttctgctgatgcctttctttcctctgcttttcttcttgcatttgctatatcattttgcatcttttctagtgcttttgctcttttttcctctaacttcctctcaactttcttcatccatgaagtagccttttggacttcttcattttcccatccattaatcacagcatcttcacacttaaacctattattaatctttgcaatttttgcagtttgccatgcactaatctttgattcaacttccct

SEQ ID NO: 11034 - DNA, 1236 bp, Lycopersicon esculentum
  Predicted polypeptide sequence is orthologous to G600, G2768
gggaaaccctagttccggcaccccccataaagctttactcttttggctttcttttcagttttccgttcgatccgcttcggaattcaacggacttttcggcgagttcaccgtgcgcgaagaggaattgacgatttccggtagagaaacctctcctgttatctgaagaattgtcggtcgacgggcggtcggttggtcgtcgctgattggattcgattcaattcaatcgatctgaagaatccggtgttctataaacccatagaaagcttctgagtttatcggatagaatcatcaacctcttcaagggtatccgctaagagagacgcccggcgtgattagatagatcggatcgagatcgtccccagtcgaaggagtagcggtagcagtggtttgattttggttataataagcttgcctttagatattgctgctgacggaagcttgcggattattttgctcgtggaggatgttcctactgatctattggaggaatttggtttgactgattttcttgagttattgaagagaagttgtgagctagaaaaaagagcttttaatatttttgtactttatatcaattttctttgagttcaatatcaggcctattatgattttttgatcggcctcgttgttgttatattgtttttgtttgaggaaaaaaaggaattttaagaaaaaaggagctatgtcagtttattttaagtttaaaagtgcgaaagattatgattcaattccaattgatggtcactttattactgttggtaatttgaaagaaaaaatatttgaatccaagcatctgggcaggggtacagatttcgacctcgttgtcaccaacgcccagtctaacgaagaatatcttgatgaggacaccttgattcccaaaaatactagtgttttgattcgtcgcgttcctggacgacctcgcatgcccatagtaactgcacctgtaacagaaccagacgagccccaggtagaataccgatctgaggaggctcaagcagttagaagtaattttgtgggaggggagtcatctgccaccaaatatcctgaagatcttgaatgggatgaatttggaaatgatctttactctattcctgaaacaatatcagtacagtcaagcaaccaagtgcaggatgctcctcctccaagtaaagctgatgaggagagtaagatcaaagctttaattgacactccagccttagattggcagagtcaaccctctgatggctttggtgctgg

SEQ ID NO: 11035 - DNA, 332 bp, Lycopersicon esculentum
  Predicted polypeptide sequence is orthologous to G600, G2768
ttttttttttttttttttttttttttcctgcctccccaactacaggcttttgctgaacctcttcatcagccaatggagcactccccggggatacaggttctttaacactgacggactcgtgtgtagcttcagaaacatctgcaaccttcaaagttcttcctctttccaacatttgctgagaagcactgccattcttaccctcttctgcaatctcctgggctttagaattttcctccttaacaggtggaggaggtggtggtggtggcaacggctcaccccttgaagctgcagattgtgaaggagatggaatctttggtgggagaatgcgcgct

SEQ ID NO: 11036 - DNA, 533 bp, Lycopersicon esculentum
  Predicted polypeptide sequence is orthologous to G600, G2768
ctagcaaaaatatttcagttatggcagtgtatatcaagtataaaagttgtaaggattatgattcgataccaattcttgatcattttatttctgtgggcaatctgaaatcaaagatatttgaatccaagcgttatggttggggtaaagatttcgacattcttctcaccaacctacaaactaacgaagattatgttgatcatgccaccttgattccaagaagtacaagtgttttgattcgtcgcgttgctggattaccttgcttccccattgtaatcaaagaggagcccaagcaagtgctgtgtaaacaggaggaggttcattcagttaaaaaagagtccaaatattctcaagatattgattacaatgattttggcgatgatgtgtatgtaattccaaaaatagcagtgccaattcaattaggcagtccagagtccagttgttctagtagtataatcaagaattcagtaggaaacatatcgtataataacacaagatcagctggctctagtgttggacaaggtagaacggaatgg

SEQ ID NO: 11037 - DNA, 621 bp, Lycopersicon esculentum
  Predicted polypeptide sequence is orthologous to G602
ttgcaactgagaagaggctatcactcatcaaagcatgggaagaaagtgagaaatcaaaagccgaaaacaagtatgtatctgttcaatttcacatacatgtcgtctattgatgatgcggtatgaggactaatagtatacatgaattggtttagcttgtgaaggaacgataattgtaggaatcattgttgactgcaattcaaaatcaaacaacaaataatcaaaagaagtttcggtatagtaggaatttgagattacaagtcttgctcagaattaaaatcttgttggttactcttcagagacatttccttcacttggtcatttcatttgcacacatttgatcattcccttttgccctgaacttgagagagagtaattaaaattttcttcatacgatgaggtactaaacgacagtatgtgccaattgccaattgttgtgacaatgtgttcattttgcttcattaacaatcttcttttgtcgttttgagatgactatatattttttcatttccgtttatttgttgcaaaatttgcataaatatatggagtatgagttgtgtgctgctaatattgttttttgtaactgctattatctatcccatggacctgttcattgagaaagcc

SEQ ID NO: 11038 - DNA, 653 bp, Lycopersicon esculentum
  Predicted polypeptide sequence is orthologous to G605, G1944
ggagcagtttgcaaagcattaatatctgctgaaaaaaatggagtcaagggaagctatagctccagaagctccatcaaactatcatatggtatctagaacagaatctactcctataccacctggtacattggcggtgattccccctccggtggctaccgcctttccaattagctcagagaagaagaaaaggggacgtcctaggaagtatgggcctgatggagcagttgcaaggacaatttcacctacgcctatttcagcagacttcttgtcgaagaaagtgagtgttgcccgtcctgaatcggagaaaaaggctcgaaacaaagtgggagctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcagggggaactctaacttatgagggtcgatttgaaatcctttctttgtctggatcctttactccaacagagtttggggggttctcgtactactagcagaaccggaggaatgagcatttctttggcaagtccggat

SEQ ID NO: 11039 - DNA, 684 bp, Lycopersicon esculentum
  Predicted polypeptide sequence is orthologous to G605, G1944
gcggacatactgaggaaagttagcaacccctaaattagtttttatttttattcttttaataacttatcaaaaactccatatttcacattttctcaagaatctcattacaataaagcctaaaaattcaatgttttccccataatttcatcttttaattctgaaaaaaatcttaaaattttcaacaaaaaattctgataatttccatcttcatttctgtttaactttcttgttttcttataagctctgtttttctgctaaactctggttagacttcaaaattaccactaattaagctttttttgagaatttttttttcttggtttcttcattgaaggaaaattatggggttttgaagaaaaaaagagggaaattttttaattttttttggtgattttttttttttttgggctatggaggggagtaacagtggagttacagtagtgggatcagatgctccatcagattaccatgtggcagcaaggaccactgagaatccgacaacacagactgtgacatcccagattgttgttgtttcaccaacgccggcaatagctgtgtctgtcggcgccggcgccggcttaacagctctgagtgtgaaaaagaagagagggagaccaagaaagtatgcaccagatgggtctgtaaatgttctttctccaaagccaatttcattatctgttccgt

SEQ ID NO: 11040 - DNA, 503 bp, Lycopersicon esculentum
  Predicted polypeptide sequence is orthologous to G605, G1944
aagcttagcagaattttgtaaaatttgatggttgccgttagttgcgcatgcttagctgtagagttaacaatggcggcttcagatgcttcatcagactatcacatgactggatctgctcaaccaggagcagcaacccagtcgggtgcagcacggcagtgaccactcccaaagaagaagcgaggtagacccagaaataatggaccaaaagggtcagtggccacgccaatttcatccgtcgcaccttttctcaggtgattgatttttaggcgaaagtccagccagttgggtcagctattacagttgtatcagcccaagttgatgttgagaaatgagaagtcagcatgaaggttttatcattttttcaacaagggtctcggtcaatgtgtattctctcagcaactggtgtaatctctagtgtcacatttcatcaaacagatacttttggtggtaaagtgacatttgagggccggtatgatttacttacttccgctggatcatatgct

SEQ ID NO: 11041 - DNA, 620 bp, Lycopersicon esculentum
  Predicted polypeptide sequence is orthologous to G605, G1944
cagatttcaccaactctctcaagaaattttgaaagcacaataaaaattagcaatacatattttctttccattttcataaaattattttgtttttttaaagctctgttctttcttttgcagtaacagagtatcagttagtcattagttttccagtgcacatggtcagatgatctttctgtagatacaattaagtctagcatttgcagatttctgagtttgtacttttcttggtatttttttgcttgtattagcatttgaaaaaagattgtatttttattatatttgttattatggggttttgagttcttgaaaaacaaatatatttttgctgttttgggagcttatgttatttggagttgtcttcagggtttaaggggttttgagttcttgaaaaaaaaaccattttttgctgttttgggggattaagtgatttggagttgtcttcagggtttaagggggcttgagttatttggggtttaaggggttttggttgttttattattgtgtatatgcatggaggagaaagaaggagttaatggttcaggggttacagttaaaggtgatgaagctccagagagctacagagtggctcccaggagtgaaagtaataatattgagtt

SEQ ID NO: 11042 - DNA, 541 bp, Lycopersicon esculentum
  Predicted polypeptide sequence is orthologous to G605, G1944
aaatctaaattgaaaatcacaataaaatggtccaaagtacaaaatgtagcatttaattaagaggatgaatatgcctgttaaaactagacataaacccttaaaacactaagaacctagaacatggtaaccttcgtaaccaaagcgttatgacaacatcatacatctaaaactagtttggatttactgaacagacctcaaacaaacatcaaataggaggtgagaaggatcaatatgaacttcgttaaagacgcgtagtccttatggtctagtaaaatcacattcaaatttcaccctatgctggaagagatacatttatttcagctggcttattcctagaatcaggagctgaccaattatctacgcggaaagaagaggaagttggtgtagtttgttttactgaggactgataagggtcttccgtctcgggtagaggaacagcagcaataatgggctctggtttgtttttcttggttctctgctcatgttgatctccagcaagaaagctacctataacaatctgcacaggactggcagctactaa

SEQ ID NO: 11043 - DNA, 479 bp, Lycopersicon esculentum
  misc_feature (474)..(477): n is a, c, g, or t
  misc_feature (479)..(479): n is a, c, g, or t
  Predicted polypeptide sequence is orthologous to G605
cagcgaatccagcgccagcgcggtctcaggctcctccacctcctgctgctgctcccagaccaatgtcgacaggacctaagaaaagaggtaggcctaggaagtataactaaaaaaggtttgatttttatggtttgtctcaagaattttgagtcttatggagattataatgcttagtttgatcaactcgactggaattgaatgatcgatcgaatcttgtagtaagttgagtagtgagcaaaagtagttgcttttctttactcatcatatgaagaagtatataactgcagaactgtgctgtagcttgttcttgatagatgccttgtgtttgtagaaatttctcgttgttggtagattttctgcggtttgtaggtactatatttattcaattgtcaagactcgtagtcatagactcgttttgtaattgaatgatctttatgccaaatttcgaaattctaatttctgtctcgttcacannnnan

SEQ ID NO: 11044 - DNA, 1661 bp, Lycopersicon esculentum
  Predicted polypeptide sequence is orthologous to G611
gagatccagacgagcacattgatagcaaaatgaagcatggagtatcagattctataaacacaactttagagaagtcaaatctagttttggatgaccaacaagattcttctggtaagagaaggaaattgtcactccctactgctgttagtgtggcagcagaagatggatctgagagcaatgggatgtctattagcaccaatgattatgtatcacattcacaagcaccagatcagtctggctataatcatggtacttctttgcatgagactggggacaatgtctcaaatgaaggagaggacactataaaggaaactgtgaagcatgcatcctactccaaaaatttaccagaatggaaacccctagagaaagaactatatttaaaggggatagagatatttgggagaaatagttgcctaattgctagaaacttacttcctggcttgaaaacttgtatggaggtatcctcttacatggataacagagcagcggcgcaacgtggaggctcctcaagcttattttcggaggataatgggaaagctgacatggattacatggagctagatattccgacgaaatcacgttttcttcgtagaagaggcagaacacgcaaactgaaatattcctcaaagtcttctgggcatccctcaatctggagaagaatggccgatggaaagaatcaatcatgtatacaatataatccatgtggatgccagccgatgtgtggaaagcattgtccttgtttgcagaatggtacttgctgtgaaaagtattgtgggtatgttgagcgtttgaatttatcaataaaggatttcgtctttgacttgttaagtcagatgcctctccagtccacctttttctcttctatttttctcttttaactacttccatgccctcctgtaaagcttgttctcttgcacccctctcctcctggattcgttggttgctctgtttaattctatgaattgatcatttgtgctcaccacagatgagagtagtccagtgcatcaactctttgttgcatttaccatacattgaactctggcatagttgaacaggactcaataaactagaataattatgtcctcaattgcattcattttcatgtgaaagaagactacagctcgatgtccttgactgttttcgttgttaaaaaagttgttcaacttgatgtttgctctatttttttggtttgcttagggctagcggggaactcatttgttcgctttccgatattattttaggaacctgtcatatctcctaatatctcttcttccattttagctgctcaaaaagctgtaaaaatcgtttccgtggatgtcactgtgcaaaaagtcaatgcagaagcagacaatgtccatgttttgctgctggacctgaatgtgatcctgatgtctgccccaattgttgggttagctgtggtgatggctcattgggtgagcctcctaggcaaggagaaagtcaatgtggtaacatgaggctcctcctaaagcagcaacaaaagattctgctgtcaaaatctgaagttgctggatggggagccttcctgaagaaccctgtttacaaaaatgattacctgggagaatatacgggtgaattaatttctcatcgagaaacagataagccggggaaaatatatgatccgtgcaaattcgtctttcctt

SEQ ID NO: 11045 - DNA, 552 bp, Lycopersicon esculentum
  Predicted polypeptide sequence is orthologous to G611
gatcttctccatctccatctctgctgaatctgcgcccacaccgactaagttcgatggagaaaatgaagaggattcttcagcatctctaaagtacagaatcaatcagctgaaaaggcaaattcaaacggacagagttctttcagttagggacaaacttgaagagaacaaaaggaagctagaaattcatgtttctgaacttcttatgttggctacatcaaggagtgatactatgaagaattctgggactggtaaaatgctttctttaagaatatcaagtcccctctgcaaagttgttggacttgttcaaggttcaggagacagggactatgctaatggagaggaagtcgtatcttcagtaactgctagacttcccttcattcagaacattccaccatatactacttggatctttttagacaaaaatcaaagaatggctgaagatcaatcagtggttgggagaaggcggatatactatgaccagcatggtagtgaggcactaatctgtagtgatagtgaggaagacatagcagaaccagaggaagagaaacgtca

SEQ ID NO: 11046 - DNA, 487 bp, Lycopersicon esculentum
  Predicted polypeptide sequence is orthologous to G611
gataactagaattgcttttgaattagtggctgctcatctccggacaccatacgatcgatgtttattccgtaagcgccgacacgctcgcgcgaaaaaactccaaaatcttacggaacatgacggtgatgactggcgttctcactgttccaatgataatttgccgtccaaatattcctccgatcgtccgcctccgcaacctttgcctttgccggagctgcatcttgtgcttcgccacgaatccgatgcggtttcgaatgaacccaatgtaccactgccatcgccctcagacgcgcatttgcatcatagaactggagaggattcttccacccgtaaggatggtgtagcatcccatggaagcagattatcaagccaagatggtcgaaagaagaaaaaagagcacttgggaagtcgcttgtctaggaagacacctcaaaagcttcatgttgctgatagagcttctgatatcaggatcagcgcacccattagt

SEQ ID NO: 11047 - DNA, 700 bp, Lycopersicon esculentum
  Predicted polypeptide sequence is orthologous to G611
gggaaactttaatttgtagtgatagtgatgaggaagtacttgaagaagaagaagaaaagaaggtgtttgcagagtctgaagattatatgctgcgaatgactatcaaagaagttggcttgtccgatattgtgttggatttgctaggacattgcttgtctagaaagcctagtgaagtgaaggcaagatatgaagctcttgttaaggcagatgatgtaggcacttcgaagaatgagttcacggaaagttctttagatttatatcttgccaaagatcttgatgctgctctggattcttttgataatctattttgtcgtcgatgtcttgtctttgattgtagattacatggatgttcacaggatcttatatttcctgtacgttattggtcttccgacagatgtttcattaccttggaactgtgtgtactcgaaatgggatgcttatgatgtctttttacattaattaggcggaaaaacaatcaccatggtactgctccaatgcagatatggagccctgtggaccaaattgcttcagcctggccaaaaagttcgaaagtaatggctacagtgatctctcctcagtgtgctagtcatggagaaaaatccattctgccatctgatgttgctaataatactcagatgccaggtaggaagcatgtatcaagaagatcaaagtcttcaaagggtgaaggtgctccaaatgc

SEQ ID NO: 11048 - DNA, 616 bp, Lycopersicon esculentum
  Predicted polypeptide sequence is orthologous to G611
gaaactacttctcaaacagcaacagaaggtacttctcggaagatctgatgtttctggctggggggccttcttgaagaatactgttggaaaacatgaataccttggggagtacacaggtgaattaatttcacaccgtgaagctgacaagcgtggcaaaatttatgatcgtgaaaattcttcatttctcttcaatcttaatgatcagtttgtgcttgatgcacaccggaaaggtgacaaactaaaatttgcgaaccattctcctgttccaaattgctatgctaaggtcatgatggtggctggagatcacagagttggtatctttgctaatgaaagaatttgcgctggagaagaactcttttatgattatcgatatgagccagacagtgcacctgcctgggcgaggaagcccgaggcatctggtactaggaaagaggatgctgctccttcaagtggtcgtgctaggaagcatacataattgagtgcccatttaactgattttttgatccgttaattctcattcttttgcgcaactcatcattgacgaccaccagatagagcttctaatcattccattcctggagaggccattgccatctccatttaactgattatagac

SEQ ID NO: 11049 - DNA, 706 bp, Lycopersicon esculentum
  Predicted polypeptide sequence is orthologous to G616
ggttaagagatagacgtgttcgcctttctgtcaatactgctatacagttctatgatttgcaagaccgtctcggctgtgatcagcccagcaaggctgtcgaatggctgctaaaagcggccgctccttctattgctgagcttccacctcttgaggcatttccagacacactgcagctgagtgatgagaaaaagtcaagtgagcagggttttgattcagctgatgtggaaatggatgatgatcttcattataatcagcagcaacaaccttgttgtagcaattcagagactagcaagggttctggattgtcactttccagatctgatagtcggctcaaggcaagggagcgagcaaaggaaagggccacagagaaagaaaaggaaaaagaaaacaagtcttgtattgttggtcaacaccaccaaaacatgcaccctggctcgtctttcactgagctattgacgggtggtatgagcgataacaacacgagtcctaatggtgggtccatccaccaaaatacagcaaggcaatggtctacaaatccgttggagtattttacatcaagattactaggcccatcagctactcgtggaatagacaaccaaatatatttgggaaatcctctacagccattaagaccaatgtttagtattacgggtgagcatagagcggagctgcagaatttcccatttggtggtgacaacctagttcc

SEQ ID NO: 11050 - DNA, 423 bp, Lycopersicon esculentum
  Predicted polypeptide sequence is orthologous to G616
tgcagaatttcccatttggtggtgacaacctagttccgggtgttacctctagtaatactagtactaattataacgagtacaatttgaacttcagcatttcttcttcatcatcatctggtttcaatagggggacccttcagtccaattcttcctccactttgcctcattaccagaggttttctccgacagatggatcatatcttggttcaacaactgaatatgatgctcgtttacatctcttctatggaaatggctatgaacattctgatcagaaaggaaaaggaaagaactaaacttccatggcaattgaagatggaagcagcctctgcagtcccaaaggaagcaatgctttttcaatgcaacaagctcatatattactattattgtgcttcttaattccttattctatgttttcattctgag

SEQ ID NO: 11051 - DNA, 687 bp, Lycopersicon esculentum
  Predicted polypeptide sequence is orthologous to G618
ggttttcaagaactctttttgtgtttgagaaagtttgaatcttgttgtctcttgaatcaagaaaatgctgctaaggagttcttcaacaccacttcttggatctttacactcagagagtcccaacagtcatcaccatcatcatcagtctgatttaaccccaaatcacacacccaattccattcaccatagttatagcaaactctcatgtagccatggtggatatcagaattttaatagaagtttatacccttctaagtctccaatctctccttcattttctgagatcagcaatgccaacaaattcccatctcatggttttagaagagctcaatctgaagggaacttggaaggattggtaaaagtttcaactgatgaagtagttgatgaatttaccctctctaaaccaaccaacatgctttcgcgtaaaccaccaaaatcattcttggaaaccattccatctttctccattcacaattcaagggagcttcattcggacgacgatgacagcgatgactttgattgcataagtggacagaacagtttgggaatgaatgctgtaaaagaggaaatgagttatgtgagtcgaaattcgaagatagaaatagttgaaggcagagaagagatgttcctagcaagaggacttggggttgctgatattggttgctttgatgatggtggctgtggcat

SEQ ID NO: 11052 - DNA, 1177 bp, Lycopersicon esculentum
  Predicted polypeptide sequence is orthologous to G618, G2057
gctagctttctgcctccatctttagaatctgatgctattgctgatactatcaaatcttttttcccaatgggttcttcaacctcagctaactcttcagctatgcagttccatagcttccaagaaccccatatgttatcaagagccaatagccagaaccaagatttgagtctctctttacagtttcaagatcctattttgcttcaccatcaaaaccagcaagctcaacaccataaccaaactaaccatagggaacaagagcaagtgcagggtcaagcaccagcccactttggaggaaacaccccacttggttttgacacctctggctggtctatgcatcagagacttcgttcttggagtgacagtagagaaattggccctggtggtagtggtggagcagtaacaggacctggtgggtacttgttcaattcgccaccagcaccggcgctgctgcagcagctattcggtcaaaatcagtttttttctcagaggggaccccttcagtccagtaacacatcttcggttcgcgcatggatggatccgtcagcgatagcaattgcctcaggtgatccaagtaatcaccatcaagctgcattatcaatgtatccatcaacaattcctggctatggatttgcctctgaagtaggcggattctctgggtttcgtattcctgctcgaatccaaggtgaagaagaggagcacgatggcatttccgataagccatcctctgcttcctctgattctcgccattgaattagctccaaaaagtttgatctttctcaatccctgacagggaaatgctctacttgaatgcaattagaacttacagaagtaatgctgtcaaaagagcctggagatggagaatgagagagttcaaaatagagtctgattcaatggcatacaccgagtcgaaaagaatcctgatccttgtttcaggttcttcgatccggtctaatataattagttattcaccgttcttgattttccagttcttgtgtaattgagcttttctagctcaacaagctacattaggagtgttatgtgtttggccagacttgtcatattgctgctgtttgctttatttcatgattttggagactttcaacctagaattggtaatgttttgttagttatttttaagtcttgaaagccattcttaaaaaaaaaaaaaaaaaaaaaa

SEQ ID NO: 11053 - DNA, 604 bp, Lycopersicon esculentum
  Predicted polypeptide sequence is orthologous to G618
gtttttttgtcatttctttcttttcatgtttaactttattctttacatttcagaagtcccttttaaattaaaaagaaaaacaaaaacctccggacttctgtttctgcatttaagcaacaattttacgactattgggcacagttctcctagtttcttatcatttctttcttattatcttttccttcagtatttttttttattaatattgtgaagtaaatatttttggataataatgcttttaatgatcacttttagaatatgaaatttgttaagacaaagtataaattgaataacacctttttttgtgacgacgattttatggaatcggaccaaatgatggtgtaaagttctgtcatactctaaaatccggatacgtctttgtccacctccactatgcaaccgatcacccattgttggttgtcaccacaactagctactatttatatttatcaccactaccaccactaccatttccatatagcactatcaactatctatatatattgtcaatcaccttgccattcaccaccacccttagctaaaactattatcttctacaattatcaattgccatcaacaactaccaccgtcattaactactact

SEQ ID NO: 11054 - DNA, 1002 bp, Lycopersicon esculentum
  Predicted polypeptide sequence is orthologous to G618, G2057
gtaccaaaaaacagtatcttttatcatatatttgatttgctctctgcaaactctattttgaataattaaataactagaattgttagatgaaagggaatgatgggttaggggtatttgttttgatttaaagttatggaatttgggaagttgaatggcagagagtttgagatttcagtgtaaacaatcaaaaactggaaagagaaattgcaaacaagggtttgagtctggatcctcagaggaatcagcagcaacattatcatctcaatcaaaatcaaaaccaaaatcaagattcagttggcaaagaagaagaagaaaatcaacaacaatcagaaaacgaacctcagctttatcttcatcctcacaaccagcaacaacagccatttttcaatcaacatcacttgatttatggaaggttagattcacagcaattgcttccaccacagccaacaccgaagaaacgttcgtatttgccttcgacgtcttcattggggcaaaacgtcgaacatgcagcagcattgcgtgggaaaatggcagaaacgtcaagattgggtataaggaatactgtaggagagattgtagaagtacaaggaggtcacattgtgaggtctacggggcggaaagaccgccacagcaaggtttgcacagccaaaggccccagagatcgccgtgtgcgtctctctgctcatactgctattcagttttacgatgtgcaagaccgccttggttatgatagacctagtaaagctgtggattggcttatcaaaaaggcaaaacccgccattgatgagctagctgagttacctgcctggaaacctacaattggtactgcatctgctgctgctgctactaacaccaatcttgaacaggaacaggctcaaaaacagcaagaagataacaactttgcatttcaacaaggaaatgttagtttgtttgataatgttgctggcccttcaagtaaagagcaatcgaaagtaatactgctagctttctgcctccatcttt

SEQ ID NO: 11055 - DNA, 538 bp, Lycopersicon esculentum
  Predicted polypeptide sequence is orthologous to G618, G2057
gttttatgcctcattctttagattctgatgcgatttctgataccatcaaatcatttttcccaatgggaggtagtggttcaaatgaaggtaattctttccagagttttcaacaacataatttgatgtcaagaagccaagatttgaagctttctttacaatcttttcaagatccacaagctcagtttgaagcatcaaatttctttactggatttgatgcttcagtgtggcctcagcaccagcagcagccggttgaacttggtcgactggcggctgctcgtggagacattggtggcggggcaattgctggagcacgtagttatctgtttaactctcagcctgccccgccgctattacaacaattgttcactcaaaatcagtttttgtctcagaggggaccccttcagtccagttactcaccttcgattcgtgcatggatagatccatcagcgattgctatcgccacagctgatccaattcaccaaaaccaaaaccatcatcaagctgtgtttcctatgtattcaacatcactttctggcat

SEQ ID NO: 11056 - DNA, 823 bp, Lycopersicon esculentum
  misc_feature (509)..(509): n is a, c, g, or t
  Predicted polypeptide sequence is orthologous to G618, G2057
gtttgatcatctttactttttttttttttttgttgtaaccaaatcaatcaggctgataaccattggcattcaagagaactttacttgttctaatgaacggatgctaataagcacacatcaacaacaacaacatggtcttagccacagaaaaacacacttgtacttgatcatttcgccgttatttaatcctagaaaaaaacctgagactatgctcaggattctttttccgcggtgcattctcactgaatcagactcgatcaaaagggattatcgcgctgtccctgacttgaattttgccacttccatcttcaaatatagtacttggccctgtcaggttataatgggagattgcgtttccgagctgcttcaatgacgagaatcagaggatgccttggatggtttgccggaaacaccatcctgcttctactatatttcaccttggattcaagtaggaatgccgaaagccaaagaatccgcctaattcttgagcgaattccatgccagaaggngtgttgaatacatgggaacacagctggtgatgggtttgctctgtgagtaggctagctgggggatagaatcgttgttgttctttcctgcccaatcgtagttgcaactgcctgagggtcctttaagcatacctgtttgggaacatgttgattcgggggtggtagagtacgttctccggtaaagtgccgcccattgttccggacggcgtttcagtccagtttgtggctggcccctactttacttagagtgttctactggttggcttaagtgagaagtattgtctgccaattggaacgagaactgtgccaccctgaag

SEQ ID NO: 11057 - DNA, 873 bp, Lycopersicon esculentum
  misc_feature (719)..(719): n is a, c, g, or t
  misc_feature (855)..(855): n is a, c, g, or t
  misc_feature (857)..(862): n is a, c, g, or t
  Predicted polypeptide sequence is orthologous to G618, G2057
tggggcgatgagcgcatctgttttttttttttttttttttaaccaaaagaatctggctgataatcattggcattcaagagaactctactagttctaatgaactgaagctaataagcacacatcaacaacagcaacatcgtctgagccacagaaaaacacacttgtacatgaacattacgccgctctttaatcttagaaaaaaacctgagactatgctcaggattatttttccgcggtgcattctcactgaatcagactcgatcaaaaggggtgatcgcgctgtccctgacttgaattttgccacttccatcttcaaatatagtacttggtcctgtcaggttataatgggagtaaagcgttttcgagctgattgagatgactagaattagaggaagcctaggatggtttgtcgggaacaccataatgctcctactagatttcaccttggatttcagtatgaatgcgacagccccaaaatacgcctaactctgaggcgaatccgatcctgaaaggagggttgatacattaggaacacagctcgagatcggttagttctggggagtggatcactgtggcgatagcaatggtgctggtcttatctgcacaatcgacgttgcactgggccgagggtccctttagactaaattgatttgagagcatgtgaataacgggggcggtttaagtaacgtactaccgttcagagtgcctcccatgttttncggcggcgcttatcgtcacggggtgtggtcgccctagttaatcttagagtactaactggctggttaaagtgagaagtatgtttccaaattgggactgagacttgctctctgattgtggactaaaacggtacccccncnnnnnncctcccccccc

SEQ ID NO: 11058 - DNA, 370 bp, Lycopersicon esculentum
  Predicted polypeptide sequence is orthologous to G618, G2057
gaccggtagaaaagacccggcatagtaaagtttatacggcgaaaggaccgagagaccggagggtccggttagctgctcatacagcgattcaattttacgatgttcaagaccgattgggttatgaccggcctagtaaggcggtggattggctcatcaaaaaggcgaaaaatgctattgataagttagatgagttacctccttggaatccgaatcagattccagggaataccactgaagctgatgctctggtgttgaagcaacaaccggagtatcagcttcagagggaattagaagaaaataaccaaagtcgggttaataattcttctaattcctacctgatgcaaggcggtagcgggggttggtggaggag

SEQ ID NO: 11059 - DNA, 610 bp, Lycopersicon esculentum
  Predicted polypeptide sequence is orthologous to G618, G2057
gaaacagaatgggttaggctaagcttattcttgtttttttctttgatttttttttcttcttcttgttctagcattacaaagctggatcctcataagaagaacaaaaagaatcataattatcaaaatgtagaagaagatgaggaagaaaaagaaaaaaatcaaccacaaccacagttttttcaatttcaacaaccttttactcatcatgatcattttatgtatgaagatttagataccatcaaacaacaacaagaacaagctcgatcgaagaaacgttcgttttttcctcctcctcctcctcgtccttcttgctcgaagcaaaaaggtgtaacatcgtcaaaatttggttgtggagagattgttgaggtacaaggtggtcatatcataaggtccattggtcgaaaagatagacacagcaaggtgtgtacagctaaaggtccaagggataggcgtgtgcgccttgctgctcatacagcgattcaattttatgatgtacaagatcgacttggctatgataggccaagtaaagctgtggattggcttataaaaaagcgaaagcttcgattgatgagctagctggattgcctccatggaaaccaactaccactgg

SEQ ID NO: 11060 - DNA, 460 bp, Lycopersicon esculentum
  Predicted polypeptide sequence is orthologous to G622
gagcaaacaaatacgacgaaaatccgtcgcgtgggcgacacccgcgcgcgcaggcgaagcattgcaatcctttgtccctttctcctttctgcgcttgtacgattccaacagcacctccaagcctgcaggatcgtccttgaggatgcaggatgacgctacgtcgagctccaaggacgggaggttgatcacactcgtccgcgtccctttcaacttttgggatttttggccaaattttgggataatctggtacagcccaactgttccttgtccttgggagtaatttgaatttggattgggcatgagattcgcgattcgaaaaccctaatttcttctcctataaatacatccttatcggtcttgaatagggatccttttttttttgggtgaagaattaggaaaaactcttaagagttataagtatatttcggaaattttagtgaaaatctcttaagcagaaaac

SEQ ID NO: 11061 - DNA, 571 bp, Lycopersicon esculentum
  Predicted polypeptide sequence is orthologous to G622
gcacaaaccatgatagaatctcagtacaggcctcgtgtcacagagtcaaaattgcagaagatctccataaactgtgggcatggtgtcacccctttgtttcaaaaatcgttgactgccactgatgctgatctcacattatcacgtcttgtgattcccaaaaagtgtgctgaggcttactttcctccactttctgggccacacaagatccccattaatatactggataccgacggcaaggaatggaattttcacttccggttttggcctaattcaaggagtaaaatgtatgtgctggaaggacttagagattacatggtctcgaagaagtggcaagcaggtgatgtagttactttttatcgaattgaaccaggacagaaactggtcatgggattaaggaatacttcgcctggttcttccacctcatagatctcagctcgatgccggaggcggatctacatgtaacttatgaggttcacaggaactatactcagatcttgtacgtgtattatggaattgatggaatatctatagatactttgattgtaaacccaatcattattttgtatcaact

SEQ ID NO: 11062 - DNA, 727 bp, Lycopersicon esculentum
  Predicted polypeptide sequence is orthologous to G629
tgccactgagttaactcgccattcttctcttctttagacaagcctgataaggaaagctgattcttaacaatgtgttgggcatcaaaggttttcttttgttctccttcaaaatgcacataggtaaggtacttattcatagtacaattatttggcatatattgtagttacacacgtgcttgtgtacttgttctactaaaatgttgttatgactttgtaagctaggttaaatatcacagaacatggtgcatctttcatttggagcatgaacttgtgtttcactcttggtcaagttatgtgtaaaaggtattctgacattcatgtcagctagtttgcaggtttttacagataatagagcagaggcaatgaaactgccgtaacaatgtctggtactcttttctaaaagtagtatgccatgctctcaagtataactagaagtgcttgtagactgtgcctcaacaaaatgtgaaatctctgtcgtgtgtgaaatcatttcagctacctagtgttctttagttgaggcttcatgcttgcttcagttagaaggtggttcaccttgaggtgtatccttgtcaattacataattatgtattttacccattggtttttctctatcgggagattgtttttaaggaaaagacacgattttgtgtaaacatttacgcaagctatatttgcagaacatggtcagtcatttatgatgacgtgcttaattattctcaaaaaaaaa

SEQ ID NO: 11063 - DNA, 425 bp, Lycopersicon esculentum
  Predicted polypeptide sequence is orthologous to G629
gaaattttctctctctttgtgtatacaaacttcatacatattcatatatgcaaagtgagtgatcttttttggagaattgggtattgctttattgatttgatggtattggaattttgatttcaagattctattcattttttttttatttttcttctatgggtgtttagaaggatttaggcttttagagttttgaagtgggaaaaaaaaggtttcttgaagacttagctgttgttggctttaagtcggaaggcaatgaattcttcaacatatactcaatttgttgcttctaaaaggatgggtatatgtgatccaatccatcagattggcatgtggggagatttcaaaggtagcagtttcccagatagcttgattcttgaagtcgagaattgcctcgagaatgagatgcctattatggagaaaagact

SEQ ID NO: 11064 - DNA, 663 bp, Lycopersicon esculentum
  Predicted polypeptide sequence is orthologous to G634
gtgcctcaatcttatcccttggcatagagagtgaaattcttatgttagaaatgttgctaatgtgattaataatcaagtaagcatggtgaatgcttcaaatagttctagaaaaaacaactaaaccccctccccccccgccaccccacacacacatacacaaaaaagaaaaaaaaaaggaaagaagtgggggtgaacaaatttcttacaaatgaatctatggtgcaaattgaaccagcataaagtgattaacatttgactttgtttctagttgatttaagggcctacacactgattctgctgcaacattcaaaacttagttgcattgttaccgcaattgagaaattacttcataagtatgtagttcaaaagattttgttatggttaacagacatctgaggatagtatacaattctacaaggtggttgatgacttacatagaaatctgttagtgttcttgctgaaaaaccaaattcttcaagtgcagttataaatatattaccaacaatgagctagtgtttatgctaaatgtcattcttgagaagttccttttaagtacgcaccgttgccgaattaaagatgaaagattggagtttgaaaatctagggacacagatatgtgttgtaccatcttaaacatatgacaacactttttttctatttcttg

SEQ ID NO: 11065 - DNA, 569 bp, Lycopersicon esculentum
  Predicted polypeptide sequence is orthologous to G635
aggaccggtaccttgttcagctgaatcaataagatcaactcctgtcaaatcttctaaggaatctgacggtttcagtaacagctttgtaaataaaccatgtacgacgtccccatatacaagggtgatggataaggtttatagtagtagcgaccagaagccgaggaaggtagccaatggagcggagccaaggagatgacagaatgttgaagagcgaactgattatgcagtgaatcagacaagaactgttactgttgcatttgtctattccttctaactgctgttcgacatgcaaaatatggtagaatctgtatagcctgtcacatggaagaaatgaatgttgtaatcttatgctgggctgggtgacttgggatcattgtgcttgtaccattacatgttacatggatgccagacacatcgatacgctttcagcattgcctcagtgtacatcattgatgaggcaatatggtagaaaagttctctatgtagtctctggtattccggaggtattcgttacgtgtgtgtaaatgtattcattatgtgatatctatggtcaggacattttcatactc

SEQ ID NO: 11066 - DNA, 863 bp, Lycopersicon esculentum
  Predicted polypeptide sequence is orthologous to G636
tggccgaaagaagaaatcgaagcatggataagtctccgaacctgtttagatctaaaataccaagaaaatggaccgaaaggaccactgtgggaagaaatttcatctggaatgagaaagataggatacaacaggaatgcaaagagatgcaaggaaaaatgggagaacatcaacaagtacttcaagaaggtaaaagaaagcaacaaaaaaagaccagaagattccaaaacttgcccatatttccaccagctggaagcactgtacaaagaaaaagccaagctcgaacctgtaccacacaacactaccttcggattaacaccccaaaacaatcctcctcctcctcctcctcccatcatggctcaacccgagcaacaatggccaattcctcaaaatcaacttcaccagcaaaatcgtgatcatcatcacgataatgaaagcgacagcatggatcacgatttggaagaggacgaggatgaggacgaagaagatgaaggtaatggctatgaaataataatcacaaataaacaacaatcatcatcaatggcggctaccccagtaacaacaacaacttctgctgctgcagtttaaagcacaaaattaaaattgataacaacataaacagcagtagttactgtgcattgggaatggcaagttgggcaacagattgtgcagagaattgtcgtattgggcaagagaagatggtgactgcagtaaaaaaataaataaataaattataatttggaaattaatgcaaaaggcatttaagtttttacacatgtttttttttatttggtaagggggtatagtttttaatttttaatttgtggtaaaaatatatttttcattttcaaaaaaaaaaaaaaaaa

SEQ ID NO: 11067 - DNA, 2169 bp, Lycopersicon esculentum
  Predicted polypeptide sequence is orthologous to G636
atttcttgacccccttaaataaaaataaaataaaatagttgggggttgaatttaaaaatatccaattttttcgaagagaaaaaaaaaggataataagtgccttctactcaattatttttactactaataaagtccaaaagaaattttctttgtaagaagaaaaaaaaatgctagaaagttctgttttgttggagaatacagctgctggtggcgccgtcaccggcgccgatggtgaagcgtcggagctgaagaatgaaggtggtggtggtggtggaagtgtcggtggaggttcagaggaagaagataagaatttttcaggtggaaatcgttggccacatgaagaaactttggctttactcaaaataagatcggaaatggatgttgcatttcgtgattccaatctcaaaagccctctctgggatgaaatttctaggaagatggctgagcttgggtataatcgaaatgcgaagaaatgcagggagaagtttgagaacatttataagtatcataagagaactaaagatggtagatctggtagacaaactgggaaaaactatcgatttttcgagcaattagagcttttagatagccaatccttgttttcatcgcctccattaaaccatagccaaatcaatagaatggaaacaatgcctgtaccaatgcctatgccaatgacaatgataaaaccagctgctagtggatgtcaggattttggaatggatcatagtcgagttcggggttttaatccggggttcatgtccacatccacgtccacgacctcgtcctcggggaaagaatccgatggtagtgtgaagaagaaaaggaaattggctagttattttgagaggttgatgaaggaagtgttggataagcaagaggacttgcaaaacaagtttctagaagcaatggaaaaatgtgagaaggatcgaatagcgagggacgaggcttggaagatgcaggaaatcgcgagattaaagaaagaacaagaagcattagctcacgaaagagcaatttctgccgcgaaagacgcagcagtgattgctttcttgcagaaagtctcagatcaaaccattcaactacagttaccaacagatttaccccataggcataccgaggaacgagagagtgaatcaatgaaaactattggaaatcaggagaatgttgttatgcaacaagacaacgacaaggaaaacattgacaaacaagagattgatagtgctggtgagaattcaaactcgtttcaaacgaattcatcttctcgatggcctaaagccgaagtggaagccttaatcaagctaagaacaaacgtcgacttgcaataccaagacaacggctcatcaaaagggcctctttgggaagacatctcatgtggtatgaagaagcttggatacgatagaaacgcgaagagatgtaaagagaaatgggagaacataaacaagtactatagaagagttaaagaaagccaaaagaaaaggccagaagattcaaaaacatgtccatattttcatcaattggattccatctatcaaaacaagtccaagaaacaattgcccattatggaaactccgggttcgaatatgaaggccggagagatactaatgcaaataatcaaccaacaacagcaacaacaagcattagaaagaacagaatgttgaacaaaagtttgttcaagaacaaagtaatgcaaataatagattgatggacaagaaggtttttctattttactttgtggttagtgtaccatttttgacaagtgggacaaaatcaattatgtgctttggaaatgtgggattatgtgtgagggaggaactttttcattcacaaagttagttttactataaatgcacacacaaagaaagtggcatattttctttttttctagttaggtatatttaatcatttgttgttagtagttaaatagtgtcatagggaatagttttagctttggtgtgattttgatatttctttttttgaagattatatatgtagcatatagtatacattttcttcttttgaggctttggtttctcaaccatatcctccataagtacatgtgtgtaatagttcaaaatagttgattgtgtttgtatgaatttagaatatacttttacaaaaaaaaaaaaaaaaaaactcgagactagttctctccctgcagcccgggggatccac

SEQ ID NO: 11068 - DNA, 389 bp, Lycopersicon esculentum
  Predicted polypeptide sequence is orthologous to G636
tttttttttttttttttttcttgatctaatcactccattgtttccatcaaacttctttgtagatcttcttggtggttcgccagtttcttcactaatgacttgaaaaatcttccccattcatctttccctctcttccttttatgaaatttacccatagtattatccattttgttaaccatggcttcattgagagccaattcaggaaaagtgacattgtggttggttggcaaattatcagcagattcagatgcaattccacgaatacaaatagcttctaactctccgaatactactctacgtttattagtttcttctaaactatacaattcctcatcttcttcttgtttgtttttctcaattgcatttccatttgaatattctttggtgcc

SEQ ID NO: 11069 - DNA, 486 bp, Lycopersicon esculentum
  Predicted polypeptide sequence is orthologous to G636
gcatcatcaaatgtacaagtcacggcttcacaaggtactattcctcatcatgttactatttcatcagcaccaccgccaccgaatagcctttttgctccttctcatcaaaatgctccgtcaagttcacccgtgccactaccaccaccgccatcacagcaaccatcaccgcagccagctgtcaatccgattaataatattcctcaacaagtgaacgcttcagcaatgtcgtattcaacttcttcgtctacttcctcggatgaggatatacaaagaaggcataagaagaagaggaaatggaaggattattttgagaagttcaccaaggatgtgattaataagcaggaggaatcgcacaggaggttcttggagaagcttgagaagcgggaacatgatcggatggttcgagaagaagcatggaaagtagaggaaatggcaaggatgaatagggagcatgatcttttagttcaagaaagacaatggcggcag

SEQ ID NO: 11070 - DNA, 597 bp, Lycopersicon esculentum
  Predicted polypeptide sequence is orthologous to G636
gcatatttccaccagctcgatgcactgtacaaggagaaagccaaaaaccccgaaacagcttcttcaacgtcttcgttcaatccttcattcgctttaaaccccgataacaaccaaatggctcccatcatggctcgtccagaacagcaatggccacttccacaacaccatgaaagcaccacccgtatcgaccacgaaaacgagagcgacaacatggatgaagatgatcacgatgatgaggaggatgaagatgacgaggacgaaaacaacgcttatgagatagtagcaaacaagcaacaatcctcaatggcggccgcaaacaccactaccagcaccgcaacaacaacagtttgaggtaaaattagcacagatctctcatcataaaaataaaagaaaaatcagaagtgtgggggcaaaaagaagcagaaattagtggggaagtgagtggaacattgggaatagcaagtgggtcaacagattcttgcagagaaaatgtcagattggatcagatctcagaaaattccggttggtatgagaagacggtcactcggaggaaaaaaaatgtgaagagaattttacaaatcatttcaactttatttc

SEQ ID NO: 11071 - DNA, 454 bp, Lycopersicon esculentum
  Predicted polypeptide sequence is orthologous to G638
gggttcaattttggtgttcttttaactaaatgatcatatgtacaccttgtaacaacaaaaaagaattaaagaatgatgttagaaacttatgcgattaaccatatctggtgtttgagaaaggtatataatataaagatagacactcaaacttggtctcaactgacaaaacgctccaaggacgatgcacatctactaatttcaactcgtctccattgtgtcagttgaacactcagcttaaagaaataatcatctggacgcatccaaaatttatgtgtcaagtcagcatcatcgtgtgtccactcccaaaattggattgtctacttgccaatcgaggccaaacttgaaagtctatgtatgtgttatgcctttgagaaactggattagtttctctttgaatcatctaaagcaaagttaactcaaacttcttctctggttaaagggacaatatacagaa

SEQ ID NO: 11072 - DNA, 546 bp, Lycopersicon esculentum
  Predicted polypeptide sequence is orthologous to G643
gcacaagttcccataacatcatctaacttctttcttcatactgctcttcttcccaattccagcagctatgttgagcgtcaggcaatagattcagaaaaattgggcgtcaaaaatggagaggagcggcggttcactaaggacgcgttcacaggcggcgcctgactggacattacatgagtcagttacccttgtgaacgaaatgaaagcaactcaaattgaatgcggcaactccctagcctctttccagaaatggcaatcgaccgtgcacaattgcaactcactgggcgtgaatcggagtttgaatcagtgtaaacggaggtgggaatctatgttggaacagtacaataaagtgaagccctgggaatcggcctattgggattccttcgatgaggagaggaagagggaattggagctgccggagcagtttgatttcaagttgtttaatgcgattgctaagtatttgagtttaaaaggtgaggatggtggcggtgctgaaactgacccggataccgacccggaagcacagcaggttcaaggaaataatgc

SEQ ID NO: 11073 - DNA, 935 bp, Lycopersicon esculentum
  misc_feature (896)..(896): n is a, c, g, or t
  Predicted polypeptide sequence is orthologous to G646
gttgttgttttcatcatctgtctaaagactcttctttctcatttttgcctttactttttcgtctccgctttttctgtcttttgttcaaatggatacttctcctcagtggccacagggtattggaatagtaaaaggtgttgatgaagcaaagttggatcaaaggaaaccgaggccacaaaaggagcaagcggtaaattgcccaagatgcaattcaacaaacacgaaattctgttactataacaattacagtctcactcaacccagatatttctgcaaaacgtgtagaaggtactggactgaagggggctctttaaggaatgttccagtaggaggcggttccagaaagaacaaaagatctaacagtattagtatctcgtcttcttcaactacgtcatcactatcattatcatcgtcgtccaagaaattatttacagatctggcgaaccctaacgatctcaatttaacctataacccaatacccagtggtggtactactactactactgcgaccaatttcagtaacttttctgatttcatggcgttacctttgctccatccatcagctaattcagcttctacattcatgacgagtagtaatttgtatccgtcatcaactactgggatttcgaatttacatgatttgaagagtagtaatggtatcaatttttctttggatggatttgaaaatgggtatggaagtttaccttctcatcaagaggcaaaattgttttttcctatggatgatttgaagattaatgtttcaacggttggtgatgaacagtttgaagaaaatagaggccaagcagcagatcaatctaatgggttttggaatgggatgttgggtgggaagaagtacatcctggtaaaaaaaataatgaagattataaaggggttgntattttaattttaattttgtgcttttaaaaaaaaaaaaa

SEQ ID NO: 11074 - DNA, 745 bp, Lycopersicon esculentum
  Predicted polypeptide sequence is orthologous to G646
gaatatcatttcactcactcattcattcattttctctctcttttcccacacaaacataaagcaacacaatacaacatccacaaaccctctcaaacattcctttttttctgcttttaaaaccacttgctcataaagctgctcattttccccttttcactccaaaaaaaaaacacaatttttttcttttgcttcttctttaatttctacttcttcatcatcatccatggatacttctcaatggcctcaggagatagtgatgaagccaatggaagatataataggtaacacatcaaaacctactaattgtgttgaaaggaaattagttagaccacaaaaagaccaagttgtgaattgtccaagatgcaattcaacaaacacaaagttttgttattataacaactatagtctttctcaaccaaggtatttttgcaagacttgtagaagatattggactgaaggtggatctcttagaaacattcctgttggtggtggttcaagaaaaaacaagaaatcttcatctccttataatcatcatgttatagtaaataataaaaaacttcctgatttggttgtccctccaccacaacctgacaacatcgaggaatatccagaaaggcattttggaaatcgacctcatgatcaaaaccctagtaagattatccttgaaggaagccaagatctcaatttgggattttcatctgatttcaagactattactgacctaattcaggtaccaaattatgat

SEQ ID NO: 11075 - DNA, 623 bp, Lycopersicon esculentum
  Predicted polypeptide sequence is orthologous to G646
ctctcaaaagctactaattttttattattatttttcacaaaaaaataataatcctcctcctcctccttttttcatgaatggacacttctcaatggccacagggaattgtggtgaaaactatggaagagatgaaaataccaaagaatacaaatacaaggaaaattaggcctcaacaacaacaaaatgatgaagctttgaagaattgtccaaggtgcaattcaacaaacacaaagttttgttattacaataactatagtctttctcaaccaagatttttttgtaagaattgtagaagatattggactgatggtggatctcttaggaacattcctattggtggagtttcaagaaaatccaagaaatcatcatcaattaatattatgaaaaataatattatttctcctaaagtacaagatattattaataataataataataaaggggttaatcaagatctcaacttggatttttcatctgatttcaagattatttctgagttgatacaagtaccaaataataattcatttatgccaatcatgcctaatatttctgatccaaattcaatttacttattctctagtaatttggatcatggtttaattggaagtagtagtattagtgat

SEQ ID NO: 11076 - DNA, 424 bp, Lycopersicon esculentum
  Predicted polypeptide sequence is orthologous to G651
gggtcgtaggcttactcctactcgagttcctcggctgaaccgatattcggtttagttaagacgacaagtccgagtactcctacctagtagaagtcaatgagacgacctaaaattattcgctctctacctccggaagctggccgggcgacgacctcgtagcggtataaacaagcaaaccaagagcaggttaagcccacgtcgtactaaccacgcacggacacccctctaggagagcggattagaggccctagtcggaaaagagtacgaaagcttccttcttgggcgcagataacgaagacagcagtacttagtaagcggtaggtgaggacactagcggcgacaggagcgacattctccctagactaataatataaatttatttagaaccgatactacggctcgtaggcggcgcgagcttcggagg

SEQ ID NO: 11077 - DNA, 574 bp, Lycopersicon esculentum
  Predicted polypeptide sequence is orthologous to G651
caaactaaagaaagtgatttttaattgtctcctctatcagtaaaatcagctgttacattcaacattaacagaacaattttcaacagtaactatgaattacagtcaaaactattgaatgagtaaaagctaatccaactttcccaagaaattttttaacttagatccataatcccactattaatccctttgcctaataccactaaaaatttaaggaagagcaaacctttacctctgattgttgatggggttgacaaattcagcatcagaaactgcagaaacttcaacttgactgataatttcatcatcatcttccattggtggaggaaaattaagatctattaaacttgttccaccagttcttgataattctaatttatctggagcaggaggaggaagaacagttacacttgttgaaacaccagcaccaatagtatgtgatcgcttgtgtccacctaaagcttgacctgatggaaaaactctgtaacaaacagggcatagatgtattttctcttcaattactgcattattattattattattatgagccgcgctttccatcacttcctttgataga

SEQ ID NO: 11078 - DNA, 455 bp, Lycopersicon esculentum
  Predicted polypeptide sequence is orthologous to G652, G1335
ctcgtgcctcacaatcaaagggttttagggtttctttttctttgtgagcgaaaaaaatggctgatgagggttgtgagaggctcaagggaactgtcaagtggtttagtgaccagaaggggtttgggttcatcacccccgccgatggctctgaagatctgtttgtacaccagtctggtatcagatctgaaggattcagaagcctagctgaaggtgaggatgttgagtatcagattgagtctggctcagatggtagggctaaggcttccgatgttactggacctaatgaagcggctgttaaaggaggttcccgcagcggtggaggacgtgatggaggtggttacggcggaggcggtggttacggtggaggcggaggttacggtggtggccgaggaggaaatcgtggttatggaggtggtgacagtggctacggaggaggtagccgaggtggtggcggc

SEQ ID NO: 11079 - DNA, 608 bp, Lycopersicon esculentum
  Predicted polypeptide sequence is orthologous to G652, G1335
cagtatcagcagagaaagtggactgcagggaaatcggcaaggccaatatggaaatcagcctagtggaacgcaaaatgctccgactggctcttctgcaggcatgtatatgagctgtaatagttgtggtggaacaggtcatagtgcttcaaactgtccaagcatgatgagtggtcagagccaggcatatggaagtggttttggcaatagggcaacttcagggatgagcagtggtggtggtggtggtgagtgttataaatgccatcagtatggacattgggcaagagattgcccaggtgtaagcaatgcacctgctgccaataacatgacatcaggaagatatgggaatactccaaggcaacacgttggtggtttttgatgaacctttgagcacataaagttgtcctgtacaggtttagatgtcttctcttagtggctcatcatggctcatgttctgcttttgagaaagcttcttgaggggcttgcgttttgcctttctgtacagtggtcgcttggggcttaaattatgcatcacggctcctggacgggagtgcactacaagtcttgtcgtccatgttttgaggaatgaccgttccgtgctctttctttgt

SEQ ID NO: 11080 - DNA, 521 bp, Lycopersicon esculentum
  Predicted polypeptide sequence is orthologous to G652, G1335
ttgggtggtacctctaccccaactttgctgagctccaacaccactactagaaactctatcaccctacctgactgtactctgcaacgacctctaccctgtagagctagtggtctagtatggaatgaagaattaggtcgaggcccaccacgacccctttaagaagtacactgccgcattagatgatcgggatctccacaagtaaaacaaaatctctaacctgggaactgctgtgtggaccctgaaaacccacaataattgcctcgccctgaaggtcgctgctgtgaaccgtacgagccctgaaccaggacataagaacccctagatgtttggccaccctcaaatattgtcttagatgcatgaataggtccccgctgctgaaaagaaccactcactctctgtgatcccctacctccagatgaatcaccatgaaactgacttgatatacgggcccttatagggtccccaaactcctccctctcttcatcaattccaactctttggaggcgctcataatggactgg

SEQ ID NO: 11081 - DNA, 917 bp, Lycopersicon esculentum
  Predicted polypeptide sequence is orthologous to G653
gaataaactaaagatatttctctgctttttttttttctcccattcatcattctctctttggctcattctcccagaaaaaaacattctcttcatccgccattaacgctcgccgcatcacaagcttcgctccatcaacagcaccatttttttttgatcttccaatagtcaaagaggttggaggatcagatctaggagttgaaatcatgtcgtttacagggactcaacagaaatgtaaggcttgtgaaaaaactgtttacccagttgagcttttgtcagctgatgggattagttatcacaaatcttgtttcaagtgtactcattgtaaaggaactctcaagttgagcagttactcctcaatggaaggtgttctgtattgcaagcctcattttgagcagctctacaaggagtctggcaacttcaataagaactttcaatcccctgtgaagtcagctgagaagttaactccaatgctgacaaaatctccaagcaaagctgccggcatgttttctgggacacaggaaaaatgtgccacctgcggtaaaacggcttatccacttgagaaggtgacagtggagaaccaaagttatcacaagtcgtgtttcaagtgttctcatggtgggtgctctttaaatccttcgaattatgctgccctagatgggatattgtactgcaaacctcatttttcacagcttttcaaggagaaaggcagctacaatcatttaatcaagtctgcttcaatgaagcgtccagcagcaactgttccagattcttaaactatatctccatcaactattttatccagggagcttggtcttttaatatttgtttcctcccttcttttccgtatatctccaattggtgtgccatttttgtttactgtgtgatctgatttacacaactgtgaaaacttatccttt

SEQ ID NO: 11082 - DNA, 412 bp, Lycopersicon esculentum
  Predicted polypeptide sequence is orthologous to G653
tttttttttttttttttttttttaaaacaagagatatttggttgtatttggataacataaaagtggcatccttatagagttagaacactctgaagaaaattacaatgagtatgatacagaacaactgctacacgattagttgataggaaaaattgcagctgcgcgttttttggctgcaaactcagtttcgtgtgcagctgaaaaatatgaaaggaaactaaaagaatgttgaaaaagctacagagttgagagtgtcgcggagctcctgaattagattatctgcagacctaagactcctgaacagccattggttaataaaacagaaacgctgtgcagaacaccagaacttctggcaggtcaggaggaaactgtaccaaaaaagtgctatgaacacacgcgaaccctttgagat

SEQ ID NO: 11083 - DNA, 352 bp, Lycopersicon esculentum
  Predicted polypeptide sequence is orthologous to G653
gcccgaacacaacaagatgtcgaaccccaagtgcggtgtttgtgccaagaccgtgtacccgatggagctggtgacggcggcgagcaagagctttcacaagttctgcttcaagtgcgagaagtgcaagaccacgctcaacttgaagaactttaaggcgcacgacggcaagatttggtgcgccgtgcactacccgccggcacagaccaagatcacgtcgttcaacaacgacaagtcggccgactcgggcacctacgagaacgaggcgcagcagtcggtcaccgacgccggcggcgcgtggggtggtggtcaggcggacgccggcgagtacgccaacgagccgcaagccggctac

SEQ ID NO: 11084 - DNA, 515 bp, Lycopersicon esculentum
  Predicted polypeptide sequence is orthologous to G663
gtaaaactatatattatagaaaaaataatgaatactcctatgtgtgcatcgttgggagttaggaaaggttcatggactgaacaagaagattctcttttaagagattgcattcaaaaatatggtgaaggaaagtggcatcttgttcctgctagagctggtttaaatcgatgtcgaaagagttgcagactaaggtggctaaactatctaaggccacatatcaagagaggtgactttgctccagatgaagtggatctcatcttgagacttcacaaactcttaggcaataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatga

SEQ ID NO: 11085 - DNA, 395 bp, Lycopersicon esculentum
  Predicted polypeptide sequence is orthologous to G666
ctaggagaagaaattactaacgggtccttatataaccaatctcttcttccaggaacaaaaagttagtgatgatgacgaatttgaagctggtgatgatggtgaaaactagaaacgtaactgatgtctattcctcccatggtagctagtctcaagatgttcttcgagaacacgaaacatatgatcgtttttcaaggtatgtatactaataatatacataatttgttctgcctttgtaataatatatatcgagattaatgcaagtatcctttcattttctcatgtaaatttgaattcctttggtaataatgtgttcaacatttgtatgcattttatgtaaagatttttttttaaaaaaataaattaataactattgaatatagaaaaaaaaaagaaaa

SEQ ID NO: 11086 - DNA, 694 bp, Lycopersicon esculentum
  Predicted polypeptide sequence is orthologous to G666
gagaattcaaaattgagatgggtctcttcttttccgtttcccccctttttcttttgggagaatcctatttcaccttctatatattattgttctccactgttaagaagggggattttttttgaaagcttaaaagttttcggcaaaagattttatagaggaaagaaagttgctaacctaaaacgttcatataagaaaatacattctgaatatatacttgatttctttgttcgtggtttgctgggaatttgccggtttctttgaagttattccttgaagttggtggaaaagtcacgttctccaagctcgtcagcctttcttggtcgccgcaccttaaaagctatgtgttggtttgcttcagcgaccaatgtggatggaccttaaaataatcttgcagaaaaaaatctgatgtattcaaagtgagatatttcaacagtgaacatacatgtccgatgcgggataggataccaacaaaagtacaagcaacaattggatttattagtggtgtgactgcccctaaattggtaaatcataaaagaatccatacacttcgagatgtaattgaagatattagagaattgtatggggttgaggtatcgtaccaacaagcatggcgtgctagagaacgtgcactagaaatgctcaagggtaagccatccgaaggatataaaacagatgccgagatacatatggatgc

SEQ ID NO: 11087 - DNA, 566 bp, Lycopersicon esculentum
  Predicted polypeptide sequence is orthologous to G670
ctctctctctctcttttctttgcatgtgagcaagaaaaaataatataatcaacaagcttcacttaacatattcaactttaaaaaaatcacaaactttgccctttttgtttttttttttggttttccagcattgcaagtatcacatggggaggcattcttgttgctacaaacagaagttaaggaaaggcctttggtctcctgaagaagatgagaaacttataaagcatattactaaatttggtcatggctgttggagctctgtccctaaactagcaggtctccagaggtgtggaaaaagttgtagactgaggtggattaactacttgaggcctgatttgaaaagaggaacattctcacaggatgaagaaaatttgatcattgaacttcatgcagttcttgggaacaagtggtcgcaaattgcagctagattacctggaagaacagataacgagataaagaatctgtggaactcttcaattaagaaaaagcttaggcaaagaggaattgatcctaatacacacaagccactttccgaactagagaacgaagagaaagcgtcggcaaac

SEQ ID NO: 11088 - DNA, 500 bp, Lycopersicon esculentum
  Predicted polypeptide sequence is orthologous to G671
gctgaaattattgaaattaatgaagaagaagatgtagattctttatgggaaatggataaagaagctcaaagatataatattaaaagaatcattgagtaccaaaaatctctaatattctcttcttcaacttcttcaacaagtactacttctttatcatcaatttctacttcatctactccaagttcaagtaattcatctaattcattctccaagagaagtaatttattaaatttgatgaaagaagggagcacatcattaaggagattatttgatatggaacatactagtttatcatcacattttcaagattatagtggatcacctattattaaaccacatcttttgtggggcagtgattctgatcctgatcatgatcctgatccttggagttcgatacaaaatcatcaacaacaaaaagatgcaaaagggagtttcatgacaaaacaagaaattgttggcatcaagaaaaagcaaagatttggtaagcataaattgaaaag

SEQ ID NO: 11089 - DNA, 918 bp, Lycopersicon esculentum
  misc_feature (18)..(18): n is a, c, g, or t
  misc_feature (768)..(768): n is a, c, g, or t
  Predicted polypeptide sequence is orthologous to G675
gaaatgatcagtccgttnctgactcttttttactagttaaataattaataaactttttctatcaacatatatatatggtaattaaaacagctcaattatttgtaaaattaaaggtgtagtgtgataatattacttcacagggaatgaaacatgtgattagtaaaagcaagtggattatggctttcttcttcttcctcctcctcctcctcctcacggagttgatgaattgggtcaaaacttggagagttattagcagtacaggtaactgatccatgcagttgatgatcaaaaatattattagtagtaaagttattgaaattgttgatgaggttaatattgttgtttgaaatagaagaattgtttgagtaacttggctgtagaaatgcaatgtgttggtcttgggaaaaatttggatacgcatttgccattgcatatttgctgttcataaccttgtgttcactattggtagctctgattgaacgatgccacctcttgtttccaaaagaaattgtttgaacaaccaagacagtgtccggagcctactttggcttaaaaggatactaccccccgtttttccccgttttcccatgtgcccaatacttatccaatgttttccaaaccctttgccccgtttaaaccccccccctggttgacaaaggggggaaaaccccctgtttttttttttttaaaagaggaaaaaaggccggtgtggacaacacccgttttttccccccccacttaattttgctttccgggggcaaattattnttttggtatttttaatattagcggggcgcccactcttttctcaaccccttggtggaaaagtatttcttgattctaaatccaatcagggattattttcttctatttctctttttctaccccctcacccccccctgctttttcttaactttt

SEQ ID NO: 11090 - DNA, 1125 bp, Lycopersicon esculentum
  Predicted polypeptide sequence is orthologous to G715, G1646
ggcaccattacacctttcccattttctctacacagatagtagcttccattttccgcaaaccgccatggacaacaaccctcaccaatctccgactgaggccgctgcggcggccgcagcagcggcagcggcggctcagtcagccacgtatccgtcgcagactccataccaccatctccttcagcagcaacagcagcagctacagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccagttctgttcgcgaaagcttgtgagcttttcattctggagctcaccatccgttcgtggcttcacgctgaggaaaacaagcgcaggactttacagaagaatgacatcgctgcggcgattactcgtactgatatttttgattttctggttgacatcgttcctagggatgaaattaaggatgagggtgttgggcttggacccggaattgtgggttctactgctagtggtgtgccgtactattaccctccgatgggccagccggctccgggtggagtgatgcttggtaggcctgctgttcctggggttgatccatcaatgtatgtgcaccctccaccgtcacaggcgtggcaatctgtgtggcagactggagacgataattcctatgctagtggaggtagcagtggacagggtaaccttgatggccaaatttaaaagatctcgctgctgccagtttggaggcttaacagcacatgtgaaactgatggttatgatagggaaatgtaatttcttcaaattgtgaatccaccttttatggcttctgtcatggatattgtttgactttaaccgacttgaaccttctgtctgtataaaacttgacttttgtgtatttctagatttctctttaaaatccttttggggttgctaactgccagttctaaatgctgataaaactatgttcacatgtagctgtattggttccacaataccttccctttcttgtttcaaggtccctaaaactttttccaaacaccaaaaaaaaaaaaaaaaaaaaaaaaaaaaaaaaaaaaaaaaac

SEQ ID NO: 11091 - DNA, 240 bp, Lycopersicon esculentum
  Predicted polypeptide sequence is orthologous to G715, G1646
gtttatagagaaagaaagtgtccctgtgtccataaaaagccatggaaaacagccctcagcaatcggcggcgaatgcagcggcggcggctgcatcggctcaggccgctgggtacccgactcagccaccttaccaccatctccttcagcaacagcagcagcagatacaggtgttttggacctaccaacgcaaggaaatcgaacaggttaacgattttaagaaccatcaacttccccttgccc

SEQ ID NO: 11092 - DNA, 214 bp, Lycopersicon esculentum
  Predicted polypeptide sequence is orthologous to G715, G1646
gacatcgctgcggccattacgcggactgatatttttgatttccttgttgacattgttcccagggatgagatcaaggaagagggtgctggtctggggcccggaattgtgggttccacagcaagtggtgttccctactattatccaccaatgggacagcctgcttcacctggggtgatgatgggaaggcctgctatgcctggggttgatccttcaa

SEQ ID NO: 11093 - DNA, 1345 bp, Lycopersicon esculentum
  Predicted polypeptide sequence is orthologous to G718
gagaataattaaacttgcatatttattaggctgagtcgtcggcaagcatttgtttgtgccatttgtggggttaatgaaccatttaatgtttggttatttatttggtttcattgattaggtgatgaaacaagtagctgaaaatgatgttgtggagttaacagatgggagaaacatttgttgtcttggactggaagggattgagctctgtttctgtatttgaatagttatccttgtctccttatagtcttaatcagcttcgtactagttactggaatcatacagctctgtcaaagagattcaagtcttaattactcttttgcattccatgagtctgggaatttggtaaagccatctcgtagtttctttcccaagatggagtggaatgtgaagtgggactggggaaatctggtaatgtttggttcaaaggcctctgaaagtccaaaagaactacaattaacagattggggagttgaagaagagggagaacttgatgggggatcttttaatttgtcaagtggtggtagtggcacgggtggctatggttctgatctgaagtgtggttcttccatcaaaagctcaatatcagcttctactgactcttcaccaaaggatggctttaaagtatccaactttgcttttgagacatttaatgcctctcctgaggatcctagtaagaaattggaatcctccaaagccgaggtctctagaaattcaccacccatggaggcttcagtaggctctgttgaaccagtgataggtctaaaaattggtaagcggacatgtgaaacctttggtggtggaagcagtgctaaggtttcatccttccccccgaaccccacatcatctgctgctgcaacaaagaaagcaaaatcatctactcagaatgcaccaattcctcactgtcaggttgaaggttgcaaccttgatctttcttcagctaaagaatattatcgtaagcatagagtttgtgacagtcattccaaaagcccaaaggttattgtagcaggtgtagcacgccgcttttgtcaacagtgtagcaggttccatagcgtgtctgaatttgatgacaagaagcgaagctgtcgtaggaggctctctgatcacaatgcacggcgccgcaaacctcaccaggaaactatccagttcaattcagcgaggctttcgtcgttgttttatgatagcaggcaacctatgaatcttgtgctcaacgaagcacaactcattcactccagagctgctgcaaacgctacctgggagagcactcaagactctaagttcagtataacaagagagtttactccaaagcctgaaagaactggcagcacaaatgggaagtcattactgg

SEQ ID NO: 11094 - DNA, 890 bp, Lycopersicon esculentum
  misc_feature (867)..(870): n is a, c, g, or t
  Predicted polypeptide sequence is orthologous to G720
gcaaattttgccaaaggaagtagaaagaagatggcctaatccgcaaccaatagattcagtccaaagaagttactatcctcataaacctatcatgacattcccacaatatcattctaatcatgttgccccaggtggtcagttctatcctgcttgggtaacaccagcaagttatccgaacggtttacaagtgtggggttcactttactatccgggatggaaacctgcagagacttggcactggacgcctcgtccagagctgcatgctgatacatggggctcccctatcatgtcaccgtcgcttggatcatatccaccatatcctcagaatgctggagtgtaccggccacatggaacacataacagatatagcatgctagagaagtcgtttgatcttcacccggcggatgaggtgattgataaagtagtaaaagaggcaataaccaaaccatggttaccacttcctttgggcctaaaagctccttcaacggagagcgttcttgacgaactttctagacaagggatctcaaccattccttcacaaatcaacgactcccgttgtcggagatgagatgacatgtcattctaattttttttgggtcccatagttggtgcatgtcaaaaaaaaataataatctccaattacttgatggacatatgtaccatgacattacccagtgacccgagtgacccacgcgtatggcattgactcgacggtcaaaatcgagttgttgtaaataatggacccaaatatgggttttcccttttttgttggcccaattttagatgtttgggccgatgagtgtgctccattaatttctttggaaaataatgaataaaccattcttagtttatgggttataaatcccnnnnaaaaaaaaaaaaaaaaaaaa

SEQ ID NO: 11095 - DNA, 790 bp, Lycopersicon esculentum
  Predicted polypeptide sequence is orthologous to G720
ggttttttgtttttatatgctgcagcatgtcctctatttttctttgaaaaaatttcttgtgactaactaaaaagtgtacagttttttggtgattaataaatttgttcatgtgtgcagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgataaatatccagctccttcaaccccacaac

SEQ ID NO: 11096 - DNA, 1261 bp, Lycopersicon esculentum
  Predicted polypeptide sequence is orthologous to G720
tatactaatttattattgaatttacatgcattacatgtatcactgtgattcttctttacatgttcatgcatctagaacaagaacaaagttaacaactttcttgcttgtgctttttcttcacctaattttgaaaactaaaggttttcttgaaattgtgatgttggtgttttcacattttggtgttaatatgttgaagatctctcacatggggttttctgtttttcattttttgttgcttttatgttttttttcttcttcttcttattttaagataaaaatacagtctttacctcttcccttttttgttatgtgatgttaaagattcaagctttataaggtttgttggaaaaagaagatgattttgtattttttaggttttctgttgattctatgacattttttttctaaagattgttttttttttagcataaatcggaaacaacctctttagttcaaggtatgcgtacattctaccctctgcagaccatggattatattgttttaatgtctgaggggaattcatttttgggtgtgcagattgaatagttaatgactgattaaaaagtgaccgagttggagggactaaaaaggatgcctttttagaaatgatttgcattgagaatgaattattgggttggaaagatttcccaaaggggcttaaagtcctacttcttgatgaagatagcaactctgctgctgagatgaaatcaaggcttgagaaaatggactacatagtctactcgttctgcaacgagagcgaagctttgactgcaatctcaagcaaatccgagggctttcatgttgccattgtggaggtaagtgcaggcaacagtgatggggttctacggtttcttgaaagtgccaaagatctaccaactataatgacatcaaatatacattctcttagtaccatgatgaaatgtattgcgctaggcgcagttgagttccttcagaaaccattgtcagatgataaactcaaaaatatatggcagcatgtagttcacaaggcattcaatactagaaaggatgtgtccaaatcacttgagccggtaaaagattctgtcctctcgatgctgcagttacaactagaaatgggtgaagcagatgacaaaagttcaaatggaacagaacctcccactgcagtagcggaaagcaatactgaacagtcatcgggctgtgataaataccctgctccctcaaccccacaattgaaacaaggagtgcgatccgtcgatgatggtgactgccatgatcatactat

SEQ ID NO: 11097 - DNA, 467 bp, Lycopersicon esculentum
  Predicted polypeptide sequence is orthologous to G720
caaaggaggaacactattctgctgctgatcaacatatggaggatcctattgctacttgttcaccaagtaatgacaatggcagtacttgttctgctgacccgaacaaagcttctggtctccatagttcaagtgggacaaaagctaataagaagaaaatgaaggtagactggacacctgaactacacaagaaatttgttaaagcagtagagaaaattggtatagatcaagccattccttctcgaatactggagctgatgaaagtagaaggcctgacgagacataatatagctagccatctccagaaattcaggatgcagcggaagcaaatcttgccaaaggaagacgaaagaaggtggcctcgtcctcaacctagagatcctgtacagaggacctattatccacataaacctgtcatggcctttccaacccatcattccaaccatgcaaccacagctggtcaattctat

SEQ ID NO: 11098 - DNA, 578 bp, Lycopersicon esculentum
  Predicted polypeptide sequence is orthologous to G720
ctgtcatggccttcccaacccatcattccaaccatgcaaccacagctggtcaattctatcctgcctggataccaccaggaggttacccgaatggtgcacatatgtggaattcgccttattatcatggatggcaaccgcctgagacgtggcactggaatcctcaaccagggctgtatgctgatgtatggggttgccccgttacgcctccatctttaggatcatgtacaccataccctcagaatgcatctggatttcacagggctgagggaatgctgaatggatatagcataatacagaaatcagtcgatcttcacccggcagaggaggtgatagataaagtggtgaaggaggcaataaacaagccatggttgcctctacccttgggcctaaaacctccttcaacggagagtgttctcgacgcgctttctaaacaaggcatccccgccgtccctccacgccaccaccgctctcatcgcccacactgacatgccaattgcttaccgggaatcccatatacggaggctcgtgtttgaacactccacccatgcgcgtggcgatgacttcacccgacacgaaag

SEQ ID NO: 11099 - DNA, 866 bp, Lycopersicon esculentum
  Predicted polypeptide sequence is orthologous to G728
gtgatacaacaattaaatatatttttttttataaaaaaaattatgggttcaaattctaaagaaatgaacattgatttgaattttgtttatgtacccaagttaatttcagatgttttaactgaagtttctgccatggatgacatctccaagaaattaaaaaagctcaatcagtttcttgttcctttagaagaagaactcacaaaaatcgaagcttttaaacgtgaattgcccttgtgtatgcttcttctcaaacatgctattgagagattaaaggcagaagctttgctgtataaggagaaagataaaagccctgtgatgatggaggaattcatcccactgaagaagggtaattctgatgaaattggaagggtaaaaaagtcaaatgatttaagtgataagaaaaattggatgagctctgctcagctatggagcactccagttcagtatgaaagctttaatcttcaaaacttaaaacggagtggtgtagaagataaagccaaggagaagcaataccagttaggagcatgtaaattgacgagtgaaagaggggcatttttgccatttcaaagacaagctttgaaggtagacaaaaaatgtttggcagtgaaggatttatctctgtcaatggcagtgacagtgggtgaaggagaaaaccgtgaaaatccaattgatgtgagtgtcaaaagagagaacggcccatcaaattcaaatgggtgtgatggtttttcacatgacaaatcactacagaggaaacagaggcgttgttggtctccagaattgcatcgcagatttgttgatgctcttcatcaacttggaggtccacaagtggctacaccaaaacagatcagagatatcatgcaagtgga

SEQ ID NO: 11100 - DNA, 669 bp, Lycopersicon esculentum
  Predicted polypeptide sequence is orthologous to G728
ggtttaacagaatcttctccttcttaccctccacccccctacccctccactttcccttcttttcttttctccactcttcttttctctctttatatatatatatatagaatttatccttataatttcttggggttccatttttatccattctgagtgcaactgaagcaaaaagattcaattttgttgttgttgtaaagatctaatctggaagatctggagaaatgggttcgatcccagccgaattgagcttagattgtagacctagttttattcccaaatctattactgattttcttcgacaactttctttgatccgtaatgttcctgataaactatcacagattgacgattatatcaccagacttgaagatgaaatgaggaaaatcgatgccttcaaacgagagcttcctctttctgttcttcttgttaaagatgctattgtagctttgagagaagaatcaatgcaatatagaaaatcgagaacagaaccagtattggaagaatttattccactgaagaagagttcccgtgaagatactaaagctgaaattactaaagataaggatagtagagaaaagatgagctggatgagctctgtgcagctttggaacagtgaatctcactgcgaaaatactgatgaagcgattaataaacaacagtctaaatcag

SEQ ID NO: 11101 - DNA, 662 bp, Lycopersicon esculentum
  misc_feature (595)..(595): n is a, c, g, or t
  Predicted polypeptide sequence is orthologous to G729, G730
ctactactacctttcttttgatcaacacaaagataacataagttactagtaagcgcagcgcgctagcgcaaagaaagagaagaagtatatacatggagctattcccagcacaaccagacttatctttacaaataagtcctccaaacaacaaatcatcatcatcatcaacaacaacaacaacaacatggaaggctatgagtagtaataataacaatattgatagagatgagatggacttattcttcttgagaagagctttagaatcaaaacctgataacaacaatactctttttgagctttctttatctaatcctaattataaaccttctcatcatactcaactaattaactcttcccattttcatcccctacaaaacacaaatttcatccaccaacaaaatcaacaacaacttaatatcatgagacctataagaggaattccattgtacaatcaaaaccctcttcctcttcctcttcctctttctcatcatcataataactacccaatatttgctcaccaaacctttgaaaatactgctcctacaacaacacctacattacctatacattcttctggatattgtattagtagttntagtaacaatagtaacaaaactatacctaattcctcaccaacaactatcccttttcatcattctaat

SEQ ID NO: 11102 - DNA, 908 bp, Lycopersicon esculentum
  Predicted polypeptide sequence is orthologous to G729
gatttcaacctttcatatgtaatgcaactaatggatctccttcattcaacattacctttaaccaaagaaaatgtatctcctttgtaaagggtttccccacaatggccatgaatgattgctcggaggtggccaaataaggctaaagaataaggtcccaaggccctaaataagtagaatttgatagtcaaatgtcataattttgattaccatctgaacttgtatcaactgtttgagacaaatgaaataatactgtcaagtgtcaatattcttgtgggcacactagtggtcaagaatgtttatttttaggattaatccaaaaatagtttaattaatccatcagcagcatgtaagtgaagatgtactaatgagtgacatttgtgaagttatttagattgtattcttgaattctacttcttttctctgcatcctgttgagatttgaggttgatgagagttatgtttgacctagattgtcagatttataaggctggtggttcttgatttgtttactactgattcttcaagagttgagtgtggtctagattcactatgataatgataatggtgtgttaacaaggacatgtgaatacttgtcaaaaagagatctggtttgttaagaggggacaaaggtttgtcctgtaaaattcttatgatataaaatgtatttatatttcttttcaaagaaagtggacatcatcttgggactgctgaaagcatgaatatcctttttgggtggaagtgttattttttcgaattatgtcaaacatttcaagtcatcctggagcggaaaaatgtgaaggtttcagtgaagtacataaaatcatgaaattgtttacatcattatggaacctgaattgtgcacatctggtgttgggttgttagtttgattgcacgttcttaatgttcaat

SEQ ID NO: 11103 - DNA, 569 bp, Lycopersicon esculentum
  Predicted polypeptide sequence is orthologous to G729
gttttcacaaacaccattatccccttcttcttcttcctttttcacaaacatgtccacttaaaaagaagataaaagataaaaatcaaaatctttgctcttcactttttcttcacttaccaccaccttggcttttttttactcttttttccacctaaatctatcatcaagaatcaaacttgaagtttgttcatctctctttttccacatcttgtttatgtgtgtttgcaactttttaccttttatttttcatcaattttggggttttttgaggtattaaagaagaaaaaaagaacaaatcttgaattgtcatataattttgtttgctatccaatatgcccttagaaggggtttttgttcaacaaaactcatcttcatcaaaacaaaccccggatctttctcttcatattagccctccaaattcatcatcatcatcaacacgtacaacacataataatagtttgactgagctttgtttagctcatccaactactaccaataatgaagaaaataagagtttttcaagaaacccttttctccaacaaagcccaaacatgaatagttatcatggg

SEQ ID NO: 11104 - DNA, 405 bp, Lycopersicon esculentum
  Predicted polypeptide sequence is orthologous to G729, G730, G1040
gatggacaacttcacttcatgctagatttgctcatgctgttgagcttcttggtggacatgaaagggctactccaaaatcagtattggagctaatggatgtcaaagatctcactctagctcatgtcaaaagtcatttgcagatgtatcgcactggtaaaactactgacaaacctgcagcttcctcagatggatcaggtgaagaagatttgttagctattgacaagattatggatcaaagaggtccattagatggatgtgatgaaccttctacaactctttggagcaactcctcaagtagtagagaaagattgtcacaagctaactttaatgaatcaaatggactcatcagatcatcctctttcccatctcaacaaagattcagccatcatatagaggaatgtgaat

SEQ ID NO: 11105 - DNA, 490 bp, Lycopersicon esculentum
  Predicted polypeptide sequence is orthologous to G729, G730, G1040
gcacgagataatagtttgactgagctttgtttagctcatccaactactaccaataatgaagaaaataagagtttttcaagaaacccttttctccaacaaagccaaaacatgaatagttatcatggggtttctttattagaccctataaagggtatcccaatttatcatcatcatcatcatcaagatccaaagagatcatcatcatttggatccatttatcataataatttggatcatatatcatattcgaataattcctatgttacaaatgttacttcctcttctccttataatcgaatacctattgtggctaatagatttcaaaatcaacaacacatatattataacggagttggattattaggttcaccttcttctcatgaaagtaataattttttgatgagatcaagatttttacctaaatttccaactaaaagaaacatgagggcaccgcgaatgcgatggacaacttcacttcatgctagatttg

SEQ ID NO: 11106 - DNA, 657 bp, Lycopersicon esculentum
  Predicted polypeptide sequence is orthologous to G732
ctattttctctctctattattatacactttctagcatttctctatttttcttcttaaaatataaaatatttatctatttttgattaaatatatattgatgctaaacttcttatttatcatctttgcaattgatgtctgcaattctcaatgaactctttctttgtggttttatgataaattccacgtataggcgaaggacccatttagtgcaatctttttctgttgtttttctctattggttttattgcatctcataatcaaattaattattttatttaattaattccccccataaaattattattattattattgcatacacataagtacttatatttagacctaaaaaaatcaatattttgggtcctgctaattttaattactattattttaaaagaattttgtcatggcttcatcaagtggaacatcatcaggatcaagatcggggtcagggtcatatacacttctaaactcgggatcagaagaagatttacaacaattgatggacgaaagaaagagaaaaagaatgatatcgaatcgtgaatcagctcggagatcgagaatgaggaaacaaaagcatttggatgatctcatgtcccaattgtccaatctcatgaaagaaaataacgaaatattgacaaacatgagtgtcacaac

SEQ ID NO: 11107 - DNA, 782 bp, Lycopersicon esculentum
  Predicted polypeptide sequence is orthologous to G735
ttttaggccagcaaacagataatcaaattgatataacagtgtaaccgaaaaagcattggcacacacaatagtcttgttcttttttgcttttttttttcttcagatagactcgatatactaaaaagattaattatttcaaagtaatttgatatgtaagatttacagatctctgtgaaatcttccttgccgtaacttctgctcattaagtcattctacttctctcccttgccttggtttccacaagtacttgcttctccgcagatgcgcttctgcagatgctccaacctagcctctcgctgcattgaagatggtctgtcaattgtgttggcttcaattgcctctgttgcggagctctgatgtacatttcctataggagggatatctaacataccgttttgcattctacaatcatggttgggcatatgaccattttcaggcgctggatagttcaggtcatcatgttcagggacagcagcgtctgctgatgagtcgaaaggactactagtgaaagatggcatcattactgtcgatatctcagacatagcttggaatagaggattcaacccagtaactcttttaacagtttcttcagccatcttcacctttgctctcaatgtctcaacatcggctttcaatactctattgtcaactgctgcttcattgtacttctggcttatgtcagtcaagcgtttcaataaagaggagttttctactcttacttgagagacctgcgtctctagttctgtcagatgggcttgttttcttcttctcgagcgtctagc

SEQ ID NO: 11108 - DNA, 1367 bp, Lycopersicon esculentum
  Predicted polypeptide sequence is orthologous to G735
gatgggatgcagcatagacgtatgagaatcacaactcagatttagcaattcaacaactctctgtctcaaagtctcatctctctctaactaagggagagagagaatggatactgtgttttcagtggatgagattgccgatcaattatggtcatcgccgccaccgatgaggttatctcatgacttggattcttcttccgccacttcgtcctctaaaatgatgaacaggagctcgtcggagtgggcttttcagcgtttccttcaggaggctgcagcagctgaaactacttcctcgtcttcttcacagcagatcaagcttaatcataatttaattcctgatcaatcgaagcctgtgtcatcgtttgtctctgaacctccgattgattccgatgaacatcaggctttcctcaaaagacgcctggatttggcatgtgccgccttcgctttgaatcgtgcaagctatataaaatctcaagattcggcttctttgccacccgaaaaaggatcactggcagctaatgcatcactctgtggatctcaacttcctccaaaaggatctgggcaagaattggcaaaagttcaagataaggatgctggtgagccaattggaatacctcccttgcctgcattgcagaagaaacctggtatccaggtaaggtcaacgacaagcggttcatccggagagcaatcagaagatgatgaagctgaaggagaagcagaaacaactcaatcaactgatccaactgatgtgaaacgtgtgaggagaatgctatccaatagagaatcagctagacgctcgagaagaagaaaacaagcccatctgacagaactagagacgcaggtctctcaagtaagagtagaaaactcctctttattgaaacgcttgactgacataagccagaagtacaatgaagcagcagttgacaatagagtattgaaagccgatgttgagacattgagagcaaaggtgaagatggctgaagaaactgttaaaagagttactgggttgaatcctctattccaagctatgtctgagatatcgacagtaatgatgccatctttcactagtagtcctttcgactcatcagcagacgctgctgtccctgaacatgatgacctgaactatccagcgcctgaaaatggtcatatgcccaaccatgattgtagaatgcaaaacgcgagaggctaggttggagcatctgcagaagcgcatctgcggagaagcaagtacttgtggaaaccaaggcaagggagagaagtagaatgacttaatgagcagaagttacggcaaggaagatttcacagagatctgtaaatcttacatatcaaattactttgaaataattaatcttttttttcttcagatagac

SEQ ID NO: 11109 - DNA, 936 bp, Lycopersicon esculentum
  Predicted polypeptide sequence is orthologous to G735
tttttttttttttttttttacaacttaaaaaaaggatttatatgtatcttttgaatctctacttgttcttcgcatctcataccgatgatatctacatgaatggttgctatgcaacagagatgatgactgagaatagtcagaactagcatagcaaagggatgtcaatccattagtatcatccaagaaggcgttgccatacaaagaatgggcatttttcctgccacaaatggttaaaaacagtataattttatcaacatgcatgtgcaaaatctgattcagtgcagctgggggctttgacagtgtttattgctctccccgaccttgggttccacaggaactcacttctccacgtatgcgcttctgcagatgctccaagctggctacgcgctgcattgaagctgttctacccatcttattcccaccaactgctgcagctgcaggattctgctgtacagttcctattgtaggaacatcaaccataccattttgaattctaggatcatgggttggcatatgattatttggcggttgttggtagtaatgatgttgagaatcatctggcacaggcacagcagtgtctgttgatgtgtccgaaggactgccagagaaggatggcattgccattgaggacatctcagacatagcttggaataaaggatttagccctgtaactcttttaactgtttcttctgccatcttcacctttgctctcaatgtctcaacatctgcttttaggacacgattatcaacagctgattcattgtatttctggcttatgtcagtcagacgtttcagtagggaggagttttctactctcagttgagatacctgtgtctcaagttctgtaagatgggcttgctttcttctccttgaacgtctggctgattctctatttgaaagcattctccttacgcgttttgtatcagctggatctgc

SEQ ID NO: 11110 - DNA, 407 bp, Lycopersicon esculentum
  Predicted polypeptide sequence is orthologous to G735
tctaaaatgatgaacatgtagctcgtcggagtgggcttttcagcgtttcggtcaggaggctgcagcagctgaaactacttcctcgtcttcttcacagcagatcaagcttaatcataatttaattcctgatcaatcgaagcctgtgtcatcgtttgtctctgaacctccgattgattccgatgaacatcaggctttcctcaaaagacgcctggatttggcatgtgccgccttcgctttgaatcgtgtatgttatatttcttaattgattttaattggataggttcgtttcctttcaactgctaaattcaatgattggacgcaatcgctaagtgatttggtattcctttctttttcttggatttaatcaaaccgtaagtaccaatttatccctaggcaagctatataaa

SEQ ID NO: 11111 - DNA, 540 bp, Lycopersicon esculentum
  Predicted polypeptide sequence is orthologous to G736, G2432
agtcccatctctcaaggcatcaaattgtttggtgcaacaatagaaattcaagaaaaacaagccaaagctactcatcaaccaacaaacaaagttgttgttgatgatgatgatgataatgatcaagaaaaaaggccagacaagatcatcccttgccctagatgtaaaagcatggaaacaaaattttgttacttcaacaactacaatgttaaccaacctagacacttctgcaaaggttgtcagagatattggacggccggtggagccctacggaacgtgcccgtaggagccggccgtcgcaaagccaagccaccatgcgggcccggcccgcatggcgacttggctgacggttgtaatctatttgatgtggctaatcagcttgactttgatggatcagtggtggctcatgaagatcaatggcatctttttccggcagctaagaggaggagaagcacctccgatagccaatcttattgattccctctttgtcgtttagtaattatatattttatgtacgtggaattagtaaatggttaattaatt

SEQ ID NO: 11112 - DNA, 2192 bp, Lycopersicon esculentum
  Predicted polypeptide sequence is orthologous to G740
gatcaatgcgaggaagaggatacttgttcttaatagttaccttgttcagttgtctgtagtctatgcacattctaaaactcccatccttcttcttcacaaacaaaatcggagcaccccaaggagatgcacttggtctaatgaaacctttgctcaacaactcttgaagttgggcctttaactctcttaactctacgggagccattctataagggggtatagaaatggggcgtgtgcccggttcaagatcgatacagaagtcaatatccctatctggtggcataccaggaagatctgcagggaacacatccaaaaactcacagactataaaaaccgactcaatcgaaggtacttgggtagtgtcatccttgagatgtgccaagaaagctaaacaccctttactaaccattttcttagcacgaagaaaggagatgatgcacaccggattggaagtgtagtcaccctcccacactaacggatctgtcccaggcttggctaatgtcaccgttttagcattacaatccaagatcgcaaattgcggagaaagccaagtcatacccagaattacatcaaaatcaaccatttctaagataaccaaatctacataagtgttgctccccacaaagttcaccaaacaagacctatataccttttcaactaccacagactcacccaccggagtagaaacacgaataggcatatcaagaaattcacaatgtaaatttagaccattagcaaatgaggaagatacataagaaaacgtggatccaggatcaaacaatacggaagccatgcaatcacaaactagaagattacctgtgatgacagcatcagatgcctccgcttcagaccgcccagggaaagcgtaacaatgggccctatcgtttgtctgcccattgcccctaccatgttgtgatgtagtggccccagtttgcccattacctctgccgttttggtgaccaccattacctcgaccaccacgtcctccagaataacggcctctaccatgaccacctctacctctagctattgggggtctataacttggtccgggacaatttatcctaatatgtccaatctccccacatccataacattctctggagtcactcataggccccttggagaagtgttgaccggtctgaggtggacccccaactacagtctgtagtgaagactgaatgggtcgagctgagtaacctccggaaccttgtcctctagagtaagaacccttaaactcacctccctttcgaaacctctttgatgtcgatgtcgtggtgaagtcgtctggcttcactccttccacttctatcacaaagtctaccacttcttggaaggattttgccgttgccgctacctgtaaggacgaaatccgcaattctgacctcaaccccttcacaaaccggcgaatccgctcttgaggactgaaacagagttgagtggcatatctggatagtgcacgaaacttagcctcataagcattaactgacaccctaccttgctctaggctcaagaactcatcccttttcttatccctcaaagtccgggggatatacttctccataaacaaactatagaatgaggcccaagtcataggtgatgcctctattggttgacactcgatatgtgaccgccaccacatttgggcgttcccttgaaactgataagtcacaaactccacaccaaaccgttctactatacccatcttgtgtagtagctcgtgacagtcaaccagaaaatcataagcatcctccgattcagcacccttgaagaccggaggtttcaatttcaagaacttactgaaaagttcatgctgatcatttgtcattataggcccagtagtcaaacgtggaaatgtgcctatgtccaatggaacatccatgcggggagccatagtagccgcatgttgtacttctgaaaccggaggtgttggcgcagaaaacactggaggtgcttgaccttgatcagataaaccgctaagataagccagaacctgattgatcatctctggggtaggttggggtggcatttcctcattttgcacttgttcagtttccccatcctccccttctcttattacttcctcagtcggtggaggagtcaccgccctagtaccagatgggctcggttctcgttctcttcctctagatgacgtcctcccacgacctctaccacggccccttgccgctgttctc

SEQ ID NO: 11113 - DNA, 517 bp, Lycopersicon esculentum
  Predicted polypeptide sequence is orthologous to G740
tggaggaggaggagcaagtggtggtgtctgttacacttgcggtgggtatggccatatggctcgagattgcccgagtgctggacgtgttggcggccgtggtggaggaggtagtggggcttgttattcatgcggtgcacaaggacacttggctagagactgtcccggtggtggtggtagtaattttgggagatctgggggtggtagtggaggaagcaagtgttacaactgtggagaggcgggccactttgctagagaatgcactagccaatccgtgaactgatcatgtaaatgatctttctctttattccctacaccctcttagtactcattttcttagcagtgacatgtttttccagtttttctttgattagctatatgaccggttgtgctttcggagtagctctaccgagctgtttgaattcatgttcttgggatgcaaagttttagttaatgatttatatacaagtatataaaaaggctgaaggttcgattcttgcaaaaaaaaaaaaaaaaaaaa

SEQ ID NO: 11114 - DNA, 749 bp, Lycopersicon esculentum
  Predicted polypeptide sequence is orthologous to G740
gaccatatagaccaaaaagaaaaatattccaatgtacttgttataattgcggaaagataggacatttagctagagattgtaaactacccaaagatccgaaaatgaagcaaattgcagaagtaattatagataatcataaatatatgcaaatagaatacatagactatgaattaagtgaagacgatagtatatatgaagtatcagatatagaaactgaaaatgaagaagaaaatattaatctagataataatgaaacagatgaagaaatataatgtctgaagatgagataaaaataatatctaaagaagattatcaaaatgaagaattatcagactaaaaaattatatttgataatacaatttttgaacaaataaaaggaaaagaattagacttaagtgttgaaaaagtacttgaaatacctactctatgaaattggtttaaaagacaaaaagaagaatattatgtagttagtcaaaaagaacatattatagattgtaaatatgcaagaggaaaaacatatatacctatactaagtaaacgaataataaataaagaaatacaagatataaaagctaaaacaccaataaaatatgtacatttaggaggaacagaaatattaataaaagcttgttttagagaaggaatagatacacctattgaaatatacttagcagatgatagaattatacaccctatagaaaaaagtgtaattagtgcagtaaagggaaacttatatatcaaaatttaaa

SEQ ID NO: 11115 - DNA, 646 bp, Lycopersicon esculentum
  Predicted polypeptide sequence is orthologous to G740
gaaacacgaataggcatatcaagtaattcacaatgtaaagttagaccattagcaaatgaggaagatacataagaaaatgtggatccaggatcaaacaatacagaagccatgcaatcacaaaccaaaagattacctgtgatgacaacatcagattcctccgcttcagaccgcccagggaaagcgtaacaatgggccctatcattcttatgtctgttgcccctaccatgttgtgatgtagtggctccagtttgcccatcacctcggccgttttggtgaccaccatttcctcgaccgccacgtcctccagaataacggactctgccatgaccacctctacctctaacctttggaggtctgtaactctgttttggacaatatctcttaatatgtccaatctccccacacccatagcactctctgggttcatgcataagtctctcagagaagtgttgaccggtcgaaggtggacccccaactacagtctgtagtgaagactgaattggtcggactgagtaacttcccgaaccctgtcctctagtgtaagcaccattaaactcacctccctttcgaaacctttttgatgtcgatgtcggggtgaagtcgtctggcttcactccttccacttctatcacaaagtctaccacct

SEQ ID NO: 11116 - DNA, 1875 bp, Lycopersicon esculentum
  Predicted polypeptide sequence is orthologous to G748, G1900
tagtgatggtgttatatatgatggaaatagaaatgggtctgatcttgatcgatgtttagagggaagtaaagcaagcagtgtagagaaggatgaaggaagtgagtatgaaaagcaagaagctgaaaaggataatataactggagagctcagtgaagctaaatctgaggagggagaccaaaatcagatgatagaagaatcagaaaatcctaagactccatcagaatcagagagcagtcctaaatcttcaactgaggaagaccctcaagcagtaaaatcatccaagactgagaatgaaccgactaatgtgacaaattccgagcagaacaatctgaagaagccagacaaaatcctcccatgccctcgttgcaatagtttggatacaaaattctgttactataataacaacaatgtcaaccagcctcgtcatttctgcaggagctgccagaggtattggactgccggtggtaccatgaggaatctccctgtgggagctggtcgtcgcaagaacaagaatcttgcatctcaatatcgtaatataagtatccctgaaggattactagcagcaggaattgaatctccaaatgggttaattcatcatccattattcaaaccaaatggcactattctatcgtttggtcccgacttacccctgtgtgaacctatggcttctgcattaaatcaagcagagaaaagggtatcaactggtattcaaaacggttctcataaatcagaagtcaagaattcttcttgcaaaggtggagattctggggatgagtgctgtagagggattaacatcccgactccaaatatgatggtggaagaaggtaaaggagagccccacaaggctgttatgcatagtataaatggcatcccgtctcctgttccgtgcctccatggagtaccttggccttttccatggaatgctgcagttcctgtgtcggctatttgccccattcccttccctatgccattcttccctacaccttattggaattgcagtgtgcctccttggagtaatccttggttgagtccacctctgcgagctgcaaacgagaaaacatcaggttctgatcctacttcttctttagggaaacattcaagagagggggatttgcttaagccaagcaatcctgggggcaaagaacaatcagaacaaaagtattcagaggggtctattttggtcccaaaaacattgcggattgatgatcctgatgaagctgctaagagttctatatggtcaacacttgggattaaatatgattctactaacaggggagagtttttcaaggccttgcaaccaaaaagcaatgacaagcaccacaaagccaatacatttccagtattgcatactaaccctgcagccttatctagatctatcaccttccaacaaggtgcctaaagatgatcctatgaatctgcgaaggatggtcttcacttgaaattaagtatgactgttgtctgatgagggctttttggggcctagcaaccaaaaagtaacaaagctaagataatgcttttttctcccattgaactccagcgggaaacttcatggatttcctgcctgatggggacatttacagtgcgcagatcacttacagagctgccaggctaatatctctcaagtgatccaatgaaactggggaatgacatgggaagctattgtagaaacctattgtttatagttttcttggtaacaataagagcaagtggctggcttggtttttacttttgtgtgttttctaatgtacatacctttttacagctaacactagagtgaggaagacagttgtttagatcctcatccaacagttgttgtaacatattttaaattaatgtcaaagttagtttggagagccaaaaaaaaaaaaaaaaaaa

SEQ ID NO: 11117 - DNA, 617 bp, Lycopersicon esculentum; identical to SEQ ID NO: 10332
  Predicted polypeptide sequence is orthologous to G748, G1900

SEQ ID NO: 11118 - DNA, 829 bp, Lycopersicon esculentum
  Predicted polypeptide sequence is orthologous to G752
taaagctgtcatctgactctattttttttttttataattaaagcaaagtccaaaacacttttagtggagaatttttgaaggagataactatcaatgttccttggctatcaccacacagcctgtatttgcttgggtttattggcttaatgtgacaagaactgtatatatacacaaaagcataatgaacagaaacaatgtttaatgtgacaagaacagtatatatacaccaattgagctaagatggagctgctgaagctttacatataggacaccaattcttgagactcaaccaatgttttacacactccatatgatacccatgatcacattccaaccttcctatttcatctccaatcacatactcctcctgcgaaaaaacacgtcattaacttaactgagttccaaccttcaattcattttggtattgcataatcgtagatgcttgaagtggcggagacacccttctaccacgggtgtatcctacacttttttttcataaccgaatgatgttatagagaacccctagataaactttagaaacgggtctaaaattatttgacgttaagggaatgtttttctaacataaaaggccaactatgttgtggaggctgctataaaaatgtttttagaacatccaattatatacacccccgtggaacctttagttggacagaagaataacttccgccaacaactatggggtcttatcctacccagacatttgcttatccgactttaatggtgcttttttcaaccatatttacttctaacggtatatgcagtttccctcgcaaggttcgtacaacttttacttttgaattgtgctatt

SEQ ID NO: 11119 - DNA, 1428 bp, Lycopersicon esculentum
  Predicted polypeptide sequence is orthologous to G760
ttcaaaaatgtcttttttccaagtccattaaaccctaaatctcacaataccccaaattcctaaatttaatctcaattttctttttatctgtgtttagtataaggtcttagataattttaattttttttttgtgaattttttgaattttttttagtgtggttgatggaatcgagaggatcatcgaaattgttggcgccggggttcagatttcatccgacggatgaagaattggttaggtactatctccgccggaaaatctatggaaggacgtttaagtctgatcttatatcggagattgatatttacaaggttgaaccatgggatcttcctggcatgtcaaggctgaagacaagagatttggagtggtatttctttagtgttcttgataagaagtatggcaatggagcaagaaccaaccgagcaacagaaaaaggctactggaagacaaccggaaaggatagggctgtccatcgtaataagtctcaggttgttgggatgaagaagactttagtttatcacagtggtcgtgctccaaagggtcagagaactaattgggtgatgcatgagtacagattgattgatgaggcattagataaagctggaattcctcaggatgcatttgttttatgcagagtcttccagaagagtggtgcagggccgaagaatggggaacagtatggggcaccttttatagaggaggaatgggaggatgatgagttacaagttccttcgaaggatgagactactgaggattttgtatttggtgatgatatatattttgatgcaaatgaacttgaccagattcttgggaccgacaaagctgtggctggtgcttcttttccttcggattattcttatggtgaaaatggaagtacggaggagacaaataactcctctgatgcacagcaacctgacgagcttaaaccaattgatctagctgttcaaaagaattttaatgctgagcaagtcaatcatgaatatattggtgaatcaagcaagaacatgaactctgaagatggggattacttgcttaatgaaccaactgtgaatgggactgatgacctccaatttaatgatgaagctctcctcgaatctaatgagatgtcaaatccctttcaggatgactgctctgagaacgacatgcttgaagaataccttacttactttgatgcaaatgacgactttcagaatatgagttttgatccttcagttttctttggaaatgatgatcaaatttctgatcaagcactgctgcctcagaaggacattggggaggtaactcagcaacctattgcgcccaatgaagggtttagtgaagataagaatggtattgcatcgtcctccaaactggtaccaactaaatttgaatcagattatcagtatccatttataaagcaggcaagccagatgttgggcaatattcacgct

SEQ ID NO: 11120 - DNA, 687 bp, Lycopersicon esculentum
  Predicted polypeptide sequence is orthologous to G760
gctttcttggattttcgatttccgtgtcaagcaagccttcgccattttcactttacttcacttgtaatcttcacaattctcatatctatgataccctttatctttatgttccatgtatttttcttaattgggtattctcaaaaaagttaaatttacattcttggctttttgggtggttgagaaatggaacaagaaggatcgaaaggggctgtaacggtggcaccaacgtctttagcaccgggattcaggtttcatcctaccgatgaggaattagttaggtactatctacgccgaaaggtctgtggaaagccattcagatttcaagctgttactgaaattgatgtgtacaaatctgaaccttgtgaccttgcaggatattcatcggtgaagagcagagatatggagtggtacttcttcagccctgtggataagaagtattgtaatggatctcggcttaaccgagctactggtcaaggatattggaaagctactgggaaagatcgtcatatcagccataagtctcaggccattgggatgaagaagactctcgttttccatagtggtcgagctcccgatggcaagagaactaattgggtaatgcatgagtacaggcttgcggacaaagagttggagaaggctggaatcgtgcaggattcctttgttctatgtagaatcttccaaaaaagc

SEQ ID NO: 11121 - DNA, 700 bp, Lycopersicon esculentum
  misc_feature (591)..(591): n is a, c, g, or t
  misc_feature (618)..(618): n is a, c, g, or t
  Predicted polypeptide sequence is orthologous to G760
gaattacaacacctcttcatcttctctctctaactcctaaatcttaccaaaattctgaatttttcgttgctgtatcaactttaggcggttatactgaagaatttcttgttaaattgttagttttttcacaaaatttggttcaaaattgtccatttttgttaactttgactgatggaatcaaaagggtcggcgaaatggatggcgccggggttcagatttcatccgacggatgaggagttggtcaggtactatctccggcggaaggttattggtaaacctttgagatttgatgctatttctgagatcgatatttataaagttgaaccatgggatcttccgggtatgtcgaggttgaaaacaagagatttggaatggtacttcttcagtgtgcttgataggaagcatggtaatggagcaaaaaccaatcgggcgacagaacgaggctactggaagacaactggaaaggacagagctgtccatcataagtctaaggttgtcggtatgaagaagactctagtttttcatagtggtcgggccccaaaaggtgagaggactaattgggtcatgcatgagtacaaactaattgatgangagttgcaaaaagctggaattgttcangatgcacttgtgttatgtagagtcttccagaagagtggcgcagggccaaaagatgggtgaaaagtatggggctccttttgtt

SEQ ID NO: 11122 - DNA, 611 bp, Lycopersicon esculentum
  Predicted polypeptide sequence is orthologous to G760
gaacatgaactctgaagatggggattacttgcttaatgaaccaattgtaaatgggactgatgacctccaatttaatgatgaagctttcctcgaagctaatgatctttcaaatcccgttcaggctgacagctctggtttcgacatgcttgaggaataccttacttactttgatgcaaatgacgactttcagaatatgagttttgatccttcagttttctttggaaatgatgatcaaatttctgatcaagcactgctgcctcagaaggacgttggggaggtaactcagcaacctattgcgcccaatgaagggtttagtgaagataagaatggtattgcatcgtcctccaaactggtaccaactaaatttgaatcagattatcagtatccatttataaagcaggcaagccagatgttgggcaatattcacgctcctccagcatttgcttcagagttccctacaaaagatgcaattctccgtctgaactcattctctcggtcagctagttcagttcaggtcactgctggcaatgggacgagatggccattgggcaagcatgtgtattacaacattatcctatctcttggcctatcacggggtagtagtgatgact

SEQ ID NO: 11123 - DNA, 751 bp, Lycopersicon esculentum
  misc_feature (574)..(574): n is a, c, g, or t
  misc_feature (671)..(671): n is a, c, g, or t
  misc_feature (681)..(681): n is a, c, g, or t
  misc_feature (751)..(751): n is a, c, g, or t
  Predicted polypeptide sequence is orthologous to G760
gattagctcatttttttttttttttttttttgatcagccaaaaagagaatggcattacataaaatcatcacagtaattaattgttgtgtaaaatgagttttgcagcatccaagctgcactgtgatacatcattgaattttaaaatttgttcaggagtcagaaactgcatcaactcacttgaatgtctaagacactaaatattcctggtataggttgtgtatcatatataataatgttcacttcagtcagagatcaagatatcctgccatgactttcaaaagtaaaaattgagctctctagattcttgaggccttacgcagcacgaatgaaggtcccgattttgaaggttgtggaaagaaggaggacccaaaggaacagataatagaaccagcaccaggacactgtcgaaattgtcttcccagggagaaaactagcttctgattccaagtgagcggagctatcaccatgctgtgataagcctaaagataggataacgttgtaattcccatgcttgcccaccaacccgtcatcccattgctgctcacagtcatgtttgttattcgaataaatccantgacgtggattgaactggatgcttctgaggaagaattcatacggagagctgcattttttgagggaactccgagcaatgcaggagagcagtataccgnccacatcagnttgctgctcataaatggtactgtatcgatcaattaaatgttcagttcagatgagcaactgtgcgattttn

SEQ ID NO: 11124 - DNA, 669 bp, Lycopersicon esculentum
  Predicted polypeptide sequence is orthologous to G760
cagaaaagaagaaatattgagtgtataatggggaatttgaaagagggtttccgattcagtccgactgatgcagaagctgttactttcttgttgagattcattgctggaaaattcatgaatgattctggattcattaccactcatgttgatacttacgggaaacaagaaccatgggatatttacagtcatggagtagcctgctctaatgacgacgaggacaatgattgtagtcaatatcgcttcttcatcacaaaactcaagaaaaaaagcgagtccagatatagtcgtgatgtgggaaataagggaagttggaaacagcaagacaagagcaaatccgttcgaaggaaaggcggaccagttattggatacaagaagagcatgtcttatatgaataaagggtataacaagaaaaatggtgattggctgatgaaggaatacaccctccctgagtatcttcttgataaatttgacaaggattgcagagattatgttctctgttctattaagaagagaactcgctccaaaactcagactaaagaaaaattgaagttggtgaatattgttcctgaagagtccacgaatttggaagatcaaagttctgccactgttggatcgactagttttactgagggattaccaggaaggggagtggatgcagggggatatctg

SEQ ID NO: 11125 - DNA, 1584 bp, Lycopersicon esculentum
  misc_feature (1563)..(1564): n is a, c, g, or t
  Predicted polypeptide sequence is orthologous to G772, G776
cacccttttccctcttttatacttctctctgttcattttatatgtatctgttgtttctctggtgggtttcttgaaaggaatttttctctgtttttttttggttccagaaatggagcaagagggtgcacttgttttagcaccggcaccggtggggccggtgcagccggtgccgccagtggcgccgagaagggcagtgggagttttttcggcgacgtctttagcaccgggattcaggtttcatccaactgatgaggaattggtgaggtactatttgaggaggaaggcttgtggaaaaccatttcgagttgaggctgttgctgaaattgatgtttacaaatctgagccttgggaccttaaagattattcagctctgaagaccagagatttagagtggtattttttcagccctgtagataggaagtatgggaatggatctagacttaatagagccactggagagggctactggaaagctactggaaaggatcgtaatgtgaaccacaattctaaaatcattggaatgaagaaaacgcttgttttccataagggtcgagctcctgatggagagagaactaactgggtaatgcatgagtacagacttgacgataaagaattggatgcagctggagttgtgcaggatgcctttgtactctgtcggatcttccagaaaagtggattagggcctcctaatggcgacagatacgcaccatttattgaggaggaatgggatgacgacacagcccctctggttgccggaggagtgacagagaatgacgtggccaatggtaatcaagcacgagtcgagggaaatgagtttgaccaggatgtgcgtggtaaggctccttgcgtaagtgagaacctgtttgagcctcgagctctttcgtttgtttgcaagagggaaaggtcagaggatctcgaactactctctttatctcaaagcaaaagatccaagcatgatgatcctagctctagccatgcaaatggttctgaagattcaaccactagccaacaggatccaccaacaaagacgatggcgacaacttactcccctactctcttaacatttcccttgttagatgaaccaaaagaagctccacctactaactcctttaattttgactcttccaatcttgaaaaatctgttcctccaggttacttgaagttcattagcaatttagagaaccagatactaaacgtctccatggaaagggagactgcgaagattgaagtgatgagagctcaagctatgatcaacattcttcaatcacgtctcgatttcttgaacaaggagaacgaggacttgaggggactcattcgtcgaggttagatggtaacaacaactccaaagtaatgctagttatgcagcaactgttggccgggcagagggctccgttgtatcggagtcctcaattagtagaactgtcttttaagttagaagaaactgaaaatggctagctatgtaataagtttatttacctagttttgctataaacttgtacctatgatgctatcgacataatgtcgtatgtttaactagttataaataaagtgccttcagttgcnnaaaaaaaaaaaaaaaaaaaa

SEQ ID NO: 11126 - DNA, 1625 bp, Lycopersicon esculentum
  Predicted polypeptide sequence is orthologous to G773, G1412
tagtggaccccccgggttttgaaaaaaaataatattttttttatgaaaaaaaaagaagttttttattaattaaaaaaaaaattatgggtgttcaagaaaaagatccacttttgcaattaagtttaccaccaggatttagattttatccaactgatgaagagcttttagttcaatatttatgtaagaaagttgctggacatgattttcctctacaaattattggtgaaattgatttatacaaatttgatccttgggttttacctagtaaggcgacatttggtgaaaaagaatggtatttcttcagtccgagggataggaagtatccgaatggatctagaccgaatcgagtagcaggttcgggttattggaaagcaacggggacggataaggtgataacttcgcaaggaagaaaagttggaattaagaaagctcttgtgttttatgtgggtaaagctccaaaaggatccaagacgaattggattatgcatgaatatagactttttgaatcttcaaggaaaaataatggaagttcaaagctagatgaatgggtgctttgtcgaatttataagaagaattcaagtggaccaaaacctctgatgtctggtttacacagcagtaatgaatacagccatggttcgtcgacttcgtcatcatcccaattcgatgatatgctcgaatcattaccagaaatggacgatcgattctccaatttaccgaggttgaactctctcaaggccgagaaattcaacctcgatcgtctggattcagccaatttcgattgggcaattctcgctgggctcaaaccaatgccggaattgggcccagcaaatcaagctccaggcgttcagggtcaggctcaggggcatgtcaataaccacattcacagcgacaacaacaatatgaattttctcaacgatgtttacgcccatcctccaaatttccgaggcaacacaaaggttgaaagtattaatctagacgaagaagttgaaagcgggaaaagaaatcaacggattgaccaatcgagttacttccaacagagtctcaatggattttcccaagcgtatacaaacaatgtggatcaattcgggatccaatgtccgaatcagacgttaaatctcgggttcaagcagtagaggatactggaaagtaagaaaagttgtagctcgaaatctgaatgccagtatactgtgtatatatacagaaggcctggatttagatttccttggcccaacggattcgaagaaagagcaagtacagtatcatgccaaggaaattaagtccttcgagggcacgtctgggcagacgtcgtggacgttatttgcaagttcttgcaattgtgtctgaagtcattaggctgagtggcacttcttatttgcaagttgtgtttgaagtcattaggccgaaggcacgtctgcgtggacgataaaataatgtacacaaacaggagatatatgcaggggcgtgtatattcttttaggaaactgggcttttagtttgttttattttatgatacatttccagatttggatgtattttgtaatttttacatttctgtgtagcaagttagaagatatatagaaagatacttttaaaaaaaaaaaaaaaaaaactcgagggggggcccg

SEQ ID NO: 11127 - DNA, 1236 bp, Lycopersicon esculentum
  Predicted polypeptide sequence is orthologous to G773, G1412
ttttcttctctctctacattttgcttacttgtgagaaggaaaaaaaatgggtgttcaagaaatggatcctcttacacagctaagcttaccacccgggttccggttttacccgactgatgaagaacttttagttcaatatttatgccgtaaagttgctggtcatgatttttctctgcaaattattgctgaaattgatttgtacaaattcgatccatgggttcttccaagtaaggcgattttcggagaaaaagaatggtatttcttcagtccaagagatcggaagtatccgaatggatctagaccaaacagagtagctgggtctggttattggaaagcaactggaactgataaagttattactacagacggtagaaaagtcggaatcaaaaaggctttagtgttttacattggtaaagcacctaaaggaactaaaacaaattggattatgcacgaatacaggctcagtgaacctacaacgaaaactggaagttcaaggctcgacgattgggttctatgtaggatttacaagaagaattcaggtggacaaaaatcgagttgctctgatttacagaacaaggatataagtcatgcttcatcatcgtcatcgtcatctcagtttgatgatatgctggaatctctaccggcaattgaagatcgttatttctcattgccgagggtgaattctataaggaattttcaacaaaatgacaagatcaatcttcaacaattgagctctgggaacttcgattgggctgctatggcgggattaaactcattcccggaattacgtaccggaaatcaagttccaacgccgggaaatcaaactccggtgctgataaacaccaatcagtatcacaatcacaacgacaatttgaataatttcaacgaatttttcgccaattcaacggcgttaaattttcacggtgaagttaagtttgaaggaggagttgatcaagaagtagaaagcagtgttagagctcaacgacttaacagcgttaacccgggtttcttccaagagaactcaaccgggttttcaagttcttatacaaactcggtacccgacccatttgggattcggtacccgacccaaacagtaaatatgggttttactgggtaaatagtggaagggtaaaatgtgaatgctcataaattaacttgaagacaaatttggaaaaattgtcatggttatttaggttcaaagggcattttattatttggttggggattaaaatagca

SEQ ID NO: 11128 - DNA, 655 bp, Lycopersicon esculentum
  misc_feature (617)..(617): n is a, c, g, or t
  misc_feature (631)..(631): n is a, c, g, or t
  Predicted polypeptide sequence is orthologous to G778
gttgaatatgacttaaagttatagccaactgtcaaacacatttatttttcttatatctacccttattccatctattatcttctctccaacaccaaaattttgagagaataataataataataataataataatatattgttgttttgattcattcatcaccaagaagaacacctccctcttatttaccttcgatatgaatcagtgtgtaccgagttgggacctcgatgactctaccgttcctagaaaaaatcttatacaaactcaatccaattcattagccgttgatgtcccctcgtatatactctctattactctttcacaataattattacttttattttatatttactgactcaaaattctgaattcgcagattagattatgaagtagcggagctaacgtgggaaaatgggcagttagcaatgcatgggttagggcctccacgggctaataataagcccatatcgagctacggtggcacccttgaatctatagtgaaccaagccacccgttgcaacgacgacgttcctcttcatctccacgggaagtccaccgtggacaggaacaaacagagtggagatgaggtggttccttggttcaacaaccacaacgcggntgcttacgctcctncggcaccggtttagtcgcaatgac

SEQ ID NO: 11129 - DNA, 626 bp, Lycopersicon esculentum
  Predicted polypeptide sequence is orthologous to G778
gctccctcctcacccacataatatgtataggttgaatatgacttaaagttatagccaactgtcaaacacatttatttttcttatatctacccttattccatctattatcttctctccaacaccaaaattttgagagaataataataataataataataataatatattgttgttttgattcattcatcaccaagaagaacacctccctcttatttaccttcgatatgaatcagtgtgtaccgagttgggacctcgatgactctaccgttcctagaaaaaatcttatacaaactcaatccaattcattagccgttgatgtcccctcattagattatgaagtagcggagctaacgtgggaaaatgggcagttagcaatgcatgggttagggcctccacgggctaataataagcccatatcgagctacggtggcacccttgaatctatagtgaaccaagccacccgttgcaacgacgacgttcctcttcatctccacgggaagtccaccgtggacaggaacaaacagagtggagatgagggtggttcccttggttcaacaaccacaacgcgggttgcttacgctcctccggcaaccggtttagtcgcaatgactaaggatgcgttggtg

SEQ ID NO: 11130 - DNA, 1008 bp, Lycopersicon esculentum
  Predicted polypeptide sequence is orthologous to G782
agaaaaagcaagaagacttctaaacagacaaacaaaaacctgaggcagaactcaaagactctattgctgcaagaaaagtgcagaaggcagatcgagaaaaattaaggagggaccgcttgaacgagcagttcatggaattaggaaagacccttgatcctgataggcctaaaaatgacaaagcatccatcctaagtgataccgttcaaatactgaaggatttgactgctcaggtcagcagattaaaatctgagtatgctgcacttactgatgaaagccgtgagttgacccaggagaaaaatgatctcagagaagagaaggcatctcttaaatctgatattgagagccttaatgcccaatatcaacaaagaatgaggactatgtatccatgggccgggatggatcattccatggtcatgcatccgccttcatatccgtatccaatgcccgttccaattccaactggaccagttcctatgcatccacctctgcagccctatcctttcttcggcaatcataatcctgcagttgttccaaacccttcatcttttgttcaatacatgactcccaatacattgattgaacagcaaccgactcagtatatgtctccaattatacaaccaggtagtatgaccaggcaagaatccaggaacaagtcatcagatcaaggagagagcagaattgagaaaagtgaagattccaatgaagtggcaacagatttagagcttaagacacctggatctacatccgagcaggacctttcatctggacaaaagaaatccagaaagttgccaaggaaggataacagcttcacggatggaagttcctcaagtaaatgttcatcatcccatagtgtacatgctgtttcttcaaatagtgtagttaggggaacaaagactggtgattgacgtttgaaaccgtgtaggaaccaggttataaccattttaattacttttcctttctagcttcttctgctccatctgttgtataaaaagggttacagatagagag

SEQ ID NO: 11131 - DNA, 1766 bp, Lycopersicon esculentum
  misc_feature (1731)..(1731): n is a, c, g, or t
  Predicted polypeptide sequence is orthologous to G783
gcctctcaccatcccgtttcaggtataatttttctttctatctgtttcacatttattgctcttatcctttcaatctttcttatctttaagccctatttctgatgtgcttgaaatgatttcttttggggttgcgcttttaacaaaattttattaggttttttttatttttgcgtaggcagagagcagaagtcatggggcttcttttacgaattttttgttcttgctttggtgaagaattgggaactaaaggttttttcttatcaataaatagttgattatagaaaaatggggatcaaatgctgttatttactacccagtcttccgaaacaaagagtgtttctgcttagttcgcttgaattttacttacctcaatttaggagttccgctgtttaatagcatagcataggaaatagatggtgaagtaatgagaaatcggctaagtataccgtgttaatgctgaaaatttgttacttcaaatgaacttagcttgattgttcatcatttgacaaacttttggacaatccttacttgcacctttttttcccttggacagacaatagtttttctcatcaaaggctacaccgtggactcgaataagagatggatacagaaaatcctgctccaatagttgaaaaggatactacagatgcggagacatcattggatagctctcatctcaggaagaagattcagaagaaagttccaaaaagaattcacaaagctgagagagagaaaatgaagagagagcatttaaatgagctttttcttggtttggctgatgctcttgaactatctgagcagatgaatggaaaagcctctgtattgagtgaagctgctcgatttgtaaaggacatgctttctcagatcaagcatatgaggacagaaaatacgactttgctgtctgaatctcaatatcttagcgtggagaaaaaggagcttgaggatgaaaatacagttctggaggctgaaattagcaaactgcagaatgaggtcaaagcaagggaagctgagactagtcttgacctaaatctagctcctcctgaaattcatcacacagagtttgcctcacaaactaactatatgagattgcctgcttcggagcacggatttcaacagtcacagatgatgaaccccgtgtacgtctttcccttgagttctaatcctcaggcttatccagcgcctgatgctgcagatcccatggctatgccctcatctactgtgaagaaaccacagcctagataccccactccaaatgatgtatggccatcccaaatccttgaaaagaggcctcagttattgcgacaggaggttcaagatggtgcgtaagtatagtagtctagaagaaacaagacattcgttcatagggaatggcatgtataagtactagttaggtaatgtagatttagacgataaacagcagcagattcagcaatactttggacttgcagctctccattgtatataaacttttcgttgtattttgatcaacaataacctagtttgtctgtttgagtgtcgaggtagtaccagttgggaggtaaccataccatagcagtgttggatacaaaaatatgttggtaaacaaaacctgtaagtaggcgcctgacatgacatctatggattttgatgttgaactcttacaatgttgttgctgttgaggtcattttcaagctctgggtatctctagagtggccaaaatttgtcttagtcccttgtattttgacgaggtangagacagagaagtgacttaagttgtcattatcatt

SEQ ID NO: 11132 - DNA, 533 bp, Lycopersicon esculentum
  misc_feature (484)..(484): n is a, c, g, or t
  Predicted polypeptide sequence is orthologous to G783
tttgtagactgtctcgccataagttggaaggtactatatgctagtttgcagttcacatagtagctttagaggcttaattttatgatgccaaggaattgtcgcttcttatttccaaaatctacgattttcagcaataatttagccctttctgcaagtcttaacttagcaacaggatcagtttctaactgactaacttgcaaaaggtcctcacaaaatttagagaatgtatttctgcctcttcaaaactctattcttgcatctttgaatcctcattaaagctcccaatctcaggataaatacagtaataatttgtgtactcagttcatgtatttatgttgactttgttttgcctgctctctgcatcattatcagtggcatatctacacaagtactgattgtaaagctctcttgttacagctctcatctcaggaagaagattcagaagaaagttccaaaaagaattcacaaagctgagagagagaanatgaagagagagcatttaaatgagctttttcttggtttggctgatgctc

SEQ ID NO: 11133 - DNA, 840 bp, Lycopersicon esculentum
  misc_feature (751)..(751): n is a, c, g, or t
  misc_feature (771)..(771): n is a, c, g, or t
  misc_feature (773)..(773): n is a, c, g, or t
  Predicted polypeptide sequence is orthologous to G789, G1494
tcacaactttggatcagcgcaacagaaacatcatatagtagggggggatcagaaaggtgttaactttcctccaccgataaggtcatccaatgtgcagcttggtggcaaagaagctagaagcaatctgatgctgcaagatattaaagaggggtctgtgatgacagttggttcaagccactgtggcagcaatcaagttgatactagccggttttcaagtagtgcaaatagagggctgtctgcagcaatgatcactgattataccggaaaaatcagtccacaaagtgatacaatggaccgagacacatttgaaccagctaatacatcttcgtcttcaggaagatcgggtagtagttatgcaagagcatgcaatcaatctacagcgaccaatagccagggccacaaaaggaagagtagagatggtgaagaaccagaatgccagagtaaagctgatgagctagaatcagctggaggaaacaagtcagcccaaaaatctggaactgcccgaaggagccgtgctgcagaagtgcataatctctctgaaaggagacggagggatagaatcaatgagaaaatgaaggccttgcaagagcttcttcctcactctactaagacagacaaagcatcaatgctggatgaggctattgaatacttgaaatcacttcagatgcaactgcagaatgatgtggatgggaagtggcatggcatcaatgatgttccctggtgtccaacactacatttccagaatgggaantggggatggggtccgccttncngtgccttccatgcacaatgctatgcatttagctaggctttcctttgggtgatccagcaatccctttg

SEQ ID NO: 11134 - DNA, 668 bp, Lycopersicon esculentum
  Predicted polypeptide sequence is orthologous to G789, G1494
gtgaaacaacggccacagagtttttttccctgacttggtttgttttcccattactaaaactttggtgtttctttctttttctgaacctaaaagggtttttgggttatttaacttctttgtttccttctttctgtaagtagttttagccatgaatccattatcttcctgaatggaatattgagacctgaacttcctgctccacatcaaaagaagcctatgggatttgatcatgagctagtggagttgttgtggcgaaacggggaggtagtattacatagccaaacacataaaaaacagccaggttatgatcctaatgaatgcagacagtttaacaaacatgatcaaccaacaataagagttgctggaaatcagactaatttgattcaagatgatgaaactgtcgcgtggctaaactgccctatcgatgattcgtttgacaaagaattttgttcccctttcttatctgatatttcaacaaatcctcacctgggggaggagcctgataagtcaattaggcaatcagaggacaataacaaggttttcaagtttgatcctttagagatcaaccatgttcttccgcaatcacatcattctgggtttcgatccaaatccaatgccacctccaagatttcacaacttttggatcagcgcaacagaaacatcatata

SEQ ID NO: 11135 - DNA, 1036 bp, Lycopersicon esculentum
  Predicted polypeptide sequence is orthologous to G791
tgcacgaattccgctcgagaaatacattttccgattcaaacagcaattggaaaccctcattggagaatttaccgggagaattatttttttcatcttctggccggcgactgatcggagatggtttcaccggagagtaccaattggctttatgattacggattcgaagatagttgcgtccctgattcgaatttctcagcttctgcatctgggtttaactggtctgtgcagaatttgaatggttcaaggaatgttagttctgaaatcgatgggtcaattggtgaatcagattaccccaaggaaagtggttctaagaaacgggcaagggttgaatcatgtgctccaacaagttccaaagcttgcagagagaaactgcgaagagataggctgaatgacaagttcatggaattgggtgcactccttgagcctggaagaccccctaaaacagacaaatccgctattcttgttgatgctgttcgcttggtgacccagttacgtgatgaagctcaaaagttgaaagactcaaacttgaatctgcaagaaaagatcaaggagttaaaggttgagaaaaccgagcttcgagatgaaaaacacaggctgaaagctgaaaaggagaagctagagcaacaactaaagactacaagtgcacagcctagttacttgcctcctgctataccttctgcatttgctgctcatggtcaatttccaggaagcaagctggtgccaatcatgagttaccctggtgtcgcgatgtggcaattcatgcctcctgctgctgttgatacttcacaggaccacgtcctccgtcctccagttgcttaacttgtcgcagcttaatgcctacaaaggttgccttcactgtaccttaaattaatcgtctagtcaatgtcctccggttgtattagttttggctcaactccccttactgcatttggctgatgatagataagttgtgactttgaaactggcaacggtttaatgtttgctttgtgtaaaattaaataaatttaactataaactgtaaaaaaaaaaaaaaaaa

SEQ ID NO: 11136 - DNA, 788 bp, Lycopersicon esculentum
  Predicted polypeptide sequence is orthologous to G791
ggtggttttgtagtgtgcagagcaaaagggaagggggaaatttgaagaagggaattaggtcatggaggtcgattctagtgggaatcctaattggttatttgattatgagttgatgacggatattacttctgctgcatctgttaccgtcgctgagtttcagtctccggctactattgatttcagctggcctgctcaaacgatctatgcttcttctaatctcattactgaaacagattacacatttgcggattcagaagttagcaaggaggcaagctcacgaaagcggttaaaaagtgaatgttgcagctctccgagatctaaggcatgcagagagaaattgcggagggacagactgaatgagaggttcctcgcattgagctctgtccttgatcctggaaggccaccaaaaactgagaaagttgcaattctaagtgatgctcaaaggatgctgattgagctgcgaactgaaacccagaagctgaaggagtcaaatgaggagctgcaagagaagataaaagaacttaaggcagagaagaatgagctccgagatgaaaagcaaaggctaaaggaagaaaaggataatttggagcagcaggttaaaagcttagcttctaaagcaggatttctctcccatccttctgccatgggagctgcatttactgcacaaggacaagttgctgcaggcaacaaattgatgcctttcattggttatcccagcgtcgcgatgtggcaattcatgcaacctgctgttgttgacacatctcaagatcatgtgctccgtcctccag

SEQ ID NO: 11137 - DNA, 783 bp, Lycopersicon esculentum
  misc_feature (641)..(641): n is a, c, g, or t
  misc_feature (645)..(646): n is a, c, g, or t
  misc_feature (666)..(666): n is a, c, g, or t
  misc_feature (685)..(686): n is a, c, g, or t
  misc_feature (714)..(715): n is a, c, g, or t
  misc_feature (725)..(725): n is a, c, g, or t
  Predicted polypeptide sequence is orthologous to G791
gcaaaattccaaattccaatctctaatctttggttattgaaaacccgtttgtttaaattctttcccttttcatttttccatttccaacttttttttccggtcaccggaaatattttcttgaaattccgacggttgatcggagatggttctaccggaaaacaccaactggttgtatgactatcattatgaagatatagtcacccctgatgttaatttctcagtttctggttattcttggtctatgcaggggtttaatggttcaactaatgctagtgttgatattgatggctcacttggtgaatcagactgcgtgaaggaaagcggttgtaagaaaaggacaagagctgaatcatgcacctcatcaagttccaaagcttgcagggagaaattaaggagagagaaactgaatgaaaagttcatggaattggcggtgcttcttgagcccagcaggcctccaaaaacagacaagagtgccattcttgttgatgctgttcgcgtggtgacacagttacgtggtgaggctcaaaaattgaaagactcaaatttggatctacaagaaaagataaaggagttgaaggttgagaaaaatgagcttcgagatgaaaagcagaggctgaagtccgagaaagagaagctagagncacnnactaagactatgagtgcacnacctagcttccctgctccnntgcatgctggtgcttttgcttctccagnntcagctgcangaaccaagctggtgccaatcataaagtaccctggaagtgccatgtggcaattcatgcc

SEQ ID NO: 11138 - DNA, 647 bp, Lycopersicon esculentum
  Predicted polypeptide sequence is orthologous to G791
ggttattcttggtctatgcaggggtttaatggttcaactaatgctagtgttgatattgatggctcacttggtgaatcagactgcgtgaaggaaagcggttgtaagaaaaggacaagagctgaatcatgcacctcatcaagttccaaagcttgcagggagaaattaaggagagagaaactgaatgaaaagttcatggaattggcggtgcttcttgagcccagcaggcctccaaaaacagacaagagtgccattcttgttgatgctgttcgcgtggtgacacagttacgtggtgaggctcaaaaattgaaagactcaaatttggatctacaagaaaagataaaggagttgaaggttgagaaaaatgagcttcgagatgaaaagcagaggctgaagtccgagaaagagaagctagagcaacaactaaagactatgagtgcacaacctagcttcctgcctcctgccatgcctggtgcttttgcttctccagttcaagctgcaggaaccaagctggtgccaatcataagttaccctggagttgccatgtggcaattcatgcctcctgctgcaatagatacctcgcaggatcacgtgctccgccctccagttgcttaaatttgctgctaaaacctatgataattgacttaact

SEQ ID NO: 11139 - DNA, 531 bp, Lycopersicon esculentum
  Predicted polypeptide sequence is orthologous to G791
ccccgggctgcaggttctcctcctcattttcctccttttttcctcttccacctaacacccaactggaattgggataccctacaatcttcaactgaaattttccggcaccggtactcctcacgtcggagaaaatggcggaaacagaggaagacggatcaaattggctcatagaattagggttaatggaagaccttccttctcttgaacccaatgctcaatggccctccaacgctttttcccttccaaataatctcagttctggattagaagattcctatggcaactcagatagtttgaaggaatgcggctccaaaaagagggtgagatctggagcatgtgcatctgattcaaaagcacatagggagaaaatgcgcagggacaagctgaatgacaggtttcaagaattaagttctattctggaaccaggaaagcagccaaaaatggataaatctgttatcctaggtgatgcggttcgtatggtggtgcagttgagagatgaagctcagaagctgaaagagtcgaacaacaact

SEQ ID NO: 11140 - DNA, 409 bp, Lycopersicon esculentum
  misc_feature (345)..(345): n is a, c, g, or t
  Predicted polypeptide sequence is orthologous to G791
ttttttttttttttttttgaacataagggaggtattcatgtaaacttcaacgagatttacatattagtgtacataatcagttgatcaactacctcattatagtatatgtaccaatctgctcatattaggagaacaaaatgtcaacaaacgtcaacaaaattgttgacataggaaacaaacatttgcataattctggtaacaagaagtcaccacaatttaagcaactggaggacggagagaatgatcttctgaggtatcaactgcagcaggaggcacaaactgccacatagggattccagggtagccaatatatggcatcattttgcttgcaaagacttgatgtgnggctgagaaaggggaaggcattgcaggagggtgtggtagaaatccaggttgagtgttcatggcc

SEQ ID NO: 11141 - DNA, 529 bp, Lycopersicon esculentum
  Predicted polypeptide sequence is orthologous to G791
gctgaaatcgatgggtcaattggtgaatcagattaccccaaggaaagtggttctaagaaacggtaagaatttttgccttttctgaacatttgtgctgatctccatcattgatgttgaataaagatgtggtgctgccctcaattgttaaatgtagtttaatttgattagcttctgtttcatataattattatttaaatctgtgaggtgacacatttcccactctctttctaagttttgagtttttttaaatccttttttattctgtgattcatcatcttgaaaaatctgttgtattctgcttctaactggcaagatttgagaatgtagaatccattaaaccgatttatatgttcttgatttaaaagcctgcataattcaagacatattcttaagtctctattcgaaagaattcactatgccctggcattcttcaagttcataaacgcttcaacattgtgtgatttaacatgtttcacgaagtcccactgatatattcctaatcctataattacaatgcaagttgaacgaa

SEQ ID NO: 11142 - DNA, 574 bp, Lycopersicon esculentum
  Predicted polypeptide sequence is orthologous to G791
tgcctcgtgcctttaaatttgaagaagggaattaggtcatgggggtcgattctagtgggaatcctaattggttatttgattatgagttgatgacggatattacttctgctgcatctgttaccgtcgctgagtttcagtctccggctactattgatttcagctggcctgctcaaacgatctatgcttcttctaatctcattactgaaacagattacacatttgcggattcagaagttagcaaggaggcaagctcacgaaagcggtaaataaattatccatttcttttatatcatggtttgataggtttgatgaactctttttattacattcttcttgttttagagatctggatctgtttatatatcctatgttctagtaaggagaaaacctatttggctatggttgtccactcttaaatgtactcatttaagaatttttctttcaaaatatgtgtatcctacaactatgtcacaggctaaaatgaagtcttgaatagcctttcctccattattcctaatataaccatatcccccatgtattgggtcaaaactgtcgttatctttacctacatgac

SEQ ID NO: 11143 - DNA, 2568 bp, Lycopersicon esculentum
  Predicted polypeptide sequence is orthologous to G801
ggtcggtagagcaaaacggcgccgttttactcgattctaccaccggctccggtggtggagttgctaatagtaatggtgctttgacggtgaagaaaccgccggcgaaggaccgacatagtaaagttgatggaagagggagacgtataaggatgccaattgtttgtgctgctagggtttttcagctaactcgtgaactaggtcataaatccgatggacaaacaattgaatggctgttgcgtcaagctgaaccttcgattattgctgctactggtactggtactatacctgctagtttctctactgtttcagtttcgttacgaaattcgatttcttctgttactgcttctgctccggttgatcataagttgccgtcgccgtcgccgtcgttgttacatccgttgatttctccggcgccgtttttgcttggtaagcgtttacgttctgaggatgatgataatggaagtggagataaggatgtggttcctagtgctggattttgggcagttcctgctaggccggattttggacaagtttggagtttcgctgcaccgtcgccggagatttcacattccgctgcagcagcgatgaatacgcagccatcgaggtttcttcagcagcagatggaagaggcatcagctggtagagttgggaattactttcctatagctcaagggcatctgaatttgctagcttctctatctggttcgggttctggaccgagaagggacgacgatggacaatgaagtatttgctgtttatgatatgtataaattgagtattgttgttgttgtttgttcgtattgttaattgttagggattaggtagtgtagcgagtgagaaatgaagctaggttttgttgcaatttgttgaattattgctaggattagagtgtttgcttgttcgttcgattgatcgttgcatttgttagggtttcagttcatttaagttatgagtgatgtagccatgaaaagagaaagataaaacgagacgcaagaatctaagggagtttcttgtgatcgatgaatttggttggaattaccactacaagcacagaactgctcaataagtgcttgaccatttcgataatggtgagtggataagacagttatttaagtgtggtctacgaaaaacctgtagttccgcatcaatgttttttgtaacgaaaccatggaggtttctgatgaatgaattgaattctgtaatttgttgaaactttcagtgactcaaatgagtgttatggaatttgttcgccatcttgtcttctatatatatatatacacaaatacattatctctatatgcagagtcttctccattaagctcgaataaattcctgattcatgatgtcgagtttctgttcacagtcggcaaacgacggccacaactctttcacctgcgccggcgagtcatcgccggcagccgtgtctgtcggcggaggcgtaggaggaggaggagagatcatgctgtttggcgtgagggtgaaggtagaccctatgaggaaaagcgtgagtttgaacaatctgtctcagtatgagcagcctaattctaatgataataataataataatagcaacagcggaaataacaatgacgcttctaaagttgccgccgacgagggttatgcctctgccgacgacgctgttcctcaccactccggtagtggccgtgagcgtaagcgaggagttccatggacggaggaagagcacaagctattccttttgggattgcagaaagtgggaaaaggagactggagaggaatctctagaaacttcgtaaaaactcgcacaccgacacaggttgcaagtcatgctcagaaatatttcctccggcgaactaacctcaatcgccggcgccgccgttctagcctcttcgatatcaccactgactcggtatctgtactagcaacagaagaaacgaaaaatctgcaacgacactccattccatcattgccttgtatagaaacatcaaaaatgaatgcatttcaggtgacatctgtgccagtaaattttgggcctgttatgttgccagagaacccaatagaaagtccaatccttagacaaggaaatcaaagttattataatggatcatcatcaatattcctccggccggctcctgttgttgtttcgttgcctaattcatcaaaaacagctgactttaacttgaatcaaagctcagcaatggagacatcttcgttatcgttgacattgtcgttatcaccatcatcatcatctactagacactcaggattccaagtgatgtcaaattttaaaaatggagagagcatcatcagtgtggcatgacacacaagaatctctattattaaataactaaaagctagaagaagaaaaaaaaaacatagaaaaggcaaatgggagttctataatggagttatattattagtggagtaatatgtatggtccttttgttttgtacagaccagaaatatgtcattatcatgccttctttatttgttttgtagttggaagataaaaattaacaatgaataatattggactttgtgcttgttttttgttgctaaaaaaaaaaaaaaaaaactcgagactagttc

SEQ ID NO: 11144 - DNA, 709 bp, Lycopersicon esculentum
  Predicted polypeptide sequence is orthologous to G801
tttttttttttttttttttgagtaggaaagtttaagctcacaactgatatagtttcaacaaattacagaattgaattcaacggaaaccgccatggtttccttacaaaacattcatgtggaactacaggttttcatagtccacactgatcccctattatatcttgttacaatgggatcaaagcagcttattgggaggtctgcaaacaacagaacaaaccccaccaaattcatcatcacaagcaacaacttcccctgatgcttgtgtttcgtgttatcgtcccacagcttacaacaccaaaactcggtgaacgtaaactcttgacaaatgagatatagcaaacaaacctaatcctagcaataattcatgaaattgaacaagcccctagttcatttctcactcactagaacctagcaacaaatttctcatctaacacaaacaagaacattaaaacacatttatacgatatattaacaacaataacgataacaataacaataacaataatcatatcttcaacgtccgtcgtcgtctcttctcccggaagagggctgtggaggacctgatagagaagctagcaaattgagatgcccttgagtcattggtaagtaattcccaactctagcagctgaagcctcacccatctgctgctgaaagaatctagaactctgcgaacttaacgctgccgcggctgcagctgctgcagccgcg

SEQ ID NO: 11145 - DNA, 782 bp, Lycopersicon esculentum
  Predicted polypeptide sequence is orthologous to G801
gggatcttgtatttttttacatatttgttgttttggggctctgttttttttttttttgcttccatgaatcgagctttttctattacttgaaacttcaactgaacctgctttattgatttgtaaaagttttttttcttcttttgtttggggttttgtttaattgagctctgttttccagagcttggtgaatttgttgtttttcttctttgttggggtttgctcaattcagctcataaatcccatattggtgctctatttggacctgattttcaattatttgttgttttttatttgttggggtttgctcaattcagctcacaattcccgtattagtactctattttggatttgattttcgattattgttgggttttgtttgttgataaatcctagtaattttccaccactaccgtttttgctgctagtgttttgagcttctaatgtcgacgtctgcagagggaaatggagctataattgatcctcagaggcaacaacaacaggcgcctactggggttggtacaaatggtgctttaacagtgaaaaaaccgccggtaaaagaccggcatagtaaggttgatggtagaggaagacgtataaggatgccaattgtatgtgcggcaagagtttttcagcttactcgtgaattgggtcataaatccgatggacaaactattgaatggctgcttcgtcaagctgagccttcaattatagctgctactggtactggtactattcctgctagtttctcgactgtatctgtatcggtacggaactcaactgca

SEQ ID NO: 11146 - DNA, 970 bp, Lycopersicon esculentum
  Predicted polypeptide sequence is orthologous to G802
cgcatgcctgctttatgcgccgccagggtttggcaactcactagagaattggggcataaatctgacggagaaaccattgagtggctattgcaacaagcagaaccggcaattattgctaccaccggaactggtacaatcccggctaatttctcaactcttaacgtttctacacgtagcagcggtacaacaatttcagctccgccgtcaaaatctgcacctcttttcatccacggcgcctccgcctccgcctccgccgctatgttaggcttccaccaccatctatccactgccaacaccggttttatccaagacccagatgaaaattacatgaaaaaacgattcagagaagatactactaccagtggcgccacctccccttcacctgataaacccggttcagattcttcaaaacccggttcgaatttaatcccgggtcaagccatgtgggcggttgcaccagctggtggcaacgttggtaacgggttctggatgttaccagtaagcggaggcaccggttcaacggcggtttcagttggagcgggtcaatcggaccaccaattgtggcagtacaagagttcaagaattggtgggttggagtttcccggtggaggacggttcagtccggttcagttaggttcaatggttttgcagcagtcacatccggttcaacaattggggtcaaatatgggaatgttgaatgcatataataataataataataacagtagagttgatttgggtatgaatttggagcatcataatcaaacgcagcatcaagatagtgatagtggtgatgaaaatcacaatgattcccaatcatagtttacaaatctcgatgcaaaagttaccattttcttgtgtttgatgaattttttactgtcaagattgtgttcattgtaattttcattgcaagtgttttttaatttggattgaaggattttgcctttaaaaaaaaaaaaaaaaaaaaaaa

SEQ ID NO: 11147 - DNA, 787 bp, Lycopersicon esculentum
  Predicted polypeptide sequence is orthologous to G802
ggcaatagtaaacaacaaactaccaccaataacaccacaccttctccacctctacaccaccagcaacagcatcagtaccagctactctctcagcaccatcaccaccagcagcagcagcagcttcaacaacaacatgggagatcatctgtaccttttatgacctctatttctatacagcctaatgcacaagctccaattactaattctgctactaatgcttctccttctacttcatctcctactccaccgcagccacctcatctagtggacgcttctcttgcaattgccactagatcggacaccttagttgacccaaataagaaatctcagctggcaatacaacaaacacaacctgtgcagccgcagcagccaccaccgaagcgacaaacaaaggatcggcacaccaaagttgacgggagagggcggcgcatccgaatgccagccgcatgtgcagctagggtttttcaattgaccagagaattaggccataagtccgacggagaaacaatcgaatggctattacagcaagccgagccagccatcatagctgccactggcaccggcaccatcccagccaacttctcaacgctaaacatatccctccgtagcagcggctctactctctcagctcctccttctaagtcagctcctcattcttttcacagcgctttagctttagccgctgctcatcaaacccctcatccttttgaagaaggattctcgcaaatgctagggtttcatcattatactcacctcctgacgcaaaatccaatcgctgaatcaatac

SEQ ID NO: 11148 - DNA, 1167 bp, Lycopersicon esculentum
  Predicted polypeptide sequence is orthologous to G802
ggttctgttttggctcattttgcactactacttgctttcatttgagccttttttcttttcctaaaaacttccaattggttaaagttttcaaatatcaaacaaatctttgtttgttgttacgccatggaatttagagagtcaaatagcaaaaacaaccaagatggtgggagtaatagcaataataatagtaatgaaaataatagcaatgtgatttctactaaaattgttaagaagccatcgaaagaccgtcacaccaaggtggatggtcgagggcggcgcattcgaatgccggctttatgcgccgccagggtttttcagctaaccaaagaattgggtcataagtcggatggcgaaaccatagagtggctattgcaacaagctgaaccgtcgattatagctgcgacgggaacaggtacaattccggctaatttctcaactcttaatgtctctttacgcagcagcgggactacaatttcagctccgccgtcgaaatctgcgccgcttttcattcacggcggtgctgccactatgctgggtttccaccaccagattccgggcaacagttttgggcaagacccagatgagaatttcatgaagaagaggtatagagaagatacaactgcagcatcaacttcaccatcgtcatcatcagctaaaccggaaagaaccggagttcaaggtcacgaaccggatcaagaatcgaaacccggttcatcgaatccctctagctacataccgactcccgccatgtgggctgttggtccggcggccggtaacgtcggaaacacgttctggatgctaccaggtacctcatcaaccatgcagagaattggtggtttcgagttaccgggaggtggccggttcagtccggttcaactaggatcaatgtttttgcagcagccacagccggttcagcagctggggttgggtgtgacagagacaaatatgggaatgttggcatcgatgaatgcatataacagtagtagtagtaggggtagtgggattgatttggggatgaatttggaacaacatcatcatcatcaaaatcagcctcaaggtagtgacagtggtgatgaaaatcacaaagattcccaatcataactccaacattgataccacaaaaagatgtgtgggactgtttttgtcaaatctcgagtttgagtcatg

SEQ ID NO: 11149 - DNA, 583 bp, Lycopersicon esculentum
  Predicted polypeptide sequence is orthologous to G805
cggcaatttggctgcgattgtggagtcatagagaaaaatccaccacctaccggaaatccagaaacaggcgtagctcgtgttaacggagctaaaaccgacggttgtgactgagacaacggtatgttctccgacgtcgtagtgacttgagtcgccggaaccgtacctgttcctgtagcagcgatgattgctggttcagcgttacggagaagccactctatcgtttctccgtcagtcctatgacctagttccttcgttaattgaaaaacacgcgccgcgcataacgccggcatccttacgcgccgtcctctaccattgacttttgtatgcctgtctttgctagatgaaacggataacgcattcttcttcttcgtcggaacgaccgcgagcgcagttttgccatttgtttctgagttaacgctaccgttcccgacgccggagattgcaccggaaacaactatttctgaacccatttttagggtttttttttttttttttgaatggagggaaaagtagtactttgtgctttagggatgaattttgatttttaatagaccccacaaaaatggaaaagagtttttatagg

SEQ ID NO: 11150 - DNA, 626 bp, Lycopersicon esculentum
  Predicted polypeptide sequence is orthologous to G807
ttttttttttttttttttttccatcgaaatcgttgcattttgtaaacaatagaagttacacaaagatcctctgcaacaacttgtttacatcccttcttcaatttcttaataagtaaaagaaggaacattttactgttctttttaaactaacccattgtgccagataaatgtacacacaaaaattccgaataaaatacatcaaactagtcttttaagatcgccttttcgctaccggctacacagagcatcatcattattagtaggtaagaacagtctttcaagaggagcttcttaatgcaaaccagttcagagtatccacctgacaaaatattaccacatggggggagttcattgctctacatcctctagaagttcaccacacttcagcagtcgtgctcaaggcagtagcacaataattcagaataccctgcgtcagtgcaagctttcaaaaaaatacatgcaatcatcaaatttgggcagccgatgatagtaaccccatctgttcagtaagattatgcatatgctttaatttatcccaatcactctcctgaactccaaggagatcctcttccacgactaaggaaccaatctcatctgtatccccagtgagagggcttgcaggggtt

SEQ ID NO: 11151 - DNA, 691 bp, Lycopersicon esculentum
  misc_feature (596)..(596): n is a, c, g, or t
  Predicted polypeptide sequence is orthologous to G807
ctacaaacacctattgaagagtataagcaggcgaaaaccctctcagttgcagggccatcaacaaaccacctccaaagtaccaaatgcatctgttgcatcctgtgttgaagttggaaagtttggaatagaggaagaagtggaaaggcttaaaagagataaggatgtccttatgcaggagctggttaagttgagacagcagcagcaggagacggatcaccaattggtgactgttgggcagcgcgttcaattaatggagagcaggcaacaacaaatgatgtcgttccttgccaaggccatgcagagccctggctttgtagctcaactagtacatcaacagaatggcaataacaggcatattactgggcttaataagaaaaggagacttcctgaacaggctgaagaaaatgttgcgtgcaagcctgtcaatgctttgcaagatggacaggtagtcaggtatcaaccttcaatgaccgaagctgcaaaagcgttgctgcagcagattttgagaataaatgcatctgggaggctggacaaccgattacacacaaatggcggctgtttgactaataatcccctcccgcctaacaattctctangcagtagcggtgcatccagttgtatttccagtgttaccctctccgaagtactgtcaacttcttcacagcctaatctgatatcagattctggattt

SEQ ID NO: 11152 - DNA, 888 bp, Lycopersicon esculentum
  Predicted polypeptide sequence is orthologous to G811
gctgccactgcccctaaccttccgccaccgtgaacctccgcccagctcagtggagctccaccgcgttgacatcggaacgatatatatatatatgggatggaggctaacaatattattgctccgttcgtgatgaaaacttatcaaatggtgaatgatccgaagattgatggacttatagcctggggaacagctaataacagtttcatagttgttgaacctttggatttttctcaacgaattttgcctgtttactttaagcacaacaatttctccagctttgttcgtcagctcaatacttatggattcagaaaagtggatccagataagtgggaatttgcaaatgaatggtttctgagagggcaaacgcatttgttgaagaacatagtgaggaaaaagcacagtagaaattcgtgttctcagaagcaggatgagagtgaagatgaagaaattttgactgaaatttctagattaaagcaggaacaaaaagcattagagcatgaagttgagaatatgactagaagattagaagctacagagaaaaggccacagcaaatgatgggttttttgtgtaaagttgatgatgatcctgagattctgcccagaattttaatggagaaagagagatctaaaaggctaactttaacaaattgtgagaagaaacggagacttgtgatttcgaattcaacgagttgttcctcagtgaagagtgaagatgcactaagggcaacatcgtcatttcactcacccgacgcaaatttcgataaggatgcgatctgtcagtcctcaccgtcgtcgggaactccgccgacgacgacggcctggctaggtagtcggccgatgataacttatgagccaggtacgatacagtcgattctatctcctgacgcg

SEQ ID NO: 11153 - DNA, 1671 bp, Lycopersicon esculentum
  Predicted polypeptide sequence is orthologous to G812, G2467
attttccttactttagggtagctagccaagatattttcaagcaaatccttttttcacaaacttctaaatattactaccatactatgtaaagaattttcaaatcgaacaaaaaaaaaaacatgtgatgggtaggacagttaaaacaaatttctagacttcattaacatttggtaaaaaattcaataatttttattcatattatattttcttttacataattaaattaattaaatttcaaaataaatatcaaaaatataaaaaagaaaaaaaccagaatcaaggcttaaaagaataacatgagaattgtttcactcacaaagattttttttttttatgatttttaatatggtatctgatacttatattgaagttcaaacaatttcgatcaagaaggaagaaggattaaaaatatctagaatatcatcccacttaatagtaaaagaatgtataaaatattcattgaaccctcactatacttcctttttagttctcattactctcttgctaatatacctccaatattgcaaacatattaatttgtcctaattctttctccctcttacccatactccaaattaatattaaccctatcttttctcatatatccacaaactcctttattacctttgccaagatcctctatcttcttaactttgacattgactcaaaaatattgttatactcatctttgttgaagaatcaaagcatggatcattttggtaatttaataaaagaagagtttgatggatcatttttgacgcctcaaccgaaggagtgtcttcatgagaatggacctccaccatttcttacaaaaacatatgaacttgtggatgatccaagtaacaacgacgtcgtttcttggagtagaggttacaatagtttcatagtatgggatccccagaatttggccattaattttctaccaaggtatttcaagcataacaatttctcaagctttgtcaggcagctcaatacttatggatttaggaaagtaaatccagaccattgggaatttgctaatgaaggttttctgagagggaaaaagcatctcttgagaacaataaggagaagaaaaccaagtaatttcatcaagtcttcgtcatcaattaataatcaagcatcaaaaggctactaaatcacaacttcaagctatggagcaaaagcttcaagggacagaaatcaaacaagagcaaataatgagttttttggctaaagcattacataatccaaattttgtggagcaaataatgcaacaaaatgataaaaggaaacaacttgaagaagcaatgaagaagaagaggaggaggccaattgattattatgaagctggtcctagtaatataattaagttagaacctcaagatcatgatattattaataatgaatttgatgatgatttacaagtggctatgaacatgtcacatgggaacacattaatcaatttagaagaagaaaataatgaaggattttgggaggatatgctgaatgagaatagtaatgttgaagatgagattatggctttgcttggtgttaataatgaacaagaagatgaacaacttcatgtggatattttctctgattaattaattacttgaataaattatcagccaatttctctggctcatcatgatttaaattttaaaaaaaaaaaaaaaaaaactcgagaggggg

SEQ ID NO: 11154 - DNA, 1225 bp, Lycopersicon esculentum
  Predicted polypeptide sequence is orthologous to G831, G1202
accttccccggcggcggcaccatgtttccacgtggcgctgatgcttatattgatgatatcggaaaattgatcaagctgaaagatggttccattagaaccgccattgataccggttgcggagttgctagttggggggcttacttgctttccagagacatccttccaatttcctttgcacctaaagatacacatgaagctcaagttcaatttgccctcgagcgaggagttccagcattgattggcatattagctactaatcggctaccttatcctgcaagggcatttgacatggcacattgttctcgctgtctcatcccttggggaaaatatgatggtctttatttaattgaggttgatcgaattttacgtcctggtggatactggattctctcgggaccacccgttaactggcaagatcattggaggggctggaacagaacagcggacgatttgaaagcagagcaagatcaaattgaaaatgttgcaagaagcctatgctggaaaaaagtaactcagagaggtgatctagcaatttggcagaagcctacgaatcatgtgcattgcaaaattaaccgaaaggtcttcaggaagccacctttttgccaggaacaagatcccgacaaagcatggtacaccaagatagatgcttgtttgagtccacttccagaagtgtccagtgttaaagatgtcgctggagggccactggagaattggccggaaagattaaccgcggtccctcctaggattgctagttctagtatagagggagttactgcagagggcttctctgaagatacagaattgtggaagaagagagtcgcccactacaaggcattggacagtcagttagcagaacgtggaaggtaccgtaacatacttgacatgaatgcttggctgggaggatttgcagctgcacttgttgatgatccagtttgggtcatgaacatcatccccgctgaagctgaagtcaatactcttggtgttatcttcgaacgtggtttcattggaacataccaaagctggtgtgaggcaatgtcaacgtatccacgaacttacgacttcatacatgctgattcggtattcaccctataccaggacagatgcgaagtggaagatatattattggaaatggatagagtattaaggccacaaggcagtgcaatattccgagacgatgtggatgtattggtaaacgtgaagagcatattagacggactacaatggg

SEQ ID NO: 11155 - DNA, 692 bp, Lycopersicon esculentum
  Predicted polypeptide sequence is orthologous to G831, G1202
gagcgtaccttttgtcaaggaatatcctagctatatcatttgcaccaagagatacacatgaagcacaggttcaatttgctcttgagcgtggtgttcctgctttgattggagttattgcttcgaaaagactcccttatccgtctagagcttttgacatggctcattgctctcgttgccttattccttggggcgaatatgatggcacgtacttgattgaagttgacagagtcctaaggcctggcggatattggattctttcaggtccaccgattcattggaggaaatactggaaaggctgggaaagaacgaaacaagacctaaatgcggaacaaacaaaaatcgagaaagtggctaggagcttgtgttggaaaaagtttgttgagaaggatgacattgctatatggcagaagccatacaatcatttacaatgcaaggaattgcgaaaggcgtccaagaatccaccaatgtgtcctgctcaagatcctgataaagcctggtatacagatattgaaacatgtttaacttccttgcctgaagtttcgagtgaagaaaaggtagctggtggacagttggaaaaatggcctaaaagattacacgcgataccaccaaggattagcagaggaactgtaaatggggtcacgtctgacaccttcaacgaggactcacagctatggaaacgaagagtttcgtac

SEQ ID NO: 11156 - DNA, 519 bp, Lycopersicon esculentum; identical to SEQ ID NO: 10355
  Predicted polypeptide sequence is orthologous to G831, G1202

SEQ ID NO: 11157 - DNA, 617 bp, Lycopersicon esculentum
  Predicted polypeptide sequence is orthologous to G831, G1202
cttcaacgaggactcacagctatggaaacgaagagtttcgtactacaaaacagtgaataatcaactcgggcaaccagggagataccgaaatctattagacatgaatgcttacttaggcggtttcgctgccaatttggttgatgatcctgtttgggtcatgaacatagttcctcctgaagctaaggttaacacacttggtattatctacgaacgaggattaattggaacatatcaaagctggtgtgaagctatgtcaacttatccaagaacctatgatcttattcatgctgactctgtatttactctgtataaagacagatgtgaaatggaggatatattacttgaaatggacagaatattgaggccagaaggaagtgtaataataagagatgatgtagatacattgatcaaagtaaagaggataacagatggactaaactgggatagccaaatagtggatcatgaagatggaccattggagagggaaaaactactctttgcagtaaagtcctattggacagctccatctattcaagaatcttagatatcttttaacattttcatcttcataagattcctctatctttttacaattgtgatatattattgttaacctc

SEQ ID NO: 11158 - DNA, 763 bp, Lycopersicon esculentum
  Predicted polypeptide sequence is orthologous to G831, G1202
gaactagtctcgagtttttttttttttttttttgcttgtataagaaaatttcaactagaagaggaagaaatagaggctcaaaatcctgcttataaatgaatgaaaaagcccaacaaaagaagtggagacagattagggaaattacaatgaaattttcattatatggtattccttataagggtgttaagcccatctatacaaaaatcactaggagctaaacacccaatgatcacaatcacaaagaactaattttcaacgcggtttaattacagttatcgcttgatacaacatttgaggcctctcatataaggaaaatgtgggtcttcaggaagccacctttttgccaggaacaagatcccgacaaagcatggtacaccaagatagatgcttgtttgagtccacttccagaagtgtccagtgttaaagatgtcgctggagggccactggagaattggccggaaagattaaccgcggtccctcctaggattgctagttctagtatagagggagttactgcagagggcttctctgaagatacagaattgtggaagaagagagtcgcccactacaaggcattggacagtcagttagcagaacgtggaaggtaccgtaacatacttgacatgaatgcttggctgggaggatttgcagctgcacttgttgatgatccagtttgggtcatgaacatcatccccgctgaagctgaagtcaatactcttggtggtatcttcgaacgtggtttcattggaacataccaaagctg

SEQ ID NO: 11159 - DNA, 559 bp, Lycopersicon esculentum
  Predicted polypeptide sequence is orthologous to G837
ctgagaaggactccaaaatggctgatcatactgctgagcaggatgtccaaatggctgatcatgcagctgagaagaaagatgaaatgcattcttctgctgttgatgttgtggaaaagaaccaagctgaaaaaatgggtgaaggccaaaaggcaggagatggtccttctaaagaggctgaggttgagaaagatgacaaaatgtcagactgtgttgcagagaagaaagataaaacttctgatgttgatgctgtgaaaagtgatgacccaactgaagatggaaaagcagaagatgctcctgctgatgtgtctgcggctgacaaaaatgttggagatgctttcatggtgaaagaggtgccaattgggaaagcagcggatgaagctgaagcaactgataacggtgtcaacaccgatgagattaacccttgaatagtgacatggagccattctctgctaccctcgtaccctgctctcttattctctctaacctcttacccttgttacttttctctagtgactgtagtgttgttgtcaatggtagtactctcagactgttcatgaga

SEQ ID NO: 11160 - DNA, 514 bp, Lycopersicon esculentum
  misc_feature (490)..(490): n is a, c, g, or t
  Predicted polypeptide sequence is orthologous to G839, G1196
ggctactttcctcattgctccgaagttctggataagtttatggaggatgacttaccagacttatttttccttgaaaagggcactccagaggaacaaaagatcaagcggaggcgatttaaggagctcaaagatgatgttcaaagggcatttaataaagacaaggctggacttcaccgctctggctcgtcttcctcatcatcttccacaacttttaacgacggtgcaagtgtcaaagctaggaacctatgatagtaactaggttttatcctacatccttagactcagttttgtatctaagataagtagtcttcaaaacacttatcttataaaattttcattatagtggctgctctatcgttgaccatttttatagttcgtattgttaagtttgcttgtttatagtagaaataaagttgcataagaacaaacttgcggaaatattaaagatgtacaaatgattcgtgtatggagaatctatcgtattttattnctatataaaaaaaaaaaaaaaaaa

SEQ ID NO: 11161 - DNA, 703 bp, Lycopersicon esculentum
  Predicted polypeptide sequence is orthologous to G839, G1196
caaaaacagggtttttttgctctgcaattggaaatatttttggttgtcttggctggtatgaatgttattccatttcggtaagttgtgatcaagtagttgaagggttattagttggtagaattttcatttgtgtaagttgtgatcaagctgttgaaaatttgcatgttgtattcttgaaaaagatactatttttactgtgaaattgaagtttagctgatggtagatacggtggagttattagtttctgctcaagggttgatttggttgtaactgaaattgggagaatttgagttttagttttggaatttgcttcgtttcttcatcttcgttgttgaatgtgaggagaaaggaagaatttcttgtattggtgattgattaaggttttggagaggttctttttgtgcatagagactgtgtggggacttttgattttcttggagtttgactatcttagatgtagataatatttgtgtatttttagcttatacaattgtgaaaatggcaagttctgctgaaccatcatcttctataagctttacttcaacttccaacacgtcgaatgggtccattggcataggccaaaacacatgtgcctgtggtggatctgagacagggagtagttatgaaatcatcagcttaagtaaactcagtaataatttagagcaactattgttagattccagctctgagtttagtgatgctg

SEQ ID NO: 11162 - DNA, 739 bp, Lycopersicon esculentum
  Predicted polypeptide sequence is orthologous to G839, G1196
acactagtttttgggtcatcagtcagcagagtgcaactttcttccacaatacatatttggggtatgcagaatcaccttttttattttttgggagttttcatgtttatgttagaatgatgggatttcaccagcagcagccaggcttgcaggtgtgagagtttgggccaagatcatgcagagttgacctgttgactttagttttcaactttttcagattcctgaaagttttgtgctttctcttgagggatgaattcttgctagtttatttaccaaggcagtaattaagtttgaacaatggagagcggccatgagagttttgctacatcttctaatgtatcaaatgagtgcagtagtccccaggaaccaggaccaaatgttgatcatttgagtaatttatgtggtagtcttgagaaactcctgcttaatcctgaatatgactatagtgatgcagaaattgtcgttgaggggattaatgttggcgttaatcgctgtatattggctgcacgaagtcagtttttccatgaaaagtttaaggagaagaatgagaattccttgaaaaatgaaaagcctaaatatttgctgaaggatttggtgtgtgtttccctcattggctatgaagtattcatggtcctcctgaattatttatatacaggaaagattaagtcgtctccttcagaagtttcgagttgtggtgataatgcttgtgctcatgatgcttgccgccctgccattaattatg

SEQ ID NO: 11163 - DNA, 476 bp, Lycopersicon esculentum
  Predicted polypeptide sequence is orthologous to G846
cgaaagtcagttggtttagggtgattttagatgaagcccagacaatcaagaatcatagaacacaagtagctagagcatgctgtagccttagagcaaaacgaaggtggtgcttatctggaacaccgatacagaatgccattgatgaacttttcagctacttcagatttctgagatatgatccttatgctgaatacaaatcattttgcagccaaattaagtttccgattgctataaactcaatcaatgggtataagaagcttcaagcaattttaagggctataatgttgcgacgaacaaaaggtaccgtgattgatggtgagccaattataaacttaccaccaaaaactatacagttgaagaaggtggctttctcttcagaggaacgagctttctataacaaattagaagcggaatcacgatcacaatttaaggcatatgctgcagctggaactgtgaagcaaaactatgcgaatatt

SEQ ID NO: 11164 - DNA, 611 bp, Lycopersicon esculentum
  Predicted polypeptide sequence is orthologous to G846
gtgttaccatatgcggacatgtattctgcaaccaatgtgtatcagattatttaactggggaagataatacatgtcctacacctggatgcagagaacaacttggtcctgaggctgtttattctaaagctgcccttaaaaaatgtgtaacaggtgatgtaaatggcgatccttccagcttgtctgaatttgatgagaaatcaattatggaaaatgagtacagctcttctaaaataagaactgctattgaaattcttgagtcatgttgtaagtcaaaggatacctatttagaatcagatatcttggtgcaatgcaatggtgattcatcaaatttgggagaaagagattcagaaatgcaatccaaggggccgataaaggccattgtcttctctcagtggacaggcatgttaaacttggttgagcatgctttgaaccagtctggttttcggtatgagaggctggatggcacaatgtctcttgctgctagagacagagctgtcaaagagttcaacacaaatcctgaggtgactgtcatgttgatgtcactaaaagctggaaatcttggtctaaatatggtggcagcttctcatgtaattcttctggacctttggtgg

SEQ ID NO: 11165 - DNA, 1560 bp, Lycopersicon esculentum
  Predicted polypeptide sequence is orthologous to G849
gatgctgaaatcacgacactggaaagtgtctcccaagttgaaggaatatgagcgatcttacacaaatggtggaatggagtccttttacctcagtaggaaaagtgtacgtgcacgcaagagatgccaacttgaagttccttccaagagacggaaattgagcaaccatggctttgctgttgcatattaccaggaggccagtagcgaaagcgttacaaattcacctgacaaggaaatcaaacgagacattagtacctcgcatgccatcccgccgagaggaactgctgatccagcttcagttaacaatcatcacaagaaggaccctaatgttaaatttagcatcaagtctttcaaggtgccagagctttacatagaggttcctgaaactgcaacagttggctctctgaagagaacggttatggaggcagttacagctatattggaaagtggattacgggttggggtggttctccagggaaagaaggtcagagatgacaatagaactctggagcaggctggcatttcccagaatggcaacctcgataatttgggtttcactttggagcctagattcacccaagtttctccatcatcatctcctaataaacttccggcttcatcaacatatgttgcagatcaggaactaacaaggcggcgacctagtcctataatggaatttgggattcacaatgcttcagcagaccctctagagactgatatgtgcaagtacagcgagaataaccatccatcagagctatcgcctacaaatcctattgattcatcaaccgatgtatctattccagattctagagccttggtgatagtcccttcagttaatgcagaggcacttgctatggttccgctgaaccataaaagtaaacgttctgaactttcacaacgtagaatacggagaccattctcagttgcagaagtagaagcactagttgaagctgtggagcatcttggaactggaaggtggcgtgatgttaaaatgcgtgctttcgataatgctgatcatcgaacttatgttgacttgaaggataaatggaagacattagtacatacagcaagcattgccccgcaacaacgaagaggcgagcccgttccccaggaacttctggacagagtcttagctgctcatgcttactggtctcaacaacaggggaaacatcacgctgaacttctaaaaactccagatgcaaaagcacagaaagttagcgcttgaaggaattcgtcgaattgtcaatgatgtaaagaaactattatattagggtaacacgaagagcacgacgaggaaactgtataaaaggattcgttctgtttctcgtcaactcggttagactcactgatttgatgccttacaacagttgtgactttgtaaattgcttcaggaataaagctgtggtaaccagcacatgtcttttagggtttactttgtttatgcatggttctttcatttggtgttgttagggttatggaaagaatctaatgtgtattcaatatgtaccgggctagtacttccaattgattttatagtgtaatttcaaaaaaaaaaaaaaaaaa

SEQ ID NO: 11166 - DNA, 700 bp, Lycopersicon esculentum
  Predicted polypeptide sequence is orthologous to G849
gcactgttgctttcggttttattttatttctcaaacccagaggtttttcatttctatccaaaaacaaatccatttagaaggaaaaaaaaactaaaatcaaattcaacataaattaattttcatctattttttgtgcaaattttcgttgtttgattaccaaattctcgaagaatctgtacagaatcacatccagatctctctcatcagcttgaagtgatattggtgtcaacggctcattgtacatgatcatcacatattggcatgctatctgagttatgtcgtcgaagaagagagtaaggcatggtttcagtggctttgaatttcctgttataccaaaagctcctagatcagttagaaggagacactcgcacaaaaatataaacaatgatcaaatttgtgcatttgaattactggcgactgttgctggtgaactattacaggagagcgaaagttctgcttgtagtagtgcagtgataggaaaagataagctctccgattgcagggaagttgtgaaacgtgagcaactcaaagaagataaagctgtgaaatcagagtgctttgaccaggggagttgtgttgaaagcgcttatctaccggaacctgcagtgcaagagccaaatctcaagtatagtttgggataacctaatcgtatagagaataacattttcgcactgaagtagaaggcgcatcctctaatctt

SEQ ID NO: 11167 - DNA, 729 bp, Lycopersicon esculentum
  Predicted polypeptide sequence is orthologous to G852, G2633
aagaaccaactggcttggaactattgtcttacatgcaagtcatctttaacatgtgtccatactacaaatttgcttatatgtctgcgaatgtcgtcattaatgaagccatgatgaatgaaaacagaatccatatcattgattttcagattgcacagggaagtcagtggatgttcctcctccactatcttgctcatcgtcctggtggacccccatttgtccgcatcacaggtgttgatgacgacgaatcagcttatgctcggggtggaggacttcagctagtaggcaaaaggctagcagaagttgccaaatcatgtggagtgccttttgaattccatggtgctgcactatcaggctgtgaggtccaactagagaaccttcgggttaaacatggagaagctctggcagtaaacttcccttatatgctgcaccacatgccagacgagagtgtaagtactatcaatcatcgtgaccgcttattaagactagttaagagtttatcccccaaaattgtgaccttagttgaacaagaatcaaacaccaacaccgcccctttacttccaaggtttcgtgaaactcttgattactatacagcaatgttcgaatcaattgatgcagctcgtcctagggatgacaaggagaggatcagtgcagaggagcattgtgtggcacgagatgttgtgaacataatagcatgtgagggagctgacagagtggaaagacatgaacttt

SEQ ID NO: 11168 - DNA, 2030 bp, Lycopersicon esculentum
  Predicted polypeptide sequence is orthologous to G852, G2633
ctccaaattttatcaatctacaagttagattcctccttctgcagattatatcaggtggatttcggtgaagcagatattaagtgttagtgagaaagagtttgcgcatagagcagctaatgacagccgtatagtatggactcgcaccatttggttgcttatggtgtgaccggtagtgatttgtcgtattcttcatgccctactgttagtcctctagagaatagaccatttggtacatcgaaatttgattcaggaaattcgccacttgtgaactattttaactctgagaccttcaacacagtaagtgattaccaggagcagcccagctgtacagagaatctttcaggtgctagttcttcaagtggttcctcactggattataaccaatatttccatcgaccaagcccctcggaagatcatcttccagaagctccttacagtcggaacatgaaacatactctgctgcagttggagtctgctttaatggggccagacaaagaggcaatgaaatccagcccttatcttggtgaaaatatgggggcacaaacatcaggtcagaggtataaagcgtggaacaaggaagcccaagttgtgcgtcatcaacaatcagtagtttcaatccttaatggaattcaaagtgataagcgagacaatgtaatggaggacttgcccttgcagggtgttccgtctagcaatctgaagcagctgcttatagcatgcgccagagctcttgctgaaaacaagctagatgattttgaaatactggttgctaaggcaaggagtgttgtgtccgttactggagatcccatccagcgtcttggtgcttacattgtagaaggcctcgtagcaagaaaggagttatctggaactaccatatacaggagtttaaagtgtaaggagccggctggtaaggacttgttctcctacatgtatatcctctatgaaatatgtccttacctaaagttcggctacatggctgcaaatggtgccatagtagaagcatgcagaaatgaagatcgcatccacattatagacttccaaattgcacaggggacccaatggatgactctcttacaagctcttgcagcacgacccggtggtgccccctacgtacgtattacaggaattgatgatccagtttcacagtacgctcggggagatggattggctgcagttgccagacggctatcagcaatttctgaggaattcaacattgctgttgagtttcatgcagtgccagtttttgctccggaaatcacttgggatatgcttgatgtaaggcctggtgaggctctggctgtaaactttcctttgcaacttcaccacacccctgatgagagcgttgacgtgaataaccctagagatggtctcattaggatgataaagtcgcttagccccaagatagtcactttggtggagcaagaatcaaacacgaacacagctccatttctccctaggtttgtagaagctctagattactaccatgcaatgtttgagtccatagatgtgaccctactaagggacatgaaggagcggatcaatgtggaacagcactgtttggctagggatatagtgaatgtcatagcatgtgagggcaaggaaagagtagaacgtcacgagctattggggaagtggaaatccaggttcatgatggcaggttttcagcaatatcctttgagctcttatgtgaattcagtgattaaggacctcatgaagcgttactcggagcattatacactggtggagaaagacggagctatgctgttggggtggaaggagcggaatctagtctctgcgtctgcttggttttaacgagttactgttcattatgtggaaacagatggttagccttcttttttattacttaaccagacaataggattgatcaagtaattatactcatgttatgtagtttcaattttctgaaattttagttgtttatttttcaagttatcgtttgatattatttgttaaaacttataaacaattatatcttcgccttgatgattttgtgagcaaaaaaaaaaaaaaaa

SEQ ID NO: 11169 - DNA, 608 bp, Lycopersicon esculentum
  Predicted polypeptide sequence is orthologous to G852, G2633
caatagcggagaataatttgatcacagctgaatggttaatgtcagaactacgcacggtggtatctgtttgtgggtctcccatacaacgtttaggtgcttatatgctggaaggtttagttgctagattggcctcctcgggaagctccatctacaaggccttaaggtgcaaagagcctactagtgtcgagctattctcgtacatgcacttgctttatgaaatctgtccatacttcaagtttggatatttgtcagcaaatggtgcaattgttgatgccatgaaagatgagaactcaattcatataatcgatttccagattgctcagggtagccagtggatcaccttaatccatgctcttgcagcacggcctggtggacctccaagaatccgcatcacagggattgatgactctacatcagcttacgccagaggaggagggattgaaatcgtaggtcgaagactgtcaagcattgctgcatcttgcaatgtacctttcgaatttcatcccgtgtctgcttcttgtccagatattgagattgagcatcttaaggttcttcccggggaaccattggctgttaactttgcgctcgtcttgcaccatatgcctgat

SEQ ID NO: 11170 - DNA, 498 bp, Lycopersicon esculentum
  Predicted polypeptide sequence is orthologous to G852, G2633
gctgcttatcgcgtgtgccagagctcttgctgagaacaacttggatgattttgaaaaattgattgccaaggcaagaagtgctgtgtccattactggtgatccaatccagcgtctcggtgcttacatcgtagaagggctagtagcaagaaaagaagcatccggaaccaacatatacagggctctcagatgtaaggaaccagcaggctgggacttgctttcctacatgcatatcttatatgagatatgcccttatctaaagttcggttacatggctgcaaatggtgcaatagcagatgcgtgtagaaatgaaaatcgcattcacattatagacttccaaattgcacaagggactcaatggctgactcttcttcaagctcttgcggccaggccaagcggtgcaccttatgtacgtattacaggtattgatgatccagtttcaaaatacgcccgaggagatggattggccgtagtgggaaaaaagctcgcagcaatttctga

SEQ ID NO: 11171 - DNA, 710 bp, Lycopersicon esculentum
  Predicted polypeptide sequence is orthologous to G852, G2633
tggaattcaacctggagaagcactagcagtaaattttgctttcacattacatcacatgccagatgaaagtgtgagcactgaaaatcatcgggatagactattacggatggtcaaaaacctcaaccccaaggtggttacccttgttgagcaagaatctaatacaaatactgctgctttctttcctcgatttcttgaaaccttggattattattcagccatgtttgaatcaatcgatatgactcttccaaggggacacaaggagcgcatcaatgttgagcagcattgtttggcgagggacgttgttaacatcatagcatgtgaagggattgaaagggtagaacgacatgaacttcttggtaagtggaagtcgcggtttagaatggctggttttaacccatacccattgagttcattggtgaacgctacgatcaagacattgctagagagctactctgataagtataggcttgaagaaagagatggtgctctttaccttggttggatgaacagagatttggttgcttcttgtgcctggaaataacaaatggttctttcatagaacttttctctttggtcccttttttttctctctctcatctttgtaacagctgaagtgctaatatatagtaagaaaacaggttccttgtcaagtgtatcacttgatcaatcaaagtaaaagttttatttcttggaaaaaaaaaaaaaaaaaa

SEQ ID NO: 11172 - DNA, 704 bp, Lycopersicon esculentum
  Predicted polypeptide sequence is orthologous to G852, G2633
gcaaagtccagattcatcagaatataatgatggaagggtgacaatgaagcttcaagaacttgaaagggtacttttcgatgataacgaaattgaaggagatgatgtatttgctcgtggcgagactatggacatagatgatgaatggtttaaccagatccgaacagagttacttcaggagtctccgaaggagtccacatcggcagattctaataccagtagcagtagtagctacaaggaaatatctgtatctgctcctcaaactccaaagcaaatgctgtttagttgtgctgctgctattcaagatggacacattgaacaagcgtcatctatgattaatgaactgaggcagatggtctccatccagggagatcctcttgaaaggactgcagcttacatggtagaagctcttgcagctcgaatggctacatctggcagaggtctttataaagctctaaaatgcaaagaagccacctcttctgagagactctctgctatgcaagtcctctttgaagtatgtccatacttcaggtttggttttatggcagcaaatggtgcgatcctagaggcttttaaagatgagaaaagagttcacatcatagattttgacgttaaccaaggaagtcaatattacactttattgcagacattgggtagtatgcctggtaagccaccccatgtgaggctaactggggtagacgaccctg

SEQ ID NO: 11173 - DNA, 182 bp, Lycopersicon esculentum
  Predicted polypeptide sequence is orthologous to G852, G2633
ttcccggggaacctatgcaacaataaaacgcatacatgtcggaaggactcagagcatgaatatattcttcgggaagtaacatctacaaaatgctcaagtgcaaggaaccaactggttcagaattgacctcttacatgcaagtcctgtatcacatctgcccctactacagatctgcttacaca

SEQ ID NO: 11174 - DNA, 537 bp, Lycopersicon esculentum
  Predicted polypeptide sequence is orthologous to G852, G2633
agttctgatggatgctttggagaaaagggtatcggtttatggggaacctatgcaacgactgagtgcatacatgttggaaggtctaagagcacgattattgtcctccgggagtaacatatacaaaaaactgaagtgcaatgaaccaactagctcagaattgttgtcctacatgcaagtcctgtatcacatcaccccttacttcaagttcgcttatatgtccgccaatgttgtcataagcgaagccatgaagaatgagaatagaatccatatcattgattttcaaattgcacagggaagtcaatgggtgttcctcatccactatctggctcgtcggcctggtggtccgccatttcttcgcatcacaggcattgatgattcccaatcagctcatgcacgcggtggtggacttcagctagttggcgaaaggttagcgagcattgccaagtcctgcggagtgcctttcgaattccatactgctgcattgtcaggctgtatggtcaaactagagaacctaagagttagacatggagaaagcct

SEQ ID NO: 11175 - DNA, 510 bp, Lycopersicon esculentum
  misc_feature (465)..(465): n is a, c, g, or t
  Predicted polypeptide sequence is orthologous to G852, G2633
gcacgaggccagacgagagcgtaagcactatgaaccatcgggaccgcctattaagactagtcaagagcttgtctcccaaaatcgtggccttagttgaacaagaaatgaacaccaataccgcccctttccttccaaggttccgtgaaactctagattaccacaaagcaatattcgaatcagtcgatgtaactcgcccgaggaatgacatgcaacggatcagatcagaggagcattgtattgcacgggatgttgtcaatctcatagcatgtgaaggggctgatagagtggaaaggcatgaagtttttggcaagtggaggtcaagacttttgatggctggatttactccatgcccgctgagtccatcggttgctgaggccattaaggtcatgttgaaggagtatagctcaaattataagcttgctgaaagccagggggcgctttatattggatggaacaacagagctntagcaacttcttctgcttggcaattacctcattcgctgcctttgg

SEQ ID NO: 11176 - DNA, 526 bp, Lycopersicon esculentum
  Predicted polypeptide sequence is orthologous to G852, G2633
gagaaccttcgggttggacctcacagcctgatagtgcagcgccatggaattcaaaaggcactccacatgatttggcaacttctgctagccttttgcctactagctgaagtcctccaccccgagcataagctgattcgtcgtcatcaacacctgtgatgcggacaaatggggagaagttgaggaattccgatccaaatatgatgataagagtgatgcttacattgcaggatatgctttcttttacgcgaattattcatgtttcaatgacaagccaggattttattttgaaagtctttacttcagagagagttatacaaagttgggaatggggaaattgttgtttggaacagtttcgtccattgctgcggacaatgggttcgtatcagtcgatggaatagtagcagtttggaataagaagtcatatgatttttacataaatatgggagttgaaatatttgatgagtttagatatgggaagttgcatggtgaaaatcttcaaagtatgctcataacagggggaaattga

SEQ ID NO: 11177 - DNA, 591 bp, Lycopersicon esculentum
  Predicted polypeptide sequence is orthologous to G852, G2633
ctttgacacttcaccacacacctgatgagagcgttgacgtgactaatccaagggatgagcttctaaggatggtgaagtcattttctccaaaggtggtcacgttggtggaacaagaatcaaacacaaacaccgacccctttttccctcgatttcaagaagctctagactactattctgcaatgttcgagtccatagatgtgacattagaaagggacaggaaggaaagaatcaacgtggagcagcattgtttggcaagggatatagttaacgtcatagcatgtgagggcatggaaagagtggaacgccacgagctattagggaaatggaaattgaggttcacaatggcagggttccaccagtatcctctgagctcttacgtgaattcagtgataaagagcctcatgaggtgctactcagaacattatacactggtggagaaagatggagctatgttgttgggatggaaaaagaggaacctaatctctgcatcagcttggcactgaagaaaattacgaaaggacagcctggtggactaagctctcggggtctagcgaagatctagtttagcaaataactaagtatgtaagttca

SEQ ID NO: 11178 - DNA, 666 bp, Lycopersicon esculentum
  Predicted polypeptide sequence is orthologous to G852, G2633
caacggtaaaccaaagagaccagcttctgcggatggtgaagagcttaaatccaaagctggtaacagttgttgagcaagacatgaacactaacactgctccatttctacaaaggtttgcagaagtctacaactactattgtgccgtatttgagtctctcgatgcaactctttcaagggatagccaagagagggtcaatgtagaacggcaatgtctcgcacgtgatatcatcaacattgttgcctgtgaaggattggagcgaatagagcgttatgaggttgcagggaagtggagagctaggatgatgatggctggtttcactccatccccaattagccgaaatgtctatgaatcgatccggaatcttatcaagcaatatagcgaaaggtacaaagcagaggaggaggcaggtgcactttatttcgggtgggaagacaaaaccttgactgttgcttcagcttggaggtagaaacaacatatgctctctcagaaacaaacaatgctgtgcattggagatcaacttgtagcgaaaaccgactgtgtgataatatttcagtgtttatgatcagaatgcatggcattgtatactttgatgctattcttagatacgattaacttctgtgctgatgtaggttgatgtgaaactagtagataaaactgtttttttt

SEQ ID NO: 11179 - DNA, 254 bp, Lycopersicon esculentum
  Predicted polypeptide sequence is orthologous to G852, G2633
caagagtccaacactaacacagcccaattctttcccaggttcttggagacactgaactactacctatctgttttcgaatcaatagacgtggctctacctagagaccataaggaacgaatcaacgttgagcaacactgcttagcccgtgaaattgtcaacatattagcatgtgaaggggcagagagagtggaacgacacgagctgcttgaaaggtggagatcacgatttgctgtggccgggtttaaaccatatcc

SEQ ID NO: 11180 - DNA, 866 bp, Lycopersicon esculentum
  Predicted polypeptide sequence is orthologous to G861, G1140
aaaaaaaaaaactcctaatggctagagaaaaaattcagatcaagaaaatagataactccacagcaagacaagttacattttcaaagaggagaagaggtttattcaagaaagctgaagaactttctgttctctgtgatgctgatgttgctctcatcattttctcttctactggaaaattatttgactattctagctcaagcatgaaacaaattcttgagaggcgtgatttgcattccaaaaatctggaaaaattggatcaaccatcacttgaacttcagcttgtagaaaatagcaactactccagattaagcaaggaaatttccgaaaaaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggtatgcatctaatggaagaaaatgaaaaattaaggcaacaggtgatggagatatctaataataataataataataataatggatatagagaggcaggagtagtaatatttgaaccagaaaatggatttaataataataataatgaagatggccaatcatctgaatcagtaacaaatccatgtaactcaattgatcctcctcctcaagatgatgatagttctgatacttctctcaaattggggctaccttactcaggctgaagagatcaaaagcaaggtgtggctatttttgtatgttattagaagaaggagaaaaaaaaaagtaactactaattattataattaattaatgtctgattaatgtaaaagctaaccccaaaa

SEQ ID NO: 11181 - DNA, 621 bp, Lycopersicon esculentum
  Predicted polypeptide sequence is orthologous to G861, G1140
ggtgaatagtacttattccatctccaaaattaggtcttacatatttctatactcaattattggcccatttttgtataggttttctaactagatctaaagttttcctcttttattagggtttcttacaatttcttactatttatatcttttgtgagatttcttagaaagtttgaggaaagataattagcttcttcgacctgttaaggatggcaagggaaaagataaaaataaaaaagatagataatataacagcaagacaagtaacattttcaaagaggagaagagggctttttaagaaagctgaagagctttctgttctttgtgatgctgatgttgctcttatcattttttctgctactggaaagctatttgattttgccagcaccagcatgaaggatattcttggaaagtataaattgcaatcagctagccttgagaaagttgaccaaccttcccttgatttacagctagagaatagcctcaacatgagattaagcaagcaggtagctgataaaactcgtgagctcaggcagatgagaggtgaggaacttgaaggattgagtttagaagaattacaacaaattgagaaaagacttgaagctggtttcaaccgtgtgcttg

SEQ ID NO: 11182 - DNA, 225 bp, Lycopersicon esculentum
  Predicted polypeptide sequence is orthologous to G861
gagtattcaagctccagcatgatgcaactgattgagaagcacaagatgcagtcagaaagggatggtatggataatccagaacaactgcattcttctaacattctgagcgagaagaaaacccatgcaatgcttaacagggactttgtggagaagaatcgggagttaaggcaactacatggagaagagctgcaaggacttggtttggatgaattaatgaaattggag

SEQ ID NO: 11183 - DNA, 1287 bp, Lycopersicon esculentum
  Predicted polypeptide sequence is orthologous to G866, G883
gcacggacaacaaaaatggctgtagatttgttaaattattcgaatttgaatgaacaattagctttacaagaagctgctacagccggtttaaaatctatggataatttaatccggttcgtttcatttcaacaacagcaaaatcaaacggttcagccggattgtagagagataactgattatactgtttcgaattttagaaaggttattactattttgaaccggaccggtcatgcccggtttagacgtagtccggttcaggttactgatgattcgtctacggctttaactctatcgccgttgacaaatccggcggaggaaactgtaccggcggtgaaagtaccggttgagaagtatcaatcgaaggcgttgactttagattttacgaaacggaaagttggtaaatctattggatgtgaagctgttccggtagcgagttcgacgacgtcgtcgtcgtttatgtcgacgattacaggtgaaggaagtgtttcgaatggtaaagtgttttcgtcgatgagtttacctcctcgtccgcctgtttcctccgggaagccgccaatcgccgggaaaagatgtcgtgatcatgagctgtctgatgaattttccggtagaacttctagctccgggaagtgtcagtgcaaaaagaggaaatctcgagtaaaaaaagtgatcagagttccggcgatcagttcaaaaactgctggtattccggcagatgaatactcatggagaaagtacggtcaaaagccgatcaaaggttcaccatacccaaggggatattaccgatgtagtagtgttagaggctgtccggcgagaaagcacgtagaaagagccaccgatgatcctggaatgcttgttgtgacttacggcggagagcatcgtcatgttcaaaccacgatctccggcaacgtcaccggcgctggagctggaagttccggcgagagaatgatggcttttgagttaacaggacagaaaaatggagaaagattagggttagagatttagggactgtttttgtaatttcgaaatagtggaggggtggaaattgacatgtgagaaagcttaaaagcgtagaaaagtcaatagtttggtggcagttgaggggtgtgtatgtaaatttgggaaattttgactactttttatttaatacgaaaatcgagaaggtttagaaattttcaagtttgactatacttttacttttttatttgaaaaaatagaaaaatatttcttatctttattgtaatttaatttaattattgagattaaaaaaaaaaaaaaaaaaactcgaga

SEQ ID NO: 11184 - DNA, 429 bp, Lycopersicon esculentum
  Predicted polypeptide sequence is orthologous to G866, G883
cgagttttcatggaggaaatacgggcaaaagccgatcaagggttcaaaatacccaaggggttattacaagtgtagcagcttacgtggatgtccagcaaggaaacacgtggagcgcgcgatggacgatccaacgatgctgattgtgacttatgaagatgaacattgtcataatccagttgctgcgatgcatgggaacagttctcaaatggtgaattttgggttaatggaaaagaagtagggggtgaaatgaagatagaggagagttgtagggtgattttgtagtttggaatagttggggggttgaagttatatttgggaaaagttataagggttaaaagagtagagagtaggaagttgtgggaattggtttgttatgtaaatttggaaagattttaggggttgaaagagaaaaaaaaagaaaagtttcgc

SEQ ID NO: 11185 - DNA, 635 bp, Lycopersicon esculentum; identical to SEQ ID NO: 10373
  Predicted polypeptide sequence is orthologous to G869

SEQ ID NO: 11186 - DNA, 633 bp, Lycopersicon esculentum
  Predicted polypeptide sequence is orthologous to G869
gcctcgtgccgaattcggcacgaggaagaacaggaggaaggaggaggaggaaggaggaagaaaggggttgtgatatatgtcggcaaatttctgtttggctgtgattagagctccattgaagctctgggtgtctgtttcttcggtgatatttggtctttgcatgcaacaaatcctctgctgtgatcatcagcagcagggtattactctgtttttcacaactgtttcgatgcgtttgaggcccaaaaggacttgttctggtgttgtttgctttggtggatttcatataaaccgatttttacatcctattttgctcttgagacggccgattacttgaaaatttttgctgagtttttcaaattaaattcaattttatttgtgtttcctgttgaaaaaaaccaattttctgggcatatttcgaggggttttgaagatttgaagaaatcatgaaaatgtccgagtctcggagacaatctcagaaatcgaagattagggaagaatcagcccgacccatgaggaaaatccggatcgtttgtgacgacccggaagctactgattcatctgatgatgaaggggttgatgtatcgaaacccaaacgaattgttagggagatttatcttcctgttgttagctctt

SEQ ID NO: 11187 - DNA, 756 bp, Lycopersicon esculentum
  Predicted polypeptide sequence is orthologous to G869
cagtcacaaaagcatgttaccttggagcctgaatggcataaccatggggaaattgagaaaaaaaacctttcaagaaaaagcaggtatgccaaaggctttaacctctaaccatgcatgccatctaacaaaccaataaatgtcatgaatctagaatcttgtaaacaaacatcatgttcattgtctaaatcagctgataggtgtaatactatgaaaagaaatcctaaagctaagtcaggcttacttggaatccgaaagcaaaagaatgggagatatagtgctgaaattagagacccgattaagcataagcaagtatggttaggtactttcaacactattgaagaggcttcacaagcttatttatccaagaagtctgagtttgatatgttaactcagggatataaggaggataaaccaaataattgtgatcaaactaagcctgaatcatctgttggggcatcattgtctagtgggggtagaaataaaaaaatggattctcccaaacaacgcgtatcattggggttcgcaagaaccagtgggggaaatatacatctgagattataaaccccattagtaagaaaaagatttggttggggacttttggcacgtatgaagaggcttccctagcttatcaatctaagaagctagagtttcgggaaatagtcaaggcaaagaagaaatgtagtaagaaaattcatttaaatgcaagggagaagcaagttgggaaagagaaaatagctgtaaattgtggaagatttc

SEQ ID NO: 11188 - DNA, 390 bp, Lycopersicon esculentum
  Predicted polypeptide sequence is orthologous to G869
ggatgcagagtgtttaacttaggtttaatggctaatgtttgtggcacaaaatcatctgatgactgtaacaatactacaagttgcaatcctaaagttaaggtaagcttgattggagccagaaggcaaaagaatgggagatatgaagctgtaattacagatccatttacgcataagagagtccggttggggacttttgacacagttgaagaggcttcacaagcttatttctataagaagtcggagtttgagaaattaagccatcagggaaatcagcagaatatactgaagaagaattgcgatcatattcagcagcttgaatcatcgtttgtggtggcatccttagatactgttgctagtgaaagtggaatatctaaaagaatcgattctcaa

SEQ ID NO: 11189 - DNA, 725 bp, Lycopersicon esculentum
  Predicted polypeptide sequence is orthologous to G872
gcaagattcatcaatttaacttcaatttcacaaaagaaaatttaaaatttgattaaaaatggtgaaacccaattcgaaagatactgaattttcacagtcgtcatcgtcgtcgttgtatcggggagtacggaagaggaaatgggggaaatgggtatcggaaattagattacctaatagtagagaaaggatttggttgggttcttatgatacgccggaaaaagctgctaaagcatttgacgccgcacttttttgtttgcggggtaaaggggctaatttcaatttcccggaaaatccgccggagattaggaacggaaggacgatgactccgtcggagattcaatcggcggcggcgcagtttgcgaataatacagaacccgaacttatccgggtcgggccaagggagaattcggatctttcttcttcctcatcggaaatatttcgagcggaatcaccgtcggtgtcagtttccgatagagtagaaagtgaaaagacggaaataaccttgggtaacgattttatcgatgtgtatcgggtggagtctagagtggaaagtgaaaagacggaaatgtccttggataacggatttgttgacatgttttcgtcgttaggaacgggtaatgatatgtctgattttggaatttttccggggttcgatgacttatcgggtgaattttttataccaccaccatcgtcaccacaaccatcaccactgcaaatgcctaatt

SEQ ID NO: 11190 - DNA, 443 bp, Lycopersicon esculentum
  Predicted polypeptide sequence is orthologous to G877
ttttttttttttttttttcaaatgagtggcggcctatatggtatttagaagttaaaacaaagacaatatagcttcaaaaagttgtattataggactctgtgtagggaggtatgcccattaagtaccaaaatcagcatctctaactttctgttctttagagaagacaaaaactgtaaatttacatctgaggtccaagcgacaaactgttcaaaaattgctgataagctgttgggccaggatctgacagaggttccacctttggttcttcctttgggaacataaatcccatatcatgcatgggtcgcggctgtcctagatatggatgcataggaacctcccctggcttgttttgattaggatgaaatccggccattgctagactggataggccgccttgctggttcattccatagctaaatcctgggttaggtccaagctggggg

SEQ ID NO: 11191 - DNA, 973 bp, Lycopersicon esculentum
  Predicted polypeptide sequence is orthologous to G878, G884
gcactttcttctttatctcttgagaagaagaagaagaaaactgaaaatgggggaaacaggggaagcttcagcaatatcgtttccatctttgacaattccacctcgcccttcatttgaatccttttttaacatgtcttctttcagcccaggtccaatgtctcttgtttccagtttcttgtctgatcagagccctgattctgcagattgtcctccttctttctcccagcttctcgccggatatgaatattctggagatcctcctgggtgtcaaaagaactctgggtataaccaaaatgggtctgtgaatcctcaattgttcgttattccctctggtttgagtccttctggattccttaattctcctggctttctttccccacttcagagtccctttggaatgtcacatcagcaggctctagcacatgttacagcacaggctgaattttctagttcatatatgcaaatgcaaatgcaaatgcaagcccaagaccagtgttcctctcaggtggctccagtagaagcattaggacatgagttgtcgattgatccaaaggagtcttccttgcagataaaggaatgtctgcaatctagtttggataacaagccatcagacaatcagggtaagcaatttgaacagccggaggtttctcaatctgagaacaagacatcctctggtgctctcgataagccagcttgtgatggttataactggagaaaatatggtcagaaaaaggttaaagctagtgaatgccctaggagctactataagtgcacatatctcaaatgtctagtgaagaagaaggttgagcggtctgttgatggtcacataactgagatcacatataatggccgtcacaaccatgatcaaccaaccaaacgaagaaaaaatggttctgctttggataatacagactgctttggagttcgaccagatattagtacacatgattggacagtaatgaatagctcggat

SEQ ID NO: 11192 - DNA, 815 bp, Lycopersicon esculentum
  Predicted polypeptide sequence is orthologous to G878, G884
gtgcaaagcctccattttcgtataagcaagcgtggactttctagtttctactaaaagtttgttcagatcctatacatacaactttctgtttaattttccaaattgaagagtaaactccaatcatcaaatctccatacaaacacccactttttccaacaataaacacaacaaaaaatcgacaaaagaaaaaaattgatttttttttgatagtttacagagaatttacaaacaagaaatgataaatttattttctacataataaaaatacccagaaattatggccgaaaatgaaggatcatcttcttcttcaacgtcgagaggtcaattactccgtccaactattactttaccgccgagaagttctatggaaagtctattttcaggcgggtcaagcggtattagtccgggtccgatgacccttgtatccagttttttctccgataacgatccagattctgagtgtcgttcattttcacagcttctagccggtgcaatgacacctccggcgggttttaccggtgttagaccgggtttcccgccacttccgccaccatctacggcggcgataactcagtcgccgactgcgtttactgtaccgcctgggttgagtccaactagtttgtttgatgggttcttctcacctggtcagggtccttttggatgtcacatcagcaagtgctttgctcacttacatctcaggcatcccaggctcagtctcaaatgcacattcagcctaactatccatcttctgcaacggcagctgcactatcaatggtctcagtccagtccttaccatcaaatgcagcagcaaaccg

SEQ ID NO: 11193 - DNA, 663 bp, Lycopersicon esculentum
  misc_feature (585)..(585): n is a, c, g, or t
  misc_feature (617)..(618): n is a, c, g, or t
  Predicted polypeptide sequence is orthologous to G878, G884
gaagactcattttttggtggtggaaatatgccctattttagtccaggtccaatgacccttgtctctactttcttctctgaatctgagtacccatctttctcccagcttcttgctggagctatggcttctccattagcaaaaccgcctaccctttttcctggagaagaagagaattgtaaacaagggtataaacagaatcgacccatgaatctaatggtggctcaatctcctttcttcaccattccaaccgcttttactccttctggattgcttaattcacctggatttctttccgcagttcagagtccttttggaatgtcacaccagcaggccctagcacatgttacagcacaggcagcgttatcccagtcttacttacaaactcaagctgaatgccatttcccctcgcaaagtaaatcagtacaagtattaggggcatctgacccagaggagtcttctttacaacctcaattagatactatgtcgtcagaccagaagagtaagaaatttgaactgccacagctttcgcaatctgaggacaaaccatcctttaattcagtcgatagaccagcttctgatggttancattggaggaagtatggccagaagatggttannagcagtgaatgccctcggagctactataatgcacacatctcaaat

SEQ ID NO: 11194 - DNA, 608 bp, Lycopersicon esculentum
  Predicted polypeptide sequence is orthologous to G878, G884
ccaggttccaacccaaatggtatctgaacttcttgtgaaaagagaatgtgatgaaaccgaaagctatttgatagacgtagatgatgaagggcatgatgaaccagatgcaaagagaacgaagacggcaattgagactgtagcttcatcacatgtcacagtagctgaatccaagattgttctgcagacgagaagtgaagttgatttcttagatgatggatataaatggcgaaaatatgggcagaaggtggtaaaggggactcagcatccaaggagttactatcggtgcacatatcctggatgcaatgtccgcaaacaagtcgagagggcttcaactgatccaaaagctgtcataacaacatatgaaggcaagcataatcatgatattcctactgttagtgttaggaatagaggaacaaggaataaatacagctaaagatagcgttgagaacgtaagaaacagtgtgaaggccttcagttcacaaaaatatcttggtttctgaaaacaacaacaaaattccctcgtgtgaaaactgaaagattgcagcattagtagcatcaggaaaagtagaagggtgaaaagatgtggtttgagcttcttacttctgtac

SEQ ID NO: 11195 - DNA, 269 bp, Lycopersicon esculentum
  Predicted polypeptide sequence is orthologous to G878, G884
gtgcatccacacttgatatacacgagttactatcggtgcacatatcctggatgcaatgtccgcaaacaagtcgagagggcttcaactgatccctaagctgtcataacaacatatgaaggcaagcataatcatgatattcctactgttagtgttaggaatagaggaacatggaataaatacagctcaagatagcgctgagaacgtaagaaacagtgtgaaggccttcatttcacacaaatatcttggtttctgaaaacaacaacaaaatt

SEQ ID NO: 11196 - DNA, 1260 bp, Lycopersicon esculentum
  Predicted polypeptide sequence is orthologous to G881
gaaagatggatataattggagaaaatatggtcaaaaagtgacaagagataatccttctccaagagcctattttaagtgttcatttgcaccatcatgtccagtcaagaaaaaggttagtttactactcccttctctctattttaattatcatgcttattaaaaataattaatttaaaatagttatcatttttaaaaattaaatatttattttcaattttacccttgctcaataaataaagatagatattaatgaagtgaaaaacaacataatataaaattaaattaaagtaaaaaagtaaataaagataatttattcaaattatgcttttagttgattctccctcaaatgttgactgaatttatgaggcagtgtacacataaaaatattgaagaatataatttaaatacactttccactattgtctttttcatcggtataacttgtcttctagaaaatatcaaattttattaagaaagagacaaattttgaaaaaaaattaaaccttgaactttgaatactttaattattttaaataataaaaaaagcctaaaattcaattaatataaaatagaggaagtattttattagtggttgtgcaaataaaaacatgacaaatagaagacaaaagatggagttagatggagcttcatgggttcggacgaactcagtagctttttcataaaccctacacttgtattaaaaatttaattaaatatttatgtatattaatttatgaatcactaacaaagttaattgacgtttgttaacaaaatttagaaccccaaaacacttaatccccgcttcggctatgaactagaaggagtaaatgcttggaaaaggatgtgtttactttaatgttcccacctaacataagagtatagaaatgaaataacattactatactaagtatttaattttgtgttgtctaaatttcttttatattaataggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctagttttgcagctacagttgctacagccatctcaggattacttttttgaattatatgatgatttaattacctttcaaatgacacaaaattactgtttgt

SEQ ID NO: 11197 - DNA, 1042 bp, Lycopersicon esculentum
  Predicted polypeptide sequence is orthologous to G881
ggagaaaatcattggcaggaaattttctttttagcatcaagaatagtttaagcaagtggtgatagtaatatataaattatatattcgaagggggaagaaaagtttcagtttttccgagtttcatactccctgtcggctcaacagtgttccccaagatgatacgagttgccgctcaagccacaaattttctatccgtactcgactctgtggtgaagttgctcacgaaagcttcagtctcagaatgctgccttaaaagaaggaaacctcaaatcagatttcatatttttgtgtattggcatgttttgaccaatgaattgattagatgttagtagactgggttgtttcgacttcgtgctgacttcagataagtagcatacatttaatttttttcttatatttatcaagttatctttcagttccttctctcttgtgtcaactcgtcttgtttcgttcagttgattgcttgttggtgattatgaatatgaactgggactatttgttctctcttgtatttagctcgcgatatgacttgaatatgtatgtggatattggtaggcttaccactctgttcttattttggacttccatagcattgttgtcctcgtcttttggttttttttctcgatcggaagtggaaaagttttttttttgttgtggagccgactgtggagagtgtctttatctgtgaattatttgtgatatgatttacataaaatgatcattaaatgatttagtttctgatcatccgaaagaatacgatagtttttctatcttgtatcatttattcgtttcatcttgcctcttataaaactggtagttttcatcctagttcctctaaagttttcacttcaaaattttcttgctttgcttatgtgttattattttagaaatttttttgactctttggcagctgtgatttagtaaaagaattttgcagctttgttcttgttgttgttgttttccttgtgtttgatgctttccccttaggtctcaagttcttgttctttcattgttagaatgattcactgtaacagtagtgatt

SEQ ID NO: 11198 - DNA, 474 bp, Lycopersicon esculentum
  Predicted polypeptide sequence is orthologous to G884
gaggaaaatttttgaaaagaagaaacatttaaacatgggaaatgatgggttttttatcatctttttcccttgattcttttggggtggtaatcgtaggggatttagcgacaacttctaagtcaaaattcattatgggttcggtataacgggaagtttcttgatacgaatacagagcctcaacaagttaatggcagtaagtttaagactgaatcgagaatattttgaagtctttctggacctcctctttccgtttgtttgggttcgtgtctgtgctcgcctgattgaaagatcgtcaccctcaaactcgtagtcttattttactacactggaaaaggtgctggttagacgacatattgaagactcttgcggcggtttggacatcagtgttatcaagactatttggcacagttggacgctagagctacagactcaacgttgcaactatccagacgtcgagcatcatacgaacttggc

SEQ ID NO: 11199 - DNA, 1302 bp, Lycopersicon esculentum
  Predicted polypeptide sequence is orthologous to G896
gcacggtaaaagcatcaccattttcaatttatcaaattaattgaaacaagaagaagaaagaaaaaacatgatgatgcttgtcaattgttccaagtgtcacacccccttacaactcccaccaggtgcaaagtccattcgctgcgccatctgcagagccatcacactaattgctgatcctcacgctgctccgccaacacccccttccgcttacaataaccactactatcccccttcttctccttctcctgctcttgctccatctacttatagttccggtcaaaattcatcgtcacgaaagagggcggtcatcgtaggtatttcgtatacgaatacgaggaatgaactgaagggatgtattaatgatgctaaatgtatgaaatttttgctcaccaatcgattcaactttcctcaagactctattctcatgcttactgaagaagagagggatccatacagaataccgacaaaacataacataagaatggcgatgtactggcttatgcaaggttgtcaagcaggggattctctggtgttccattattctggtcatggttcacaacaaagaaattacaccggagatgaagttgatgggttcgatgaaacactttgtccgttggattttgaaacccaaggaatgattgttgatgatgaaattaatgcaacacttgttaggcctcttccgcgtggagctaagcttcatgctattatagatgcttgtcacagtggtactatgcttgacctaccgtttctttgtaggatggacaggactggacgatatgtatgggaagatcatcgtcctcgatcaggagcatggaaaggaacaagtgggggagaggtcatatccttcagcggttgtgatgatgatcaaatctctgctgatacggataatttgtccaaggtcacttcaactggtgcaatgacgttttccttcatccaagcaatcgagcaaggaaaaggaactacatatggaggtattctaaatgcaatgagatctgccattcgcagttctgataatggtgtaggagctggcattgtgacatcgctattgactatgctgatcactggaggaagtgctggcattggaatgagacaggagccacaattgacagcaaatgaaccatttgatgtgtacaccaagccattttcattgtagcatcttactcatcaagcaacactaccaacctaaggtttttcatattttcatttagcttttgggtgttgaattcctgtacagttaccaagaaggcagttgtagagtactaagattcttatattcatcaatttcataaaatattaaaaaaa

SEQ ID NO: 11200 - DNA, 405 bp, Lycopersicon esculentum
  Predicted polypeptide sequence is orthologous to G896
ggtcaatccactttgatcaccctccatacaatggacagcaggagatgcaaatgccagtggtgtgggatgaagatagcagctcccattggagcacaaacagctacctgtccgaggtgccaatctgtgacacaactccaacctgcaagaaaccatggctttgctaattttcccactgccaataacaatatgagcccagcttttccatcaaggccaggaaggatgtgtgcaaatgctaataattttcagcctcaacaattcaaccgccctatgtcaccacagatcaataatatccgacctcctgcagtacatggacgaaaaagagcggttctgtgcggaatcacttaccgtggccatccaaagagtctgaagggaagcattaatgatgttttatccatgagatatttt

SEQ ID NO: 11201 - DNA, 253 bp, Lycopersicon esculentum
  Predicted polypeptide sequence is orthologous to G896
tacactactctggccatggcacacgagtacgagaccatgatggtgatgagattgatgggcacgacgaatcactatgccctgttgattttgagacagaagggaggatactagatgatgagatcaataataccattgtcaggcccttaccccgcggagccacacttcatggaataattgatacatgctttagtggaactttcctagatttgccctttttgtgcagaataaacagggcaggatactttatgtggga

SEQ ID NO: 11202 - DNA, 1045 bp, Lycopersicon esculentum
  Predicted polypeptide sequence is orthologous to G898
gtaaaaccctaataaatgtttttgggttgttgaatttttttgcagttttgaacaagttcaggaattatactgtcgaagctaacccttgagatatcacgactgtgcaaagcatgagttcccaagaaagtagtgcacaaccaattaggcgtacaaggtcccagtcaagaagaaatactgttctaaatgtggatctaaatgctgcaccgccagctgagaacagaattcaggaaggagatcctattcatgttgtgtctggggatacaccacaaggacgaagaggttcctctttgacagctggagcaattgatgttgaggcacttgatgatgatgtgattatatcatcccctagggcgtttgcagtagctaagaacaactctagaaggaatcaaggacgggttattgtgcttgatgtggattctgaggaccgtgcgtctaggggtaacagtcgcaacaggcatagaagagtctctacaaatcaagcagcaaacaatggtgatattcacatagacctagaaggacatagctgcccaaagagagttgatctaagaagtgcaataccagcaccaccaaaagagcctacattcagctgtccagtgtgcatgggtccattagttgaggagatgtcaacgaaatgtggtcacattttctgcaaggcgtgcattaaagcatccattgctgctcagggaaaatgtcctacgtgtaggaggaaactggccgcgaaagacaccataagagtatatcttcctgccacaaattaagtccaaggattttgctatcatttacatgacctctggatgaagtgtatgactatgtgagtggaagggaaagtatgactggaaatactttttcagtttagctttaggtctgaatcattgatggtactcttacagtatgtgcctttaaaagattggtgtaattagtaaatggatttaagctacatgcattgacaacttttgtgatatcatttgtgtaatataccttgaagaaaatctatgaaccattcagcaagttcttgcctaaaaaaaaaaaaaaaaaaaaaaaaaaa

SEQ ID NO: 11203 - DNA, 718 bp, Lycopersicon esculentum
  Predicted polypeptide sequence is orthologous to G903
gaaaaaataaaatctctcctctctgtctttaattaccataaatctgggagaattttctggttcttgtctttctcttcttctaaacagcaaatccttagttttgttagtttctaaaacctcaatatatataagaaattaaaggagccaaaataatctatatttagccttttgctttcattattatttactctttcaatgtcaaactcaaacctctcttctggaaatagtagtgaagaagcagatgaaactccttatgtgttgtctagtacaagtgatggatctagtgctcatcaacaacattctcaaactaataataagaaaagaaggaaattacctggaaatcctgatcctagtgctgaagttattgcgttatcaccaaaaacactaatggcaacaaacaggttcatctgtgaagtatgcaataaaggcttccaaagggaacaaaatcttcaactacacaggagaggacataatttaccatggaaactaaagcaaaaaacaagcaatgagattaaaaaacgcgtttatatttgcccagaaagttcgtgcattcatcataatccttctcgtgctcttggagatcttacggggattaagaaacatttttctcgtaaacatggtgaaaagaaatggaaatgtgaaaagtgctctaaaaaatatgcagtgcaatctgactggaaagctcattcgaaaacctgtggcacaaaagagtataaat

SEQ ID NO: 11204 - DNA, 636 bp, Lycopersicon esculentum
  Predicted polypeptide sequence is orthologous to G910
ggccattatggggatttggcttgaaagatttggaaaatgccactccaccagatcagttcatctcaacatcgaatggtaaagcgaatggagttaaggtcatttcaaaaaaatttaaacggtctcactcatcaccagggggctcttccttagcttctgaactcgacttcacaggtctcgttgtttctcctgaatcagaagtgggatcaactagttactacactaaggtgttaagcttgcgtaaacggagagagaatacttctcttattctacagcagattcttgacttggaaagacttcagctgactgagggcagtaacaatttaacaagtggagaaagtcgaaataatgtttcttcattgaaaaattgtacatcatggaatatgcataacaaatttgattgcttgcagagttcacttgatcttggccctgaacttcaggattggggcagtactcatgaaagtccagttgatgaatcgtttccattaccgttgcctgatggtgattcgttttgggaatgtaaaagtccggttcagagtagtcagctttggcctcaaaatctgcaagatctaagagcttatgctgaactaaaacgtttcgataattccaatatgccctgatgtgatttgaccttccaaa

SEQ ID NO: 11205 - DNA, 451 bp, Lycopersicon esculentum
  Predicted polypeptide sequence is orthologous to G910
gaaaagtacatcaagagaaagtgtttataatatgataggatatatattcttgtgactctcaaaaaatcacttttttttttttttatctcaagaaattttctaattttttttttttgttgattcaagaaagttgacttcttagaagacattaatcacagatgtgcagaacaactgtttcgagggctcgttcgaatttgtaaagatggaaatggagaaagcatgtgaattttgcatgttattgaagccagtggtgtattgtgaagctgatgcagcacatctttgtttatcttgtgatgctaaagttcattcagctaatgccctctctaatcgtcatcctcgtactcttgtctgcgagtgttgtggacacaaccctgcttatattcgatgttctgatcatcaaacgttcatgtgtcgtgactgtgaccgatgccatcatgatctctcttctcac

SEQ ID NO: 11206 - DNA, 562 bp, Lycopersicon esculentum
  Predicted polypeptide sequence is orthologous to G912, G2107, G2513
caaacccaaaaacgtccatccatcgtacactactatattttactctctcgtcaaaatagtattatcatatcatggatatctttgaatcctattattcaaattctttcgttgaatcattattatcatcgtcattatcaatatctgatactaataatctcaatcactactcccctaatgaggaagttattattttagcttcgaataacccgaaaaagccagctggcaggaagaagtttcgagaaactcgacatccagtatacaggggaatcaggaagaggaattcaggaaaatgggtttgtgaagtcagagaaccaaataagaagacaaggatttggcttggtacttttcctacggctgaaatggcggctagagctcatgacgtggcggctatagcattaagaggccgttctgcttgtttgaatttcgctgattcagtttggaggttgcctatccctgcttcctccaactctaaagatattcaaaaggcggccgctgaggccgccgaaatctttcgatcggaagaagtttcaggagaatctcctgaaacgtcagaaaatgtgca

SEQ ID NO: 11207 - DNA, 573 bp, Lycopersicon esculentum
  Predicted polypeptide sequence is orthologous to G912, G2107, G2513
ctttctatttttagctctcaacaacaatgaatatctttgaaacctattattcagactcgttaattttaaccgaatcatcttcttcttcatcgtcatcgtcgttttctgaagaggaagttattttagcttcgaataacccgaaaaagccagctggcaggaagaagtttcgagaaacacggcatccgatatacaggggaatcaggaagaggaattcaggaaaatgggtttgtgaagtcagagaaccaaataagaagacaaggatttggcttggtacttttcctacggctgaaatggcggctagagctcatgacgtggcggctttagcattaagaggccgttctgcttgtttgaatttctctgattctgcttggaggctgcctatccctgcttcctccaactctaaagatattcaaaaggcggccgctcaggccgtcgaaatcttccgatcggaagaagtttcaggagaatctcctgaaacgtcagaaaatgtgcaagagagtagtgacttcgtggatgaggaggcgatctttttcatgccaggattacttgcaaatatggcagaaggacttatgc

SEQ ID NO: 11208 - DNA, 647 bp, Lycopersicon esculentum; identical to SEQ ID NO: 10387
  Predicted polypeptide sequence is orthologous to G912, G2107, G2513

SEQ ID NO: 11209 - DNA, 850 bp, Lycopersicon esculentum
  Predicted polypeptide sequence is orthologous to G913, G976, G1753, G2514
cctaccaccccacccccctatagaaatctacatatacatacacacacacaaaaaaaaacatatatatatatggctgactctcaaaattctaccaagtccacccaaataattcaacctcctaatcaatcaagtgaaagtacgaaaatacccttcaacactacccttcctccaccactaccaccgttgccgccgcctccggcgccaccggagacacatattcaaataaccaatacattatcatcaaaattagaaaacacaaatacaactccaaaaaccgttattattccaactgcaatcatgagttccacctcatcgagcggcttgggatctccgagccgctcaataggcggaaaacatgcggtattccgcggaatacgatgtaggagtgggaaatgggtgtcagaaattcgagagccacgtaagactacgagaatatggttaggtacttatcctacacccgaaatggctgctgctgcatacgacgtcgctgcaatggctttaaaaggaaacgacgccgtaattaactttcccggtaatattaattcgtatccttcactccctccttcgcccgccgcggcggatatacgaaaagctgctgacaccgccgccgccctgatgaagattgaatccggagaaaccacctcgggaactcaaccaggtacggatgatcatcggtcattggggaatgtgcatatgatggaaactagggatcatgaatacattgatgaagaagcattatttgatatgcctaatttgctagttgacatggcggaggcaatgatggttagccctccaagaatgagctcaccgcggtctgatgattcaccagaacattctgatgcagaaaatc

SEQ ID NO: 11210 - DNA, 582 bp, Lycopersicon esculentum
  Predicted polypeptide sequence is orthologous to G913, G976, G1753, G2514
aaaataaaagctacctaagtcagtctcatttgtatggctgcttatcattttaatgacaattctccttcattagaaaatctttcacccactgggggaggaagtagcactaggcatcccaatttcagaggaattcgacagaggaatgggaaatgggtctccgaaattcgcgagcctcgaaagaccacacgtatatggttaggtacttttcccattcctgaaatggcagctgtcgcttacgatgttgcagctttggcattaaaaggtcctgatgcgcaattaaactttcctgatcgtgcatactcctaccctgtccctgcttctctgtcagccgcagatattcgtactgcggctgctaatgctgctgctgctagagcacctcctttgtcagaaatcaatacagcagcaggaggaggacaagggcaagagtttgtggacgaagaggaaatatttggaatgccgaaattgcttgatgatatggcagaggcaatgcttgttagcccgccaaggatgcatcagtacgacgaatcacctgaaaactctgatgcagatagtctctggggttatccatgagtaaaatatatg

SEQ ID NO: 11211 - DNA, 496 bp, Lycopersicon esculentum
  Predicted polypeptide sequence is orthologous to G917
gaagaaaattggtgcattgatcgaagagatttaagcatgtcgttgatgaagggagagccattggtgaggaagatcgcgctgatagctaagtacgcagtttttccgggagctatggctgctgccgtgatctactctcctcccacttatgcttcttattttaagccccaatcttctgcttcaaaataaactggggatacccttttgttttcctcatggggttctttttgacttgccgaatgcttctgttgcagtaggctctatttgtaatagacgtggtatgtagtaataatccaatggcagtttgtttctgtactcgaactatcgacttttgaaaatcggaatagactctagctcctttctatatcatgcgaaactttcttccatcatatgtatccaagttcctcacaaagcttgaaggacaagaaaaaaatgaaagagtaactaattcataaataaatttgaaggtttttgtgtattgaaaaaaaaaaaaaaaaaa

SEQ ID NO: 11212 - DNA, 774 bp, Lycopersicon esculentum
  misc_feature (572)..(572): n is a, c, g, or t
  Predicted polypeptide sequence is orthologous to G917
ggtgactactgagctgcttttttttttttttttttaggtggtaatattatgctttataggaaggggaaaaaattgttttctttactaataggaacaaatttttcacttggtgatatctttaaagaagaaccgcggcctatgaaatctgctgctctggccgctcttctgatatgatatcttcttttttaaaaagagacagaaacatttacacgctacaacattttatcccccaatactaaggcaggtttttcattgaagcttggcatcattttggtttgcttcctttgaatgttgaaagagagaagaactaacgtgttgcttttgttgtagtcgctgacgcctagatgtgtcccttttgcaaatatttaacacccatgttgcttatactattaggctcctataagatcgcatacttcagatgataaccaattttgtcccctagtttttgtttgactaggtggccccttcttttaatagaattcacaaaattttctttttttttatttttgaagagtccattttcctgtttcccccccacagcaaaaagggataaccacccaagttaccttccnccgggtttttttttgagcaaaacttcaacccccttaaactttaaagtcccttttttataatatggattgggtttttaactttccctcgtatttctttgctttaccttttttgacccttttgaaagctaaacaacttgtccttggcttttttcccctttcaacacattagtatttctctttgaaagttttttttttattaatg

SEQ ID NO: 11213 - DNA, 539 bp, Lycopersicon esculentum
  Predicted polypeptide sequence is orthologous to G921
cttcaattcccccccaattttccaattctctataacaaaaattttaatcaattttgaagaacaaaaatcaaagcaaaatggagttcacaagtttagttgatacttctctggatttgaactttagacctcttcgagtttccgatgaattaccagtatgtggaaagcgatataattttttttttgttctcaatataattattttgatgtgatgatttgatttttcgttgcagaaacaggaagttgagagtaatttcataggacttggaagagatctggtacctgtaaaagatgaggcaagtaatttaatagaggaactaaatagagtaaatgctgaaaataagaaattgacggagatgttaacagttatgtgccagaattacaattcattgaggaaccaattgacggaatatatgagcaagcagaatagtagtactagtggagctgatcaggatcagaacagcgatggatcgaagaaaattaaaattgaaaacaacaacaataataataataataatgaaattgtgaaatcgtcagttcaa

SEQ ID NO: 11214 - DNA, 1473 bp, Lycopersicon esculentum
  Predicted polypeptide sequence is orthologous to G921
ctgcaggaattttttaccagcttcaattcccccccaattttccaattctctataacaaaaattttaatcaattttgaagaacaaaaatcaaagcaaaatggagttcacaagtttagttgatacttctctggatttgaactttagacctcttcgagtttccgatgaattaccaaaacaggaagttgagagtaatttcataggacttggaagagatctggtacctgtaaaagatgaggcaagtaatttaatagaggaactaaatagagtaaatgctgaaaataagaaattgacggagatgttaacagttatgtgccagaattacaattcattgaggaaccaattgacggaatatatgagcaagcagaatagtagtactagtggagctgatcaggatcagaacagcgatggatcgaagaaaattaaaattgaaaacaacaacaataataataataataatgaaattgtgaaatcgtcagttcaagtgttgaattcagagagcagctcaagtgatgaagattcatctacaaagaaaccaagagaagaacacattaaaactaagacttcaagagtttatatgagaactgaaccatctgatacttctcttatagtgaaagatggataccagtggaggaaatatggacagaaagtaacaagagacaatccatctccaagagcttatttcaaatgctcttttgctcctacctgtcccgttaagaaaaaggttcaaagaagcgtggaagaccaatcgattctagtagcaacctatgaaggagaacacaaccattctaaagtggataccgcaggccctgttacaacaacttccccgtctagccgatttaacccgaaaaataatacttatgctgctgcggtaatgccaagacaaaccttaactcttgatttggcagaaccaaaaacattacaaaatgatatcaaaaaagttcatagcattacaagtacaagtagtgcaagtggtcagaagcgtaaatcaccaggaactgatcaacaacagcaaaatagaccagagtttcaacatttcttgatagaacaaatggcttcatcattgactaaagatccaagttttcaagcagccttagcagccgccatatcaggaaaattcttgcaaaataatagtaacactaaggataaataattaaaacgaaaattatgttgacacattgaaatgttccagagaaagacaggcagccactaggacatgtcgttataaattgtatatattgtttactatatttgtcttctttttttttgggagaacagtagccagtaggtaggactagtaagtgcacgtgaaaatgggatgggctaattttctatagcagcctatattagttaggtctcagtttgctccttttcagtctcacaagattgagacttttggtggcccttgaaattaaagtgttggatttgctcaaataaatatttttataatttgatttaaaaaaaaaaaaaaaaaaa

SEQ ID NO: 11215 - DNA, 981 bp, Lycopersicon esculentum
  Predicted polypeptide sequence is orthologous to G921
gaatatatttaattactcccactttctttatcccttataaataccaatcttacccaattcctctcttcattccatcaataaaaccaaaaatagaaagagagaaaaaaataataatattaaaattagattatattccatagacacaagtatgggaaacaagtctttttttattgaccttaacacaaatcccttattgcacaacatcaatagaagtccgataccgcgtgagacgttggatgaagaattgagtaggatgagagaggagaacaagaaactagcaacaacactaacaagtttgtatgaaaagtacaattctttgcaaactcatataattgagttgcaacaaaaatactcaaatcatgaagaagacaactctaaattattattatcaagaaaaagaaaggctgaagaagattattgtgtgaataattcatacatcaattttgaagaagcatcaccaaagatgccaagagaaatcacaactaatatttcaactgtttgtgttaaaactaatccctccgatcaaacttcagtggtgaaagatggatataattggagaaaatatggtcaaaaagtgacaagagataatccttctccaagagcctattttaagtgttcatttgcaccatcatgtccagtcaagaaaaaggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctaattttgcagctacagttgctacagccatctcaagattacttttttgaattatatgaagaattaattacctttccaatgacacaaaattactggttggtgagaagataaattggtattg

SEQ ID NO: 11216 - DNA, 1603 bp, Lycopersicon esculentum
  Predicted polypeptide sequence is orthologous to G921
cagattttgaggagataaaaagaaagtgtttgtttctttaacttaaacacacctgaagaaagactacaactttgttgattcttggaattttcatacatcaaagaagatattaattacaatggaatttaccagtttggttgatacttcattggatttgagctttaggcctcgtcaaaaagtcctgaaacaagaagtgcagagtgatttcactggattgagcatagaaagagagaatatggtggtgaaaaatgaggcaggggatttgttagaggaactaaacagagtgagtagtgaaaacaagaagttaacagagatgcttactgtagtttgtgaaaattacaatgctttaagaaaccaaatgatggagtatatgagcacacaaaatggtgtagctgaagatactagtgcagggtcaaggaaaagaaaagctgaaagtatctctaatcctgttaacaacaacaacaataataataacaatatggatgttgttcatggacgttcatcagaaagcagttcgagtgacgaagagtcctgttgcaagaaactcagagaggagcacataaaagcgaaagttacaattgtttctatgaagactgatgcatctgatacctctcttattgtaaaggatggttatcagtggagaaagtatggtcagaaagtaactagagacaacccttgtccaagagcttacttcagatgctcatttgcacctggttgccctgtcaagaaaaaggttcagagaagcattgaagatcagtctattgtggtagcaacatatgaaggagaacataaccatccacaaacctcaaaaccagaatcaggtccaagtactaatacttccacagccagccgattaaatgtgacaactatcgcgggcactactacttcagtcccttgctctaccactctcaattcctcaggaccaaccattactctcgatcttactgcaccgaaaacagtggaaaagcgcgatatgaagatgaatcacagtactactagtcctaccagtggcaatagcattagaacaacaacaacaacatcagcagcaggaggtgaatatcaaaataggccagagtttcaacagttcttgatagaacaaatggctacttccttgaccaaagatccaagtttcaaagcagcacttgctgccgccatatcaggaaaaatcctccaacataataatcagacagggagatggtaaacaaaagtccagcagagcagtcaactactttgtatagacaattgttcaatattttccaacttgactcatatcaaaagttcttaggaggaaaaaggaaacacaaattattgttcaaatgtaaatacaggaaaagttagtaacatttggaccgcaaagttggactcggagatgcacgtgagaatgggatcttactagactcttaagaaattttcaacagcagccatactgggtcccctgcagaatggacttgctctgagttggctagattgagactgaattgtcctagaagcatttaagttgttgaatttgacaactttgtagaatactgagatgagattatgaaatatacaacttactgttctgttcactgactttaaaaaaaaaaaaaaaaaaaaaactcga

SEQ ID NO: 11217 - DNA, 638 bp, Lycopersicon esculentum
  Predicted polypeptide sequence is orthologous to G921
ggaagaagacaactctaaattattattatcaagaaaaagaaaggctgaagaagattattgtgtgaataattcatacatcaattttgaagaagcatcaccaaagatgccaagagaaatcacaactaatatttcaactgtttgtgttaaaactaatccctccgatcaaacttcagtggtgaaagatggatataattggagaaaatatggtcaaaaagtgacaagagataatccttctccaagagcctattttaagtgttcatttgcaccatcatgtccagtcaagaaaaaggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctagttttgcagctacagttgctacagccatctcaggattacttttttgaattatatgatgatttaattacctttcaaatgacacaaaattactgtttgttgagaggattaaattgttattgtattatatattggagt

SEQ ID NO: 11218 - DNA, 434 bp, Lycopersicon esculentum
  Predicted polypeptide sequence is orthologous to G921
ttttcttatagattcaatggatacaaacttgggagacaataatttttctattgaccttaacacaaacctctctttgcacaacaccaacacaagtccgagcgagacgttggatgaagaattgattaggactagagaggagaacaagaagttagtaacaatgctcacaaatttgtgtgagaagtacaattccttgcaaactcacctaattgaattgctgcaaaaatactctagtaataatgaagaggacaattccaatttattattatcaaggaaaagaaaagctgaagaagagtgttgtgttaataattttgaagaagcatcaccaaagaggccaagagaaatcacaaccaatgtttcaactgtttgtattaaaactaatcgatccgatcaaacttcagtggtgaaggatggatataactggagaaaatatggtc

SEQ ID NO: 11219 - DNA, 1401 bp, Lycopersicon esculentum
  Predicted polypeptide sequence is orthologous to G922
ggtggagataccatgcaaaggattgcttcatattttactgaggctttagctgataggattctaaggagttggcctggtctttataaggcgttgcgttcgactaagttatcggttgtctcagaagaaattcttgttaggaagatgtttttcgagatctttcctttcttgaaggtggcgtttgtggtcacaaatcaagctataattgaagctatggaaggtgaaaagatggttcatattgtggatcttaatgctgctgaacccctgcaatggcgtgcgttgcttcaggacttgagcgcgcgtcctgaaggaccgccccatctgcgcattactggggttcatcagcaaaaagaggtgttagatcaaatggcacatgtgcttactcaagaagcagaaaaactggatatcccttttcagttcaatcaagtagttagcagattggaaaatcttgatgttgagaaacttcgcgtgaaaacgggggaggctcttgcgattagttcaattatgcaattgcacacccttctagcccatgataatgacaagaagtcccctttgccttttaagcattcaaatggtgttaacttaaacagggcactagtcaaccaaaatactttaggggaatttcttgaaaaagatatggctaatggttgcagtccaagcaatgacaccgcttcttcatccccgctatgttcaactggttcaacaaagatggatagtttcctcaatgctttgtggggtttatcaccaaaagttatggtggtaacagaacaagatgctaaccataatgggacaactcttatggagaggctatcagagtcgttacatttttatgctgcattatttgattgtcttgaatcgacgctgccaagaacatcattagagagattaaaggtggaaaagatgttattaggtgaagagattagaaacattatagcatgtgaagggatcgaacgaaaggagaggcatgaaaagctcgaaaagtggttccaaagattcgacacatctggttttgggaatgtgcctttgagttattatgctatgttgcaggcaagaaggttgttgcagagttacagttgtgaaggatacaagatcaaagaagataatggttgcgtggtgatatgctggcaggatcgcccacttttctcagtgtcgtcttggcgatgtaggaagtgagactaaacttagttttcattgtaatgttttagatttgtatcttccttttgttgttgtaacataatgtgtagaactccagttggtgaaactgctattgacatgtttgagacattttgtcaacttttttgatctcatgtgataagcttctctctagtgtttagatttccattttgatatggatcaataaagctgatgttctcttaaaaaaaaaaaaaaaaaactcgagactag

SEQ ID NO: 11220 - DNA, 1016 bp, Lycopersicon esculentum
  Predicted polypeptide sequence is orthologous to G926, G2632
gcttccccactcccaccactttttctctatgatacacacaaataaataaataaattaggcctagatatctacttctatatatatatatatgttgatacagatgtatgtataatcttgagaatctttagtgaaaagaacttcctttttagcttaagcatatgtatgtaatagacacaagctaaacttgtgagtttttcttgaaaggggtttttctttaactgctgtcatccccagaaaaagaaagatcataattacttggggcaagtctaataatgcctactattgctaaacatgatggtcggcagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacaccaacggagactcaaaaatatggggcaaccattgcaactcactctggcaactcttctgggttccgggaagtctgatcaggggggaaaggaaggatctacagttca

SEQ ID NO: 11221 - DNA, 1080 bp, Lycopersicon esculentum
  Predicted polypeptide sequence is orthologous to G926, G2632
cctttgcatgcagatgggagttatgggaaggcggatcagaattttcagccagctgctccagccatacctccaagacttgatggaagcctagcacagccccagcagcttgaacttgttggacactctattgcgtgtgctccaaacccatatgttgatccatactatggcgggatgatgacagcttttggccagcctttggttcctcctcatgtacttgatatgcactatgcaaggatgcccttgccacaagaaatggctcaagaaccagtttatgttaatgctaagcagtatcgaaggatcctgcagcgaagacagtcacgtgctaaagcagaacttgaaaagaagcaaataaagggtagaaagccatatcttcacgagtctcgacatcagcatgcactgaggagggtaagggcctcgggtggacgttttgccaaaaagacagatgcttctaagggtactggttctgtgagttcatcgggttctgaacctttgcagttcaatgctgctgatattcaaaagaggaatgaaaatggaaggttggccgagcttcagcagtcttattcaaatggtagcagttatggcaatcaaagtagctttcaagaatccaaggatgagtcccagtttgctaaaagcagggaaggaggtttttttgtcaagtaattggagatacgttcatgtgtaaactagctcttgccctgcaacgagggtagagtatgagcaagaggagtttacagggattgtttcatttcttggcttttcaagataggcggcaattcattcttggctttttactttagtgttaaagggagcaacagaggtgacgagggtatcagtgttgcagcatttgcttggagattacatcttcccttatgtacagagatggatgaacttagaactaggattagaaagtttttcagtaagtttatgtttggccagttactgtagttttagtttaggagaccatgtaaaaaggttgttagttttgcaaaaggatcttttttctttccctaattggtgcattaatttctggaaaaaaaaaacaaaaaaaaaaaaaaaaaaaaactcgagactagttctctc

SEQ ID NO: 11222 - DNA, 673 bp, Lycopersicon esculentum
  Predicted polypeptide sequence is orthologous to G926, G2632
gcatcatccgaggatgcctttgcctcatgaaatggctcaagagcctgtttatgtcaatgccaagcagtatcatggtattttgcggcgaagagagtcacgtgcgaaagcagaacttgaaaagaagctgataaaagtgagaaaggttagtatatgcctcatccactgggctgcttgttgggtgttcttttctcctgttatctaaagaatgcatgatgcacctttttagcagcatatttttgttacatgtgcctggctgttctggagatattccgttgtcccggattggagatgtacccactctttggctgagctcacttttctttaaaaaaaattaaactgttaaagaattttatgttacttaagtaggaggaaatgaaaggtaaaatctgatattacttttatctgtgtagaacacggtcaattcacctttttaaactgatccgtcaaatacaccactcataagtataatttggtgaaaggagttccttatgccaatgtttgggctattaataaccaatatcagtttctccactgctatatttttattgtgaagtcacaggattggctgacatgattttgcacgaatgttatgctgatgatatgcaacatatgctcggtttattctgcttactcatcctcagttgttgatactttctgtcttcctcgtaataca

SEQ ID NO: 11223 - DNA, 270 bp, Lycopersicon esculentum
  Predicted polypeptide sequence is orthologous to G927, G1334
cccccaaacattcattttgcttcctctgttcgtgcagggaatatgggctatccaggtcactttgagctaggctctggtcagtccctgatttatgcaaaacatccttatggagagcaatgcattgggttattttcggcttatgctcctaaactttcgggccgtattatgctaccattgaatccggcttctgatgaaggtccgatattcataaatgccaaacagtatcatgggatactaaggcgtagaaagaccagggctaaggaaatggac

SEQ ID NO: 11224 - DNA, 591 bp, Lycopersicon esculentum
  Predicted polypeptide sequence is orthologous to G927, G1334
gagaaattgtactgacatggctgctactaaatggggtttctctaattgactgtacaatcacacaaagcttaaagttttcatcttggtacaactattacttcactaggaacataattcctttagattttcaagagaaaaggtgtgagttgctcttgtataaccatgaatactactatattttccaaaggaaatgaacgggttgtccagaatcaatctgttggaacattgtgctctgctccttggtggagtaatggttttatgtctcaatctgtggcttatgctgagccttttggacaattgaaatctgcatctgtggagcagcagcctaaggggaatgcaacagagttcactatttcctctggtgattgcaaatcttcggcaaatgggcaaaaacttccgaacattcaggctgcttcctctgttcgggcagctaatatggactatccaggtcactttgagctaggttgtggtcagtccctgatttatgcaaaacatccttatggagagcaatgcattgggttattttcggcttatgctcctcaactttcgggccgcattatgctaccattgaatttggcttctgatgaaggt

SEQ ID NO: 11225 - DNA, 630 bp, Lycopersicon esculentum
  Predicted polypeptide sequence is orthologous to G928
ttttttttttttttttttttttttaacctcagaagtttatgtactaagcatgagaatgattcaacaagttcattttgttgcacaaagcctgagttaaacatattaacagtgatacaatacatagcacagaaatgaaaaccacaaatgcaaatgacactaacaagtacagacttagaagtgcaagatgatacacacacgctcgaccaagaaaaggagaattcttttacagccttaatctccactgtttctcattaagaccaatatatttttctcttttccttgcccttcttgatcacgtgcggcaccaacctgcgctctttctcatttaactatgaaacatataccataacacaactaaagctttaggaaaagtgttcatgatttcaattcaggaaaaggaagagtaacatagccaaggatgaactgccgattatccatttgtgtgcaccaataagaatgcatttgtaatgcagcctgtattggcaccgccaccatggataacacaagtgtgctgtcaggttccaacatgcaggaagtcttcagcttcctgaatgtgaaaagggaagccagagactctgaactctggttgctggaacatgttgtcaccactgaagatacttgtcacatcag

SEQ ID NO: 11226 - DNA, 428 bp, Lycopersicon esculentum
  Predicted polypeptide sequence is orthologous to G928
ttttcaagatcaggattcctcgtctactcaatcaacgagtcaatcatggcctgaagctcctaatgaacgagaaacaaaaatccatggtaaaaacaatatttctttgcgagcaggtgaggatattcactattgttctgcatctagttttatatatacaacactttaagttatgtcagagaagttttgaaacaaagtaatcgtgttcatgattagcttgtttataactttttaccatacatcaattaggagaagctaattgataggagtgttgaagagaaatttgcaaattgattgtctagtacgtttatcaatttaagtacttccatgttgttcctccaaatgtgatcggctacaaccttttaaatgtggtggattgtaggtacttgttagcctgctaaggaggcaccacagaaatgaacttgaaatgt

SEQ ID NO: 11227 - DNA, 584 bp, Lycopersicon esculentum
  Predicted polypeptide sequence is orthologous to G928, G931
cgcagccaaatattgtggtgttctgtatacagagagactggacttggacttcttttaccaccaaagattcagaggtgcttgaattctgagtttggttcaaccataaagtttcactaaatcaacaagatttacagatgcaacaaatgtctacatttcctggtcctcagaataccaaggaactgaatcaccattttcaagatcaggattcctcgtctactcaatcaacgagtcaatcatgtcctgaagctcctaatgaacgagaaacaaaaatccatggtaaaaacaatatttctttgcgagcaggcagtgttagaagtagtgggaagtccgatgattcccaaagtgtgtcaagtcaggagcatggttggactttcgatacgtatcagacaaattttgctgttgttccttttcctcacccggatccttactatcacgatctagttgctgcctatggaaatccaaccttggttcaatcccaaatgttaggcacggttgctcctcgggtgccacttccacttgaccttaagcaagatgagcctatatttgtcaatgctaaacaatatcaagctatcctcaggcgtaga

SEQ ID NO: 11228 - DNA, 1174 bp, Lycopersicon esculentum
  Predicted polypeptide sequence is orthologous to G929, G2344
gaaaataaaggatgacaaaacgtaatagtaacagttacaaacacgtagtaaagctctctctagagaaggaaattcaacagagaacaccaaaattaaagctgcttattggttttcgtatacacgaagctcttcccgaaaggtttgttactttggagattctgtggcaagcagcattatgacgtcctcgcttcattatcattcagatggtagtgagaatgaacagtcagaaaatcaatcagaagcccacagcgagtcttcatcgcctgcagctggaatgtctgtccctggcactgtaacaacaaatatgcactatgttatgcccaatcaacttgggaatggaaatcctatgttgcaggctcaaacagcttatccatatccagacccatactataggagcatctttgcaccgtatgatgcacagccttatcctccacaaccttatccagcacaaccaatggttcacgttcagctaatgggaattcaacaagcgggtgttcctttgccatcagatgcgatagacgaacctgtttttgttaatgcaaaacagtatcatggcatcttgaggcgtcgacaatctcgcgcgaaagctgagtcagaaaagaaacttctgaaagctaggaagccttacttgcatgaatcacgccatttgcatgcattgaaaagagctagaggatgtggaggtcgtttcctgacagcaaaggaaactgataatcagcagaaacaggatgaatctggtgataaatctcaagtcaacattaatctcgagtctggaaaagacaaggtcgcttcttcagagaatgcctcttgatctatgcaatatcaaggactttgtggaccatagtatgttgttactgtttgtagaaacagcagtgcttttgtttaaatagaattgtggtagctgggcaaaatcagggtaattgtggtgttctgtatgtttatctgagtgtagatagatcggaataggcctactcgtttgagagctacaaagtggccgctgggcgtatgttctctaaataccatctctctgagcttgtttgtagacattctttcttgtcctttcgtaattgccttgtgattccttcaaaatgttgttctggtaagtgtatggaatatcgagtcagaaatttgagtaataacgtttggcccttaaaaaaaaaaaaaaaaaaaaaaacaa

SEQ ID NO: 11229 - DNA, 761 bp, Lycopersicon esculentum
  Predicted polypeptide sequence is orthologous to G929, G2344
gcctgccagtagtcatatgcttgtctcaaagattaagccatgcatgtgtaagtatgaacaaattcagactgtgaaactgcgaatggctcattaaatcagttatagtttgtttgatggtatctactactcggataaccgtagtaattctagagctaatacgtgcaacaaaccccgacttctggaagggatgcatttattagataaaaggtcgacgcgggctctgcccgttgctgcgatgattcatgataactcgacggatcgcacggccatcgtgccggcgacgcatcattcaaatttctgccctatcaactttcgatggtaggatagtggcctaccatggtggtgacgggtgacggagaattagggttcgattccggagagggagcctgagaaacggctaccattgaatttggcttctgatgaaggtccgatattcgtaaatgccaagcagtatcatgggatactaaggcgtcgaaagaccagggctaaggaaatggagaaaaaagctcttaaaccacgcaagccgtacttgcacctctctcgccatctccatgctttgcgccgacctaggggctgtggtgggtcgtttcttgaacacaaggaatatgaatggaactatgaaggctggaaaaaccaccatatgttcaagacgggcgatgttcaaaacttttaccccaccggatcccagaattctgaagtgctgcagtctgatagcagcaatttgagctcaccaaaagaaacatctggcagtaggttcttcg

SEQ ID NO: 11230 - DNA, 174 bp, Lycopersicon esculentum
  Predicted polypeptide sequence is orthologous to G937
cttatttggacctgttgttctcttattttgatcatgtggctttcttctatttaggccttaaacatgcagcctgcttttcaaaatatgtgcttttacttgataatgtggaagttgttcatccttgatttactcttcaagggaaggcggatggcctgtgggtcagcatagaacata

SEQ ID NO: 11231 - DNA, 2473 bp, Lycopersicon esculentum
  Predicted polypeptide sequence is orthologous to G938
aaaaggctcaattattattctctaagctgagttccagttgaaccacagttttgcaacgacataaaaaaagtgatctttttgaggctcatgtaatttgatcaatttcaattagattctgatctgaatattggattttgggtattagctgcttaatcctgtggaagttgcaagtagcttcacctttttcatcctgtggaagatgatgatgtttgaggaaatggggttctgtggggatcttgatttcttccctgctccgctgaaggaagtggaagtgtctgctccgcagagtcagactgagccggattctgtggtggatgatgattatagtgatgaggaggagattgaagtggatgagctggagaggaggatgtggagggacaagatgaagttgaaaaggctgaaagaaatgagtaaaagtaaggaaggtgttgatcctgcaaaacaacgtcagtcgcaggagcaggcgaggaggaagaagatgtcaagggcacaggatgggatcttgaagtacatgctgaaaatgatggaagtatgtaaagctcaggggtttgtttatgggatcattccggaaaaaggcaagccagttagtggggcatctgataatcttagggagtggtggaaggataaggtgaggttcgatcgaaatggtcctgcagcaatagccaaataccaagctgatcatgccatccctggcatgaacgaggggtctaatccagttggtcctacccctcacaccttgcaggagctgcaagataccacccttggttcgttattatcagctttgatgcagcactgtgatcctcctcagagaagatttccattggagaaaggtgttccaccaccatggtggcccacaggaaaggaggattggtggcctcaattgggtttgcagaaggaccaaggttctctaccttacaagaagcctcatgatctgaagaaggcgtggaaggttggtgtcctaacagcggtgatcaagcacatgttccctgatattgctaaaatccgcaagctggtaaggcagtcaaagtgcttacaggacaagatgacagccaaggaaagtgcaacttggcttgccatcatcagtcaggaggaagctttggctcgagaactctatcccgatcgctgtccacctttgtcctcagctggtgttagtggaaatttcatgttgaacgacagcagtgagtatgatgttgaaggtgctcaagatgagcctaactttgatgttcatgagcaaaaaccaaaccatctcaatctgttgaacatcagtgctgagagattcaaggagacgatgcctcttcagcaacaatctcatccaaacaaggatgaactggtcacaaacttagacttcagtctgaagaggaagcaagctaatgaacctactgtgatgatggatcaaaagatatacacatgcgagtttcttcaatgccctcacaatgaacttcgccatggttttcaggacagatcttccagagacaatcatcaatttgcttgcctttaccgaagttctacctgttttggagtttcaaactttcagattaatgaagtcaagccagttgtgttccctcaacaatatgtccagccaaagtcatctgctctgcctgttaatcaaggtccaccttcctttgatctatctggtataggagttcctgaagatgggcaaaggatgattaatgagcttatgtcaatctatgatagtgatgtacaaggaagcaaaaggcaaaatagggggaacattgcattgaccaaagagcagcctcatcaacaacctcgtgtccaccaggacaactacctgctcagccaagggataatggacggaaatatcttcaaaaacactaatatttccacaactcagtctatgctcccacaagtcgatccatttgatcaatccaaggctttcaatgcaggctccaacgacaacttccatttcatgtttgggtctccattcaacatacaatctaccaattataacggaaatctacctagcattggatacgataccacaccaaaacaagatgctcctatttggtactagccagccagaagtctgttgacatgttgtatatcaagtagtcagttttggcttcatagatatagcgatttctcatgggtaaaaagatcccatgtactcgtctgcttttttcattctggtggatttttcatcgcctatagtcctcttagttatggtgttttcagttaccatgtgttgtaaaggttgaagaactaggcatggtgtaaacaaacacccctcaaatacttgccaatgcttctcataggacatgtagatataaataagttacttgtttcatcatggccagttttatcagtctctttaaaactgttgaatttataggctatggttaaggtctttactccttgtttaatacttcttctcaagattgtttgggatatcaatgttgttattgttgccatatcttatatgatgtttttctttcaaaaaaaaaaaaaaaaaaaa

SEQ ID NO: 11232 - DNA, 1102 bp, Lycopersicon esculentum
  Predicted polypeptide sequence is orthologous to G938
ttttttttttttttttttttaaaacataattgcataaagataattattgtgtttagcacttacaaccatggaaacatcaactacatcacaaagaaactacaatacctgtatatataaaggacagagagttgatcactttttttttttttttcaatttaaaacataattgcataaagataattattgtgtttagcacttacaaccatggaaacatcaactacatcacaaagaaactacaatacctgtatatataaaggacagagagttgatcacttatctaaacatatacaacctatcaagccttcatataggaaataagacagtttaatactagtactagttcagaggtaccatgtagatatatcctgctttgtcagctgttccacggcgtagtcgcttcctcccaagttgaacggggaaccgaatctgtaatcagttatatcatttatgtttccaccgaagggggcgtcaaaggacattttgcattgatcatattgaaactctgttgaacgataaacaggcatgctggtttcttgagctgaggtctccatatgtcctaggttgatgttgccatccatgggaagttcaactgtttgttgctgaggcaggctttggtttactagaatctcagaaattccggaacagatgctaccattttgctgaaagttgttgtcgtatgatgttatgaggtcagaaatgatcctctgatcatcttcagggagtccaagccccgaggcactcatcgaagaggaagcagtgactgacgagaccgctggcttagaagttgcagtttgtgcaggaaaaactgtgttgtgctcatagttgatctgatacttaggtgtagtaagtgtttgagcagaattgaaccggaatggacaactcatttggtggttgtttcttgaagtcctgtcaaggaatccagcttgataattgctgtatgggcagtgaaggtactcacaagtatatatcttttgatcaacagactcctcaaaacatggttccttcctcttctggataaaatcggaagttaaatcaataatttctcctttcactggagctaaacctggcatcaaaaccctatctttaggtaacataattccag

SEQ ID NO: 11233 - DNA, 878 bp, Lycopersicon esculentum
  Predicted polypeptide sequence is orthologous to G938
aatgtattccctttgttctctgttgtcttctctctctctaccttctatattctgaagggtcaattcttgaacaaaattttggaagcaaaaagaagaaacccctttgaggttgctggtttttttcaaaccaaaatttggctgccaagatgatgatgtttgaagacattgggttttgtgctgatcttgatttcttccctgctccgctgaaggaggcggaaacagtagctgctgttccaccaattgtgccggagccgatgatggatgatgatgatagtgatgaggagatcgatgtggatgagctggagaagaggatgtggagggataagatgaagctgaaaaggctgaaagaaatgagcaagggcaaggaaggtgttgatgctgtcaaacaacgccagtctcaggagcaagctaggaggaagaagatgtccagggctcaagatgggatcttgaagtacatgttgaagatgatggaagtctgtaaggctcagggttttgtttatggaattatcccggagaaaggcaaaccggtgactggggcatcggataatctcagggagtggtggaaggataaagtgaggtttgatcgcaatggacctgctgcgatagcaaagtaccaagctgacaatgccatccctggcaagaacgagggtgctaatccgattggtccaacccctcataccttgcaggagcttcaagataccacccttggttctctactgtcagctttaatgcaacattgtgatcctcctcagaggcgatttccattggaaaaaggtgtatcacctccatggtggccaaatggacaggaggattggtggcctcagttgggactgccaaatgatcaacgtcctcacaccttacaagaagcctcatgatct

SEQ ID NO: 11234 - DNA, 1160 bp, Lycopersicon esculentum
  Predicted polypeptide sequence is orthologous to G938
cgagggatgaccctatctttgatgttctggatctgcaaccaaaccatctcagtttgctgaatgtcaatgttgagatgttcaaggagaagctgcctctgctacagcagtctcagccaatgaagggtgacatttttgccaacttagatttcactcgcaagaggaagccggctgatgacttgactttcctgatggatccgaagacatatacttgcgagtgtcttcattgccctcatagtgagcttcgcaatggttttccagacagatccagcagagacaatcatcagctaacttgcctcttcaggaatacttctcaatttgtagttccaaactttcacatggaggaggtcaagccagttgtcttccctcaacagtatgctgagccaaagcgggcttcgcttccggtcaacccagctccaccctcctttgatacatctggacttggggttcctgcagatgggcagagggtgatcaatgagcttatgtcattctatgaaagtaatgtgcaaggaaacaaaagttcaatggcggggaactctgtgatgtccaaagagcagcctcttcaacaacctagcattcaacagaacaattaccttcaaagccaagggaatgtgttggagggaagcatctttggggacaccaacatttctgctaacaactccatgtttgtgcagggtgatcggtttgatcagagcaaggttttaacttcaccattcaatgcaagctctactgatgatttcaatttcatgtttggatctccattcaacatgcaatccactgatctctctgaatgtctttctgggatttcacatgatgacgtgacgaagcaagatgcctcggtttggtactagcaatgcgattactcaaatgaacatcaagcagtggatatcacaatatacctttaatcaggtggatttcagtttgcctatagttctcagtttggtttttctgttaccatgtagttgtagaggttggaggatcgtgcatgacgttattacaagggagtagtaagagatgtcatgctgctggttagaaggaacttatagatgtttctaaataaggtttagcagtcagtttattttcatatatgtctataactctatataggttttagctttatcccatagtcaatcgttggtttcggagataaaaaaaaaaaaaaa

SEQ ID NO: 11235 - DNA, 913 bp, Lycopersicon esculentum
  Predicted polypeptide sequence is orthologous to G938
gcttcctctcttcttcttactttccaatacacaacaaaagtgaaaacatcacttcaatacacctaacattcttctcaaaccccttctctttctctcttttttctttttttttttggttcaaaatcaaagtagtatagccatagataacagcttcaacaagctgttttcaagaaaatcataatttggtaaatggggatatttgaagatatggggttctctggaaattttgagtttctatctgattctatgggatgtggagctcaagaagttgagcataagccggttgggttggaggaggatgattatagtgatgaggagatggatgtggaagagctagagaggaggatgtggagggatcgaatgcttttgaggcgtctcaaagagaaaaacaagaataaagtggtgggggatggtgcgaagcagcgtcagtcgcaggagcaggctcgtagaaagaagatgtcgcgtgcacaagatggtatactgaagtacatgctgaaaatgatggaggtttgtaatgctcagggttttgtttatggaattatccctgagaaagggaagcctgtgactggtgcttcggacaatcttcgtgcttggtggaaggaaaaggtcagatttgatcgaaatggccctgctgctattgctaagtatcaggctgataatcagattcctgggagagttgaggaatcgagtgtgatagtttccactccccacactttacaggagctgcaggatacaactctaggatcccttttgtctgctttgatgcagcactgtgatcctccacagaggcggtttccgttggagaagggggtatctccaccctggtggccctctggtaaagaggaatggtggggtcagttgggtctgccaaatgatcaagttcaacctccatacaagaagcctcatgatctga

SEQ ID NO: 11236 - DNA, 575 bp, Lycopersicon esculentum
  Predicted polypeptide sequence is orthologous to G938
tgaagatgggcaaaggatgattgatgaccttatgtcattctatgattgtaatatacaaggaaacaaaagccaaaatacgggaaatgttgcagtgaccaaagagcagcagcctcatcaacaacctcgtgttgaccaggtcaattacctacacagtcgagggatgatggaggggaatatcttcaaagacattaatgtttccgcaagtcagtctatgcagccacaaggcaatcttgttgatcaatgcaagatcctaaattcaagtgacaatttgcaattcatgtttgggcctccattcaacttacagtccaccaattaccctggaagtctgcctggcattggatgtgacaccacaccgaagcaagatattccaatttggtactagccatgatattggtgaaacgtatatagtcagtcggggcttcatagatatagcttgttccccgagattggcacaccccattataattggtcttcattatcaggtggatttttaatcgcttacaactctcttagtcaagatatttcctgttaccatatgttttagagggttgaaagctaggcggcatggtgtaatt

SEQ ID NO: 11237 - DNA, 474 bp, Lycopersicon esculentum
  Predicted polypeptide sequence is orthologous to G938
gaacgtcccccaccctttcttctctatttcttacttatctttcttctctgtttccatatagtctcttaaaaaatggtcaaattattattctcctaagtagagaaaaagagtttaatcaaattttttcaaatatcataaattcaggattaaatatcgcgtaatttggattgatgagtgttgagaaaggacaggataatctgtgaaaaaattgggtgttagctgctagttctgtttagatttcttgacgtttggtgattagttttttggaggagtttgttcttgtgaagatgatgatgtttgaggaaatggggttctgcggggatcttgatttctttcctgctccgcttaaggaagtggaggtggctgctccacagactgaggcagagcaggtggcggatgatgattatagtgatgaggatattgatgtggatgagctatacaagagagtgtggacggacaagatgaagctgaaaa

SEQ ID NO: 11238 - DNA, 575 bp, Lycopersicon esculentum
  Predicted polypeptide sequence is orthologous to G938
caaagtgcttgcaggataagatgacagcaaaagaaagtgcgacttggcttgctatcatcaatcaggaggaagctttggctcgagaactataccctgatcgttgtccacctttatcgtcagctggtggtagtggaactttcactgtgaatgacagcagtgagtatgatgttgatggtgctcaagatgagtgtaactttgatgttcaagagcaaaaaccacaccatctcaacttgttgaatgtcactgttgagagattcaacgagaggcagcctctgcaacaacagtctcatcctatcaaggatgaaataatcaccagcttagatttcacccgcaagaggaagcaatccaatgaacagactgttaccatggctcagatttatacatgtgagattcttcaatgtccttacagtgaacttcgccacggttttcatgacagatctgcgagagacaatcatcaactggtctgcccttatagaaacacttctcaatttggagtttcaaagtttcccatgaacgaagtcaagccagttgtccttcctcaacaatatatcccgtcaacttcagttgctctgcct

SEQ ID NO: 11239 - DNA, 495 bp, Lycopersicon esculentum
  Predicted polypeptide sequence is orthologous to G938
ggtcaattattattctctaagctgagttccagttgaaacacagttttgcaacaacaacaaaaaaaagtgatctttttcaggctcatgtaatctgatcaacttcaattagattctgatctgaatattggattttgggtattagctgcttaatcctgcttggatcctgtggaagttgcaagtaacttcacttttttcatcttgttaagatgatgatgtttgaggaaatggggttctgtggggatcttggtttctttcctgctccgctgaaggaagtggaagtggaagtggctgctccacagagtcagactgagccggattctgtggttgatgatgattatagtgatgaggaggagattgatgtggatgagctggagaggaggatgtggagggacaagatgaagttgaaaaggctgaaagaaatgagtaaaagtaaggaaggtgtcgatcctgcaaaacaacgtcagtcgcaggagcaggcgaggaggaagaagatgt

SEQ ID NO: 11240 - DNA, 581 bp, Lycopersicon esculentum
  Predicted polypeptide sequence is orthologous to G938
ctgttataaagcatatgtcacctgatattgcaaagatcaggagactagtgcggcagtcaaagtgtttacaggataagatgacggcaaaggagagctcaatatggttagctgttttaagcagagaggaatccactatccggctacaaaccaatgacaatgggtcatctagcataagtgaggcacctattagaggtcatggtgacaaaaagaaatcttctgttgatagtgacagtgattatgatgttgatgatgttaatgtctctgtttcatctagagatgagaggagaaatgaaccattggatgctcgtcctctaactgatgttcctcaatctcaccaaagtaaggagcagggagatggacaacgtcgaagaagaaaacgtgctaggtcaaactttcaacagactcaactgtctcccagtgagcagcaaccttatgacgtggctagaaactccttacctgatatgaacaatgccaatgcgcagttttctgggtacattgcaaatgaaagccaaccagagaacaatatgatggtaccgaggaagtctgtggagagaaactctgagggtcaatctgacttacca

SEQ ID NO: 11241 - DNA, 569 bp, Lycopersicon esculentum
  Predicted polypeptide sequence is orthologous to G938
gatttgctttaccattttggaactacgatagtcaagttggtatgcaattaccatctttgtacaatgatgttaattcaccattgtacgatcctaatcgtaaccaaaaccattttcctcctaatgttgtcgatttagggttcactacgatagacctcgatgcatccgatcaacaaaaaatcaataataatcttactatgatgtatcgacaaatgctcacgaatgcaccttgtcctcaactattttttggaaaccctatacgcggcggggagcagccgattcgtggtatgggtacgattgagaatgtaccacataactctgtccatcgatgggttggtaacccaaataataagtttagggagaatatgggaactttttattcagctgctagagatcccattttctatgctcatcatgctaatgttgataggatgtggacaatatggaagactttaggaggcaaccgacgtgactacaatgatagggattggctagatagtgccttcttattctatgatgaaaatcgtacccttgtgaaagtaactgtccaagattgcataaacaatgagaaa

SEQ ID NO: 11242 - DNA, 593 bp, Lycopersicon esculentum
  Predicted polypeptide sequence is orthologous to G939
gctgcagcagctttagcttttgaatcacttggttcatggttgtggacatcaagtcaaatctttgactctctttagggtcttttggtataatgtataaggaaaatgatcagatatataatttagtataacttaatccaatatttggtcatgatttgaattatgtacaacttaatccaccaatggtgtattgttttataccaccaacagcattgaataactaatccttctataatttatacatggataaaatagcaaaaggacaaactaactttaaattttccctgaagtcaatgaaggtcaagcatttaagggtataactgcaaagtcattactttttagcttagaaagtaaataaatattttaaaattacatcttgtaatccaattttagtgcaatgaactaaacacccaacgagaaataatcttggtatttcttatccctgtataactactaaaattcttacgtaacttagccctgcatcataatccttgtgtaagttgtcttcaaaccaaacaccctttagaacatttgtattattgttgtatcatcataaacataatctgcttctcatatcaaataatgggacttaatga

SEQ ID NO: 11243 - DNA, 467 bp, Lycopersicon esculentum
  Predicted polypeptide sequence is orthologous to G957, G961, G2535
cctcgtgccgaatcggcacgaggtgtaaatgtacaatctcaagtcccaccagggtttagatttcatccaacagaagaggagctattacaatattacttgaagaagaaagttgcaaatgagaagattgatttggatgtaatccaagaagttgatctcaataagcttgagccttgggatattcaagacaagtgtaaaattggatcaactccacaaaatgattggtatttcttcagtcacaaagacaaaaagtatccaacgggtacaaggacaaatagagcaacggctgctggattttggaaagctacggggcgtgacaaagtgatctattcaaattgtccaaggattggtatgaggaagacacttgttttttacaaaggtagagcacctcatggtcaaaaatctgattggattatgcatgagtatagatttgatgatcatattgccgaagaagaaggttgggttatttg

SEQ ID NO: 11244 - DNA, 555 bp, Lycopersicon esculentum
  Predicted polypeptide sequence is orthologous to G962
atggcaattggcccttttattactacaaacatgagtcaatcccaacaacaacatcaacaacaacaagatgatgatgataacaacaacatcaacaacactattaaaggagatgataatgatgatgacgatgatcatgaacacgacatggtcatgcctggttttcgatttcatcctactgaggaagagcttgtagagttttatcttcgccgtaaggttgaaggaaaacgttttaatgtggaactcatcacttttcttgatctttatcgttatgacccttgggagcttcctgctttggcagcaattggagagaaggagtggtatttctatgtccaagagatagaaagtatagaaatggagataggccaaatagggttacaacatcagggtattggaaggctactggagctgatagaatgattagaacggagaattcgcggtccattggcctgaaaaagacattggttttctactcagggaaggctcctaaaggcataagacgtagttggattatgaatgaatatcgtcttccacatcatgaaactgaacgcctacaaa

SEQ ID NO: 11245 - DNA, 618 bp, Lycopersicon esculentum
  Predicted polypeptide sequence is orthologous to G975, G1387, G2583
gcctaaccctcatttcatcattcatttctgtgtctacctgaacttctgcaactttttttttttctttttttaaatttgtccccctcttaacaacatggtacaatcaaagaagttcaaaggtgtcagacaacgccagtggggctcttgggtttctgaaattcgccatccgctgctgaagaaaaggatatggttaggaacatttgagacagcagaggaagcagcaagagcgtatgatgaagcagctatcttgatgagtggacaagttgcgaaaacaaacttcccaattgtgaaggagagtactgataacaacaatgacactactaaattccctttaacttcttcatcaacactgtctagtagcatgctgaatgcaaagctgaggaaatgttgcaaggatccagcaccttccatgacctgtctgaggctcgataacgacaactgtcatattggagtgtggcaaaaaacatcagggaaacattcaagttctaattggataacaaaaatctaacttggaaagaaagaggagaagcctcatgatcatcaggatatgaatgctgaacttggcattactaaaccattggacgaagaaaacagaattgctatgcaaatggtggaaga

SEQ ID NO: 11246 - DNA, 451 bp, Lycopersicon esculentum
  Predicted polypeptide sequence is orthologous to G975, G1387, G2583
ggacaattgcttgcccacattcaagtatggtacaggcaaagaagttcagaggtgtcaggcaacgccattggggttcttgggtcgctgaaattcgtcatcctttactgaagaggagagtgtggctaggtacgtttgaaactgcagaagaagctgcccgagcgtatgatgaggctgctgttttaatgagcggacgtaacgccaaaacaaatttcgcagtgcaagcaatggatgaaaataaaaaagacaattataaatctaataattcgacattatcaggatcatcatcatcactctctgctatacttagcgccaaacttcggaagagctgtaaatcgccatcgccgtctctcacttgtctcaggcttgatacagagagttccaacattggggtttggcagaaacgggccggagcccggcctgattctagctgggtcatgacggttgaatttgg

SEQ ID NO: 11247 - DNA, 975 bp, Lycopersicon esculentum
  misc_feature (807)..(807): n is a, c, g, or t
  Predicted polypeptide sequence is orthologous to G977
cctcaaccaatttcattttctatctcattcaggcatttcaacaaacacttttttgcgaacacacacacttcaattaactacatttgtaagattgtcaatattatggctagggcacaacaaagatatcgaggagttcgacagagacattggggttcttgggtctccgaaattcgccatccattgttgaagacaagaatttggttaggcacttttgagacagcagaagatgcagcaagagcatatgatgaagcagcaaggctaatgtgtggtccaagagctagaactaatttcccatacaacccaaacatgccacaaacatcttcctctaagctactctcaactacattaacagccaagttacacaaatgctacatggcttcacttcaaatgaccaaaacctcaccacaaggacaaaaattagcaaaaaatgcaaccaatgttcaagaaagtgttattaattcctataaaatgaaacaacaaatgttggtaccaaagccatcagtactattgactcatcatgatcatcatgaggaagctaaagtagtcaacttgggagtgggagtaattaggaaagttgaagatcaagtacttgagggtataccacaatttgtcaagccacttgaagatgatcacattgaacaaatgattgaagaattgttggattatggatccattgagctttgctctaatgttgttccttctcaccaaatccagtgagcttgctcgtaaatcgactattgcctaatacttgctacatttgatcagtgcaggtattagataactcttctactgatgttctctctcagnaattgtctctttttgggtcctacattgttctgtactagaaagatactcattttgctaatttaaccccatttgtatagccgttcccgatttgtttgggactgaagcttagttattgttgtattaagtcttttaagtagtctccctctgttttaaatctatgtatcgtta

SEQ ID NO: 11248 - DNA, 424 bp, Lycopersicon esculentum
  Predicted polypeptide sequence is orthologous to G977
ggttgtccgcttgggttccctgtctttcaaaagccactcttagtcaactaggatagagctaaaccaaaacctcatattaagcatgacacaattgttttgtatgttatgtgatatacgtgttgtatatatgttgtataatagttcattattttaaaatcacttttgttaacctagttttaagaatattcataattcaagtccaattttttgaagttaaatagttggaactacgtttgacctgattcctacttcaacgggatacgtaggcgccattaaggctcggtcatcttccccgtaagttttccaaattttaagaacagaaactggggcaaaattttggggaagtctccaaaattttataatggagatagttgttacaatattaaataccggaggtttgtcgaagctgaaacaggggcaaaaa

SEQ ID NO: 11249 - DNA, 740 bp, Lycopersicon esculentum
  Predicted polypeptide sequence is orthologous to G979
tacggaacagtaaagaaatataagaacatgactgtcgacagcttgaaaaagaaaaaaggagttcaaccgttccctaaatatggagtcaatgactttgaagggccattattgagtcaagcaaccgaaaccgagcaaagaagtcacatctgagctaattataactaagtcatccgcttatattataccaagcaagacccttttgcagtttactcgctagtgtcatcactcactggacgagcctttctatttgtaccagttgagtacgtctgcccaagacccagacaaaaagctttgtaccttaccacggaaactccgctatcaatgtcgtctggcccagttgccccaactggacttaaccatttgacttctgacaataagaggaagagaagccctcttgagtaagggctcttgagttagagttcgaactcaccttctttcttctatttcatagcctcttccgtattctcaatcggaatagccaggccaacaatctttttcttttattaggaaccgaatccgaaagagacgcagcagcaagaggtcctgaatcaaatagagcaagcaagtccgtattctgttcggcttacggcttcattcccagagtaaggagaaagaagacacagcgccggggaatagctccgagagggacttctctgagtaaagagataagtaagggtaagagtcattccaattgagtaggtgaagagtctctttcgagcgagatcctttaccacgcccta

SEQ ID NO: 11250 - DNA, 572 bp, Lycopersicon esculentum
  Predicted polypeptide sequence is orthologous to G979, G2106, G2131
atttacttgactatatttgggcaaactttcaaataatatatatggcgaaaacctcaaaattgagtaaacaaaacacttgtttaagcaacaaggatactgataatagcatttctaaagtgaagacgaagcgaaaacccagagactcgacgcctcaacgacgtagttcaatatacagaggtgtcaccaggcacagatggacgggtcgatatgaagctcatttatgggataaaaattgttggaacgaatcgcagactaaaaaaggaagacaagtatacttgggggcctacaatgaggaagaagcagctgcacatgcatatgacttggcagcattaaagtattggggtcaacacacaatccttaatttctctgtgtctacttatgaaaaagagataaaagaaatggaaactcaatcaagagaagaatatattggttctttgagaaggagaagtagtggattttcaagaggagtctcgagatatagaggagtagcacgacaccatcacaatggacgatgggaggctcgcattggcagggtgtttggaaataagtatctctaccttggaacatatgct

SEQ ID NO: 11251 - DNA, 1831 bp, Lycopersicon esculentum
  misc_feature (1698)..(1698): n is a, c, g, or t
  Predicted polypeptide sequence is orthologous to G987
accacttcaacagctatatatcaggtaccattctcagttcctattttttgtttcagttcttcttcttcttcttcttcttttggttagaatttctgggattgctttgatttcttcaatcaaacatctcagaatttagtagctcaaaccaatttccatggaagccctttttcaagaacagctttttccttgtgctgattcttttatttttaggcacccttccattccaatggatccaagaaaagaagttatacaaaatggactcaataatcatcctagttttgatcaagattacttttcaaatcatgttgttggagtgggagattcttctcctcctcctcaagaggaaggggaaaaggactattctgatgcaatgtacaaattcttaagtcagatgcttatggaagaagatgatttggagaataagccatgtatgtttcatgactgcatggctctccaagctaaagagagatacttatctgatgtacttcatggatccgaaaacaactattccccacaatctgtcattatcaatccacacgattcctctagttttctcagcaactattcacctgattctattgagtcacctcaatgggatcttaatttcgaatcccctgcttccatgtccactttatctaatcatgactctttcttcacttccttcggcaatggccattttgaagaaggagctgtcaatgtgttacaaagtggcagcagcagcaattcaccaactggtctgagggaaaagaaaaatcgacatcgaggagatgttgctgcagaccagcagaggagtaacaaacagatggctacatttgttcatgatgaatctgaaccattggaaatgtatgacaatgtgttgctttgtttaaacaatccatatgtggaacagcatagtgctactagtatcacttcctactcgccgcctaatgaagccaaaaaaacaagcaaagttggaaggccgagaggtggtaggaagcatagcagcattgtcaagaaggaaatggtggatttgagggctttgttgactcagtgtgcgcaggccatggcaaactatgatagcagaacagctaatgagctgctgatgcggataagagaacactctacacctcatggcgatgggacggagaggttggctcattatcttgccaatgcccttgaagcacgcctgtccggcacgggaacagctttgtatacagcctacgcacccagtaggatatcagctgctaacattttgaaagcttacaaggcatttatcagagcatgtccattcaagttgctgtcaaacattttcgcaaacaagtatatccgaaaggtcattgctggagcaccaaagatacacataattgattttggtatcttgtatggtttccaatggccctgtctcatacaaggtctatccatgagggctgggggacctccagagcttcgcattactggaatcgatcttccccagccaggtttcaagccagcagggagggttgaggagacagggcgtcgcttggaaaagtactgcaagcgatttagtgtccctttcgtattcaaagccatcgcgaagaagtgggaaagcatcacgcttgaagagcttgaggttcaaagggatgaagtgttggtagttaacagtttgtataggctaggaaacatacctgatgagacagtagtaccaaacagtccaagggatgctgtcctgaatttaatcangaggatccgtcctgatttattcatccatggtgcgttgaacggtactttcaacactccatttttcgtcacacgattcagggaggcgctttttcacttctcttcactggatgatatgtttgaggctactcttccc

SEQ ID NO: 11252 - DNA, 509 bp, Lycopersicon esculentum
  Predicted polypeptide sequence is orthologous to G987
cgttttaagaacctgttggatgagacagtgatgttggacagtccaagggatgcagttctgggcttaattagaaagatgaatccggatatcttcgtgcaagctgtaatcaatggatcttacagtgcacccttctttgtcactcgcttcagggaggccctcttccattactcaactctctttgacatgtttgatgctaccttaccccgtggtgatcagaagaggttgcattttgaacaagaattttacagacgcgaggcaatgaatgtcattgcttgtgagggttccgagagggttgagaggcctgagacgtacaagcaatggcaggttcgcaatatgagggctggattcaagattcttccgttgaaccaacaactcgtgcagaagttaaggtgcaaggtaaaggctggatacctccgcgattttgtgtttgatgaggatggtaaatggatgttacagggttggaaaggccgggtagtatgcgctagctcgtgttgggtgccagcatagaa

SEQ ID NO: 11253 - DNA, 465 bp, Lycopersicon esculentum
  Predicted polypeptide sequence is orthologous to G987
cttacactttttttatccatctgggatttctcagaatcacagaataaatggtcatggatagtagaaactataaggggttatatgatgcaacatctggaattcaattaaaggatgaggatgatgataagctattttttcaagatctgaatctgatcgatcatcttagagttagtgatgctttagttgaacgaaatctggaacccggtgatttcgttccatcagcaatggataactctcatgaggattatgactttagtgatgtagtgcttaaatatattagccaactgcttatggaagagaatattgaagagaaaacatgtatgtttcaagaatctgcagctcttcaagctgctgaaaggtcgttttacgaagttattggagagaagtaccctctgtcccccattcttgatttaggtcaggatggacgtcgcggtgtggactgtagtactaataattactatagtt

SEQ ID NO: 11254 - DNA, 399 bp, Lycopersicon esculentum
  Predicted polypeptide sequence is orthologous to G987
ccaaggaaaagcgcctgcctctcattttttcacttttgctgtcatcttgttcactccactcattaagattgatttatacacaaaactgttatggatccacgattcattccgttgtctgatcctgtaaacactttcgagttcgaagatcagattactttgtctagctatgagggatctctgaatcctcctcacaattataatgatgactatgatgctttcggagttccgtatacggccccgagtgtatacattggtaatttcgccccatcatcaaacgtgagctcggaagtggactctccagatgatcgtgactctgattttctgtttaagtacttaaaccccatacttatggaggagaatattgcagataagcccagcctgtttcatgacccgcttgct

SEQ ID NO: 11255 - DNA, 600 bp, Lycopersicon esculentum
  Predicted polypeptide sequence is orthologous to G988
cgaggggaaacactctggtttactatgccagttttagttctgaatctcatgtcctattgaccagtggaagtatttgaaatggcacaagcacaaatacttgaccacacgtcgaagaaagaggatgatccttccattgcttctcaaccccttaattgacatagtgatctgtctcttgaagtttcatatgatttgcagctcgctcttctacttcaagcttctgctgaaatgttttccaagagacactatgaacgtgcaacggagttactaagcttgtgtaatctgtctgcttctccaacaggtactccggatcaaagagtagtttactgctatagtgaagctctgcgagagagaatcaataaggagacaaaatcgataaccaggattaccaactagatagaccttgtagattttgaagtgaaaaccaattggcgttgaagagatttccttgtgtacaaagcctcatgtaattgcatgttatcacgcccttcctttttaccaagtcgctcaatttgcttgtattgaagccattttgaataattttaagtcagaaagacgacttcatttgattggttttggaatcagaagtggagctcattggat

SEQ ID NO: 11256 - DNA, 331 bp, Lycopersicon esculentum
  Predicted polypeptide sequence is orthologous to G1017
caggcatacagggagccaggcatgctcaatttggagtacctttattggatcttcaccttagcaacaaattaccgtcaggactgttaccaccaagtttccagcgcgttgcagccaactcacaacttcctaatgtcatcaataagtgccaaaatgacagaaatgataacatctcttgtttgcttacaatgggtacttcaagtaagacattggacaaaaatgatagtgtgaatacacctcggttcttactcttcggtcagccaattctgactgagcaacaaatctctaatggatgttctgtcagtgctccacaagtagtccaaacagggaaaga

SEQ ID NO: 11257 - DNA, 362 bp, Lycopersicon esculentum
  Predicted polypeptide sequence is orthologous to G1017, G2567
gattctctgtgcctagatactgtgcatagacaatatttcctaggttggattacacggctgacccgcctgtgcagaccgtgacagccaaagatgttcatggtgaaagttggaagtttaggcacatttatagaggtactcccaggaggcatttgttaacgactggttggagtagttttgtgaatcagaagaaacttgttgctggagattccattgtgtttttgagggcagaaaatggagaactttgtgttggaattcgtagggcgaaaagaggtggtattggtgggcctgaagccccatctggatggaactctggtgctggaaattatggtggattttctgcgtttttgagggaagagatgagc

SEQ ID NO: 11258 - DNA, 191 bp, Lycopersicon esculentum
  Predicted polypeptide sequence is orthologous to G1017, G2567
taggaatgaggttgaatttgatgatgatggggttgttgggatgaatggttcggataaccaagataagcctagttcatttgctaagacgttaacgcaatcagatggcgaataatgggtggaggtttttctgtcccgaggtattgtgcagagacgatctttcctcgtctggatactctgcggatcctcctggt

SEQ ID NO: 11259 - DNA, 1237 bp, Lycopersicon esculentum
  Predicted polypeptide sequence is orthologous to G1020
gattttgaattagctatggcgcctaaggaaaaaattggtgcagttacagctatggcaatggtgaatttaaatggaatttcgaaagaggtgcattatagaggtgtaaggaagaggccatgggggagatacgcggcggagattagagatcctgggaaaaaaagtagggtttggttaggtactttcgatactgcggaggaggcggctagagcttatgataacgctgctagagaatttcgtggagcgaaagcgaaaactaattttccgaaattagaaatggaaaaagaggaagatctgaaattcgctgtgaaaaatgaaatcaatcggagtccgagtcagactagtactgtggagtcatcgagtccggttatggttgattcatcatcgccgttagatctaagtctctgtggatcaatcggcgggtttaatcatcatacggttaagttcccgagctccggtggaggttttaccggttcggtacaggcggtgaatcatatgtactatatagaagcacttgcacgcgccggagttataaagttagaaacaaatcggaagaaaacggtagattacctcggtggtggtgactctgattcatcaacggtaattgattttatgcgtgttgacgtgaaatcaaccaccgccggtttaaatctggatctcaactttcctccaccggaaaacatgtgacatcaccagagacgacgatgaagacgatcggagatattttgcgagaaacatttttaatttagtacaagttcctttttaatgttttttaatttaaacagaaaaggaaaaaaaaaagtatatagaattagatatatagatgatagaaaactgaagagccatcgccgttgctgctgccgtcgccgccggcgacgattaatcaccgccgatgtcaatatcaagaagggctgatctatttttacccttttttgcaacagaaaaaaaaacaaatctatttgattttgcaaagctgttgtttccattagatcatccttatcatatagttattataatacattgttgccggttttttcagctgaaaataattatcacaattctctatctcattcgattaattcttgattaatcgtaacgagagggagttattcgaatagtaaatatgttcctatttttttgtttttgtgaatcggtcggaatgtgaggagcaggcggcggcgagcgagaaccgctaaaagagtttcgcggtaaacgtgtggcacgtgtggtccatttgatt

SEQ ID NO: 11260 - DNA, 915 bp, Lycopersicon esculentum
  Predicted polypeptide sequence is orthologous to G1020
caaaaaatcgtatcagcacctatggctgtgaaagataaggctgtgaaaggaggtaatgtgaaagtgaatcatggagttaaggaagttcactacagaggtgtaaggaagaggccatggggtcgttacgctgcggagattcgtgacccgggtaagaagagtcgggtctggctgggtacttttgatacggcggaggaagcggctaaggcttacgatgccgctgccagagagtttcgtggacctaaagcgaagacgaatttcccctttccggcggagatgaataatgttggtaacaataacagtcagagcccgtgtgggagcagtaccgtggagtcatccagcggagaaacggttgttcacgcgcctaatacgcgacacgcgccgctggagctggatctcacgcgccgtctcggtgccgctgctgaaggtggacgtggaggtgtcggctacccgatcttacaccagcagccgacggtggcggttctgccgaacggtcagccggttttgttgtttgattctatgtggagaccgggagttgttagtaggccgtatcaggttgtaccggcgacgatggagtttgccggtgtcggtgccggagttgttactagtgtgtcggattcgtcttccgttgtggaagagaaacattatgggaaaaagggacttgatcttgatcttaaccttgcgccacctatggaagtttaaattaatgacgacgataatctaattttgtgagagagattaagagagtgacagagctaatggctgatttttgtatataagttcaaaagaattgattgcttttttttttttggcagctgaaactttctcgtgctgtttctaccatttgtaactctaaatccttttaattaatgagaaaattccatattttctcctttctaaaaaaaaaaaaaaaaaaaa

SEQ ID NO: 11261 - DNA, 697 bp, Lycopersicon esculentum
  Predicted polypeptide sequence is orthologous to G1023
tgggattgatggaggatagtttatcgcttgctgacattggtgcacgaatggatttcgatacggagatggacatgttctttgctgggaatgataattttgatcagaatcttgatgactttgctgtgaatgatttcgaggatcttccaatatgtggacttgatgagcagttgcctgctggtttacctgattttgatttcgactttgattttgatggatacaatgaagcttgtgcttggatggatgatgtagcagctactccattgatgaatggaacaacaacaacaacacccctcaatattgcattatgcccataagttttgcagctataggaagtttcaatattatttattagtactatattagtttatttattagtaatccatagagagttttcatgtctcaagaatcattaaacttagcttctcgagaccgtggtcttcgtcctttcaagtgagttttgagtagtctttacattatgttttaagagagttttgagactttgagttgtgttcatgtctttgaagaagattgagtcaatagtccctttgggtttttcttgtgctgctagagccgtccaaaggcctattgaatctcgatttttcggtgtagtctcagactgtttactgtttgtgatgagctatgagctatgttatgaaacttatatatgatatttggctcttcattttacctattgatt

SEQ ID NO: 11262 - DNA, 738 bp, Lycopersicon esculentum
  Predicted polypeptide sequence is orthologous to G1033
gaggcaacgcaccaaatccacacaaacgaataatatccaattctctctagaggtttcatcatgaaaggagctaaatcaaaggctaaagctgataccaagcttggtgtaaggaagaaggctactgagagtaagaaggcgaagaacgctgctaaggatccaaacaagcctaagaggcctccaagtgccttcttcgttttcatggaggagtttaggaagacctacaaggagaagcacccaaacaacaaatctgttgctgttgttggcaaagctggtggagacaagtggaaacagttgtcagatgaagagaaagctccttaccaagccaaggctgagaagaggaaggctgagtaccaaaagagcatggatgcatataacaagaaactggctgctggtgatgctgatgatgagtctgacaagtccaagtctgaggtacatgatgatgatgaggacgatgatggaagtgaagaggaggatgatgattaaacaatcagtaggctgttgaaattcagagaatgatggataagttcatgtaggaattgctcagtccttccttgataaatagatgccctctttttttacattttttgtctagtttttgttctttgagggtttagtttggacagaaaggtgaaattcagatgacttgccttgaaagctcaagtagtttatgtaatttctctattttgctgatgttaatgaaaatttagcttggaaaaaaaaaaaaaaaaaaaaaaaaaa

SEQ ID NO: 11263 - DNA, 887 bp, Lycopersicon esculentum
  misc_feature (61)..(61): n is a, c, g, or t
  Predicted polypeptide sequence is orthologous to G1033
ttttttttttttttttataataataataataataataataataataataatagagaaaaanccaatatcaatcacaaacagtacaataatcaaagcaaggggagatgccacatcacatatcgtcatatatatatatatatatatatatatatatatgagttcacaagagttgagagtttcagcaaactgcaaaactcaactaggtaacagaaaatacataggtttaggtaacagaattacgaaaactattatgtttgaagtgtgcatgtgatggaccaaggtaacggtgcaagccagaaattacatagcttcaatcatcttcctcatcttcatcctcttcgtcttcatcgtcctcttcctcttcttcgccctgtccactgtcctccgcatcttcatcatgtacctcaggctttgaccttttctctttttcttcttctttttcttcttcgtcctcatcatctgagctttccacctgcttattgttataagcattcatgagttttccatactctgccttcctttttgcagctttggcttcatatggtgctttttcagctgcactcaaagatttccacttttctcctccagctttcccgacagcagaaacagccttcacattaggattctcctttttaaatgtcttcctaaattcctcaaggaatacgaaaaaggcactgggaggcctcttaggcttattaggatctttctttgcctttttatcctttgtgaccttctttttggcgtccttcaacgtggcttttctcttccccatctttcggtcctcaacaggcttcaacgccgaccttgtttcttttctcaatgcaccttttccttttccacccttcattgaaacttaaaacagaagaggaagataagaaggtgttggc

SEQ ID NO: 11264 - DNA, 1402 bp, Lycopersicon esculentum
  Predicted polypeptide sequence is orthologous to G1033
tttttttattgcgaaacgaaatcaacattttttttcataatgataagatatgaaaagtaatatctgataacatttctctcagaaacaaaacaacatgaatccaaatttaagaactactatattgagagaaactcagaatttaaccttcgcctgcaaacggtcaattctcaggaatctcaacatcgccatcagaaatctcttgctgcagatcctttggatcctttccatcaacagtgcaaccaacagatacacaagtacctaaaatctccttcactgttccactcaaatccttagccatagatctaggctgcataaccttagcaatctcaataacatcatcaagcgagatatttccattatgcttgatattcttcgtcttcttcctgtcacgttcaaagccccttcttatcctctcttcacaacacacacacaatacacaattcatctcaaagggcaaaaaatatctctttgtttttttctctctcaaccctagaagtttttttttaatcatgaaaggaggtaaatccaaggggaaagcagataacaagctgggagtgaagaagagtgctgcccagactaaaaaagagaagaatgctgccaaggatccaaacaagcctaagaggccagcaagtgctttcttcgttttcatggaggacttcaggaagcagtacaaggaaaagcatccaggcaacaaatctgttgctgctgttggcaaagctggtggtgacaagtggaaacacttgactgatgctgagaaggctccttacatcgctaaggctgagaaacgaaaggctgattatgagaagctaatggacgcttacaacagaaaacaggctggtgaagctgaggaagatgaggaatctgacaagtcaaagtctgaggttgatgaggaagatggaagcgatgaggaagaagaggatgatgactgaagtgctaatgggagggagtaaattggtggggaagctgtgtaataccttagatatttctctatatgatgactccttacttttccccgttaaatacttggctcttttttttagtttattttggggtttcttaggtatgggaaaaagatgaattagatgagagctatctttaaagctcagtggcttatgtactttttattctgatgctggtgttgcttaatgataatgcaactttttaggcaatttgtctttctttttctatatttgtgtagagcttattgtttgtttctattagaacgctcttttttttagtttattttggggtttcttaggtatgggaaaaagatgaattagatgagagctatctttaaagctcagtggcttatgtactttttattctgatgctggtgttgcttaatgataatgcaactttttaggcaaaaaaaaaaaaaaaaaaacacaaaaaaaaaaaaaaa

SEQ ID NO: 11265 - DNA, 491 bp, Lycopersicon esculentum
  Predicted polypeptide sequence is orthologous to G1033
gagaagaatgctgcggaggatccaaacaagcctaagaggccagcaagtgctttcttcgttttcatgtacacatcagaactctgttcttaagatttatggtgacactcagcttcgtaaatcctgatttaataatgttattttcgtggcttggtatattaagggaggacttcaggaagcagtacaaggaaaagcatccaggcaacaaatctgttgctgctgtgagtattttctcttgtcagacctgaagccgagactgattttgtgcttgaaactggtatttgattgagagctgttttctctttgattaatcaatctataggttggcaaagctggtggtgacaagtggaaacacttgactgatgctgtaagtatctgtgttttagctatttttaaaatgctgtatcgagacttagtgatgttgcagtcttgttttagtcatcgagttttgttctattgatattgaattttgtgttgtttgaaatcatgaatac

SEQ ID NO: 11266 - DNA, 391 bp, Lycopersicon esculentum
  Predicted polypeptide sequence is orthologous to G1033
gcctctcttcacaacacacacacaatacacaattcatctcaaagggcaaaaaatatctctttgtttttttctctctcaaccctagaagtttttttttaatcatgaaaggaggtaaatccaaggggaaagcagataacaagctgggagtgaagaagagtgctgcccaaagctggtggtgacaagtggaaacacttgactgatgctgagaaggctccttacatcgctaaggctgagaaacgaaaggctgattatgagaagctaatggacgcttacaacagaaaacaggctggtgaagctgaggaagatgaggaatctgacaagtcaaagtctgaggttgatgaggaagatggaagcgatgaggaagaagaggatgatgactgaagtgctaatg

SEQ ID NO: 11267 - DNA, 187 bp, Lycopersicon esculentum
  Predicted polypeptide sequence is orthologous to G1033
tgaaaggagctaaatcaaaggctaaagctgataccaagcttggtgtaaggaagaaggctactgagagtaagaaggcgaagaacgctgctaaggatccaaacaagcctaagaggcctgcaagtgccttcttcgttttcatggaggagtttaggaagacctacaaggagaagcacccaaacaacaaatc

SEQ ID NO: 11268 - DNA, 549 bp, Lycopersicon esculentum
  Predicted polypeptide sequence is orthologous to G1037
gtttccgtacctttcgaagcttcaagaggagaaacacaatgccgtgaaagtttaggggctgctgttcagattatgaaccaagcaacctgccaacggtggccagatcagaaccaacattattcccacaattcaaacaatatttttggtaacatgagctctcaagtttctagcaatggtggaatggcctctttaactcatcctgtggaccaaaacaatgatatgttctgcacaagggtggagacttctttgaactgcatatcaaatggtagttcttcaatgcacacacacaatcgtgaaagtgaaaaattaactcatgactcgaggacaaaaacaaatgaagactacctcttccagacaacaaagcaacaagttggttttcttcctcagggctatggctcccttgatgatcttatgggtgaaatgaaacaggatcaagatggagccatgttagacggaggagaattcggatttgatgcttattcacttggttcaggtttatgaggtttttgtaactagcaagttaggaaggagaggatctagtgatatagc

SEQ ID NO: 11269 - DNA, 326 bp, Lycopersicon esculentum
  Predicted polypeptide sequence is orthologous to G1037
ggaacttcacaggaagtttgttgcagctgttggtcagttgggcatcgaaaaagctgtgccaaagaggattcttgacttgatgaatgttgacgggcttacaagggaaaatgtggcaagccatctgcagaagtataggctttacttgaaaaggatcaattcagttcaaacccaacaagcaaacatggttgccgcattagggggaagggactatgtgcgaatgggctcactggatgggcttggagattttcgaacattgggtggatcaggacggtatactcatgctgccttgtcatcgtacagttcagggggcatgcttggcagactaa

SEQ ID NO: 11270 - DNA, 565 bp, Lycopersicon esculentum
  misc_feature (507)..(507): n is a, c, g, or t
  Predicted polypeptide sequence is orthologous to G1038
gggagaatagtaaaaccagtgttgggttttcttctccaagaactgatacttttccagctggtttaagggttcttgttgttgatgatgatcctacttggttgaagattcttgaaaaaatgcttaagaagtgttcttatcaagtgacgacatgtggtctagcacgagaggctttgtatgtgctccgagagagaaaggatggatttgacattgtgatcagtgatgttaacatgcctgacatggatggatttaagcttttggagcatgttggacttgagatggatcttcctgtcataatgatgtctgtggatggtgaaacaagcagggtgatgaagggtgttcaacatggtgcatgcgattatcttttaaagcctatacggatgaaagaacttagaaacatatggcagcatgtactcagaaaaaagatgcaggaggcaagggatattggtaatcatgaattggaccaatatgatgaattgtggattcttaatggagctgaaatcctttcangaaagaaaagaaaagattttgagaataagcacgatgaaagagaaatgtccgattcaag

SEQ ID NO: 11271 - DNA, 1174 bp, Lycopersicon esculentum
  Predicted polypeptide sequence is orthologous to G1043
aattatcaaaatacacatatggataactcatcgactgatctaaatagagcaatagaaggtttaattcgtggtcgagaatttactcgacgactaaaagagattattaaaaaatctggtggtgaagttgaaaacattatggctgaggatttagttgccaaaattctggattcattttctgagactctctccgttataaacaattctgatgtcgtcgtcgctacggcggttgaggtcaagtcgccggaagattattctagtggaagttgcaagagttcagatcgaagaggatgctacaagagaaggaaaacttcagaatcagacataaaggaatcctcagatttggtggatgatggtcatgcttggagaaaatatggacaaaaacagatccttaattccacttatccaaggcactactttaggtgcacacataaatatgatcagaaatgtcaagcaagcaaacaagtacagaaaatccaagacaacccacaaagatttagaacaacatactatggacatcacacttgcaaagcttttcctagagtttcacaaataatattggattctccaatggatggaaattctaattatattagttttgatcaaaatcatacatttccatcaataaaacaggaaacaaaggaggaagtagttttcagattctatcctaaaattgaagatcaaattcaatcatcaagctctgattattttcttcccaatgatcatgatcatgatcatctcactccaacaacatttgaagcctccggcagccgtatgacctcgcccgatgttatgtcatctggggtttactcttcttgtactactactagcaacaatgataatcttgagatagatatagattttgaggagggtctttggaactttgatcaagtgtagtgtaggtagcttgatagagatggtgtacaaattttgtattattttgacttggagtttgcattaaagcatttttaggtttggtatcaaagtataaatttgacttccacattttattattaggcaatgatggtagcctactattgttttttgttttgtccctataaagtttaaattaaataggtatatgttaatgttaggatatactattaaccatgcgttttgcgatattactaatattaaataattgtttatttgttaaaaaaaaaaaaaaaaaaaaaaa

SEQ ID NO: 11272 - DNA, 722 bp, Lycopersicon esculentum
  Predicted polypeptide sequence is orthologous to G1043
gaaatatacaggaaaacttcagaatcagacataaaggaatcctcagatttggtggatgatggtcatgcttggagaaaatatggacaaaaacagatccttaattccacttatccaaggtttgaaatttttaataatgatagagtagatgtgatagatgtacagttaatccatatattttatatttgtttttatatctatttataataattataataaaatgaatatgtatgcaggcactactttaggtgcacacataaatatgatcagaaatgtcaagcaagcaaacaagtacagaaaatccaagacaacccacaaagatttagaacaacatactatggacatcacacttgcaaagcttttcctagagtttcacaaataatattggattctccaatggatggaaattctaattatattagttttgatcaaaatcatacatttccatcaataaaacaggaaacaaaggaggaagtagttttcagattctatcctaaaattgaagatcaaattcaatcatcaagctctgattattttcttcccaatgatcatgatcatgatcatctcactccaacaacatttgaagcctccggcagccgtatgacctcgcccgatgttatgtcatctggggtttactcttcttgtactactactagcaacaatgataatcttgagatagatatagattttgaggagggtctttggaactttgatcaagtgtagtg

SEQ ID NO: 11273 - DNA, 1090 bp, Lycopersicon esculentum
  Predicted polypeptide sequence is orthologous to G1043
ggcttcctgtcatgttcttatctctttccttctcactctcacccaccatatataaactataaccccatcatcacttcctaaattctcagatcttataataactttttttttttaaaaatggaggattttcttggtgaaaacccacataatagattgataaaagaacttgttgaaggaaaaagtttcactgtccaacttcaaactctacttaaacaacctaatgaatcagtcttagctgaagaacttattcgcaaaatatggggatcttttactcaggctattactgtgttgaatagtttgggtaattccgataatagtttaacccagggccagatcgaggaagttgatcaacccaattccggttctgaattgaagaagaagaagaaggagaagcaagaccgtagaggttgctacaagagaagaaaaacttcaggttcatggatgagagaatctgcaacaatgaatgatggttgtgcatggagaaaatatgggcagaagaaaatactcaattcaaaatatcctaggtgctactataggtgcacccacaagtacgatcaagaatgccgggccacaaaacaagttcaaataatccaagaaaatccaattataatgtatcacaccacatattttggcaatcacacttgcaatccaacaaagattccaaaacatacatacaataatcatgctatggtaaagcatagtgactcaacagtactaaaagaagaagaggaagaggaagaatccaaaggacaaagtgataatgcatcatcaattgtggattctaatttatggcaagattttatgccttcttctccctctgctcatgattccactatggctgctaattataattcttcttattatgaagaaatcatatctagtcatgatatggaagattgggctaaatttggtgaaattgaggccattgagttttgttgacatattgttaatagtaatttagcccttatggggtatggctaatgttgtagaataaaaccttcggctatgttcttggtattacttttaaatgaaaaaaaggtatatagtaaaaaaaaaaaaaaaaaacaaaaaaaaaaaaaggggggagggc

SEQ ID NO: 11274 - DNA, 868 bp, Lycopersicon esculentum
  Predicted polypeptide sequence is orthologous to G1043
cttggtgaaaacccacataatagattgataaaagaacttgttgaaggaaaaagtttcactgtccaacttcaaactctacttaaacaacctaatgaatcagtcttagctgaagaacttattcgcaaaatatggggatcttttactcaggctattactgtgttgaatagtttgggtaattccgataatagtttaacccagggccagatcgaggaagttgatcaacccaattccggttctgaattgaagaagaagaagaaggagaagcaagaccgtagaggttgctacaagagaaggtaattattatagtactattagtttaacttttgtacactcatcgtttgcatagtacgtatatataaagtagtcctagttaagataacttgtttgtaaaaagtgtcttagtataaatttttactatatgatagtgtaatgaaacaacttttaactatatcgatatgatctatcgatgtcctaacacttatatcaaggtaaattgcctttctttttacggatgaatgtgactaatttttatactatcaatgactattatagttaaactcatgaaaagtaggatgaattacctagttaaaatacacttacaaatatatattcattagttagatctaattaattatatgaaaatattcttcattttcaattggtatatatggtacttgtatgtgtagctagctaaaaaataaagaactaaaataaaagaataatactaagtaaccccactaacccttataattttgtgtatgcaacttggattatatatatagatctacaagccaaggcaatttgaatagtcaattggatatcttctgccaacaagctagctatacattgtttactgaacacacaagtc

SEQ ID NO: 11275 - DNA, 701 bp, Lycopersicon esculentum
  misc_feature (664)..(664): n is a, c, g, or t
  Predicted polypeptide sequence is orthologous to G1047, G1808
cccacccccctttagaagcgattttccggccatgttgtccactttcccggccactactctgtccgccgacggacttttttccaatttatttccggcatttgatggaggattcactccttgggaatgtatcgaaccggcttttctattttcacaacaagtggaatcggttgtttcacccaaggaatccccaccacctgaaccggttatttcaaactccgattcaggttctgatgactccaaacctaattctgttcactctagttccggttcagatgacccgaaccggaataataacaataataataagtcgaaccggtgtcctgacgagagaaagcggcagcgcacgacatcgaaccgtgacatggatgagaggaagcgtcgacgtatggtatcgaaccgggaatcagcaaggcggtctcgcatgcgaaagcaaaagcatctggaaaacctgcggaaccaagcgaaccggcttaaagtagggaaccgggaaataatgaaccggttacggttaatcactcaccagtgccaagtggtccagtgtgagaacgagcggctgaggaccgaatcggctatccttcggcaaagactttgagggtatacgtcaaatatggatcaaccggcaatttaattcttattctgcatgggcatgcaataatatggaacnaagacctcattaattaatcattgggaactatataatc

SEQ ID NO: 11276 - DNA, 1133 bp, Lycopersicon esculentum
  Predicted polypeptide sequence is orthologous to G1048
gggacatccagagatcgggtcccaaaatagtgagtcggaccctagtttcttcaccccacaatctccgtcgaactggcgatgatcgataacatcgatgatatcatcaactgggacgatgtagatcacatcttccacaacgttctagacaatcccgacgatgatcaattcactcttcatgattcctccccacagtcattccagcagatcgagcagcttcttatgaacgatgacgatttcggtcttgtctctgatcctcagtttgctgccgaatctctttctgacttcctcgtcgattctcctcttcactccgatcattctcactctcctgctgaacaagccattggattctccgatcccaaggtttcaagtgccgatcaggacaaacacaaggtttcccagtcgccttctgacggcgacgacgaactaaacaaccatgaccccgtcgataagaagcgcaagaggcaattgaggaatagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttttctttgcataatagcagtgctaatggtgtttctatgaccaagcaggagtctgccgtgctctttttggaatccctgctgttgggttccctgctttggttcctgggcatcacatgcctgctcattctacccagccaaacctggtcagttccagaagaaagtcagggaagcagaaaccacgggcttctggttccaataaaggagggaaaaaagactagtcggattttgttgttcctgtccttcatgatgagcaaaagatgcaaagcttcaagatcgaggatgaagctcaacccccatcccttgggagttgtgatgtgactcgttgtgatcaaatcttttcccataggtggatcatggttccttttgagttctttagttttttatcagagattctcttgtatgtgtcttgctttgacatctgaaggatgaagttcactgttattagttaatgacttatgagctatataatatctatgcaactttttaatagttccaaccgaaaaaaaaaaaaaaaaaaa

SEQ ID NO: 11277 - DNA, 662 bp, Lycopersicon esculentum
  Predicted polypeptide sequence is orthologous to G1049
gcaatcatgatttcatcagaggctgcaacaatccactacttagctcaagaaaatccctcatcacttcctattgattacaccttcacgcacaaaaacttccaattcaacaacacattcctaaccaacaactatcagtcgttcacttttcctattcaagacttgataagtacacaacctgcatcatgcatcagtagtaactcaacctcggatgaatcggaggaacaacaacatagaatcatcgatgaacgaaagcagagaagaatgatatcaaacagagaatcagctagaagatcaaggatgaggaaacaaaggcaccttgatgagttatggtcacaagtagttcgtcttagaacagaaaataataatcttataaataagttaaaccaagtctcagaatctcatgaaaaagtagttcaagagaatatgcagctcaaggatgaggcttatgatcttcgtcgattgcttgtagacattcaagttgctactcctttcaatggtttcagcaacatagacgataacgttccatctagtctaaagactgaatcatcaaaccaatccaccacagagagaaaattagagtgagctggacatattttcaatgttgttccttcatcatgttgttctctttttacctcaatgccaatgagtttaatttttagttg

SEQ ID NO: 11278 - DNA, 2314 bp, Lycopersicon esculentum
  Predicted polypeptide sequence is orthologous to G1050
gagtcatcttcgttgataacagtgagatagagagagaaacaagaaaaatatcatagaaaaaacagtattacaagggggaaaaagtacacacaaagaggaatagaggagcgtcttctgttgaaaatggtggatttacactcaggtgtaacagaagtactgtaaaggttggattttggtaaagttgaaagggtttttttttggttgactggtagagttgaaatttggggaaaaataaatggctggtgacaatgacgaaggtcatagtgatatggtccagagacttcaatcatcatttgggacatcatcgtcttcacttcctaaacagcttcaacctatttcgatgaaccaattggacataccccagttgacaacttctcaatttaggggtcaaatgaggcaattttctcccaattttggtgttgaaaatagtaaaagagtaggtataccgccttctcacccgcaaatgccccctatttcaccatattctcagatccctgtaaccaggccagggaatcagcaaatgggtatgcagaactttactagtgcagggccatcacactcgcgatctttatcacaaccagcgtttttctcactggattccttgccacccttgagcccttcaccgtatagggaatccccgtccacgtctatgtctgacccgatatctgctgatgtctcaatgggtgatcaggatggcaattcacattctttattgccgcctacgcctttctctaggtgtaattcatcgagggcaggggagagtcttcctcctcgtaaggctcataggaggtctaatagtgatataccattcggcttttctggtataatgcagtcatcaccaccacttgttccgctaaggagtcctggtgctcttgaaaggtcagttccttcaagggataatttgggtggtaaaccagttcagttggttaaacgtgaatctatgtgggaaagaggaaatgataataacaatgttgaagggatgggtgagaggaaatctgaaggagaagttgtggacgacctgttttctgcatatatgaatttggacaacattgatgcatttaactcttcgggaactgatgagaagctgggtattgagaaccgtgaagatttagatagtagagcgagtggtacaaagacgaatggtggtgacagcagtgataatgaagctacaagcagtgtcaatgacagtagcagcggcagtatgcagaagagagaaggggtcaaaaggagtgctgtgggagatatcgctccaaccactagacactacaggagtgtttcgatggatagttttatggggaagttaaacttcatcgatgattcaccaaagttgcctccatctcctggaccacgcccaggccaactctcaccaaccaattcacttgatggaaattcaaacagtttcagtttggaatttggaaatggtgaatttagtggtgctgaattgaagaaaattatggcaaatgaaaaacttgcagagatagctttagcagatccaaaacgagccaaaaggattttagccaaccgtcaatctgctgctcgttctaaagaaagaaagatgagatacattgcagaattagaacacaaggttcagacattgcagactgaagcaaccacattatctgctcaactgaccctcttgcagagagatgcgactgggctgacaagccaaaatagtgaactgaagtttcgtttgcaagccatggaacagcaagctcagcttcgtgatgctctaaatgaagcattaactgctgaagttcaacgcttgaagatagcaaccgcagagcttagtgcagacgcttccaagtttcagcagctatctctaaatcctcagatgttccaatcgcagcagcaacaatcgaatcagctaaacatgcatcagttgcaacagcagcagcagcagcaacaatcatctcagccacaacaacatgctcaagcacgacaacaacttaacagctcgacgacttcaaagcatgaatcaaagtagtagcttttgggaaatatctcatcttcataatatttatgttagtttgtcaatagatgttgcaagtgttttcatatcattcaatgcattcattcatttagttctgcattcacaacaaaacacaccgagtcttggtatttattatctataggacatgcatgttcattggatttacttagtcacagagtcttgtgatgtatacagttggttcttttttttgttcaacaaggatattgaattcaaggtcatatgaacttgactcgttttgttaaaaaaaaaaaaaaaaaagtttaattcaaatttgcctatttcaaaataaaaaaaaaaaaaaaa

SEQ ID NO: 11279 - DNA, 1176 bp, Lycopersicon esculentum
  Predicted polypeptide sequence is orthologous to G1050
gaaaggctgatttttgtattgttgagagcggggattatgagacattcccttggggtatacttgtatttagagccatgatggagtccataaacaataggttgcgtgtgggtctgaagatgtataggcttgggggtttacctttggctttgcagtgttggttctacgagtgctgcagtaatgctgatggtaagttggctcaccaggttgacaacaaagtgcctcgtattcttaattggaaaattgagaagcaaccgaccttgaatgagttgtctggtgggttattcaagatcagaagtgacaagttgaagttcaagaatatttctcccacggagtttgagcaacttcacttggatttgcctgaatcatctggaaatccaaatgataacgaggtggcatacagagatcttcctgaagttcatcctagtgatgatgactttagctctcctcctataacaagcaaaactcagcccaaaaccaaatcggatcccccagtgaacaatttggagaggagtgccgagctcaaacgactttctgatgaacagtcagagttgaagagtaatattcgagaggtcttcaaagcaactgagttgctcaagaaacaaatgatggtgtcatttgcagatgtctttaaagcgatcgagtcattgtcgaagaaacaatcagaaaaggataattcagaagcattgcatattgatggaagagatggccaccttgacagacacggtgatggtgattccaatggttttgacgctaacaatggccatggtagtgatggcccagattgtggcaaggactcccttggtgacaaggagaatagcgagaaagtcaatattggagccttgagtggaattacaaacacatagggaaaatcattttttccctgtcctacattttatgagtaaggtttgtcttcacgacaccagatcagtttggtgatgatttgactgaaggtaataacaggtactccaggttgcagaaactgttgcagggttgacaaagcaagatagagtaggcaaagcaagctgttgtatgttcgagtgtctgtctagtttcggattttcacaatacagttcaagatgaatttggaatcagcaaggaggatgaggtcttcttccctactcaatccacaagtgttgactatttcaactgggtggtgtaatagacatgtactcaatg

SEQ ID NO: 11280 - DNA, 1017 bp, Lycopersicon esculentum
  Predicted polypeptide sequence is orthologous to G1050
gctctactcttctctttcatatcagtacaagttattttcattttctcttacaaattcaaccgtaatcaccgccattttcagcgggaaattcaccttctctccaaaatcccattttttcccctataaccccaccccccacaacttcactttcatcaatgtttgcacgtttgtctctcatcatattcaactgtagctcctttaaattttgactataaactttcaggtactccgttttcttccttgctctgcttttctcaatcttgtttttcattcatctgttgtttggggttttgtgtttgtttgaattggattgggttgaaacagttttttttttgggtgggtttaaggagttttctatttagggttttgctgggagctgaaattttgatttatttaatgagaattgctgaagttctttgattattacgaagaaatagcatttggggtgtcggaaaaattgaatcttttgcgggttttatttgttgatttttgatggctcagtctaattctaagccacctatgagtagtcagaattttggtgttggagctgtatctcatgtgaggtcgttatctcaatcgagtattttctcgaatagttgtttgcccccattgagtccttttcctcctagtgagccggggatggtgtcgggtcattctagcttgaaagatatatccatggaggaagcagatgtgaattctcaaggtgtaggagttgtgtcttcgtttacgagggatggtcttcctcctcggaaggggcatcgtcgatctaatagtgatgttccattgggattctcggctatgattcagtcttcacctcagttgatgcctataagtggtcagaaggttttagggagagcagtgagtcttggggatagcaatggaaagattgatgagaggaaaccaaagggagaggttacagatgagttgttgttttcctacatgaatttggaaaatatagagacattgaacggttctggcacgaaggacagagataaggacagcattgtcagtgggaca

SEQ ID NO: 11281 - DNA, 694 bp, Lycopersicon esculentum
  Predicted polypeptide sequence is orthologous to G1050
caggtgataatgaagctacaagcagtgtcaatgacagtagcagcggcagtatgcagaagagagaaggggtcaaaaggagtgctgtgggagatatcgctccaaccactagacactacaggagtgtttcgatggatagttttatggggaagttaaacttcatcgatgattcaccaaagttgcctccatctcctggaccacgcccaggccaactctcaccaaccaattcacttgatggaaattcaaacagtttcagtttggaatttggaaatggtgaatttagtggtgctgaattgaagaaaattatggcaaatgaaaaacttgcagagatagctttagcagatccaaaacgagccaaaaggattttagccaaccgtcaatctgctgctcgttctaaagaaagaaagatgagatacattgcagaattagaacacaaggttcagacattgcagactgaagcaaccacattatctgctcaactgaccctcttgcagctctaaatgaagcattaactgctgaagttcaacgcttgaagatagcaaccgcagagcttagtgcagacgcttccaagtttcagcagctatctctaaatcctcagatgttccaatcgcagcagcaacaatcgaatcagctaaacatgcatcagttgcaacagcagcagcagcagcaacaatcatctcagccacaacaacatgct

SEQ ID NO: 11282 - DNA, 639 bp, Lycopersicon esculentum
  Predicted polypeptide sequence is orthologous to G1050
tttaagggaaggaaccaagaggagcgctgatgcgaatattgctccagctgcacgtcactttaggagtctttccatggatagtgctattggaaattttcactatggcgatgagtcaccaaatttaccaacttctctgatgatgcgttccggtcagctttcaccaagtaattcaggaaatgaaagttcgagcaagcacaatcttgacttcggaaattctgaatttagtgaagctgagatgaagaagattatggcagatgaaagacttgctgagattgcagttttagatcccaagcgtgctaaaaggattttggctaatcgtctgtctgctgctcgatccaaggagcgaaaaacacgttacatctcagaattggaacacaaggttcaaaagctacagacagaaacaactaccttatccacacaagttacaatcctgcagaaaaattttgttgagatttcaagcctgaacagtgagctgaaattccgcatccaagccatggagcaacaggcacagcttagagatgctctgcatgaggcattaactgcagaagtccaacgtctaaagcttgctgctggggaacatagggaggaaggacggttgcctaataacatgacacaacagacaccaatgaagcataatat

SEQ ID NO: 11283 - DNA, 372 bp, Lycopersicon esculentum
  Predicted polypeptide sequence is orthologous to G1050
ggttgactggtagagttgaaatttggggaaaaataaatggctggtgacaatgacgaaggtcatagtgatatggtccagagacttcaatcatcatttgggacatcatcgtcttcacttcctaaacagcttcaacctatttcgatgaaccaattggacataccccagttgacaacttctcaatttaggggtcaaatgaggcaattttctcccaattttggtgttgaaaatagtaaaagagtaggtataccgccttctcacccgcaaatgccccctatttcaccatattctcagatccctgtaaccaggccagggaatcagcaaatgggtatgcagaactttactagtgcagggccatcacactcgcgatcttta

SEQ ID NO: 11284 - DNA, 616 bp, Lycopersicon esculentum
  Predicted polypeptide sequence is orthologous to G1050
cccaaaagtttatatcctgtagcaaatcgtcatgcctcctattcaagaactggtgctgattatgaaattgaagtagcttattttgtcgggcaatttatgcgctactattttggaaaataattttgaagaaaactatgtagtttgttggaactactaaaatgcctcgtctaaagaagcagatttccaaaaggaaaatatgtctctattttactgcaagccgttccagcactttgatgcatctaagcatgcaccacttaactcaaaattaaagtcattgtactactgagtgtgacgcacatacaacaccacgttatgtttctgattttgagaacattgtacaggattttggcaaatcggcagtctgcttctcgttcgaaagagagaaaggccgttacattactgaacttgagagaaagttcagacccttcaacagaagcaaccactctttctgctcaattaaccctttccagcgggatacaccccagtttactaatgaaatacagagctcaagctccgttgcaagctatggcacaacagctcagttacgtgatgctctgaatgaagcccctgagcaggaagtggaagactttaaatggcacaggggaatgtcatcatc

SEQ ID NO: 11285 - DNA, 836 bp, Lycopersicon esculentum
  Predicted polypeptide sequence is orthologous to G1051, G1052
aataggatgatgaactacttactactatggtttccgatgatagcggcgccggtgctgcgtttgctggtacggcgccgtgttcgaatccgtcgagtacgaatccttctacgccgtcggatcaagtcagtgaaaatgaagatcacaaatcgccggtcagattggaggttaatctagtggttcagccgaagaatgagcccggagaagatgatagtgataatcaatcgccggtgactagtaaaaatccggtgaatgattcttctgataataataataataattctattgtggatccaaagaggattaagagaatattagctaacaggcaatcagctcagagatcgagagttagaaaattacagtacatttcagaactggaaagaagtgtaactactctgcaaactgaagtatcagcattatcaccaagagttgcatttttggaccatcaaaggctacttcttaacgttgataatagcgcactcaggcaacgaattgcagctttggctcaagataagatttttaaagatgctcatcaagaagcattgaagaaagaaattgagagactaagacaaatttatcatgaacagaacatgaagaaaatgaataccgccgatgaaccaccgtcaacggcggcgccgatgagttgtacggaagaagcgtaagcttcttaaaattgcattgtcttcagctaacttgcgccttcacgtgatgtgtttctcttttctcttgtggacccctgtgataatttttaacatgattttaggaaattaattcctactatttaatttaaaatagtagtaggaaataattcattcaatatttttttttttaaaaaaaaa

SEQ ID NO: 11286 - DNA, 595 bp, Lycopersicon esculentum
  Predicted polypeptide sequence is orthologous to G1051, G1052
gctgatcatgatgatcatgttgataattctagcgaaaaaatcatcgatccaaagagaattaaaaggattttggcaaatagacaatcagcacaaaggtcaagggtgagaaaattacagtacatatcggagctagaacgtagcgttactacacttcaagctgaagtttcagtattatcaccaagagttgcatttttggaccatcaacgtttggttctaaatgttgataatagtgttcttaagcaaagaattgcagctcttgcccaagataaaatatttaaagatgctcatcaagaagcattgaagagagaaatagagaggttaagggaaatatattaccaacagaacttaaagaagatggaaaatgatgatgatgataatgatcattcaataaagatacaacaagatgttaatggctctgagaagaaagaacagcttgtcaactgatcattttttcagctataggataaaaagaatgtagcttgaggagaagcactaagcagattcatgtggtatttggacctaccaagaaagtttcttattatggaggggacaaagataaggtcacttgaattcttgcattgatcactcaatttct

SEQ ID NO: 11287 - DNA, 754 bp, Lycopersicon esculentum
  Predicted polypeptide sequence is orthologous to G1051, G1052
gatggcacacttaccaccaagagcgcctaacatgacacaaaattggcctgatttttcgcttcatcaaaaaatggaaaacttagctccgtccgcccataatttatgggcggacgaattcctcgacatgtcgtcgaggcgtgggtcccaccgaagatcaatgagcgactccatagcttttttggagtcgcccatggttgaagaatgccggaggctatccagtactactccgggatccggtgggaccactaacggtcacgacgaattcgagagattcgatgacgaacaacagattatgtccatgtttaacgatgacgtccacgatatgtcgtgttccaacccgtcatcaccgtccgattacatcaacgttactgaagataaaaagatgaacggccctgatcaaatgatgatgcagcgtaagagtgatcaaaatgaggaagttgaaagctcatgcaagactaatgaggaattagccacagctaatcaaaatgcaagtactaataataatgaatattcttctgaaagagttgttgatcccaagagaatcaaaaggattttagcaaatagacaatctgcgcaaaggtcaagggtgaggaaactacagtacgtatcatagctcgaacgtagtgttactactcttcaagctgaagtttctgtactgtcaccaagagttgcatttttggaccatcaacgtttattgctaaatgttgacaatagtgccctcaggcaaaaaattgctgctcttgcccaagataaa

SEQ ID NO: 11288 - DNA, 1400 bp, Lycopersicon esculentum
  Predicted polypeptide sequence is orthologous to G1062
ttttttttttttttttcagaattaatgagtgaatttcattgacatatccaaattttccttgcatatgctttttatacactaaaactgcaggacaattgagaaaactgctagttaatcggttcgctaagtaactgataaatggaagcaaaggttcatggaatagcaaattgtgagttgtaaaacaaaacaacagcctgctggatgaaatatagaaatacaatatgagcataggaaattggctagaacaacaagaagagtctaaagttgaaagttgtggctacattgtttccctttgtcaatcacagaagctcatatcatcccatggcaaccagcggaatccagcagtactgctttgatttgatcaggatgaaagtcttgaccttctttgcattgctcagctctaaagatatctaaggcaaatccattgaagcagctgataacagcttgttggatgtccagtccgaggttgtcgagtgccctcattgttgagagtaagaggcctggtctgcggctgcaaaacatatggatattcacagctcttccttctcttgcctttacttcaacccttgcaggttgtccagtcgggctagacagtgggcttgcaaatgaactcggatagagttcttccttgatgcggcctggcagagctggtccagttggtgttagaggatagaagcttgttgtttgggtcagtgaagagctaggtggcgtggactccagttcattatgcaggtcattgattttctgtaaaagctcctttaagtactcaattgcatcccctaagattgaagccctgtccatcttgctaatccttggtacaacagacctcaacatgtaaagcctatcgtttagcttcttcctacgtcgtcgttcagccatcaaattcttagccggaagtccctttttctttcctttctgattcccacaggtgacagtgctagttgcatttgagctatttccaccattcttaacagtatcatccaccttattagtaacattttcagtaaggtcatctgaatcataactcaatgtgcacccatcaaagctcacatcatcaagttcttccccactaccccactttctcttcctttcattctctccattcatggaattctggccaatttcacctccgaaatcccccaaactgccaccagtagtattagctaagttcttcctaagagcagcccttttctgaaaaagggttggttgtgctccatttgaagcaaaattatcaagtggctttaacaacttggacctattgagaaacagagagttctcatttgcagaaccatcaacaaaccctagtggactaaacccagtagtagtagtattttggggcaaatgggatgatgggtattgagtaaatgaattcaaattggggttacccatttggttatgtg

SEQ ID NO: 11289 - DNA, 414 bp, Lycopersicon esculentum
  Predicted polypeptide sequence is orthologous to G1062
gaagaaaattttagcaacaaggggaataccactaatgttgagcttgaaaacaaacaagatatggaattgggtgcactttctacattcaaatctatgttagatggtacagatgtagattggtatcacaacaacatgcaaaaccatactgaaaatatctgtttcactcagaatttcactgaattagctgaaaacagcatgtttctacagccagtagtaccagtggattcttcatcttcttgttcaccatcttcagtttctgttttcaacaatctagacccatctcaggtacattacttgttagcccaaaaggctattaacaacaaccctttggattatagttttaatttgggttgtgaaaatggttttcttgaagctcaaggtatgggtggtttgaataaagggggatttcttctt

SEQ ID NO: 11290 - DNA, 517 bp, Lycopersicon esculentum
  misc_feature (504)..(504): n is a, c, g, or t
  Predicted polypeptide sequence is orthologous to G1062
tgatacccttgacatgccgaggtctgttgtaccaaggattagcaagatggactgggcttcaatcttaggggatgctattgagtacttaaaggagcttttacagtatcatccaccttattagtaacattttcagtaaggtcatctgaatcataactcaatgtgcacccatcaaagctcacatcatcaagttcttccccactaccccactttctcttcctttcattctctccattcatggaattctggccaatttcacctccgaaatcccccaaactgccaccagtagtattagctaagttcttcctaagagcagcccttttctgaaaaagggttggttgtgctccatttgaagcaaaattatcaagtggctttaacaacttggacctattgagaaacagagagttctcatttgcagaaccatcaacaaaccctagtggactaaacccagtagtagtagtattttggggcaaatgggatgatgggtattgagtaaatgaattcaanatggggttaccca

SEQ ID NO: 11291 - DNA, 625 bp, Lycopersicon esculentum
  Predicted polypeptide sequence is orthologous to G1062
gctctttccctcttggttatgcgcggtgaatctgattgtatgttggcagatggacagggcttcaatcttaggagatgcaattaagtacttgaaggagcttctgcatgacatcaatgagctgcataatgagttggagtccacaccagctaacaactcttcattgagtcccgcaaccagcttccatcctctgacaccgactgcatcagctctgccaagtcgtataaaggaggaacttgttccaagccccctgtccagccctactggacaacctgctaggattgaagtgagggtcagggaaggaaaagcggtgaacattcatatgatctgcagccgcaaaccaggggttttactctcaacaatgaaggctctggacagtcttggactggacattcaacaagctgttatcagctgcttcaatgggtttgtgttggatgtgttccgagctgagcaatcgaacgaaggtcaagagatgcatccagatcagatcaaagctgtgttgatggagactgctggctttaaggggggacgatataagctgctcgatctagtatacgaaggagaggctctatcgaagattttggacctcagggtgctatagcttttagacctcaagactttattagtt

SEQ ID NO: 11292 - DNA, 591 bp, Lycopersicon esculentum
  Predicted polypeptide sequence is orthologous to G1062
gtaaatggtcataaatactatgctttattaggagtgtcaaagtttattgtatggaaacaacatggtacttgaattttagcactatcatgcggaaacattttactggagccctaagaaaccaagacgtaggaagttatctttgatagaccgtgatgctgaaagttatctacctattagttaacatttgcgtcttacttgagaatttaatcccaaacaaccattggacttgattttaatcttcctgactacctaatataaaaagcttcttcttggcatgcaatttatgaatacgcatgttcacagatggacagggcttcaatcttaggggatgcaattgagtacttaaaggagcttttacagaaaatcaatgacctgcataatgaaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctgcaagggtttgaagtaaaggcaagagaaggaagagctgtgaatatccactatgttt

SEQ ID NO: 11293 - DNA, 491 bp, Lycopersicon esculentum
  Predicted polypeptide sequence is orthologous to G1062
taacaatcatcacatcaacaacaacaacaacaatggtggtggtggtggtggtggtagcaacatgcagagccacatttcttactctacaagtttcactgaagctgaaaacagtttgcttctgcaacctgttgattcttcagcttcctgctcgcctgtttctggtaacgttttcaacaacattgacccttctcaggtgaacttcttcatgccccaaaaatctactattccttcttcactcactgggttatccaacaacccaatggataacagcttcaatttgggtatgttgaatcaagctgggaacgggatgatgaatactgggtatcatcatctgggttcaccaaaccaaatggggacgaacaacctgagttcttatactcagttttcttctcccaatctgctccagctacctcaggtagctggtgggtacagttcgatgggatttggggctaacaattctgctaatgggaacactttgttttctcaatcgg

SEQ ID NO: 11294 - DNA, 598 bp, Lycopersicon esculentum
  Predicted polypeptide sequence is orthologous to G1063, G2143
ggaacacttctcatagtgtggtatcccttttagcccatctttcattctaatatttctatatatcctcttgtttttttatttttaccttacaaaaacaaatcatggatttacaaaatattgctcactcactagaacttggattctccaatagcaatattgaaatgatacctttacaatcaccactccataactccaattacttaatgaattctcctccatctaatttctcattcatgggcaatccaattgaagagccagccgcgatgccaatactctcatcgatcgatgaaattatagcatcgactcatggtaatggaaatgattactcatgtttgcagaggaggaattctatggaggctatgagggagatgatttttcgtatcgcgatgatgcaaccaattcacattgatccagaatcagttaaacctcccaagaggaaaaatgttaagatatcgaaggatccacagagtgtggcagccaggcatcggagggaacgaataagcgaaaggataaggattttgcaaagactagtccctggaggaactaaaatggatactgcttcaatgttagatgaggctgtccattatgttaagttttt

SEQ ID NO: 11295 - DNA, 815 bp, Lycopersicon esculentum
  Predicted polypeptide sequence is orthologous to G1064
gaagaaacataaaacagacccacaaagaattaaatatagtgtctgtcactattttctcataaaaaagaacttggtctagtgaggagaaaaaaaaagagaaaagagaaagaaggggctcatatttttatttttttttaagagcgagtttttagtcattactactttgtgaacatggatggaggaggtgatgatcatctccaccaacgccaccaacacaatcaccgctctatcgcgacttttccgtttcaattacttgagaaaaaagaagacgaagcttgttccagttcatccaacgctgcagctgcttatactacttctcttgctatttcaaacacagataatactcatacaaaccctaataatacacctcgatcaacaatttcaactcttcaaatctcagcttctggtgccgatacatctaaaaagccgcccccaaaacgaacctccaccaaagaccgtcatactaaggttgatggtcgtggcagacgtatccgcatgcctgcgctttgtgcggctagggtttttcagctcacacgagaactcggtcataaatccgatggcgaaacaatagagtggctacttcaacaagcggaaccagcagtaatcgccgctacaggaactggtacaatcccagcaaacttcacgtcgcttaatatttcactacgtagctcaggctccagcatgtcagtgccttcacaactacgatcttcatatttcaatccgaatttttcgctctcacacgacgaggactatttcctccgggaattggattgtcgactgatacttagctactaacgttgttgaattttcagtcg

SEQ ID NO: 11296 - DNA, 671 bp, Lycopersicon esculentum
  Predicted polypeptide sequence is orthologous to G1064
gtgaaaatttagttattaagagtgatcatggaaggaggaggaggtgacgatcatctccaccatcaccatcacaatcaccagcaccaccaacatcaccagcaatatcgtcctaacaacttccctttccaattactcgaaaaaaaagaagacgaaccttgctccagctcctccgcagctaataatattaattatccttcgctagccatttccccatccgatacaaatacgaatataaaccctaatagtaacgaccttcaaattacagttgcctctactgagactgctaaaaagccagctcccaagagaacttccactaaagaccgccacactaaggttgatggccgtggcagacgtatacgtatgccggccctttgtgctgctagggtttttcagctcactcgagaactcggtcacaaatccgatggtgaaaccatcgaatggcttcttcaacaagctgaacctgcagttatagctgctacgggaacaggtacaattccggcgaatttcacgtcactcaacatttcattacgtagttcaggatccagcatgtccgtaccatctcaacttcgatcttcgtatttcaatccgaatttttcactgtcccaaaggcgcagtttgtttcagggtatcggtttatcatcagacagatctgcaactacaacgttgctgaa

SEQ ID NO: 11297 - DNA, 1259 bp, Lycopersicon esculentum
  Predicted polypeptide sequence is orthologous to G1068
gcttgaaaaaaagggtttttttttttgaagaacaattctctgttttcatggattctcaagaatcccaagcgggtcaccaccaaaatcaacaccatcatcaaccccaacacccccaatttcatcaccaacagcaacatggtcatggccatggccatggccatcatcccatgatgatggcaagaccacaacaccatcagcttcaacagcttcaacagcagcatcaccaacatcagcagcaagctaacacctttggtttacctaacaatgttccaacacataacaacaacaattctgctatgatgcaacagcttcagcaacaccagcagcaaaattctggttttccttttaattctgtggttaatacggcttctgcggcggtggcggcgcctcaacataatcttgattactcagatgcgtcatctcctagggctactggattcagcattgagcctgctaggaaaaaaaggggccgacccaggaagtattcacctgatggtaacatcgctttgggtctctcgcctactcctgttaccccgatttcatctggggtgcctcctacagattccggaagcggtggcggtggtgatgcggagggtccttcttccgagaatccttcgaaaaaggcccgaggaaggcctcctggctctggaaagaaacagctagatgctttaggtgcagctggagttgggtttacacctcatgtgatcacagtgaatgttggggaggacatagcttcaaagataatggctttctcccagcaagggccgcgtactgtttgtattctatctgcaaatggagccatctgtaacgtcacccttcgccaaccagcaatggggggtggcactattaattacgagggccgatatgagatcatctcattgacaggttccttcatgcagtcggagaataatggcagcagtggaccaagtggtctgagtgtgtcactggcgggggcagatggtagagtaatgggtggtggagtttcaggagtgcttatggctgccacaccagtgcaggtaattgtgggtagcttccttgctgaagggaaaaagccaaagtctaaggtgccatcttcgacaccaccatccaatatgttgaattttggtgctcctgccacaggggagagccctccttctcaaggtgatgcctcaagtgactcgtctgaggaaaatggcgacagtcctttccaacatgaatcaggaccttatggtaacgctggccaaccaatgcatggtatgtcaatgtatgcaaatatgggc

SEQ ID NO: 11298 - DNA, 655 bp, Lycopersicon esculentum
  Predicted polypeptide sequence is orthologous to G1069, G2153
gtctctctctcctcttatgatcatctctctagctccttgcttagatccttgttcaattattcaaacaaaaacaaaaaaccctaatcccaaattttcaattaatctttgtaaaattagctagagttcaaggttttttcttcactagaaatatttaaaaaccctatctttgtgttgtaacatgtcaaacccatggtggacaggccaagtaggtttacaaggagttgaaacatcatcatcggcggggtcaccgtctcttaagaaggcagatctaggcgtatcaatgaacgataatagtggtggtagtggtagtcatgatgaagatagggaccacagcgatgaccctaaagagggtgctgtggaagtagccactcgtcgacctagaggtcgaccagctggctcaaaaaacaaacctaaaccaccaatatttgttacaagggatagccctaatgcccttagaagccacgtcatggaagttgctaatggagctgatgtggcagaaagtatagctcaatttgctaggaaaagacaaagaggtgtttgtgtattgagtgctactggaactgttactaatgtaaccctaagacaaccatctgctcctggagctgtcatggcattacatggccgattcgagatcttatcattgaccggagctttc

SEQ ID NO: 11299 - DNA, 557 bp, Lycopersicon esculentum
  Predicted polypeptide sequence is orthologous to G1075, G1076
aatatatacctattttcttactcatgctcattaattaatttcccttataattaatcatatatcatagtttattataccttagttttctgttcactacttttgttattgttatcgttatcgttatggctggtttggacttaagttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatcc

SEQ ID NO: 11300 - DNA, 861 bp, Lycopersicon esculentum
  Predicted polypeptide sequence is orthologous to G1078
cggaatcagaaaaaggttggtgaaaacaagcagaactatgcagcccaccatttgaataactgggagagtgaagctgagagagaagaggtacagtgcagcgagtggggagatcacgatcattacagtactacaacttcatctgatgatgacgacgatgaagaagaagaagtagaggaaaaggatgatataagatctgggtatgggccatcccgatcgaatttcgggtctactgcttccgtgaagaaatctgataagatgtcggaggacggtgggtcgtcttcgatgagttgggggaacggaaatgggaaagtggagatggtatctgatagaagtatagtggtgaggcacaaggatctagcagagattgttgctgccattaaggaacactttgataagactgcttctgctggtgagcaggtgtctgagatgttggagacaggtcgagctcagcttgaccggagctttaagcagttaaagaaaactgtgtatcattccggtggagtttttagcaccataagctccacctggtcttcaaaacctccattggcggtcaagtatcgttttgaacctagttctattgatgaaggtgggcaaaagagtctttgttccaccttggagcgactcttggcatgggaaaagaaactgtatcaggaagtgaaggcgagggaaggagttaaaattgagcatgaaaagaagttggcaacattacagagtcaggaaagcagaagtgatgacatagccaagttggacaaaaccaaggcctcaataacaaggttgcagtcactgatggtggtcacatcgcaagctgtttccactacgtcctctgccattattggcctaagggactctgaccttgtcccg

SEQ ID NO: 11301 - DNA, 641 bp, Lycopersicon esculentum
  Predicted polypeptide sequence is orthologous to G1078
gcttgttgaactttgtcatggatttatgtacatgtggaaatccatgaaccagttccatcaagttcagaatgacattgtgcagcaggtgcgtggcctcatcaacagagaaattaaaggtcaatcgacatctgacctacaccggcaggcaactcgtgaccttgagtctgctgtatctgcatggcactcgagttattgtcgcctgataaaatttcaaagggactttatccgatcccttcatggttggttcaagctcacccttgtatctgtcaatactgagccaactaatggcaacagggagttctcagattcttttatgttttgcgatgagtggaagctagcacttgaccgtattcctgacactgttgcatcagaagctatcaaaagcttcataaatgttgttcattcgatatatgtgaaacaaacggaggagttgaagatcaaaaagcggactgaatctgcatcaaaggagcttgagaaaaaggcttcgagtgtcaggaacattgaaaggaagtattacaattcattctccatggttggcattggacttcctgatgggggacctgataatggtaatattttagatgtacgagaccctcttgctgagaaaaagctgagcttgcagctagccaacggcgtgtgga

SEQ ID NO: 11302 - DNA, 375 bp, Lycopersicon esculentum
  Predicted polypeptide sequence is orthologous to G1078
cactttcatggcattttttcttcttcttcaccgtctccgcccatcgccgtcgcaacttctttagctccatagcaacaccagtaactgcgccgccggaatagccaccgtcaacggcggagacccatttgattttttttttttgatatttaacgatgggttgcgcggcgtcgaagctagataatgaagatactgtccggcggtgtaaagaccgccggcgattgatgaaagaagctgtttatgctcgtcatcacttagcagcagctcattctgattactgtcgttcacttcgtgttacgggttctgctttatctacctttgccgccggtgaaccactttctgtttctgatcatactcctgctgttctctccgtacgtc

SEQ ID NO: 11303 - DNA, 693 bp, Lycopersicon esculentum
  Predicted polypeptide sequence is orthologous to G1078
gctcttagaaagaaagaaaaaaaaaagaggaaaaaaacatcctctttcactgacacagttatactatattatttttttctctctctttttcttgttttgttgtttgagaaattttctttgtttgcagaggaaatggctatggctctgctggttaaggccaagtgggtattcccaatacttgcttttttacctaaaaacctctttctatgtttcaatgggttgttctgaaaccattcttaaaagggacatttttcgacttgttgtttctctctacagtagaatctgtgttcaaaaaaggaacttactttaatcccttttcacccccccacacatccctccaagaaagcaccttttttcaagaatctcctattttttgcaaagctgagtagggggaagaaatggggtgtgttgcatccaagttagaagaagaagaagaggtagtatccatatgcaaagagagaaaacagtacctgaaattggctgtagataggaggtacacactggctgatgcacattacaagtattgtcaagcattgtatggagtctcagcagctttaaaactctttgttgctcgtcattctacacctacttctccatatctcatcacattcccaccaccttgttgcccttcttctccaaaaaaagagtgtgtggtttcaaaccccttgtttcttcagcaaacaccttctgagc

SEQ ID NO: 11304 - DNA, 466 bp, Lycopersicon esculentum
  Predicted polypeptide sequence is orthologous to G1079
gaaacaaatatatgtggctaagcaaacccttggtgggtcaaaaaccacgggatgagaaaccacatggttgtttagtgatcttgataggtaaggatctgttattgagtgaatatatgtcgtgggacaatcaagctagttctggtgcctatggcctctgaaaataacttaatttggactttagataattggttggtgattatagtgatcctctcaattttgtccggaatatggatttactagtggtttggctgctgagatttgaaattaaactgtgcccggctgttatctgcaaaattttcgtcatctgcttattgctttggcttccattctttgaacaagctatctgttaacattagtagaatgctcttgttttgcctggaaactggaatgtttggaactttactcagtcattggcactgtataatgataactaagtggttggagttcaaaaaaaaaaaaaaaaaaa

SEQ ID NO: 11305 - DNA, 571 bp, Lycopersicon esculentum
  Predicted polypeptide sequence is orthologous to G1082
gtggattttgaacatgaggctgttaaggaagttcatgaggatcaaaggtttgtagatgaggctgcaactgcaagtggaagttattcaaaggcagttgaggagaatgagaaggcagctgattcagagtccatacaccaccactcaagaacaagttcatctgtggaggatgacccgattgagtatgaggtacacgtcgtggataagaaagtggttgatgatgcgaatcggggaaatgtagctggttccaagggtcgtagtttcaatagtgattctgatgtggtgaaggagattcaagttcaatttgagagagcttctgaatcagggaatgagcttgctaagatgcttgaagttggaaaacttccccacaatcgtaagcacgcgacatatcaagggatagtttcttccaagatgttgcacgcgattaccccttcctcggctgtactctcgctaccgtctactttaaagaacgatgcgattgagattgctgatcatgccattttagatgtagaaggagatattagttcaagagctagaaacatttcttccacattgcagaagctgtacctctggg

SEQ ID NO: 11306 - DNA, 698 bp, Lycopersicon esculentum
  Predicted polypeptide sequence is orthologous to G1082
agtaaccctaattcttacaactatccgaattatcccaattacgctggtgagtttttttcctcgtccattcaaaggccgtatggtgattcatctccaccggcgccatctggagctgggccttcgtcagcgccttctacttcaaaaccgcctcctccgccaccctctccaccgaggagctcaccttgggattttctgaacccttttgagacttttgagagtaataattaccctacaccatatacgccaagccgagactcgagagaggttagggaagaagaaggtatccctgatttggaagacgaggattttgagcacgaggttgttaaggaagttcatggacatcagaagtttgtcgaaggcgaaagtgaagttcacggagggaaccattcaaaggcagtggcagaggaggagagagagaagcaaagtgattcggagtcgctataccatgggaggccaagtgcgtcaatggaaaatgagcaggtggagtttgaggtacacgttgtggataagaaagtggtagatgaagaagggaagtcagggcatgggggaaatgttgctgggttcaaagctcgtgcattcaaggacgactctgatggtgtgaaagagatcaggttcagtttgagcaagcttctgaatctggaaatgagcttgctaagatgctgggagttggaaagcttccccacatcgtaagaacgcac

SEQ ID NO: 11307 - DNA, 499 bp, Lycopersicon esculentum
  Predicted polypeptide sequence is orthologous to G1082
gcttcattcatccatccatccctctctcactatgacttcttttccctttttacttaattactaattccccaattttaaattatggggtgcgcaacctctaagcatgatgacttgccggcggtcgctctatgccgtgaacgttgtgcctttttagaccaagctattcaccaccgttacgcttttgcggaagcccatctagcttatcttcactcattgaaatccgtcggcgcttctcttcaccggtttttccaaaatgatctcgatctttccacttcatcatcgggtagtcctctttccccgattctccctcatcccaaagatgaaacttcctctgcccttcctcatccagttaaaaaaattcaccattctcactctagttccggttcacaccttcacttccactcggaatccgacgaagatgatgattccggttccgactctttgcatcaccatacggaaacccctactcatggtcagttcacttatggtgatcatcaaa

SEQ ID NO: 11308 - DNA, 543 bp, Lycopersicon esculentum
  Predicted polypeptide sequence is orthologous to G1084
ccattacaggggagggagtgggttgaagcactaactgacattgaagaccattttgtcaaggcatatgatgctggaaaggaagtatcaaggatgttagaggcaaattgggtacattcacagcctaatttgggagaacccaaagagaactcaacaaaaatcatcccagcaattacttggaagtctcctgcatctcgttcaccatcatgcaagagtcttgtggcgtctagttccaagagttcttccacatggacagaattcaagaatgatctatttgatgattatggtggaatgggttctgggagccatttgctgacgctaggaaggctgtatgcttgggagaagaagctgtatgacgaggttaaggctggagatagcacttggaaattatatgagaagaagtgcaatcaactaaaaaatcatgatgccagaggagatgaaggacggaccgcagacaaaaccagagcagcagtaaaagaattatatagcaggatcctagtcacaattcgaagtgctgagaccatatccaaaagaattgacgaacta

SEQ ID NO: 11309 - DNA, 432 bp, Lycopersicon esculentum
  Predicted polypeptide sequence is orthologous to G1084
gagaagttattaaggatcttgaaagtcagtttgtgattgcttgtaattctgctaaagaggtgtcaactgttttagaagctatcagggctcagtactcattgcaatcgagtgatcaatcagcgatgaaaatgttgaatccagtagctctgtttcgctcaggatcatcaagatcatcctcgtcgagatttttgattaatccttcaactttaagagatgagggttatcatagcagtagtgacttatccgatgaatctagcgtgctctcaagcagtcatcaatcaaccttggatagattatatgcctgggagaaaaaactatatgaggaagtcagggcaggtgagcggatccggctagcctatgagaaaaaagtggctcaactcagaaatctagatgtgaatggagcagacccttcgtctgtggataaaacgagag

SEQ ID NO: 11310 - DNA, 507 bp, Lycopersicon esculentum
  Predicted polypeptide sequence is orthologous to G1089
ctgcctttcttcatgaagtaaaactctcggtctgaagaagaagaaacactacctcatatccataaacccttgaaaagaatatatctttctttacccaaaaccaaattaagatggtgcaaaaaaaagtcctcaacaaacttagtatcaaaactgatcatattataaaagccaacaaccaaataatgaaccacaaaccatctttccctatgttacaaaaccatgaaaccatcaagaatagaaaagctgaactcaagaaaaagatgatgaagaaatcaggcaaaaccaaactcttagaatatgaaatctccaactcaccaaaaaatttcagaaaatatgtacctcaaccaggcaaaccaccccctagtactactaactcatcaacgacaccaacgaagcgtcagcatcagcaacagcaacagcaacaacagcaatcaacatgtactccaaattatatgaaggccacaagcagttctgttgcaagaaaagagcaatctcaggttagttcaa

SEQ ID NO: 11311 - DNA, 500 bp, Lycopersicon esculentum
  Predicted polypeptide sequence is orthologous to G1090
gtataacatcagaatatagaggtgttagaaagaggaaatggggtaaatgggtgtctgaaatccgtgagccagggaaaaaaacgaggatatggctagggagttttgagacagcacagatggctgcagctgcgtatgattcagctgcatttcacttcaggggacatgcagctaagttaaatttcccagaattgattgaacatttccctaaaccagcaagttcttcgcctgaagatatacgtttggctgctcaacaggctgcaattacagttcaaaacacgaattcaatggcctcttctagtcatggacatggagcaccagttacagtaggattatctccaactgaaattcaagctattaatgacttccctatggattcaccacatatgtggactactcatgaagacatcaactatacttatgaaatgagtgattaccaagaaatggatgattgtctttgggactactcatcaactaactcattctagaggcctaatatatta

SEQ ID NO: 11312 - DNA, 1035 bp, Lycopersicon esculentum
  Predicted polypeptide sequence is orthologous to G1108, G2394
tctgaatttactgggtgattgtgaagaggagaagaatttttcatctggtgaactcatacttcactgcttaagacttttgcatcccatgtttcctataattatctctcagtcagtggacttagatggccatttcctcattggggctacaccggaaaagccaaactaaccagtttcaattattaatggagcaagcagataaccgtagcaacgatgagcatgtaattgacataactagtagcaatgatgcatcctcatcaagcaacccccatgatagaccagttaataatgtgcttcatgtccaagctgaacatcccccatcaacaagcacaacagtgcccgtctcccaacatgcattttcttctgctagtagatccaacttgaggaactcatcatttgctcgaagaggaagtgggcgccgccatcggagtcctctgaattctgtgctctggatatccattgaactagtcttgacattgagccaaataattgcagcaatcgcggtgttggccatatcaagggatgagcacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggttgtgtatagtatttctgacctttagctgtatcgggtatgccatgccatttattctatgtgcaacaatatgctgctgcctcccctgcattatttcagtcatgggcttccgagaagatctgactcaaa

SEQ ID NO: 11313 - DNA, 1052 bp, Lycopersicon esculentum
  Predicted polypeptide sequence is orthologous to G1108, G2394
cacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggtgatctttcactgttgttttcattttggggtgtttccttactttctatcatctctaccagcatcatatttgctcatgtttctattcatccgtaggttgtgtatagtatttctgacctttagctgtatcgggtatgccatgccatttattctatgtgcaacaatatgctgctgcctcccctgcattatttcagtcatgggcttccgagaagatctgactcaaaacaaaggcgccacaccagaatcaattaatgctcttccgacctataaatttaaggtaaagaaaaacaaaagtggcaacaaagaggctgctgaaggtggggttgtggctgcaggaacggacaaggagcgtgtgatttcaggagaagatgcggcatgttgcatttgcttagcaaagtatgtgaacaatgatgagctaagggagttaccctgttctcatttcttccacaaggactgtgttgataagtggctgaaaatcaacaactcatgtcccctttgcaaagctgaggtgggtgagacccttttgagctctctaacggaagcaactgcaagtttgcgtcagagttccgcgttttaagttacgactctgcccacatgctagtatagagatgctttttaaaggaatagtagttaccttcatatatattttattttcttccatcactcttct

SEQ ID NO: 11314 - DNA, 919 bp, Lycopersicon esculentum
  Predicted polypeptide sequence is orthologous to G1108, G2394
ccaatctgtacagattatgtatagcttttcttaccattagttgcattggatatgctatgcctttcatcttgtgtgcgatgatatgctgctgcctgccttgtatcatttcaatcctcggtgtgcgtgagaatatgcatggagtgagaggagccacagaagagtccatcaacgctcttcccacactcaagtacagggtcaagacagatggaactggaagtaatgaaagtaaaaatctagaagaggaggaaggtggttgtgtagctgctggcacagagaaggaacgtgccatatcaggtgaagatgcggtgtgttgtatttgcttagcaaaatatgaggacaatgacgaactgagggaattgccttgctcgcatttcttccatacacagtgtgtagataaatggctgaagattaatgcgacttgccccctctgcaaatctgaaattgacgccaagaacagagatctaccttctgtagaagaggaacccctccaacaatcctaaggtgatgcagaaaccaacttcttatggttgaaacacagatcatcgcggctagcttgttgcatggggaaccaggagagtatatcccaactgttacttcttctgctgttgctgctactgctactgctgtttctaccacacgaatttcagtttgtatagttgtagctcataccaggtatccataacaagcttgaaagaagaggtaattccattgttgatacccttacatctctctcctgcctcaccagctatatgttgctcggaacttccaaaaaaaatgtcagttgcactcgtgttggatcttcaaaaaatgcatagcttttggaagatctaaaccgggcgatatttttgaagtgtccatcatctaatgcaaacatagcacactgtataaatagatttaagggtaaagctgggtgtacacc

SEQ ID NO: 11315 - DNA, 516 bp, Lycopersicon esculentum
  Predicted polypeptide sequence is orthologous to G1108, G2394
cgcataaaaaagttaaaaaaatcgaagccctaatttcagagaaatcttcatactgacgaactttatcgatcatcaaatataatcgctggtaggctttgcttgtgagtataaggtggtagctgaaccagtagcaatattttcttgagatttatggttgaatggctgttacctcggaagaacttaatcaagagaacccaaccgacagatttcctttgctcatggagcaagcagaaagtcgtgagaggaatgaacatgttattgatgtagaacaaggaagtagcccctcatcatcaggctcatctgataatgattctcctcatgaattggaaatacccaaccatgaaaatagaccatcaaatcgacattccgtctcttcttcgtccaacgaatcagattctcatagcccttctagtgctaggagagctgatggttctgatcgtcgttggagcccatttaatactctgttgtggctttccattgagctaatattcaccttaggacagattggtgctgccg

SEQ ID NO: 11316 - DNA, 742 bp, Lycopersicon esculentum
  Predicted polypeptide sequence is orthologous to G1128
ggtcgttcaccatccactatcagatttcgaaggttgcttccaattttctggacatactttaagcgtgaagaagtgtaaaaaggaatggcaagatttgcacgaggtagaggtagaggtcggcgaggtggaaggggccgtgggcgtggtagtgttgaaggagtacgtgataattttgcagtggtgtcatccgtaaatattaacccatcacatagacctacacttgatcaatcatctcagccacaagcacaaacaatagggattcccgaagcaattcagtgtacttctccaggctttcagacccctggaacaagtcaaaaacaattgtcggggtcacaattatcaaggaatatggaaggaagtgtacatccctcttcagtgaatttaaatagtggtgaaggttagttttctcgcatttgacttataagtggtctgtttccctcttctctgttgtactttggaaaattattatgcaatttttacttgcattgttcattttgttttttcaataacattttagtattctgttgttgctctttcaatgcctttggtcaatttcgtagagtctattatgtactatattgttgtacagttatgttttgataagatgattctgtcatgagaatcttcatggatgtataacatactgatttttttttttgataactgagcaatccactgggtcacggttcaaaactcggtgagtagtggctctgacccttctccatttaaacatggtaattta

SEQ ID NO: 11317 - DNA, 1580 bp, Lycopersicon esculentum
  Predicted polypeptide sequence is orthologous to G1133, G1137
gtctctctataattccctctgcttttactctcttaccatcaaaaaaattcaaaaatctctctgggtttttaattatactcaatttgggttttgtttctgcgattttcattcactgagctttgagagttggtgaaaagcacagaaaaacagtagtcttgaggttattgtttaaattgaggaacagtatgctgtgttgttgtctatctgttgatgtttatcgaaaagtcatctccttgaacttgtactgtcatgtaattctgtagaagtaggaaaaaagaagagtttatttgtgaaatcttgattagtttttcagtttttgaaccttgggaaattgtattcttgttagtaatcttccatgggatccacacatttcattgtcataccgtgttatgttctgaggattagctgagaatctattcctcttcagaatacttagttttactggtgttgtctttgttgttgaatcggggattatcggggatattagttttcactgttgctagttaattttgggtgtggttatctttgtcatttcttctaaaaagtagattgagttaattgcgcggagtagtattgttttccaagcattttttggggggagttgtttgaaatcactggtgtttttgattgttctggtggaagattgtggttgaagggttggaacaagtagttatggtgtgccaagcagctggccagacaagatttcgggcattaaaacatgaaaatggaattgcggggtgtgccaccataattgttagagttatagcatgctttcaacctcttcaggattgccaggctgaatatttccgacagttgttgaaacctgtcacgtagtttcgtctttcttgttgttgcatcttagttaagctggatttttttggattttctgttgtttctcaagtgtacaaggaataatctgcaatttgtattacctgagttatttagaactggtgattgttgtggttgaatggaaagagactttgtatcgtggttccgtcgccagtatcctgatctgcaatctgcccattcgaacttttctagtcgtggactcaatattgggcagcagaattctgttcctatttacatgcctccgtatgcaaatgaggttccagtaaaagggagttctcccttgtcgttttcggggttgctagaaccaaaggcaagccaaccaactgaagctcacaattggttctactgtttaccacagttgcaacagggttttgctcctgttttgagcactgtaccgaacgagaagtttgctcctcagtctgttgacaattacggggtaaatgaagaagccaatgctggccccggattctcgcagaaaagatttcttgtttttgatcaatctggtgatcaaacaactttactttacagttctccaaatggtactcctgtgcaatgcctaccctcttggcatccaaaatccgctgcaccttgtcatctgattaaggaaggccaacagattttagggaacggaatttgtccatctgggaaatactccggtggtgaatattatgaagaaaatcatagagatgatgtataaagtgaattgcatgaggatactgacaaattgaatg

SEQ ID NO: 11318 - DNA, 944 bp, Lycopersicon esculentum
  Predicted polypeptide sequence is orthologous to G1133, G1137
gttttattgagtgaaacggttgggaacaagtagttatggtgtgccaagcagctagtcagacgagatttcgggcattgaaacatgaaaatggaattgatgggtctgccaccataatagttagagtaatagcatgctttcaacctctccaagattgccaggctgaatacttccgtcatttgcttaaacctgtcacgtagatcgatctttctttaccgcgttcaagttaagctggagtttttagtttttctttatttagcaagagtgcaagaaataatcagcaatttgtagtttcacagttgtttcaaactggtgattgttaaggttgaatggaaaaagacttggtctcttcattccatcaccaacattcagatctgcagtcagcccatttgaatttttcttatccacgatttgatatagggcagcagaattcttttcctacttacatgactcctcagtcaaatgagattcctttaaatggggattctccatatttcacatttcctgggctgccagtgtcaaatgcaagctggccagcagaaacttgcaattggttatattattcgcctctgttttatcagggctttaatcctgtttcgaccactttacctaaagagaagttagctcctagagcacttgaaaatctggaaggtagcaaacatcctaatggaggcaccacatctactcagaagagattccttgtgtttgatcaatctggtgatcagacaactttgatctataattctgctaatggtactcacgtacaatgcccggcttctctgaatccaaaagccccagccctttataaggaagatccagagatcaaaagaaatgaaacttctccatttgggcatttcttcggtgatgaatattatgaagaaaacaacagagatgatgttgaaagtgaaatgcatgatgatactgaagaactgaatgccctactctac

SEQ ID NO: 11319 - DNA, 571 bp, Lycopersicon esculentum
  Predicted polypeptide sequence is orthologous to G1133, G1137
gatgatgttgaaagtgaaatgcatgaggggactgttgaactgaatgccctactctactctgatgatgattacaattattccgaggatgatgaagaaacaagcactggtcactcgcctagtactatgaccactcatgatatgcgagagtgttttgacggaaggggtgaagaagttgctagttctgctggggtgactaaaaggcataaactgctagatggtagctacgatgcaccagagctcagggatactgcaacctccgcaaaagcctatacgtgctccgacttagaggatgatgcacaatccagttgtggcaatggtctcgaacaagactcaggagcaccagattctccatctgggaaaaagaggctaagaaaagataaaatccgcgagacaataagcattttgcaggaaataatccccggagggaaaggaaaagactcaatggttgttattgatgaagcaatccattacttgagatccctgaagatgaaagccaagtccctaggacttgattctctttgagcttcagcttgccactggtcatcatattgagttactaatggtatttttc

SEQ ID NO: 11320 - DNA, 851 bp, Lycopersicon esculentum
  Predicted polypeptide sequence is orthologous to G1134, G2555
gccagtttggactatctttctccatccgttgatgtttcgcagtccgctaagcgaacccgagacgatgattccgaaagttcccccagaaaattagtatcccagttgaaaggagagtcaagtgggcagttacatggttctggtgggtcactggatgctgaaatggagaatctcatggatgatttggtgccttgtaaggttcgagcaaagcgtggctgtgctacccatcctcgcagcatagcggagcgggttcgtcgaacgcgtataagtgacagaattaggaagcttcaggaactggtgccaaatatggacaagcaaaccaacacagccgacatgttggaagaagcagtcgaatacgtcaagtttctgcagaggcagattcaggaacttacggagcatcagaagaaatgcacgtgctcaatgaaagatcaataatgagaagaagagagctccactagagtatataggcaatagtttggttagttgcatgcagtttagaaatggtaattcactcctatatatcctattcttcttcatgtgtagatattaatggaaatttgcaagagctttgctactttagaatccagagtcagctttggcttttaattattaaatttaggttgtacacttttctggtgcagttgtatcatgttgtatatgtagtgtcaatttgcttaatagtcaaatttttgcagcagaaacacttccctttctgaagatgtaatcatgatttgcagatccgtcatgttaaaatcaatataaatcgttgcatcagtgtgaagtttaataaaaaaaaaaaaaaaaaaaaaaaaaaaaaaaaaaaaaaaaaaaaaactcgagggggggcgcggtac

SEQ ID NO: 11321 - DNA, 511 bp, Lycopersicon esculentum
  Predicted polypeptide sequence is orthologous to G1142
gagaagagaaaggattaattctcatcttcatagcctcagaaccctactatcttgcaattctaagttggataaagcttcattactagccaaagttgttcaacgtgtaagggaactcaaagaacaaacttcacaaattatgcaaagtgaaacaaacttattattcccttcagaaactgatgaaatcactgtgttatcatcaaatgattgtttagctgatggaagattactcatcaaggcctctctttgttgtgaggatcgattcgatctcatccctgacctaattgaaaccctaaaatcacttggattgagtcctataagagctgaaatggtcacattaggagggagaatccataatgtgattgtattagctgttgatcataaaaaggagagtgataataacaatactgatcatgatgaatcgtcgttattgttcttgagagatgctttgaggtctatagttcaacgttcgagttatggtacaggtgaacgaggtgaaagacgaagagtatta

SEQ ID NO: 11322 - DNA, 710 bp, Lycopersicon esculentum
  Predicted polypeptide sequence is orthologous to G1143
cagtactgcctcttcttttagctgcactcaacatattaatcattagcaccaatactctccatctatagatttcctttctaatttaggaattcattttaacatatttataacaatattctcttttaaatggtagtaattaggtgtgctaaaatggaattccccagtaccccatttgataattcaaacaactctgaagaaagggaagtaggaagaagaacagataaaaggaagcaaattgatggtgaagttaaagaatacaaatccaagaaccttaaggctgagagaaataggcgtcaaaaacttagcgaaaggcttcttcaattacgctcattggtcccaaacataacaaatgcaatgaatcaaaaaccttcattctttacatagtttcataaagaatgaatttttttaaaaaaaatctaaaaaagtttaaattcttgtctgatttcagatgacaaaagaaaccataatcactgacgccatcacctacattagggagctacaaatgaatgtggacaacctaagtgagcagcttcttgaaatggaagcaactcagggggaggaactggagaccaaaaatgaagagattatcgatactgcagacgagatgggtaaatggggcatagagcctgaagttcaagtggctaacattggcccaactaagctttggataaaaatagtctgccaaaagaaaagaggtggattaactaaac

SEQ ID NO: 11323 - DNA, 621 bp, Lycopersicon esculentum
  Predicted polypeptide sequence is orthologous to G1145
gattgatcatttgagaacgttgacacattgatattggtgaatggtaattcaagaaatgggatctcgggggggaggtgaagcaaaggcaaatgctttagctacgcaaggatcactctacagcctcactcttgatgaagttcggaatcaattggggaattgtgggaaaccactcaatagcatgaaccttgacgagtttgttaaaactgtatggactatcgagtctaatcaagaagtggtggggggaaatgattacgggccagtgcagcaaggggcttctcagcatcatccatcgagcattacaatgtccagggatctcagcaagaagactgttgatgaggtgtggcaagatattcagcagggggtaaaaatagataatgttgataagagaagccaggagaggcaactaactttaggtgagataactctggaggatttcttggtcaaggctggagtgattgccgagtcgacccaaggcaagagaatttcgggtttagtttttggggttgattcaatgtcattgacacagcaagctcagtggacgcactatcaaatccccgcaatgcaacaggtaccagaacagcagcatcaacaacaacagcagaatataccaccagtttttat

SEQ ID NO: 11324 - DNA, 245 bp, Lycopersicon esculentum
  Predicted polypeptide sequence is orthologous to G1145
ggctcaagacccaaagacaaatgctttggctaggcaaggatcattatacagccttactcttgatgaggttcaaaatcaattgggggatttggggaaaccattgagtaatatgaatcttgatgagcttcttaagactgtatggactgtggaggctagtcaaggaatggggggaacggattacggggtgttgcagcatggtcaggatgcttcggggagttctttgaatcgacaatcgagtatcacac

SEQ ID NO: 11325 - DNA, 654 bp, Lycopersicon esculentum
  Predicted polypeptide sequence is orthologous to G1145
catacaataagggcagaaggtgataaatcttgaggagatgaacagccaggagagagagctaacccttggtgagactactttggaggactacttggtgaaagccgggcttttcgttgctgatgcttctttaggacatacaatgtcattggataatcctacggcaatgcaaaattttgtgcctccaataggcttgtcaccatctccttcgctgtctgatacaccagtttctgaccggaagaggggtgctatggacatcgataagactattgataggagactaaggagaaagatcaagaatagagagtcagctgcacggtcccgagccagaaaacaggcttaccacaatgagctggtgaacaaggtgtcacatctggaagaggaaaacatgaagcttaagaaagagaaggaactggagaacatgttatccgagttgtcgtctgaaccaagatatcagctaagacgaacgacttcattctgatcgagttctttggcagaagttactatagtcattatagatataggatttgtgtatcctctatgaaacatcttattaggtagttgggagatagatgttagaatgtttgatctttgtttttatctgtatatgtttatagatgcacatgaaaaaactgaagatgaaatggactctttact

SEQ ID NO: 11326 - DNA, 2257 bp, Lycopersicon esculentum
  Predicted polypeptide sequence is orthologous to G1146
gctgcaagaattcaggattagtctgaacacgtgatgtgtcatctacaccggtgtctgatgctgaccgtgtgaagatcaaaaaagcactgagaggtgtgaaggtggaggttactcatcgtggaaatatgcggcggaagtaccgcatcgccaatttaacatctcaagcaacaagagagttaactttccctgttgatgaaaagggcactttgaaatctgtaattgaatattttcgagaaacttatgggtttgttattcagcatacccagtggccttgtctgcaagttggaaatcagcagagacctaattacttaccaatggaagtctgcaagattgtagagggacaaaggtactcaaagcgcttgaatgagaaacagataactgcacttctgaaagtgacctgccagcgcccccaagaaagggagcgtgatattcttgagactgtgaagcataatgcctatgctgaggacaaatatgcgaaggagtttggcattaagattagcgacaagttggcacaagttgaggctcgtattttgcctccaccttggcttaaatatcacgataatggccgagaaaaagattgtctgccacaagttggccaatggaacatgatgaacaagaaaatggttaatggaggaactgttgccaattggatctgcataaacttttctcgcaatgtgcaagacactgttgcacatgggttttgttctgagcttgcacaaatgtgtggaatatctggaatgaacttcaacccgaatcctgttctgcctcctgtaagtgcacgccctgatcaggttgagagagttttgaaaactcgatttcatgatgccatgacaaagctgcagccgctatcgaaagagcttgatctcctggtcgctatcttgccagacaataatggctctctttatggtgatctgaaacggatttgtgagactgaccttggagttgtttcacagtgctgtttgacaaaacatgtatttaagatgagcaaacagtatctagccaatgtagcactgaaaattaatgttaaggtgggaggaagaaacactgtgctagttgatgcaatatctaggcgaattccccttgtcagcgaccgtcctacaatcatttttggtgcagatgtcacccatccccaccctggagaggactctagcccatccattgctgcggtggttgcttctcaagattggcctgagattactaagtatgctggtctagtttctgctcaagcccataggcaagagcttattcaggatctgtacacaactaggcaagatcctgttaaagggactgtgtccggcggcatgattaaggacttacttatctccttccgaagagctactgggcaaaaacctcagagaatcattttctacagggatggtgttagtgaagggcaattttatcaagttcttctttatgaacttgatgccatacgtaaggcatgtgcatcattggagccaaattatcagcctccagttacatttgttgtggttcagaaacgtcatcatactagactttttgctaacaaccaccgtgatagaaatgctgttgatcggagcgggaacattatacctggtactgttgttgattcgaagatttgccacccaacagagtttgatttctatctttgtagtcatgctggcatacagggtacgagtcgtccagctcattaccatgttctatgggacgagaacaagttttcagctgatggactgcagtcattgacaaacaacctgtgctatacatatgcaaggtgcacacgctcagtctccattgtccctccggcctattatgcacatttggcagcttttcgtgctcgtttctatatggagcctgagacatcagacggtggatcagtaacaagcggagctgctggcagaggggttggtgcaggagctgctggaaagaatacacgagcaccaggtgcaggttctgctgttagacctcttcctgctctcaaggataacgtgaagagggtcatgttctattgctagagtctcaacaaacaaaagcttcattgaagacttcatttggcgcatgcccttttggtttttgtgttttgcgatcaaacaaaattttatctggttcgacttgccctaatatttgtgacattgatgccagaaaactatttagagtttgtagtattgcgcattattataactgttgggagcattccggtgttcttcatagcctgtgtaatgatgaatactatgcaaatttatgcttgtttttaataaaaaaaaaaaaaaaaaaaaaaaaa

SEQ ID NO: 11327 - DNA, 971 bp, Lycopersicon esculentum
  Predicted polypeptide sequence is orthologous to G1146
tttttttttttttttttggatggacgtttgagtaaaatatcataaaatactgaatgtacgaaaaaggaacagagtaaaatataattgaacatttactgtcagctgtgatcataacttcgtcacacaacgtgcagttgcaaaaagcataaccatgatctgtaaagcccacagaccaacttaaaaaaaaatagtttaacataaaagaagatttctactgaatacttcttcagcagtaaaacatgacctccgacacattttcatgaatcttaggaagttgcctgaattgtgctgctgctcctccctcaccaccttcattagcagctcttacatccacgtcattctccatgtaatagcgtgcacgaaaggcagctagatgtgcatagtaggcaggtggtactaaggaaactgatcgtgtacacctaacgtacgtgtagcacaggtagttcgttacattctgaatgccatctgcggtgaaattgttctcatcatacagtacatggtaatgcgcaggacgactggtacccttgatcccagcgtggctacataagtaaaaatcaaactcagttgggtggcatatgttggtgtctaccacagtacctggcaaaatatttccactcctgtctgtcaaagtacgatcatcatgattggaagggaatagacgtgtatgatgtcgcttctgcactaccacaaaggtaactcgtggcatataatcactttgcagggcaacacatgccttgcggatcgcatccatttcttccaataaaacctgattgaattgtccttcgctgactccatctctatagaagattattctgtcaggcttaatttttgtcgcggcataaaacgctttcagcaggtccattatcattccaccgcgaacaacgccccttttagaatcttccttctccgtgtacaagtccataatgatctcttgcctatggggctgtccagaaacaatacccctatatttc

SEQ ID NO: 11328 - DNA, 1335 bp, Lycopersicon esculentum
  Predicted polypeptide sequence is orthologous to G1146
tcgatctgttgatcgtcatattgcccgacaataatggctccctttatggtgatctaaaacgaatttgtgaaactgatcttggcattgtctcgcaatgctgcttgacaaaacatgtgtttaagatgagcaagcagtatttagccaatgtgtcccttaaaattaatgtgaaggttggaggtataaacaccgtgcttgttgatgcgatctctaggcgaattccccttgtcagcgaccgcccaactattatttttggtgcagatgtcacccatccccaccctggggaggattctagcccgtccattgctgcggtggttgcttctcaagattggcctgagattaccaagtatgctggtctggtttctgctcaagctcataggcaagagcttatacaagatctgtacaagacttggcaagatccaactagaggaactgtgactggtggcatgataaaggaattgctgatttccttccgtcgagcgactggacagaagcctcagagaataatattctaccgagatggagttagtgagggacagttttatcaagtgcttctttttgaacttgatgcaatccgcaaggcttgtgcatctttagaacccaactatcagcccccagttacgtttgtggtggtgcaaaagcgtcaccacacaaggttgtttgccaacaaccaccgtgatcgaaatgctgtcgatcggagtgggaacattttgcctggtactgtggttgattcaaagatctgtcaccctactgagtttgatttctatctctgtagccatgctggcatacagggtactagccggccagcacattatcatgtcttgtgggacgagaaccaattttctgctgatgggctgcagtctttgactaacaacctttgctacacatatgctaggtgtactcgttctgtctccattgttcctccagcatattatgcacatttggcagctttccgtgctcgtttttacatggaaccagagacatctgacggtggatctgtcacaagcggagctgctccgtacaaaggtggtgtaggagctgttggaaggagcacaagggcgccaggtgttggtgctgctgtaaggccccttcctgctctcaaggagaatgtcaaaagggtgatgttctattgttagaagtcctctctaaccaggctatatgatatggacatgctggagtaatttcttttcaaattgtatgtgattatctcaccttgatgtttatgaaagttcagttgtcagttaaacagtagtttattcgcaagtgatgtttgtaaattgtggcttgaacaattgttattgaagagcatggctagttatttaaaaaaaaaaaaaaaaa

SEQ ID NO: 11329 - DNA, 961 bp, Lycopersicon esculentum
  Predicted polypeptide sequence is orthologous to G1146
ggtgggccttctaggccaccaattcccgagctgcaccaagcaaccacacagactcaacatcaagctgtaatgactactcagcccattacttgtggaagaccagctgacacatccatggaagtgggttcctcatctgagccacctgagatgtcagctctgcaagtgacacaacagttccagcaactggctgtgcagccagaagcagctgcaacccatacaattccacctgtgtcaagcaaatcactaaggtttccgctgcgtccagggaagggaaagtttggtcagagttgcatagtgaaagccaatcacttctttgctgagctgcctgacaaagacttgcatcagtatgatgtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtattgtccagtaggtcgttctttctattctcctaatttagggagacgacaaccattgggagagggtttagagagctggcggggtttctatcaaagtattcgccctacacaaatgggattatcattgaacatcgacatgtcttccacttccttcattgagccattgctggtcgttgattttgtggcacagcttctgaaccgggatgtgtcatctagaccactgtctgatgctgaccgtgtaaagatcaaaa

SEQ ID NO: 11330 - DNA, 634 bp, Lycopersicon esculentum
  Predicted polypeptide sequence is orthologous to G1146
ggttgtcatgaaaattgcatgactgacggcatggtcaattggtgtttgcaattggtatatactcctatatcactcttctgtaggcctagtcctttactctgggtctatgagtttgctggtaacttgttatcatgcagactgggattagctttgatagcctaaactgagcccaagttgtagtgacttctggctttctgggactccaagacattgtctgcatgtcttgcatagtttgtaattactttttagaaattcagttgtcgtaagatggctgatggattttggtgcgaacaatggctttcccaaaggacagaaatgctgaaactttgaatgaaggctaagtgtttgcagtagaaaacttaattcatgtattgcgatgcatggaattgagtaagaagaatgaggacaatgttgtcaatcagatgaccatggacttctattttcatgaaatctgaacacactgaaacagagaaactataaaaagttaagtgaggaaagacggcacgtgagaactgaatcagggattttgatgaaagctagttttacttgatcaagaaaaaattaactggataaagataagaggctttctgaagaataataaaagcaggaaagtgtgagttatatattaattact

SEQ ID NO: 11331 - DNA, 898 bp, Lycopersicon esculentum
  Predicted polypeptide sequence is orthologous to G1146
gacgcagatgggattatccctgaatattgatatgtcttccacagcattcattgagccactgccggtcattgaatttgtgagccagcttctgaatcgggatatctcttctagaccattgtctgatgctgatcgggttaagataaagaaggccctgagaggtgtaaaggtggaggtcactcatcgtgggaatatgaggaggaagtaccgcatatctggtttgacatctcaagcaacaagagagttgactttccctgtagatgaaagaggtaccatgaaagctgttgtggaatactttcgagaaacgtatggttttgttattcagcatactcagttgccttgtcttcaagttggaaatacacaaaggccaaattatttgcctatggaggtctgcaagattgtggaggggcagaggtactccaaacgcttgaatgagaggcagataacagcacttctgaaagtgacctgccagcgtcctcaagagagagagaatgatattcttcagactgttcgtcacaatgcttattcagatgacccatatgcgagggaatttggtattaagattagcgagaagcttgctcaagttgaggctcgcattttgcctgcaccttggcttaaataccatgatacaggtcgagaaaaagactgtctaccacaagtgggccaatggaatatgatgaataagaaaatggtaaatggaggaacagtgaacaactggatctgtataaatttttctcgcaatgtgcaagacagtgttgcccggggattttgttctgagcttgcacagatgtgcatgatatcgggcatgatcttcaacccgaatcctgttttaccaccagtgagtgctcgccctgatcaagttgagagggtcctgaaaactagatttcatgatgctatgacg

SEQ ID NO: 11332 - DNA, 498 bp, Lycopersicon esculentum
  Predicted polypeptide sequence is orthologous to G1146
tttttttttttttttttttaacctggctataatgctaaactaattaccattaattgaaaataaagccgctttacatcattaaaactaacatgacaattaacctaggatgatcaacatacatttacaaacaaagattcatgtggtctgaactgaaccccctacttactatttgttacatttgctactcacttgttatctcttcttcctaacaataaaacatcactctcttcacattttctttaagagcgggcaatggcctaacacccgtctctcgtatagccttgctgctgccttgatgagggctgcctgaattagtttcaggcatgtctggttccatgtagaatctggctcgaaatgcagctaaatgtgcataatatgcaggaggaaccacagagacagaacgtgtgcatcttgcatatgtatagcagagattgttagtcaaggactggattccgtctgctgtgaaattgttttcatcccacagaacatggtaatgtg

SEQ ID NO: 11333 - DNA, 634 bp, Lycopersicon esculentum
  Predicted polypeptide sequence is orthologous to G1146
ccggtaaccttcatagttgtccaaaaacgtcaccacacacgtcttttgccaaataaccacaatgacagaaatcaccacctgaccaggagtgggaacatcctacctggtacctgtggtggatacaaaaatatgtcatccaactgaattcgatttttatttatgtagtcatgctggaattcagggaactagtcgtcctgcacattatcacgttctctgggatgaaaataatttctccgcggatgaaatgcagtctttgacaaacaacctttgttatacatatgctcgttgcactcgttctgtttcagtagttcctcctgcatattatgctcacttggcggcctatggagcgcgtttctacgtagaaccagactcacgtgacaacggttctatacgtggcacacgtgcaacgaatggttctgtcaacgtccggccgctaccagcattgaaagagaaggtgaagaatgtgatgttctattgctagagggtgaatgttgagtttatgttatatagtagtagtgagtagataaaatgtatgaaattaggatatgaaatgttatgggtatgatatacatcataattagagtcaataaattataatttaattttcatgcaataaaaaaaaaaaaaaaaaaaa

SEQ ID NO: 11334 - DNA, 445 bp, Lycopersicon esculentum
  Predicted polypeptide sequence is orthologous to G1146
gctttatgatctttcttgtttgttgttcattagggtaccagtcgtcctgcgcattaccatgtactgtatgatgagaacaatttcaccgcagatggcattcagaatgtaacgaactacctgtgctacacgtaaagtcttttgaactttatttacttggaattagtatatctttttattatctcaaatcatataatcatcatctttttttcatctcacaggtacgttaggtgtacacgatcagtttccttaggttagttttcgcctacttggtggttttaaaaatttgtctgttttacagttactgaattatttgcacaacttattatggcgttatttacacagtaccacctgcctactatgcacatctagctgcctttcgtgcacgctattacatggagaatgacgtggatgtaagagctgctaatgaaagtggtgagggaggagc

SEQ ID NO: 11335 - DNA, 693 bp, Lycopersicon esculentum
  Predicted polypeptide sequence is orthologous to G1181, G1850
cccacacccactcacctctatgtggcgccggaaacttccagaatcaccgaaaattccgacggtcgtcctctctgtagttttggctccagatctgtgagaatagcttcatcgatcttcactcaattcgtcaggtaataagaagagatgactccacagccaatagaccggaacaaaggagagacgacagccggtgaaacgccgaggtctgtgccgacaccgtttttaacaaagacctaccagctcatcgaggatcaatctattgacgatgtgatctcttggaatgaagacggatctacttttatagtgtggaatccaacggagttcgctagggatttgcttcctaaatattttaaacataataatttttctagcttcgttaggcagctcaacacctatggatttcggaaagtagtacctgatcgatgggaattcgcaaacgacagcttccggagaggtgagagaagtcagttagttgatatccagcgtcgaaaggttgccacgccgattgctactccttccgcagctgcaacagcggtggcgattgtggcttctccgcctcagcctccacctccacctccgtctccgtctccgcctccgcctccgcctgctcaaccaccggtggctgtatctacctctgattcctgtgaagagcaagttctatcgtcgaactcatctgcaggtagcacagcggag

SEQ ID NO: 11336 - DNA, 764 bp, Lycopersicon esculentum
  Predicted polypeptide sequence is orthologous to G1181, G1850
gaagctctgcggcaatatatatggtatgatgtcgacttacgcacatccttcgagcagcggtaatcaatcggcggagagtagttcgccttcgttgaagccactggatctgttagggacggaacggtccgtaggtgaatctcaggtgaaggcggtagaggaccgggagagccatgaggtaccggaggaagcgcaggcgagattattcggtttctcgataggcatgaagcgtgttagggaaggggaacaagcaatgatggagcattgtcatgatttacggctgcggcaacctggaacaacggatgttaaagtagaaccgtctgatcaggaaagtaacggtgaaagtgaagagagatcgtggctgctacattgcggtggaagaaatcaaaggacttgtaattgatagtttgttggtgtgatgaaccttaattagatttagattagagattagctgtgatgataatcgagattatattagagattagctgatcaaaatcgaaagaggtgataattacgtgacggactaaatcttgaagaagcttcttcggcccctttttaatttataattatgtccttattgttacaaagtattttcttttgtagcagtaaaaaatagatcttttttgaaagagctgacggcggagaactgtttgagaaaaatgtgcaaaggaaagtacgtttatatccttgatccttttgtaattttgccagcccaaagaaaaattgttgattttttttctttcgggtaaaaaaaaaaaaaaaaaaaa

SEQ ID NO: 11337 - DNA, 1276 bp, Lycopersicon esculentum
  Predicted polypeptide sequence is orthologous to G1190
cctctctggtcctccagtgaactatcaacgtcgttggagaggatggaataccactattgaggagcaaaaatcagattacgataagttacaagaactactaacttcaatgtgcttcaaattattcaacaagaaggacgacattgctgtgtggcggaagctgtctgacaatagctgctataagaagcttgataatcctgacaactatccctcaaaatgtgatgatggtactgaacctgattcagcgtggtacacccctcttcgtccttgtgtagttgttccaaatccagctgctaagaaagtcaagttggatgccctccccaagtggccagaaagattgcacactgctcctgaacgcgtttctgatgttcgtggaggtagtgctggttccttcaagcatgatgatggtaaatggaaggctcgggcaaaacactacaagaagttgctccctgcacttgggactgacaagatcagaaatgtaatggacatgaacaccttttatggaggtttcgctgctgctgtgatcgatgatccgttgtgggtcatgaatgtggtttcatcttacgcaccgaatacactttctgtggtctacgataggggtcttattggaacaattcatgactggtgtgaggctttctcaacatatcctcggacatacgatcttctgcatcttgatggcctcttctctgccgaaagtcatagatgtgaaatgaaatatgttcttctggaaatggatcgtattttacggcccaacggttatgctataatccgagaatccagctatttcgtagacactattgctactatggctaaggggatgagatggagctgtcgtaaggaagaaacagaatacggcgtagagaaggagaagatattgatttgccagaagaagttatggtattcaaagcaaaattcatgaacaactttgaacatcatagcataaaacacagttgctgataatggagagaaaaagttatatatttaatattggcatcataggagataagtaagtccatacagcttatatattatatatatatcattttgttcaacaaatcattggagattgagattttgaattgaagaatcaatagccaagaattaaccatattatgatggcttgttcatgcaatacattctttgttaaggcccaaaggtttttctttgtggatcagctggccctcggagatttctcgattataaaaagacggagcgttttaatctttgggtggattctatttttattttatttttttgggaaaaaaaaaacattgcagct

SEQ ID NO: 11338 - DNA, 1171 bp, Lycopersicon esculentum
  Predicted polypeptide sequence is orthologous to G1190
tccaaagaattcggcacgaggacagctattcacaggggataacaaagccaagaatctcaaagagggaaggataagaagatgatataaaaatagtttttattttttttattttgtgattttcttcaagaaaataaataataataattaatttaaggttgtctgttttcttctcctctgttatgtaatgtaagtgtgtatatatatccatatatctcttcctctactttatatctttctccctacatctggggttggttaaaaattgagtcttgaaaacagattctggcccagaaagtgaggggaaatttggggtatttcaagatttttcttgaaaatacaaggtagctgataaggaggatcaggaaaaatgaagcacaaagatggaaaaactcatcaatcggataaaagttcatggaaagtcacagttccattaacagttgtggtgctgtgtgggctttttttctaccttggaggtattttttgctctgaaagggagagatatgtagctgagcctgttaacaaggctgttgacactcccacgggaactgctactgtacctgtccagatcaaagctgtttcttttcctgaatgtagtgctgagtatcaggactatactccatgcacagatccaaagagatggcacaagtatggtcgccatcgtcttgctttcttggaacggcattgccctcctagttttgaaagacaggaatgcttggtacccccaccagatggctataaatcgcctattagatggccaaagagcaaaaatgagtgttggtacaggaatgttccatatgattggattaacaaacaaaagtccaatcaacattggcttaaaaaagaaggggagaagtttctctttcctggtggtggtacaatgtttcctaatggagttggtgcctatgttgatttgatgcaagatttgattccgcaaatgaaagatgggacaatccgaactgccattgatactggatgtggggtagcaagctggggaggtgatttactggatcgtggaattttgacagtctctcttgccccaagggacaatcaccaggctcaggttcagtttgctctggaacgtggaattcctgcaattctgggcatcatttctactcagcgtcttcctttcccttcaaactcctttgatatggctcattgttcaagatgccta

SEQ ID NO: 11339 - DNA, 440 bp, Lycopersicon esculentum
  Predicted polypeptide sequence is orthologous to G1190
caatgagccatgtcaaaagagtttgaagggaaaggaagacgctgtgtcgaaataattcccagaactgcaggaattccacgttccagagcaaactgaacttgagcttcatgattatctcttggagcaagagagactgtcagaattccacgatctagtagatcgcctccccagcttgccaccccacaaccagtatcaatggcagttcgcacggtgccatctttcatttctggaatcaaatcttccatcagatcaacatatttcccaacaccatttgggaacatagtacctccaccaggaaagataaacttctccccttcttttacgagccaatgctgattggatttctgtttgttaatccaatcatatggaacatttctgtaccaacattcatttttgctctttggccatcttattggcaccttgtagccatctggtggggg

SEQ ID NO: 11340 - DNA, 1158 bp, Lycopersicon esculentum
  Predicted polypeptide sequence is orthologous to G1190
gaactagtctcgggttttttttttttttttttttttttttttaaccatttcattcatgagaaattgacaatcaattagatacataaaaaaaaggaggctacaatgtttgttactttttcaacaactctaagaagatacatgaaagaaaattacaaaagaatattatagcatgaaatggaactaagagactactagcacaacacatggttgttatttttctggactaaatttcttcaaaatcaaaatctcaatttctcataatctatagaaacaaataaaaacactctttgagctctggagtttttctcctatggttttggtggtattataaatatatggactcctcttatccaaagagatataatcacaactttgtatatagtttcaccatgtttatagtgaagtctcctttgaataccaaagcttcttttggcaaatcagtatcttctcgttctgtccgctatattctgtctcttcttcgggacagctccatctcattcccttagccataggggcaacgacatctatgaagtaactagattcccggataattgcatatccattgggtcgcaaaatacgatccatttctagcataacatacttcatttcacatctatgactttcagcagtgaagagattgtcaacatgaaggagatcatatgttcgaggataggtcgaaaaagcctcacaccagtcatgaaacgttccgataagacctctgtcgaagaccacggggagtgtattggcagcataagaggagaccacattcatgacccaaagtggatcctcaaccagagcagcagcgaaacctccgtacaaggtgttcatgtccatcacattcctgaccttttcacttccaatagcagggagcaacttcttgtagtgctttgctcgcaccttccacttactatcgtcatgcttgaaggcaccctcgctacctccacgaatatcagaaacacgttctggggcgacatgcaacctttctggccatttggctagggcattcaacttaactttcctagtagctggaggcaccactacacaaggtcgaagaggagtgtaccacgcagaatcaggttcagtaccatcatcacattttggtgggtagctatcagagttatcaagtttcttatagcagctattgtctgtcaacttctg

SEQ ID NO: 11341 - DNA, 870 bp, Lycopersicon esculentum
  Predicted polypeptide sequence is orthologous to G1190
agaatttggatgaccctatttttttttttttttttttttttggtttttttttttccaggagaaatggccaatcaattagatccataaaaaaaggggggctacaaggttggttactttttcaacacctctaagaagatccatgaaggaaatttccaaaagatttttatagcatgaaagggacctaagagactcctagcacaccacagggttgttatttttcgggactaaatttcttcaaaatcaaaatctcaatttctcatattctatagaaccaaataaaaccactctttgagctctggagtttttctcctatggtttggggggttttataaatatatggactcctcttatccaaagggatataatcccacctttgtatatagtttcaccatgtttatagggaagtctcctttgaataccaaagctttttttggcaaatcagtttcttctggttctgcccgctatattcggtctctttttggggacagcttcatcttattctcttagccataggggcaacgacttctatgaagtaactggattcccgataattgcatatcattgggtcgaaaatccgatccattttagcatacatacttatttacatttatgcttaagcggagagatggcacttgaggaatctttgttggttggtgaaaagcctccccgtcagaacgtccatagaccttgcgagacccggggggttggcttaagggggcccttttgcccagggtccaaccggcggggaacctgtaagggaggccaaatcggctttcttaatgggggccctggggtgtccctttctttttggtgggccttccccattaaacttgcacattggggggggcactttttttgttctagatactt

SEQ ID NO: 11342 - DNA, 887 bp, Lycopersicon esculentum
  misc_feature (489)..(489): n is a, c, g, or t
  misc_feature (850)..(850): n is a, c, g, or t
  Predicted polypeptide sequence is orthologous to G1190
tgtgtctactatcgtcaatgagccatagcgggggggggattttttttttttttttgcgaacaatcatttgaggatcatcccaaaattttgttcatgtattcttcccactgaacttgagcttcatgaatatccgaaaacttaagagcgaccctaaaaaaacaagaatcataaacttcttaggggggctcctacaccctacacacaatagcattggcagttcgcgcgatcctaggcttcatttctggactttctttatccattcagatcagcggtggcaccaacaccatttgttaccttggtaccttcaccaggacggaggttcttcttcccctttttttacaacccaatgctgttgatatctcttggtttgggaatccaatcatatggacaatttttcttgacccacctttcatttttggctctttggccattcttatgggaaccctgtaacatttttgtgggacaagccaagcaatcctttcctatcanattaggagccattgtcggttcattgaagcaagggttttagccccgggtttttgggcaatttaccgtgcccccccgggaggcccctgatgtcagacttgtttcgagggacttcctttgttgtgaaaaccggcgggtgttttggccatttttgatcctgaggcggcggagcccctgtttcttttgggcgggtggggaatttaacttccaaggcatgtttcttgaatgttcgtactccaattccaaaccgattagtgaactcgcctaaggaataaactcattttgtggggggggggaggggtataaaaaatatttttttttttttaccccccccccttttttttttctggggttgaatgggggnaaatttcttttgtggggggtattttaccatccccccc

SEQ ID NO: 11343 - DNA, 702 bp, Lycopersicon esculentum
  Predicted polypeptide sequence is orthologous to G1190
gtctcagaatcagcggactttctgggtcgtaggtcgtatccgggatcgataagactagaaacgcaacggatacgaatattccccacggaggccctgtcgtcgtcgcgactgacgacttgccgcgggctacgaacgcggccctactccatgtattgaacatatccctcgcggctcatgacaggggctccaccggaataacctacgatcggcgcgaggtccctctaatacacttctggatacatgactcctcgtactccgacggttctcctctcgttgaaagctacagacgcgaaacgaaacacgcctcctcggaaacggactgcaccccatggtttaatggccacgtcacaacttgagaacttagtcaccctgcagatatcaccgtcatcacggtcaaggggacgagacggagtcgctgcaaggaagaaatagaacatggtgcagagaaggagaagacaccgacccgttagaagaagccacggcacctaaagtaaaacctacgaataatcccgaatactacagtacaaaatatagccgtcgacaacggagagaaaaagccacacacccaacaccggtactacaggagacaagcaagcttacatagtccacacaccacacacacactaccccgcctaataaactaccggagaccgagaacccgaaccgaagaactaacagttaagaaccaattacaccacgacg

SEQ ID NO: 11344 - DNA, 296 bp, Lycopersicon esculentum
  Predicted polypeptide sequence is orthologous to G1198
tctactatttattagtctctttgcttctgaagaaaaattggcctttattcaagatgatctttaaattgaggtaagatcaagaatagtttgaaaattagttattatttgcatggagagtcaaagaattggagatacaacaagtacttcgtcaattgatcatcacatgccttataatacaagtttcatgtatcattccacactaaactttatatggagcatgcataaacagacctgcagcaactctggagatgttcccttcttggcccactaaagtgcatgacaccctaagaggaagc

SEQ ID NO: 11345 - DNA, 1077 bp, Lycopersicon esculentum
  Predicted polypeptide sequence is orthologous to G1206
ctcgggcactccatctctgccaacataagatggtgaaggcggagactctgattgtagttgcattctcctgttgtccttttctcacagcttcaacaacagtaggtgttgcaaagacaacaggtccagcaggataaaccatgggtgtaaaaggaatttggacattgatgaggaatgaagttgagaacaaaaaggatgaaaggatcaaaaaacatgggtatggaagaattggaagggcttattctttcatggcaacaatggtgaagagggcctaagctgcaagaaatatgtatcaaaattgtccttggcctaacacctaaaagaacacacaaggacaatagcaataaccaaatactaactgctactgctgccaaagaaagtactgctatttctctaagctatgtatgtgagctgctccaaatctgtgacaacttggttgattgcatgaaggaccatcttctttatctgttacaccagaggatgaaacaagtcagtaagaaatggaggcttgtcttaacatagtcagattaaaataaagcattttttatatggcacctctagtttgtcttctctggccttgtggcctttcggcaatgtcctgaactcagctgtgaggcggaaacattctcgaatgttttcaggagaaacaaaatcagcagcaactttggtacacgactggaaagttgaaaacagatggttggttacttgatgaactttatcatctggattttcatggattatttaagtattgattcttaccttgagattacgcacttggtgagggcatcctgcaggaatgaaaactgactctccaagtctttgctcaaatgtccaaggttcaatccctaaaatagtaagcgtgcacatcttgagtttattaaataaaatgtgatccttgttattgaggaaagataacgaacagggtaaattactaaccgaattcttccttcagttttctcttgtgctccaaagttaagtagaagctctggtcatggattggatgaaaaacctgatcaaccggacaacagaaagtgtgcctaaattcctttgcatgctttaaaagatactcactcaacttgg

SEQ ID NO: 11346 - DNA, 473 bp, Lycopersicon esculentum
  Predicted polypeptide sequence is orthologous to G1206
gcaaaagcagagtagtacataccaaccaccgaagcaacaaccaaactcaccagagtagccgccggcgaacagatccatcaccggagttcatttacagtaattaaagctcactgtagaaatttaaagatggccggagtaagaaaagagatgatgatgatgaatggaggaaacatgttacgaagtgtggaatatggaagaccgattccgaaaagagggcaagtgaaggttaccatagttttgggattagctcactctttatcttctattttctccaatcgccggtagagatggagtactgaagagagaacccagttttggtaaatttagagagtgttggagggtattattgtccttccataggctaggatcttgagcttggtgtgtcttgtattttgtacatagctggtgattttggcgcccattgtgtagtattttggaacttaatttccaatcaataccacttctcttttacg

SEQ ID NO: 11347 - DNA, 536 bp, Lycopersicon esculentum
  Predicted polypeptide sequence is orthologous to G1206
cctcgtgccgaatcggcacgaggatcaaaaagaactaaataatactgatacagatgatcatctagttcgtaagaatgattttgcatctgcaaaacaagaaaaagccagtgatgttttttcctctgacgagaatgtgcaattggagggcagtttatcttctgatcaggtggttgatcttgaaaacaagtttgatggaccagaggaagaaaatggtggtgcagtctgggatatctttaggagacaggatgttcccaagctcgaggattatcttaaagagcatcagaaggaattcaagcatacacttggttctccggtggaccaggttgttcacccaattcatgatcaagttttctacttaaccacgtatcacaaggagaaactcaagcaagattttggcattgaaccttggacgtttgtgcaaaaacttggagaagcagttctcattcctgctgggtgtccccatcaagttagaaatctgaagtcttgtataaagggtgctctcgattttgttcacctgaaaatgtgggcgagtgcat

SEQ ID NO: 11348 - DNA, 372 bp, Lycopersicon esculentum
  Predicted polypeptide sequence is orthologous to G1206
ggtttggaaaaaatgaagtatttgaggatatggaaggcggtgcactgtgggacatctttagaaggcaagatgttgctaagttggaggaatatcttttgaagcacttcaaggaattcagacatatctactgttgcccggtcccacaggttattcaccctatacatgatcaaacattttacttgactgaggatcacaaaaggaagcttaaggaagagtatggagttgagccatggacctttgttcaaaaattgggagatgcaatttttatacctgcgggctgtcctcatcaagttagaaacttgaagtcctgtattaagggtgctcttgactttgtgtctcccgaaaatcttcatgagtgcatccgtctgactg

SEQ ID NO: 11349 - DNA, 728 bp, Lycopersicon esculentum
  misc_feature (690)..(690): n is a, c, g, or t
  Predicted polypeptide sequence is orthologous to G1225
gaaaccaagtcaaatgttcattggggttctcaaaacaaaacaacacacacatacaaagccctcttacaaagcaaaatccaagaccctcctacttatctaaaaaatcacaaacaaaaaaaaaagttattccaaatggctttagaagcactttctaccaatgaactcctcaacttcattatctacgatacaatctctaccaccaccaccaccaccaatagcaacaacaatcttgatgaaaatgccttattttttgacaatcatgaagaaaataatgcctttctattaaagcctcaagatttttgtactactactcccttagagcaacaatattccatcgccgcctcagtgccgcgaccagagtcttctagagagaagaataatttgtcggtcgcggcacaatcaggaggcggcggtggagggagaaagaaaaggagaagaagacctaaaatttgtaagaataaagaggaagctgaaaatcaaagaatgactcacattgctgttgagagaaataggaggaaacaaatgaatgaacatctttctgttttacgttctctcatgcctgaatcttatgttcaaaggggtgaccaagcttcaatcgttgggtggtgcaattgaattcgtaaaggaattagaacacattctacaatctcttgaagccaaaaattcgtattattacaacaacaacaaaangcggtactagtaatgataatgatgattgtgacggtgga

SEQ ID NO: 11350 - DNA, 600 bp, Lycopersicon esculentum
  misc_feature (36)..(36): n is a, c, g, or t
  misc_feature (88)..(89): n is a, c, g, or t
  Predicted polypeptide sequence is orthologous to G1228
gtatgattgacgccacccctggttggaactcggtgnggttttttttttttttttttggtgcgtttgctgattggagcttcgttgctcnngggtagatctcgacattcgcgggggggtactttttcccgccagtagtggttgtttgttgaactggaaacctggtggattgtgggttgtgtgggggttaagcttgattgaaggtcggtttgttggctggagaaatgggtttaggtggttataggctcgtaatgtgtggggctaggcaacgctttattggacataatctggaaaaaggagatcttctcaatacgaaacttgtccatgattactaaaataggaaaaagggttcttggatactatggggctttctaactttcgctgcatgcctcatgataattggctttgcgaacatggtttttagatgtttggatgtttaaatttaatgcgtttacacccctattggtctagcctatacaaccttgtattgctacattggcatcccaaaaaatggtttctagccattccttgcttttatagccaagaattcgggcagctaatttaattccaatgggcccaaaaaaacttttttgggaaaaaggt

SEQ ID NO: 11351 - DNA, 409 bp, Lycopersicon esculentum
  Predicted polypeptide sequence is orthologous to G1242
ttttttttttttttttttataatcctatcataatcatttagctctttgtatctttctttgaaaacatttgcgtatctttcaacctcctcctctgtctttccttccatttcagcagcaatactttctatgtcattccgaccatacttctcacatgccctgataaaagtattgaaatctctcctactccatgttgaaaatccttcttctaataatttgtccttctcttcctgctcgtcggcagttaaaggatctccgacatcttcgggctcttccacttcaatgctatcttttaattgatttttctggtgagcttgcatgagaaaacgaacttccttctcgtacagctcacttagcctctgggtattaaagaactgaaagtcgtgcagctgaggcatcctaggaatcctgg

SEQ ID NO: 11352 - DNA, 414 bp, Lycopersicon esculentum
  Predicted polypeptide sequence is orthologous to G1242
ttttaatattttcgcagatgacacggctactggacatccttgaagattacctgatgtatcgaggtcaccagtattgtcggattgatggaaacactggtggagaagatcgtgatgcttctattgaagcatataacagaccagggagtgaaaaatttgccttcttattgtcaaccagagctggtggtcttggtatcaatcttgctacggcagatattgttattctttatgacagtgactggaatccacaggttgatttgcaggctcaggaccgcgcccataggattggacagaagaaggaagtccaagtattccgtttctgcactgagtatacaattgaggagaaagtgattgaaagggcttataagaagctggcacttgatgcactggtcatccaacagggacgactggctgagc

SEQ ID NO: 11353 - DNA, 242 bp, Lycopersicon esculentum
  Predicted polypeptide sequence is orthologous to G1246
ccatctctcaaaacttaaacttcaaccaaagtccaaacacacataaacatacttttttttatataacaacaataaaaataataataaatctagggttataatattatatggatccccatcttcatcaccatcaacatcatcttcaacaacaacaacatcaatttagtcatcaaagtgtgaatattgatacaacaagtggaggtgttaatattggaggaggaggaagagatcaatttccgaac

SEQ ID NO: 11354 - DNA, 573 bp, Lycopersicon esculentum
  misc_feature (557)..(557): n is a, c, g, or t
  Predicted polypeptide sequence is orthologous to G1249
tgaagaaggaacctccaccgttgccggagagacccaccaactccaaattccgataagccgagtgaagaaaatcatgaaactggatcaggacatcaacaagataaactcagaagccctatatctcatcgctagttccaccgagcttttccttgaattactagcagaaaaatctgcacaagtagctttggagaagaagagaaaaacaataaagctcgagcacttaagagttgccgtaaaaaggcataaacctacgagtgatttccttctcgattcgcttcccatgccttcacagccgttggatcggtctccgaaggttcaaagtcgtcctcgatcatccacagataatccacttccttccggaactcgaagaattgaggccttttttcaaaagtgtacttaaaactctgcgtttacaatctatttccagtagttgtgtgaaatagttattcacattcagtgtagggcttgtgattataatttgaaaagatatggttgatttccctagatctatatcatgcattgccaatctatgatatttgagacattagttgctgatncctaaaatatatcatg

SEQ ID NO: 11355 - DNA, 1452 bp, Lycopersicon esculentum
  Predicted polypeptide sequence is orthologous to G1255
ggtgggttcctcaaataattgcacttttagcactgtctttttgagttcctctagagcttttttttaacaattatacataaagatctaactcaacatatctccccttagttttcctcttccacctactcttcaaaagtacaaaaaaaagttcattgattaatatccgtatcagagacggattcagaatttgtcgatggtttccgaaagaaaattggcaagtgcaatgggtggaaaaacaacaagagcatgtgacaattgtattaaaaaaagggcacgttggtattgtccggccgatgatgcatttttatgtcaaaattgtgacgcttccgttcattcggcgaaccctttggcacgtaggcacgaaagggttcgtcttaaaacatcatcactaaaacaaacatcatcaccatcatcatcatcggacgattactttcccgatttggaaagtccgctatcaatttcatcagtatcagtgtcagtgtcagtcccatcgtggcatcgcggatttactaggaaggcacggactcctaggcaggggaggaaggctagtaaatccgcgggggatggagatgtcattcgaaagaatcctattcatctcgtccctgagatattaagcgatgaaaattcacttgatgagaatgaagaggagcaacttttatatcgagtgcccatcctcgatcccttcgtgggccacctttacagctcatcgacagcaccaacagatgcagattcagagtttaaactcgaatctaaggagatgacattgcaagatgatatctgtaacgtcgacctgaatagatttcacgagatgttaccctcggagatggagctagcggaattcgcagccgatgttgagagtttgctaggtaaaggacttgatgatgagtcatttgatatggaaggattaggtctattaggggtttgtaacaaggaggaaaattcaatgattagtcatgaaaaagtcaaaattgaagatgagggagaaatggaagtcgttacaaaaacaacttctccaactactcacaatcatcaatataatcatactcttgatcatgatattgatattaacgaagacacctttgagttcaaattcgattacgattcgtcgataaatattatcggagacgatgaagtagtgacgaaggatgaaaataaaaagaagattttattaaatcttgactatgaaggtgtattaaaagcatggcctttcaccattagtccaaggacacctttggtcagccatggtggaaggatcaccattggggttacaaatgctgcaaacagacaatcagaaacagctactgtacaggtgctgctggaattgaagcagctgaggcttctactgatcttatgaaggccaatattgctcgcaaggagtctgctgaagatacacatgcgccggttgaggagaagaggctcactacttggggaactgaagttcctgacgatttg

SEQ ID NO: 11356 - DNA, 879 bp, Lycopersicon esculentum
  Predicted polypeptide sequence is orthologous to G1255
ggaagcggttgctgtgggcacacaaaaatgagcaattattgtacgaacgatcctttatatatatcgaactgttccactttgttttttgggcttgttcaaattccttttaattgaatcctccgtagcgtttacgaatttcactatattctccttcggatctcgttttgatattatatcagaacgattgtaaatgatgactagtgaaagtaagacggcaaatgctataggaggaaaaacagctagagcttgtgatagctgtttgtcaaagagagcacgttggttttgcccagctgatgatgcctttctttgtcaatcgtgcgatgtttcgattcattcggcgaaccaattggcgagtcggcatgaacgtgttcgtctcgaaacatgttctaacaaatcaaccattacaaaattagtcgacaaaactcatcaaccttcttggcaccagggatttactcgaaaggctagaacgccgagaaatggaaaaaaggcacaaatcaggcaatggaaaaagaacgaggaaaatcgggtaccggaaattggcagcgaagagaactcgttggatgaaaatgaattcgaaaacgaagagcagctgctttatcgagttccaattttcgatccgtttgaagcagaactctgcaatgtgccagatgaaactggatctattgttgatctggacattttgttgaacactgaagatgcttgccatgatctgaaccttcctgagtttctttcatctgatattgagcttgctgaattcgctgcggatgttgaaaccttactgggaggcgaagaagaacagagtactcagttatttaaacggcggattttgaaaataacaaggcgattaaaattgaagttgaagacgaagaaatgagagct

SEQ ID NO: 11357 - DNA, 1041 bp, Lycopersicon esculentum
  Predicted polypeptide sequence is orthologous to G1255
gatttgcccgccggcgactatttttccggcgacattattcccggcgtcttcgggaatcgtaatggcttcctctattccaccaccgagatcggtcgcttccggcggtttccagaaccctaataagtcattaagcttctttgcaaacgcaatgaagagaaaagacagtttcatacagtttttcgccatgacaggaatacttctattgagtttaagatcgcttgggcaaaagtatcgtattcattatctttccgtcagacacgtcaaatagggtcactaagtggctgctttacatgccatgcattttgatgttacaaccaaccttcctgagtttctttcatctgatattgagcttgctgaattcgctgcggatgttgaaaccttactgggaggcgaagaagaacagagtactcagttattaaacgcggattttgaaaataacaaggcgattaaaattgaagttgaagacgaagaaatgagagctgttgttgcttgtcatttggatcctgaattggatatggaaagggaagcactgaattggaactttgatgaatattatgaagaaacagttgagcagaaagtaatggcagcagatgcagcagtaacagaatttatcgctagtgcagaagagtacagtggtagcagtacaaaatctgatgaaaaaaacagactgtttctcagtcttaatcatgaggcggttattagtgcttggccaaatcaatcttctccatggacaaatggaatccgaccccatttcaatcctgatgactactggcccgattttttctcggaaacaagtgtaggtaattatgggggacatgtaagatgtggcgatggaggaagagaagcaagggtatcgcgttacagagagaagagacagaacagattgttttcgaagaaaattcgatatgaagttaggaaattgaacgcagaaaaaaggcctaggctgaaaggacgattcattaaaaggagctcatcgttgttttcagtgcctggtttttcttacatgatgaataaacgatgatgatgaattgatcttgatgt

SEQ ID NO: 11358 - DNA, 910 bp, Lycopersicon esculentum
  Predicted polypeptide sequence is orthologous to G1266
ttttttttttttttttttttaattctctgatagagagcgcttttttctttattaagcttcagaataatcgaatcgatgaattccgaacactacatgaactatacacatgtagtgagtgagtgagaatgaaaacaaaatagaagcaatttttatgtacaaacaagtagaagaatataattctaattagaggaagtactcgtcaaaagttcctctaacaattcagcacccaaatcttcaaaaaccaaaacatttctcttcttcctatttctcttatgtttaacacgtctcattttatttgttgcctttaaaacagcagctggtgaaatcccatcttcacaaatatacttaatattttcaagtgattctcttactttgtccattggaaaatttaaaagtgccaatggacctctcattgtaagtgcagcttgatcatacgctaaagcagcttcttcacaagtattaaatgttcctaaccaaaccctaatcccatttcttgttgaatcccttatttccgctgcatattttccccatggtctctttctaactcctatgtagtgtttggtggagttattcttatcatggtgatgagacgtgacctcttcgatttcatgacgattattgctttctttagaggaattcgtatcgtttgaggatgaccaacttcttggtaattgatgtaggttggaggaggaaacttcccgtctataactttctttcgaggttaagaatgaacaagtacttcctggtagagaatgatcgttgttttggtcgatgttagtcaaatattcatctaagaaatgttgatcattccatggtaatgatgattgatcttggaagaaattgaaatttggatattgagttttaggggatgaagattccattgtatattataagaaattggatattattg

SEQ ID NO: 11359 - DNA, 844 bp, Lycopersicon esculentum
  Predicted polypeptide sequence is orthologous to G1266
ctagtattcctttatgttaaatacctcattaaactataacattttcccccaacaaattaaccaaaatcccctctaataaaagctatggttccaactcctcaaagtgatttacctcttaatgagaatgactcacaagagatggtattatatgaagttcttaatgaagctaatgctctaaatattccttatttaccccaacgaaatcaattactccctagaaataatattcttcgtccattacagtgcataggcaagaaatacagaggagtacgacgtcgtccgtgggggaaatacgctgcggaaattcgcgattcggctagacatggtgcgagagtatggctaggtacgttcgaaactgctgaagaagctgcgttagcttatgatagagcggcttttagaatgcgaggtgctaaggcactacttaattttccatctgaaatagtgaacgcctctgtttcagtagacaaattaagtttgtgctcaaatagttacactacgaataataattcagattcaagtttaaatgaagtttcaagtggaactaatgatgtatttgaatcaagatgttaaaacagagctgtgcatggagaatttcttggcactctaagcgaataatgtgtggacacgtagaaaatatttctatttatgtaagaatcaactgaactattaaaatttcgttgttgtatttatattatgtgcttgcctcttctcttattttccttatggaattgtttgcagcgacgcacgctataatctcatgtaaaaagattgcttaggatactttagtagtatgtttataagttgtaatatacaccttctattttctaaaaaaaaaaaaaaaaaa

SEQ ID NO: 11360 - DNA, 914 bp, Lycopersicon esculentum
  Predicted polypeptide sequence is orthologous to G1266
gacaacccaaaaacaaaaatcaaaagatgtcaagcccactagagatagatacttcattttcacattccaatttgttgtttttggaagatgaatcatcatggattaatactcatgatccatttgttgatattgatgaatatctaccaataattataccatgtaatgatgaagaaatagtagtagaatcctcaaacgctagtactacaacaacaacaacaacaacatcaaaagtagcaagtatccaaaatattcatcatgatcaagaagaggtaacatccatagagaaaaaacatgaagatgatcaagaaaaacattatattggagttagaaagaggccatggggtaaatatgcatcagaaattagggattcaacgcgtaatggaattagggtttggttaggaacatttgatactgctgaagaagctgctttagcttatgatcaagccgcattatcaatgaggggtccttggtctctactcaattttccaatggaacatgttaaaaaatctcttgaaaatattgagtattcttgtaaagatggattatctccagctgctgttttaaaagctactcataaaactagaagagtcaagcacaagagaagtagtagaaagaagaagaatgagaatttggaaaatgtttttgtttttcaagacttgggagttgaattattagaagagcttttaatgacttcatcataggaatgtttattatattcttcgtgtcgaaaatactaagttcagttttcgtgggagataataatcaagatcgcaatgtacgagtctcttttttttctttttttttttatttggtctggatttcttgaagaatttagagtttagtttcaagaagagcttttgatgagttgaaataatgtctcagacttgttttggtacaaaaaaaaaaaaaaaaaa

SEQ ID NO: 11361 - DNA, 408 bp, Lycopersicon esculentum
  misc_feature (300)..(300): n is a, c, g, or t
  Predicted polypeptide sequence is orthologous to G1266
gcaccagataaaatatcatcccctgttaagcaagaagtttcctcaatctctcatgtatatataagtcttttagtcattgattgagcttcaaacttccaaataagaatagtccaatcatatagtaaatcaaatggattattcatctcgggatgatcttctttttcactataattcacttccatttaacgttaacgatacacaagacatgttactttataatcttgttgctgaaggatcatcgcaagaaacagtgaattcgtcgtctagctatggaataaaggaagaggaagtgacctcatntgaagaagaaagaaaagataagaattacagaggtgttagaaagaggccatggggtaaatatgctgctgaaattcgtgattctacgaggaatggtgttcgtgtatggct

SEQ ID NO: 11362 - DNA, 784 bp, Lycopersicon esculentum
  Predicted polypeptide sequence is orthologous to G1267
gcacggattttctctcatttttttttctaatttctatatgatataaaacaaaatttagttaatcctcaaaaagtttttattttctttcttttttttttctaagttatataagttatttttgtgttttttggtcatggaagatagttcatacaaaaatctattttttcataaacaagaagattccaccggaactccaccggataatgctgctgattcttgtttttccggtgatgaagcggcggaagttagcatgccatcacctagaaaaagtaggagaggagcaaaaaagaaagtaatttcagtgccaataattgaaggtgatggatcaagaagtaaaggggaagtttatccaccacaagattcttggtcttggagaaaatatggacaaaaaccaattaaaggatcaccttatcccaggggatattatcgatgcagtagctccaaaggctgtcccgccagaaaacaagtcgagcgtagccgcctggaccccaccatgcttctcattacctattgctccgaacacaatcaccaaatcccggccgccgccgccgccaaacaccaccatcacaaccaccctactaccaccaccagttcacccactacctctaccggcaccgccggagacaataatgctactgcggctgtagccacggactctaccgtagtagacaaatcatcccccgaagaaccagatctatttgcttatcaacacgataatggattttcagagctcgccggtgagttaggttggttttccgatatgggaacaacaactacgtttatg

SEQ ID NO: 11363 - DNA, 570 bp, Lycopersicon esculentum
  Predicted polypeptide sequence is orthologous to G1269
gggtcgtaggaacctggtatgagcgaatacttcattatggggcgtggatcgcttacctggaactggaggtagacactagtgacggttattgttggcaaatctgcgctgctgctgctgctgctatttaagttccctgaccctcttgatgacctagccttcaagagagctgcctcgctgagcgactagtagtgccaccgtccggaagcatctaaagctcctaaggataagaggcccctcgtctttgaaaaaacttgttaagagcctacgatgccgtaggtaatcaggacgagagtcctagaaacgaaaagcagacgtctaacggtcccgaatagtgtaaataccagtaaaaactgacatatcgacgcctcgttacccgataacaatagggccgccccggatttattagtcagaggacacacaaacgtaagtcctaccaagacactcgaagatgcgctctagcccaccgtaatataaggcttctcataatatatccccgaagatcctcgggaaacgacaacttagtactgtcgcttcgcgaccgcgaagtccatataaccgcccgataatcat

SEQ ID NO: 11364 - DNA, 1292 bp, Lycopersicon esculentum
  Predicted polypeptide sequence is orthologous to G1272
ttttttttaacgaaaaatgatatttgatgccttactttcctatgtaaactgaatgttgagaagccctttgaattacatatgtgtatacaaacaagagaagagtaaattgagtggtggaaatacaaattgtgagatttgttccaccttattctcattttagtttacaaatatttagattggagaaaacagtaaattaaataagagcaacatatttacaactgttggacatcaaacgcagttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcagggatggtgtcagtgaatctcaatttaatcaagttctaaacatagaactggaccagctcattgaggcctgcaattttctagatgagaagtggtcgcccaagtttgttatcattgttgctcagaaaaatcatcatacaaagtttttccagtctggatctcctgataatgttccaccagggacaattatagataacaaagtttgtcatccaaggaacaatgacttctatctgtgcgcccatgctggaatgattggtacgactcgacctacacattaccatgtgttgttggatgaagttggtttctcacctgatgaacttcaagaacttgttcataatctgtcctatgtgtaccaaagaagcactactgctatatccattgtggctccgataagttatgcccatttggccgccacacaggtgggtcaatggatgaaattcgaggatgcatcagagacatcgtcaagccatggtggtctgactaatgctggtccagttactgttcctcaattgccccgtcttcaggagaacgttgctagctccatgttcttctgttgaggcctgtgcaccacctcctgttttactctacgcggttaatgtatgctctagacaaatggtttctgtaaatagctctagtttgacagcacttggagtacgaaccttgtcctagtgacctcccaaaaacaacttagttatgcggtacaatactaggtctgttgccatattcaggtctcatgcatatttttcgcgcttctgttctcctgaacaattttgctatgtatctgtaaaatgcataaagattaacctggtggtgtgactatgcctccaaaaaaaaaaaaaaccaaaaaaaaaaaaaaaaaaaa

SEQ ID NO: 11365 - DNA, 634 bp, Lycopersicon esculentum
  Predicted polypeptide sequence is orthologous to G1272
ggtcagagttgacaaaatgtttgaagagatccagtcaaaacttcctggtgcccccaagtttcttctctgtcttcttcctgagaggaaaaattgtgacatatatggtccatggaagcgaaaaaatctggctgatcatggtatagtaactcaatgcttggctcctggaagagttaatgatcagtatctcacaaaccttctccttaagatcaatgctaagcttggtggtttaaattctatgttagctgcggagatttctccttccatccccatggtatctaaggtccccaccatgattcttggaatggacgtatcacatggctctcccggccagtctgatgttccatcaattgctgcagttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcagggatggtgtcagtgaatctcaatttaatcaagttctaaacatagaactggaccagctcattgaggcctgcaattttctagat

SEQ ID NO: 11366 - DNA, 966 bp, Lycopersicon esculentum
  Predicted polypeptide sequence is orthologous to G1272
tggacttctataggacaagtaacaggcataagccagctcaaattattgtcttcagggatggcgtcagcgaatcacagtttagtcaagttctgaaccttgagctagatcaaatgatcaaggcatacaagcatcttggtgagggcggcaaccctaagttcaccttgatcgtggctcaaaagaatcaccatacaaaactatttcaagctaatgcagttgataatgtaccaccaggtactgttgtagacacaaatattgtgcatcctagaaataatgattttttcatgtgtgcacatgcggggatgattggaacaactaaacctgcacattatcatgtattgcttgatgagattggtttcgcacctgatgtcctgcaaaatctcatacattcactatcatatgtgtaccaaaggagtaccagcgcgacctctattgtggctcctgtgcgttatgcacacctagcagcacaacaattcgggcagtttgataagtacgaggaccactccgaaactttgtcagaacagggaagtgtcaaatcaattgggactactccggtaacccaactgcccaggctgcacaagaatgtcagcgactcaatgtttttctgttgaaaattgtaaagcttttaaatgcatatgctgtaaatccttagtagtttggtagtatagtacccggctccaaattttgtcgaggccttcggttagttaagtgctttaaggtcgtctaacaaggatcatgcttcgagtttgttttatttttttgacgtaattaagatagaaatttccccatttaaagggcatagaattttgggcgttgctccatttagctattttagaagttgaactgatttttgtatagtcaaagtttgtctaagtttggcgcttgatttgttaaaccgctggtctctttttagagtttaaatgactcagaaataggagtttgtgtaaaaaaaaaaaaaaactccagagt

SEQ ID NO: 11367 - DNA, 857 bp, Lycopersicon esculentum
  Predicted polypeptide sequence is orthologous to G1272
gtccagcattggttactccattatgacgtgaggaagtctctgatgcatcttcaaacttcatccactgtcccatttgagtagcagcaagatgggcataacagataggagcaacaacagatattgcagtggtgcttctctggtacacataagagagattatgaacaagctcttgaagatcatcagcagagaaacccagctcatcatacaagacgtgatagtgagtaggacgagttgtaccaatcattccagcatgagcacacaggtaaaagtcataattccttgggtgacagactttgtaggattaaaaaaaatataggaagtgatggcaaacaagttgtgcatagttgttctttgtcttgctttggtagtagttcataccacagccgcaagagacatgccaagtgacaatggtctttatgaccaaaagaatgttttcgttggcgctggaggtattggtggcattggaagcaatggattgccttttggtggagttgttagtggagtaggtgggaatgttggtggatttggtgctggaattggtggtggagctggatttggtggaggaatggggggtggtggactaggtggtctaggaggattaggtggcattggtggcggtgttggtggtggtgctggtggtggtgcaggaagtcttccacttccatgaagattaatattagttgaagtttaatttgtatcatgcatattgtttggttttagtattatggctagtgtgagaaattaaaagagtgattattttttcttttctttttgttgcatgtttggtttcattcatagtgtaatgttatgtgttttttcacgtgtttaatgtaatgtaatttggtgcacttgtaaaa

SEQ ID NO: 11368 - DNA, 3214 bp, Lycopersicon esculentum
  Predicted polypeptide sequence is orthologous to G1272
gtaaatactccccttttttttctcagtcctctctctcataaatttgtcactctccctccttctcctctcttccatttagggttttgttcttgattttggtgcttcatctgcctcttttgagcagaagataggatcctgatatggctgaagaagaaacaaatggagcagcagcagagggtctgccacctcctccccctgttccaccagatttcactcctgctaaaactgaaattgagcctgtgaagaaaaagatcttgcgcgttcccatggccaggcgtggtgttggaaataagggacaaaagattcaaatacttactaatcactttaaagtgaatgtaaacaatgtggatggacacttcttccactacagtgttgccttattctatgaagatggtcgaccagttgatgggaagggagttggaaggaaggtgttagacacagtgcacgaaacttatgatacagaattagctggaaaggactttgcctatgatggtgaaaaaagcttgtttaccattggagcactccctaggaataaaatggagttcactgttgtccttgatgacgtgatatcaaataggaacaatggtaacagcagccccggtgggcatggtagtcctaatgaagctgacaggaagaggttacgtcgtccttaccagtcaaaaactttcaaggtggagatcagttttgctgccaaaatcccgatgcaggcgattgcaaatgctctgcgtggtcaagagtcagagaactctcaagaagccttgcgagtcttggatattattttgaggcagcatgctgcaaagcagggttgcctgcttgttcgacaatcctttttccacaatgatcccaagaactttgttgatgtcggcgctggtgtgcttggttgtcgaggattccattccagcttccggactacccagagtggcttgtctttgaacattgatgtgtctacaacaatgattatccagcctgggcctgtcgtggacttcttgattgcaaatcaaaatgcaaaggatcccttttcactggattgggcaaaggcaaaacgtgtgctcaagaatttgagggtgaagacaacccccactaatcaagagtacaagattactggactgagtgaccgtccttgtcgtgagcaactatttaccctgaagcagaaaggaaaagatgcagatggtgaggtccaaactactgaagttactgtgttcgattactttgtcaaccaccgcaacatagagttgcgttattctgctgatttaccctgcataaatgttgggaaaccaaagcgtcccacctttttcccaattgagctatgttccttggtgtctttgcaaagatacacaaaatccttgtccacattccagaggtcttcactagttgagaaatcaaggcaaaagcctcaggagaggatgcaagtcttaagcaatgctctcaaaatcaaccaatatgatgctgagcctctgcttcgttcctgtggaatatccattagcaataacttcactcagattgaaggacgtgttcttcctcccccaaagctgaagacgggcggtgatgactttgtccctcgtaatggcagatggaatttcaataataagagactagttgatcccactaagatagaacgctgggccgttgtcaatttttctgcacgctgcaatgtacaagggctagtcagtgatctgatcaaatgtggaaaacagaaaggaattatggtggaagacccatttgatgtctttgaggagtctccacaagtcaggagggctccaccacttgtgagggttgagaagatgtttgagcaggttcaatccaagctacccggggcacctaaattcctgctttgtttgcttcctgagaggaaaaactgtgatgtatacggaccatggaagcgaaagaatcttgctgagtatggcattgttacccagtgtatagctccaacaagagtcaatgatcaatatatcaccaatgtgctcctgaagataaacgcgaagcttggaggtttgaactctatgttaactgttgaacattctcctgcaatccctatggtgtctaaggtccctaccattattcttgggatggatgtgtcccatggctctcctggccaatctgatgtcccttcaattgcagcggttgtcagttcaaggcagtggccatcaatatctcgttacagagcttcagttcgtactcagtctcctaaagtggagatgatagacaacttgtttaaacgtacctctgatactgaagatgatggaataatgagggaggcgttgctagatttttatgtgagctctggaaaaaggaagcccgagcatataataatattcagggatggtgtcagtgaatctcagtttagtcaagttctgaatgttgagctggaccagattattgaggcttgtaagtttcttgatgagaagtggtcacccaagtttgtggtgatagttgcccagaagaaccatcataccaagtttttccagcctaatgatcctaacaatgttcctccaggcacaatcatagacaacaaagtctgtcacccaaggaattatgacttttacctgtgtgctcatgctggaatgattggtacaactcgtcctactcactatcacgtcttgtatgatgagctgggtttctctgctgatgatcttcaagagcttgttcataatctctcttatgtgtaccagagaagcaccactgcaatatctgttgttgctcctatctgttatgcccatcttgctgctactcaaatgggacagtggatgaagtttgaagatgcatcagagacttcctcaagtcataatggagtaaccaatgctggaccagtctccgttcctcagcttccaaagctcgaggagaaagtttccagttctatgttcttttgctaaggcgcgtaacgccttcatgcttttcttttttatgtgtggtttgtgaatagtttctggttcaaaactcttttgagaagacggtggtagttaaatattttgtctagacttaaataggtaaatcactctgctaaaagatttcacatcttttggctctgtggtttgctatctcttttaacttatcctggatcatgtacttatgttttggtggtgtttttaagttatggacatgactagtagtttctctaaaaaaaaaaaaaaaaaatccattgcttttgttttatcagttttgtgtttataaaacttgttagctagtattaccagcaggtgtaatgtgaaagattttc

SEQ ID NO: 11369 - DNA, 549 bp, Lycopersicon esculentum
  Predicted polypeptide sequence is orthologous to G1272
gctcttcactctgtttcttcatccgccatttttgagctttagaagattgtggtaatggctgaagaagagaatggtggatccacagaggctctgcctcctcctccccctgttccacttaatttctctcctgcacaagctgaaccagagccagtgaagaagaaggttttacgtgttcccatggcaaggcgtggccttggaagcaagggacaaaagattccgatccttaccaatcactttaaagtgaacgtgtctaatgttgatggacacttctttcattacagtgttgccttattttatgaggatggtcgacctgtcgagggaaaaggcattggcagaaaagttctggatagagtgcatgaaacatatgatacagaattggctgggaaggattttgcatatgatggggagaagagtttgttcaccatcggttcactacctagaaataaactagagttcacagttgtactagatgacataacatctaatcggaacaacggtaccaatggcaactctagccctggcagacatggaagccctcctaatgaaact

SEQ ID NO: 11370 - DNA, 627 bp, Lycopersicon esculentum
  Predicted polypeptide sequence is orthologous to G1272
gggagataacccatctttttttttctcatagaaaatcatgtaaataaataatttgctgaaaggtctaaacagcaaaacaaaagctcccaacaacttctatcctataacaatgccaatgcaatggcataccaaagggacacaacacaaaagcacaaagaaattagcataatttagttttctccaccaacagtgggggcttagacaaaaagttgataaaaaaacaaaagacttgtagtgacaacactacataggtttaagattcatcacattacagaaccagaaattccctttagcttatcagatgaacattgaactgcgaacattcttgtgaagccgaggcaattgagggactagcacactaccagctgttgaaactccaccatggctcgaggtggcctcagaaatatcatcaaactggataaactgtgccacctgagctgctgccaagtgggcataacatatatgtgcaacaacagagatggctgtggtacttctttgatacacataagacattgaatggaccagctcttattattgtggatcattatatcaaatgagggagctgtgtcatagcaatacccataagctgtttgtgactgtgatacagcgagaaatcgtgtgagaaaa

SEQ ID NO: 11371 - DNA, 564 bp, Lycopersicon esculentum
  Predicted polypeptide sequence is orthologous to G1272
caaagaatttcattttatacgattgctttgtcaggttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcaggtgatctaacccagcctgttcaccattttgctttcagcaaattatatacattctaagtgctattgctcttttattgacactacacttgtgatgaatgtctaaatcttcagaaatttttattgagcatgacattggtgagtttttatggttctacctcattttctgccatttttatcccgtttatctattgttttagaggattcatgtagctgacctaactcttgggcatgaggagtagctcttgatatttctcttgttccatcgtttgttgttattaccactaccgtgtgttccacctgcctaacattgtcacgtagcagtgaactttgtaca

SEQ ID NO: 11372 - DNA, 489 bp, Lycopersicon esculentum; identical to SEQ ID NO: 10464
  Predicted polypeptide sequence is orthologous to G1272

SEQ ID NO: 11373 - DNA, 557 bp, Lycopersicon esculentum
  Predicted polypeptide sequence is orthologous to G1276
ctccattagagacagacaaaattccttgtttccttcttccccactgcctctgtgatctccattgccggcttctcccataaaccaatgcgattctcatttgtcactttactatacccaactcaaaaaaatcccaattctttctttgttttgtttcttttcatcaattctggttctgtaattcaggagtgaaccatttgatatttctatacttttttgtgatacccttttgggcgcactgtagtgggttttcgagatgtttgatcttaatcttagttttgatgatgtttcagtagaacccatctctgttttagcgtcggaaaaggttgatgaaatgttatttaatcaaatggagaactcaggaacttctaattcctctattgttaacatggagacttcaagtactgctgctgatgatgagtattttagtcctgatcatcatcgcgatggttatgcatttgatatattgaaatccgatagggaaagctgggatcgtggtgggtttgttgtaaaagagttgttcccgttggtgaaatggaaaagtgggttggatctttcgg

SEQ ID NO: 11374 - DNA, 525 bp, Lycopersicon esculentum
  Predicted polypeptide sequence is orthologous to G1276
cagatcacacaacccacataagttgcctcacacgtcccatctttcttcttccccaacccctaccccctatctactgctcctatggagtactataactaaatgaaattcatctcaatttattcttcttccattgacgcttacaatcattttggttaactcccacagatattttatagttagtctaaaacagaacaatgttggatctcaatgtaagcgtaatctacaataatgaccttccacaagtttctctacttgatgaatcagccacctccaattcatccttacgaaatgcggaagctacaaccagtgccggtgacgaagattcgtgcgccggtgagttgttcgctttcaattttggaatcctcaaagttgaaggagctgagactagtaggagcagcaacaacgataatgaggaaggatacggtaagaatcagagagttactcattctcaattcgtgactaggcagctgtttcccgttgatgatggtgagttgaaccggaaacaaaccgatcgggtcattctct

SEQ ID NO: 11375 - DNA, 767 bp, Lycopersicon esculentum
  Predicted polypeptide sequence is orthologous to G1289
atcccccattgtgtgaaagacagcggggctactttactactatttataactccattctatctttccaatctaaatcacaagcagatcgcgatagtactattcattttttatattggtaaatttgtgctttattgggaactgggatagatgtagattttggctatatttataataggatgcttttgggtttctcatcaactcttggcctttcattctcaattctcactcgtatgtttcgtctctacttgatcattgtatttcataaacagaaagatcttgattaacttatcttctgatgcaacatggacgacccctttctacatcttgcaagcttgagctcttatatagcccagcaatttgttcaatttattgaggatcttatctgcagagatctacttgggtggtcagaatatttagttgattttggtggtctgcttgtaaactttacaactgttcccgaggcttgttcatttccttcaagagtatctgacacaggaacaagctttagatttcacgggagaagatcctcctatgtcaatgataacttgcctgtaaattcattcttagaaattgtaagaagtaatcaaagttatggaggtttcagactcatttttgaagggttgatgcttccagtatatggtctgagattcacttggaaacttacgttggcatgttggaggtgttccgtatctcatatcagatgtgctctagttcaagttcagagtgttatatcccgtgtatgcacaactttgcgtgggtcttctgat

SEQ ID NO: 11376 - DNA, 478 bp, Lycopersicon esculentum
  Predicted polypeptide sequence is orthologous to G1328
ttttttttttttttttttacgaacaagatcaacactgaacatttcaacaaacaaagacaaatcaaagaatgtgctgctcactaacgaaattacacttgaccaaccacctaatcaagcagagaataaagatagaagatatcatgaaaaacaaagaaaagaaaacatcaccacatacgggcggtcctgaaatctataattagtctactctgattacagatagataacctactgttaacacggagtaactaacgaatgaaaaacatagaacatggagcaggccagaaatccaagctgatggtctacaaacactttatttgatgaaccctaattttataggctataatgacacacatcatcaccatcatcatcaacaacaatcgaccaatatgttcctcttgaattccgtggcgtcggcgaatttcccccacgtgtccgtccttttgcaagcacatgcacaggggcacttggttggagtgcc

SEQ ID NO: 11377 - DNA, 502 bp, Lycopersicon esculentum
  Predicted polypeptide sequence is orthologous to G1328
gattttcttgattgattgtgaaatttattgctatgtactatcaaggaggctcagaaatccaagctgatggtctacaaacactttatttgatgaaccctaattttataggctataatgacacacatcatcaccatcatcatcaacaacaatcgaccaatatgttcctcttgaattccgtggcgtcggggaatttcccccacgtgtccctccctttgcaagcacatgcacaggggcacttggttggagtgcccctgccaggtgattttcaggattctaaccgtccttccatccaggaaatttcggcatctcatcatggccttttatcacatataccgtcatccactgtggtttctccacaacaacaaatgaatttcgggtctagtcttccactagaccatcgcgaaatttcaacaaccaatcatcaggttggaatactatcatcatcaccaggagtaaataccagtaatatcgatcatactcgaggatcaggggcattatcgtc

SEQ ID NO: 11378 - DNA, 329 bp, Lycopersicon esculentum
  Predicted polypeptide sequence is orthologous to G1328
cctttaccccttttctcacataccaagcccagaaccaatacatgcctgtttccttctctacgaccccttttgctacacaaacaccttactatcaaaccacgacgcaaatgaatgtaccaagcagtactcctactcaattgaatccaagtatggctacctatgccaatgttcccctcttccaactgttctctcagttccaacaatacctcaagagtcaaaccgaagattctgaggaaaagaaaaataagactaaagctccaagacctttcgttaagagagttcgacaaaccagaccaaaggttgttgaatctaaaggagctgttcaatgc

SEQ ID NO: 11379 - DNA, 526 bp, Lycopersicon esculentum
  Predicted polypeptide sequence is orthologous to G1330, G2423
taagcatctctttctctctctataacactcacaaaatccatatttacacgacaaaaaaaatttaagtttgatggataaattaatcaatcaagaaaataatattgataaagaaattatggagcttagaagaggtccatggactgttgaagaagatttagttcttatgaattatatttctcatcacggtgaaggtcgttggaactccctctcacgttgtgctggtttaaagaggacaggaaaaagttgtcgactaagatggcttaattatcttcgaccaaatattcgacatggaaatattacacttgaagaacaacttttaattcttcaacttcattttcgttggggcaataggtggtcaaaaattgcggaacatttgccaggaagaacggataatgagattaaaaattactggagaactcgagttcaaaaacatgtgaaacaactaaagtgcgatgtgaatagcaaacaattcaaagatacattacgttatctttggattccaagactagttgagaggattgaagca

SEQ ID NO: 11380 - DNA, 564 bp, Lycopersicon esculentum
  Predicted polypeptide sequence is orthologous to G1330, G2423
attgtcatggtgataaaattgaagttgtatcgggacgaggacgagaaggaggacgaggagatagtaaggaagaaattaaggaggaagaaattgttatggatcttctaaggggtccatggaccgttgaagaagactttacacttatcaattttattgcacatcatggtgaaggtcgttggaattctcttgcacgttgtgctggtttgaagagaacagggaaaagttgtagattacgatggcttaattatcttcgaccagatgttcgacgtggtaatattactgttgaagaacaactcttgattcttgaattgcattctcgatggggcaatcgttggtctaaaatcgctcaacatctccctggaagaacagacaatgagataaaaaattactggcgaactcgggtacaaaagcatgcaaaacaactcaaatgtgacgtgaatagtaagcaattcaaagataccatgaagtatctttggatgcctaggttagccgaaagaatacaagccgccgcggctacttccaacccaacggcggcttcttcctccggccccaccaccacataca

SEQ ID NO: 11381 - DNA, 317 bp, Lycopersicon esculentum
  Predicted polypeptide sequence is orthologous to G1330, G2423
ttggaattcactctcacgttgagctagtttgaagaggacaggaaaaagttgctggctaagatagcttaattatcttcgaccagatgttcgacatggaaatattacgcttgaagaacaactcttgattcttcaacttcattctcgttggggcaataagtggtcaaaaatcgcgcaacatttgccatggagaactgataacgagatcaaaaattattggagaactcgggttcaaaaacatgcgaaacaactaaaatgcgatgtgaatagcagacaattccaagatacattacgttatctttggattccaagactagttg

SEQ ID NO: 11382 - DNA, 564 bp, Lycopersicon esculentum
  Predicted polypeptide sequence is orthologous to G1330, G2423
gcaccagcctgattcttgaacttcattccaaattgggcaacagatggtcaaaaattgcacaatatctacctggaagaacggacaatgaaatcaagaattactggagaacgagagtgcagaaacaagctaggaatctgaagattgattcaaatagtgcagcatttcaagaaatgattcgttctttgtggattccgcggcttcttcagaaaatacagagctcatctgtttcgccatcaattcagagttcacagtcatcaacgcctccaggtttcagcacgagcagtaattcgagttcacattcatcgagtatctataattctccaaacaatatttcggaatgtcctcaaattccaacacgagagatagatgattctgatttagattcattcgtgaaggctcattttccatttgacaacagttatgatatggataattttggacaattaacaactggaaactttaatgatgtgatggattatgatcaattgagtggagatcacatcaagatgactggtgatgttatagctgacagcttttggagcaatatggatgaatttttctacc

SEQ ID NO: 11383 - DNA, 566 bp, Lycopersicon esculentum
  Predicted polypeptide sequence is orthologous to G1330, G2423
attcacaacaactattttgtctttctctctctatatataacattagcaaaaatccaataattttttttatatatatttttattttatcaatcaattttgatggataaattaattaatcaagaaaattatattgatgaagaaatcatggagcttagaagaggtccatggactgtcgaagaagattttattcttatgaattatatttctcaccatggtgaaggtcgttggaactccctctcacgttgtgctggtaagtaaataattcattgacgtatttccactatgaatatgtattttttctgttttagtctatccataaattaacgttttgattacttaaacaggtttaaagaggacaggaaaaagctgtcgactaagatggcttaattatcttagaccaaatattcgacatggaaatattacacttgaagaacaacttttaattcttcaacttcattttcgttggggcaataggtattaattttattttaaaaaaatatatttttatgtttagaattttttacaatagcatatataagtttcaaatatcttacaactatataatt

SEQ ID NO: 11384 - DNA, 938 bp, Lycopersicon esculentum
  misc_feature (624)..(624): n is a, c, g, or t
  Predicted polypeptide sequence is orthologous to G1341
tgtggatgaccactctagtatcggctttttttttttttttttttatataatgataacattagattaacaagtagaacaaaaattacatatctcccaaagcttgaacaatgtacataatcatttttcaactaacaaagtagagttatatcaaacaaagctaacttgtatggtgcttgagagtgaaattcatcacgattagaagtataacctaaggtcttaacatgtgttcccttgagacacaaggtcataaactcttctcttcatcactcatccatgatctcataatacatccgcattgcaaccttcatctcatccttactataattgttgttaaaatcattattcctcttaagaattcttgagctctatatctggaattttagaagaaagattggattctgcaatgttcattcgcaataggcgttggttccgtccagttaatcgacaattataaacagcttttgtgcaaccttggatgacaaaatcttcttccaatattgaaggtgcaaccactgagatggaaatagagacatgtaaaaccctagaaagtaaaaggcgaagctgtcgagaggagcgagctgctagaaatgtgaagttgcttctagacagaggccacaagatgtngtcgaaagcaacgagagctgctgatggaaagaatctgcaagatagacgcctcttaagaagagagaggacctgtgccaaatccgggaaccctatgtcacctgcagccgcggactccattgtcctttaggaggatatcgacttgcaacaagggtaatgtttcttgggaatttccctccatccaacattccaccgaagtaggaaagcgggccatgggggccccaaatacgtgggttgggaatgggttttacaaatctctttatttttcccccccccccccccccctcctctttttgggggtggtggttagtgggacg

SEQ ID NO: 11385 - DNA, 709 bp, Lycopersicon esculentum
  Predicted polypeptide sequence is orthologous to G1357, G1452
gattgactctggatccgaatctgataaaccgactaaagagttctctcatcacgattcctctggccacttcaaggattttgatgtcgaagatgactggtttgctgatataatgaaggatgatatcattaagctagatgattcttcacttaatcccagacctgtttccatgatcccggataggcctgaatcctctgaaatatcaaatcatgaagctcaagctgcgatgtcctctgttgttcctttccagggcactgcgaatcgaagactcagactagtaagagaaattgtaatgaagtgtggagtaaaggaatccaaaccatacaaagctattaagaagaataaagtaggagtgggcacgactagttcagtaagatggttgagaaacatgttttcagttaaatggatgaggcaatatgtgataactatatttgttgctaccttgatatttctggtcatgcttcttagtttgttgggagtctcgcagcaagtaaaacagcgtaggcatcttctcgttttggcgagcagctgaagttcatactatactgggatgttgtttaagtaataatgttatttggagtggagattgaagaatgattggttatgcgaaaacgaacaagaaccaactgtgtagagcagatgtacagttgtggtggtgcttgtagcatgtataaccatatatttatattgggatctatttggatgcataaat

SEQ ID NO: 11386 - DNA, 331 bp, Lycopersicon esculentum
  Predicted polypeptide sequence is orthologous to G1361
ttacataagtggagttgtcaaaggttacaagaaaattttggtactttatacaaattatggtagacagagaaagcctgagaaaacaaattgggtaatgcaccaatatcacttaggtgaaaatgaagaagaaaaagatggagaattagttgtttcaaaagttttctaccaaacacaacctagacaatgtggatcatcaaccataaaaaaaacaattgatcatagcaacaatattattaaccccctccttaaaacaacgaatttcgtcgattattataatcctaatcctttcgtttcatataatgttgagagccaaagctcacctcatgagtta

SEQ ID NO: 11387 - DNA, 476 bp, Lycopersicon esculentum
  Predicted polypeptide sequence is orthologous to G1364, G2345
ttttttttttttttttttgtttgggcacttaggtgctgtacaaactataatagatggtttgttccaagtgacattcaaaaccaaatggtatgtacagagcggaagagaattaaaatcaaagtatagcaaacaaatatatttgcagaaattagtaggaatcctttaggcgtctagtcctctcaaacaagtaccaacaatgttgttgacagtttaacacagatatcagcaagaagagaaaccctggcatcttgtaccagcaaaagactaaccactgttctatgtattcagcttttttttgggtatgcatccaaagttctttgttcatcttaaaattcataattgggagtttccatagtctaagccttgtgcaaaagaaccttcatacatgaactgcgtattggacccaagctgacatccaactacatcttttctaacagatgcatcaccaacccttgcagatcccttccggcagcccg

SEQ ID NO: 11388 - DNA, 1344 bp, Lycopersicon esculentum
  Predicted polypeptide sequence is orthologous to G1380
gctttcttcttttctctctctaaaattctcatccaaaaacgaccacacaatacagtagagagagaaaatcaaatcgaagattttacagaaggatatcgagtttcttcggagacgaagggtagcttaatcctccattcgatctcaaaaggggaggtgtgatttttttattttttattttaaaataatttttggatatgagaagaggcagagcaactccggcggcggcggcggcggcggtgaagccagatggatctggaggattgaaggagattaggtttcgtggagttcggaagaggccatgggggagatttgctgcagagattagagatccatggaagaaaactagggtttggttaggtacttttgattcagctgaagatgctgccaaagcttatgatgctgcagctcgaactcttcgtggacctaaagctaaaactaatttccctttacctatgtattctcagcatcatcagttcaatcgaagtttaaaccctaatgatcggttagttgacccgagattgtactcacaagaagctccgatcatttgtcaaagacctacatcgagcagtatgagtagtactgtggaatcattcagtggaccgagaccgccacgtcagcaaacggcggttttgccttcgagaaaacatcctagatcgccgccggttgagccggatgactgcaggagtgattgtgactcatcgtcttctgttgttgaagatggtgattgtgaagggggaaatgacaacatcgtttcttcatctctcagaaatccactgcctttcgatctcaactttccacctccgatggatgatgtttatgctaattcaaatgatctttactgcacagcactatgtctttgaaggaaaatggtttcaaagtttcaatctttcaattatattgaaacacacaaaaaaaatcacagatttaaagcaattgctatgaatctgttgctggaagagattttaactcttccatttacttatcctatttaatgtcatggtatttcatgatagatggattagtgtctgacaattgatctgattatgtgtccttcaactatatatgagttttgggataatgtagtcttttattgtcagatttatatacattaacatgtaaaattagagggaactttcagttctgtgttgtactattacaatgatagctctagtgtcgttgatgtaagacaatatctactctttcaatcacttaatgtaagaatcaagacttcatctaatcaaatattagcttacatgtgttcgttggcatatatgctagtttaatgttttgattgatgtgttaattcagctatcatttaatttttaaaaaaaaaaaaaaaaaaaa

SEQ ID NO: 11389 - DNA, 973 bp, Lycopersicon esculentum
  Predicted polypeptide sequence is orthologous to G1380
gagaagcagagcagccgctgcggcgagacaagttccggcgacggaagttccggtaccggcaccggtggccggagaacacaacggatctggaggatctaaggagataaggttccgtggagttcgaaagagaccatggggaagatttgcagcagagattagagatccatggaagaaaactagggtttggttgggtacttttgattctgctgaagatgctgctcgtgcttatgatgcagcagctcgtactcttcgtggacctaaagctaaaactaatttccctttaccttcttctcatcatctacctccatatcctcaccatcatcagttcaaccaaagcatcaaccctaacgatccctttgtcgattcccggttatactctcaggaccacccattagtttcacagagacctacttcaagcagcatgagtagtacggtggagtccttcagtggaccacggcagccgccgcggcagcagacggcagcttccgtgccttccagaaagtatccccggtcaccgcctgttgtcccggacgattgccatagcgactgtgactcatcgtcttctgtcgttgaagacggtgaatgtgataacgacaacatcgcttcttcctctttcagaaagccgttgcctttcgatctaaacttaccggcaccgatggatgacttcagcgccgacgcatatgccgatgatcttcactgcacagcactatgtctttgacgaaatgatggtttgtgacccacctgtcatttgataccactgcttacctagtttttctttcttttttgggtgaccggaaaaaaaaacaaaaaaaaaagaagaggaaggagccatagaagataagctaaactatgtctgctatgagtcaatctgttgttgtaagagtattcacttgtttaatttaattctcatattttatattatgggatttcttgataggtggatggatcaatgtttgtctaatttgttctgatt

SEQ ID NO: 11390 - DNA, 563 bp, Lycopersicon esculentum
  Predicted polypeptide sequence is orthologous to G1380
ctgctctgaatctgcaaacaaagcaaaatcatcttgcatttgatggaaaatcggcaaaaaaattgaaaaaatacccataaaaatccaatcttgattctcaattcaccggccatgcgccaccggaagtcgtcggagctgaaaagaccaggatctgacctccttcaacagcctgacgccgacccacctcgttatcgaggtgttcgtaaacggccatggggtagattcgcagcagagattagagatccgattaaaaagactcgagtttggctgggtacctttgacacagctgaagacgccgcacgcgcttacgacgatgctgcacgcgctctccgtggagctaaggcgaaaactaatttcaatatgttacctctaacagatgatccttatgatgatgagtttgagcttttccccaatcctagaccggcttctagcagtatgagcagtacgttggaatcgtctagtgggcctcgtggcggatcgagtagtaaggtgacccggatgaagattcctcgcccagttcgtccgatggaggaatgccggagtgattgcgattcgtcgtcgtc

SEQ ID NO: 11391 - DNA, 446 bp, Lycopersicon esculentum
  Predicted polypeptide sequence is orthologous to G1382
gctgagtctacctgcacctgttagtttagaagcctcgtcaattagtacttctgctgctgcaactgataatgaagaaacaaatcagagaggtcaatcaaatacaagcacgcaagggtcacatgctgataataaagatgtatcatcgataactgctgagagatcatcagaagatgggtataactggagaaagtatggccagaaacttgttaaaggaagtgaattcccaaggagctactacaaatgtacatacccaaactgtgaagttaaaaagatatttgagcgctctcctgatggacaaataacagagattgtgtataaagggtcccatgatcatcctaaaccccaacccaaccggaaggttactcctggtgtgcttacttccatccaagaagacagaagtgagagagatgcatgcctcactggtcaagaagacaaattcaacacta

SEQ ID NO: 11392 - DNA, 634 bp, Lycopersicon esculentum; identical to SEQ ID NO: 10472
  Predicted polypeptide sequence is orthologous to G1382

SEQ ID NO: 11393 - DNA, 627 bp, Lycopersicon esculentum
  misc_feature (583)..(583): n is a, c, g, or t
  Predicted polypeptide sequence is orthologous to G1382
cgcaactcaaagagacggaagaaagaagtacctacgagtgatgacatgactccacctatgaagtctcctagtgaatcacgacacattgttcaaactagcagtgaagtggatgtagtcaatgatggttaccggtggcgtaaatacgggcaaaaatttgtgaaaggaaatccaaatcctaggagttactaccgatgctcgagtgctggttgccctgcaaagaagcatgtggagaggtcatcccataatccaaaatcagtgattacagtatatgaagggcagcatgaccatgacatcccaccttccagaactgttatccaaaatacagcagaggctgattctaatacaacaagaataagtggagagtccacatctgaatcaggtgaaaacaaacatgttgtccatattggtgcaagttgagagcataatgccaaacaatcaaactcaatacagatttagataatgttacatcatcaagttatctaatcttatcttttttcttatttgttggaattggtcaattgttctccacttgtaggagaaaaaagaaaggataaatatatatgtattatagaaacagctgatntaacctcataattggtgtgaattcctatacttaaatgtataagt

SEQ ID NO: 11394 - DNA, 714 bp, Lycopersicon esculentum
  Predicted polypeptide sequence is orthologous to G1382
gaatccgaggagttactaccgatgctcggttgcaggttgccctgtgaagaagcatgtggagagggcatcccatgatccaaaattagtcattacaacatatgaaggacagcatgtccatgatttcccaacgtctaggcctataagccaaatttcagtagcacctgatgccggtacagcaggcatacgtgaagactccagaaccgaatcaggtgaaaagaaacatgtcgtggagtccaaaactgaatcaggtgaaatgaaacatatcagagagtcgaaaactgaagcaggtgaaaccaaacatgtcaaagagtccaaagccgaatcaggtgaaaacaaacatgttggagagtccaaaactgaatcagatggaaacaaacacgtcgaagagtccaaacctgaattggttggaaacaaacatgtcggagagtccatatctgaatcgggtgaaaacaaacatgttggtcttgacatggctgttcatattggtgcaaattgagtatcaaccatcttatgcaacaaaacaatcaacttatgcagaagtagagtttcttacaacaccagtcttccaatcttaccaaatttgttcaatcattctcttcctgaaggggagaaaagaaggttacatttcataggtacacttcttaacttgttattggcatggagctgtgttatcatatattcactgtataaaatatgtttcttagcaatgggaaa

SEQ ID NO: 11395 - DNA, 597 bp, Lycopersicon esculentum
  Predicted polypeptide sequence is orthologous to G1382
ctccggaggcttccgtcacaacgccgctggatcgaacggcggtgctaagtacaagctcatgactcctgctatgcttccgatctctaggtccgcctgtatcaccatacctcccggtctcagtccttcctccttcctcgaatctcctgttctcctttctaacatcaaagctgagccatctccgactacaggttccttctccaaatttcaaacagtgcaaggctctggtggggctgctgcattcttattgacaagaggttatgctagtggcaatacatacactgaaagaaaagcaagctgctttgaatacaaatatgccggtggatctagttctacatcaggatcattagcaactgaacatgtggtaatgctctattagaaaatattattgatgttggattagaaacaaaaagcaaatgaaacaagagcttttttattagcagtagccctctttaacaactgactgatgtttaatttagaaaaaatgaaagtttaactctgaggttcaggttcctgttcttgtgtctttctcttgatatggcatctatttgaggttaatgtcaaatgtgtgcaggttctaaatagtgttgtaacatgcta

SEQ ID NO: 11396 - DNA, 304 bp, Lycopersicon esculentum
  Predicted polypeptide sequence is orthologous to G1382
gatgtattatccgtaacatctgaaagatcatcagatgatgggtataactggcgaaagtatggccagaaacttgttaaaggaagtgaatttccgagaagctattacaaatgtacatatccaaactgcgaagtgaaaaagatatttgagcggtcacctgaaggacaaataacagagattgtttataaaggttctcatgatcatcctaaaccccaactgagccgccgattttctcctggtgctctcatgtctgttcaagaagataaatgtgagaaagaagtgtgtttcaggggttcaagagtctatg

SEQ ID NO: 11397 - DNA, 696 bp, Lycopersicon esculentum
  Predicted polypeptide sequence is orthologous to G1382
cttagtgaggtaaattctctataatgaagaggattgctttaacaagaaagtttagaggaattagatttgtcctatgcaatagatatgacgctctagtttatgtaatctggacaatttagcttttggtagtgttgtgactgcgagaatcgtggttttgcttctaagttggaccccttttgtttacatctatcctcagctattcctctcttgtaatatgtttttatactgagaattgtggttctgcttctaagtttgacccctcttgtgcttgtttcaggcaatgttgatgttcgtggaatgatttctggttttcagtttctacaggtaacccctttgccaaaccattataatagagacgcacataaccagtgttatgagaatattacgagagaggaatgatagataagtatattgtaagtttattgggtgttgctgcattagttctattttggagttccactgcttggtactgctacttactagctactaattgctatttgatgaagttagcttattctacaagactctcaccttatactgaaaggtaataatacaaaaaatgtagtaatagtttcttactcaccacattgctttgacaaatggttaagctgtctgattattctgtgttcttctaactacgtcaatttgaacggtgaaagaagcatccaagacttgaaaagtttccaacttgttctg

SEQ ID NO: 11398 - DNA, 608 bp, Lycopersicon esculentum
  Predicted polypeptide sequence is orthologous to G1435, G2741
ggccttctccatttttcttcattcaacggcatctctctcaaattcgccggaatatactccaccagcggaagaagattttagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcac

SEQ ID NO: 11399 - DNA, 508 bp, Lycopersicon esculentum
  Predicted polypeptide sequence is orthologous to G1435, G2741
caattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 11400 - DNA, 784 bp, Lycopersicon esculentum
  Predicted polypeptide sequence is orthologous to G1446
gggaaatactgaacatgttccgtttttttgttcttccccaaacatcatgccatgtccgtacactcataatcttcatccagattttcttctttcacaattttctgggtttgtagtagtttgacacttcgaatttgattcaaaaccccttatcggtcgatcggttatataattaaggatgccttttccatggaagaaggtgaagaaaacaagcatttcacaattggtgaaggatcatgtaaattctcaaagtggatctcctctaatggtggaaactggttttccaacttctcttgtcgattttgttgtcaagaatcgccgaagattcaagaaatcttccaagaaaaaaatggttgacgaccctttgttcgttctaaatcccccttcgtctgtaacgttaccctctacttctgaattcatgattgatgataatgaagttcctcctatgatccgtgtaccagaagtggaaggtgacaaacctgaatctcgcaagatgaacgacgagaaagagtggggttatggttgtctcagtatgaatcaggggttggtggccgttctgaagatgtttctcgtggcggcattggttttagggatgaacaatcttgttgtgggggtaaccatgtcagctttcttattgtttttcttggaatatttaggagaacgtttgtatggcttcttttataaggcacctttggagctgtcgaaggatggttgctctgactttcgatttcaaattcaagaaattgaggctgcacagggaactaatgttgaggatagtcaatgtatt

SEQ ID NO: 11401 - DNA, 555 bp, Lycopersicon esculentum
  Predicted polypeptide sequence is orthologous to G1446
aatgtcttgacccttgttatattcttgcttcttgtctcagatactaaatatttggagggaatttttattgagtctgaatttggattatcttcaaacatgtcttttccatggaagaagttgaagaagacaagtatatctcaattggtgaaggaccatattcattctcaaaaacctcttatggtggaaactggtttcccttcttcccttgtggatctttttgtcaagaatcgtcgaaagttcatgaaaacttccaagaaaaagagggctccttcagtggtggctgagctccctttaagttctctttcgactccaccttcccctgtatgttgcatatttgagaagtctgagttaaaggggtgtcaggaaaaagatgaaagatttgatcttgatgaagctgttgataaaaacacggtgttagtcgcgcttctgaaggtctttctggtggtgtttttggttttaggaacaaagaaacttgtaatgggaataacaatgtcagctttcttgttgtacttcattgagtattcaagtgaacgcgtatatagatggatcatgact

SEQ ID NO: 11402 - DNA, 2244 bp, Lycopersicon esculentum
  Predicted polypeptide sequence is orthologous to G1451
gtcatacctctcgccaagtatgctaaagcagtgtatcatacgcgagtttctgttggcatgaggttccgaatgctatttgaaacagaagaatcaagcatccgtaggtatatgggcacaattactggcatcggtgatctagatcctgttcgttggccaaattctcattggcagtctgtaaaggttggatgggatgaatcaactgcaggggagaggcagcctagagtttcactgtgggaaattgaacctctgacaacatttccaaagtatccatctcctttctcccttatgttgaagcggccatggccacctggactgccttcatttcctggtctatcaaatggtgatatgactatgaattctcagcttccatggctgcatggtggcatgggtgatcaggggatacaatcacttaatttccagggatttggtgttactccattcatgcagccaaggttcgatgcttctatgctaggtttgcagcctgacattttgcaagcaatggcagcattagattcttctaagcttgcaaatcagccacttatgcagttccaacatatccctagtacttcagcatcttcgattcagagccagcttttgcatccatccaatttgcaacatactttcctccaaggcctcccggagaaccaactaatatctcaggcacagatgctgcagcagcaattgcagtgccaccaatcttataatactcagcagcaacagttgcagcgccagcaattgtatcatgatcaacaacttcaggaaccccatcaagtacagcgtcaagatcagcagcaaaccaaggctcaattgtgttcagctactcagtcacagctttctcatttacaggtcctaggttcaacgggttctcaacaaacattttctgatttagttggtcatcatattaatacatctaacaacagttccaccatgcaaagtctcctgagctcattttcccataatggagcatccacttccctgaacatgtctgagaccaactccctagtgtctccttcctcatcatcaaagcgaattgctctagaatctcagatcccttcacaagctccatacatggtgacacaggctgaagttttgacggtgcctaatactaaggtctcagatttttccactttgttttcaccaaatcctggcagacaagttttggattatcaagctgtagcagttagccaaaacaatgcgctatttggagttaatggtatgtcaaacctgaagggtaacagtccggagaacggatctttacctgtgccttatgctacctctaccttcacaagtacagtgggtggcgagtatcccgttaattcagacatgacgacatcaagttgtgtagatgaatcaggtgtcttgcagtcctcagaaaatgtggatcaagcaaactcacttacagaaacctttgttaaggtttacaaatcagagtcctttggacgatcactggatatctccaaatttagcagctataatgagctgcgaagtgagcttgctcgcatgtttggccttgaaggcctgttggaggatcctgagagatcaggctggcagcttgtattcgttgaccgtgagaatgatgttctcctccttggtgatgacccctggcatgagtttgtgaacagtgtttggtacatcaagatactctctccacttgaagtgcagcagatgggcaaacagggcctcgacctaccaagtgctggcaaaacgcagaggatcactagcaatggcaatggctgcgatgatttcatgaaccggaaccattcgtgtaatattatgaatgggatccctctgggatcacttgagtactaatttatgttgcttggacactcaaaatgttattgcacccgtgttggatcgtacactacttttggaggataagacacactcgttggcaattttgacgagtttgagcaacataaactactaatgaacaagaacaaccaagtgacccctaaggtaaatgtaccatgtagttgctggtatcagcaattctttgtaccttgttctatcaaaatgttattttttgtcatgcatttcttctacctaaaaaaaaatgaggtcaaatctcatttaaaccttgtaaaccagataattttcaatgtaattatttaatgttgtattgttgttattcctgtggaacaacttcaagagacaactgtacaatagtgttactagctgaagcaatgtcttttcttcctattgtatttaagaatagactgattacttaaaaaaaaaaaaaaaaaa

SEQ ID NO: 11403 - DNA, 1087 bp, Lycopersicon esculentum
  Predicted polypeptide sequence is orthologous to G1451
gtatcttcatcctcatcatctaagcgaattgctctagaatctcagctcccttctcgggttactccatttgtggtgtcccagcctgaggatgtgatagcgcacaatacaaaggtctcggatctttcctctttactgccaccttttcctagtagagaatcgttttctgattatagaggagtagacgatagccaaagcaatgcactctatggatttacagactttttgaacatactgcagaccggtatgtccaacatgaagggtagtagtggtgataatggatctttatctattcattatgctacctctaccttcacaagtactgcgggcaatgagtacccccttaactcagacatgacagcttcaagttgtgtagatgaatcaggtttcttgcagtcctccgaaaatggggaccaagcaaacccaactaatagaatctttgtgaaggttcaaaaatcagggtcctttggacggtcactcgatatctccaaatttagcagctatcacgaacttcgaagtgagcttgctcgcatgtttgggctagaaggcttgttggaggaccctgagagatcaggttggcagcttgtaattgttgaccgagagaatgatgtcctcctcctcggtgacgatccttggcaggagtttgtgaacaatgtttggtacatcaagatactttctccacatgaagtgcaacagatagggaaagagggacttgatcttccaaatggtgtccaagcgcagacgcttcctggcaatgtcaatggatgtgatgattatatgaaccagaagggctcccgaaatactatgaacgggataccattggggtcacttgactactaatgaccattagtgtgatctgcctaaggtaattgtactgtatagttgttgttgcccttggttaatgtctgcaaattttttgtaccatgttgtgtcttaagtgtcatgtatcttttctatctaaagacaagggccaagtctcatttgtagcttgttaccccagagaagtacaatgtaaattataaatattttattattgataagactggaactaccttctagtgatcagctgcaaaaaaaaaaaaaaaaaaaa

SEQ ID NO: 11404 - DNA, 1056 bp, Lycopersicon esculentum
  Predicted polypeptide sequence is orthologous to G1451
ggaattcggcacgagggaggcaaccaagggtctcattatgggagattgagcctttgactacttttccgatgtatccatctctttttcctctaaggctaaagaggcctttctatcaaggaacctcatcttatcaggatagtaacaatgaagctattaatcgaatgtcatggttaagagggaatgctggtgagctaggacatcattcaatgaatcttcagtcttttggcatgcttccttggatgcaacagagagtcgattcaacaattctcccaaatgatattaatcagcactatcaagctatgctggctactggcttgcaaagtttttgggagtggagatttactgaaacagcaattaatgcagtttcagcagcctgtccaatatctgcaacatgcaagtactgagaattcaattttgcatcagcagcagcagcagcagcagcaaataatgcagcaagcagttcatcagcatatgctgcctgctcaaacccaaatgctgtcagagaaccttcaaaggcaatcccagcatcaatccaataatcagtcagaagaacaggctcaccaacacacttaccaagaagcattccaactcccgcacgaccagctccagcagaggcaaccatcaaatgttacctctccatttttgaaagcagattttgcagatttgacctctaagttttcagcatctgttgccccttcaggcgtgcaaaatatgcttggttcgttgtgttctgaaggaagtaataattcattgaatatcaacagaactggtcagtccgtgatcatagagcagtcgcctcaacagtcctggatgtcaaaatttacagagtcacaactaaatacgtgctccaactcatcatcacttccaacttacgggaaagatacattcaatcctaggggaaattgtagcttggattcccagaatcaagcgctttttggtgctaatattgattcttcagggcatctccttccgaccacagtgtctaatggtactactacatgtgctgatttgtccttaatgccacttggggcttctggatatcagaattctttatat

SEQ ID NO: 11405 - DNA, 509 bp, Lycopersicon esculentum
  Predicted polypeptide sequence is orthologous to G1451
gagagagagaactagtctcggtttttttttttttttttttcgaaaaaagggaatttactcacaaaagttcaactgcattaacaagtttacaaatcaagattcttagtctacatcacatatgtcctgatcctcagtacagcgatcaagattaactaatacaaatagcattgtaatacaaatgacagatggggattaagtctttactacataaagaacagtgtcttagaaacgagaccggattaattaggcgaaagcaaaagaacgccaagctcttgtgaagcagagccacacttggtttatcgaacaacgacagcagtcagtaatcaagtgatcctatagatggaagtccggacatgaaatctcgaccatcagcactattattactgctcatcctttcaggtggaccgcggtttagggatccaacctcctctttccccagtttctgcacatcctcgggtgaaagaattttgatgtaccaaacattattgacaaattcctcccacggatcg

SEQ ID NO: 11406 - DNA, 595 bp, Lycopersicon esculentum
  Predicted polypeptide sequence is orthologous to G1451
tggctacgtggtgacatgggagaacaagggatgcagtcgcttaattttcagggatttggtgcaactccgtttatgcaaccaagaatggatgcttctatgttaggtttgcaacctgacattctgcaaacaatgacagcactagatccatcgaaacttgcaaatcaatcccttatgcagttccaacatagtattcccaacagttcagcgcctttgagtcagattcagatgttgcagccttctcattcacagcataatctgatacaaggcttttctgaaaaccacttaatatctcaggcgcagatgcttcagcagcaattacagccgtcaaaacttcaatgatcaacagcaattgctacagccacagctttagcagcaccaagaagtgaactcgcagtttcaacatcaatagcaaactaagaccatatctggtctctctcagatggcttcagccacacagccccatctttctcatttgcaagtcctaagttcgactggttccctgcaaaccttttctgatatactgggtaaccatgtcaatgcatctagtaattctaatatgcaaagtctgttgagttcattttcccgtgatggagca

SEQ ID NO: 11407 - DNA, 512 bp, Lycopersicon esculentum
  Predicted polypeptide sequence is orthologous to G1451
gagaaaacgagtggatgactaaaatatatagaacgaaaaaaggtggttgtagagatgatataggaaataaatcgaggacaaagttgttaaacgaatgaaatgccgaatattaacggtgaaaaggatctctcacgcgctttaaaaggtgagtaatctcaccaatctggccagtaagcattaagcgttaaaaaatgggcatgaaaagaggagccagagggttgaaatgaaactagattgagttggagtgacaaaatgaaatatcgacacatgttaaggggttgtgtatgtatttggctttctttctttctaaaattcgatttgataatatgttggatagaaggatgattacttgctgctgctgctcatgctgctgctactaatagctgtttcaatgtcttttttaacccaagggctagcccatccgaatttgttatacctctttcaaaatacatcaaagctgtatatcacactcgtgtttctgttggaatgcgctttcggatgctatttgaaac

SEQ ID NO: 11408 - DNA, 577 bp, Lycopersicon esculentum
  Predicted polypeptide sequence is orthologous to G1451
tttgaatttcaatataattggtcagcagcctgtgatcatggagcatcggcggcagcagaaatcttggatggcaaaattcgcaaattcacaattgaacatgggctccagttcaccctctctctctggatatgggaaagaaacttccaattcacaggaaacatgtagtctagatgcccagaatcaatctctttttggtgctaatgttgattcttcagggcttctcctccctacaactgtgtctaacgtcgctactacatcaattgatgctgatatatcctctatgccactagggacttctggatttccgaatcccttgtatagttatgtgcaagattctactgacttgttgcataatgtagggcaagctgatgcacaaactgtgccccgtacatttgtcaaggtttacaaatcagcgtcccttgggaggtcattggacatcactcggttcaatagctatcatgagctacgacaggaacttggacagatgttcgggatcgaagggtttcttgaaaaccctcaaagatcaggctggcagcttgtatttgttgacagggagaatgatgtccttctccttgga

SEQ ID NO: 11409 - DNA, 610 bp, Lycopersicon esculentum
  Predicted polypeptide sequence is orthologous to G1451
cgtctatgcaggtttacaaatcgggatgtgttgggaggtcactggatatcactcagttccacagctatcatgagctgcgacgggaattggggcagatgttcggtattgagggattccttgaagaccctcaaagatcaggctggcagcttgtatttgttgacagggagaatgatatccttctccttggagacgatccatgggaggcgtttgtcaataacgtctggtatataaaaatcctttcacccgaagatgtgcagaagctgggaaaggaagaggctgaatccctgaaccgtggagcggttgaaaggatgagcagcactaatgctgatgatcgggatcttatttctggaatgccatctcttggatcgctggagtactgattgttggaatgcttcaaaagaagaggactgattctgattctcaatcttctcaagggtcagaaattcaaatttcatgcttcataacctggcttctttagctttcgtctaattggtccatctcccaattgtatgttgtattttgcgtttggatgtagctgtaataggacttaagggttctcccatttgtatggtgtagttatcattgtaatcctgttgtacaagttagtata

SEQ ID NO: 11410 - DNA, 1388 bp, Lycopersicon esculentum
  Predicted polypeptide sequence is orthologous to G1480
aaaaataaaaagcaaatcaatttttgattctctcacttaacacagaaagaaaaaactaatcgaaataatgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaattattttttatatatatatttattatctctaattattaaaaaaaaaaaaaaaaaatttgcttttttcctctttatgttgttagtgaggaggatcgtaactacgtgtatatatatctaattttgtttctctttttttgtatcaaaaagctattaaaaaaatagaaatttgtaatggataaattttgtagtgaattattaaaattttcttatattttgtttaatgatgaaatttgaaaaaaaaaaa

SEQ ID NO: 11411 - DNA, 1377 bp, Lycopersicon esculentum
  Predicted polypeptide sequence is orthologous to G1480
gttagggtagagaaaaagaagaagaagaagaagatgggcatatttagagaagcccccaattgttttcccggaggatggaacatcggcgcggcggcacggatggcaaagtcgtgcgagtattgccacctggccgccgcgctggtgttctgtcgcacggataacacgttcgtgtgcctgtcgtgcgacactcgcttgcacgcccgccacgagcgtgtgtgggtgtgcgaggtctgcgagcaggcggcggctagtgtcacgtgcagggccgacgcggccgcgctgtgcgtcgcgtgcgatcgcgacatccactccgcgaacccgctcgcccggcgccacgagcgggttcccgtggtcccgttttacgacccggtggagtcggtcgttaagtccaccgccgccacactcctcgtatcaatcaacggtaccacaaccacagccacaaccacggccacgatcaccccagagttgggtaaagtagatacttgtattggacaccatgaaaacaacaatgatccatggattccaccaaacacaatcacatcaaagcttccattaaacacagaaatgaaagggatggatttcatatttacagattcagaaaactttcttgattttgattatcctgcttgtgtagacacacaatctcaacctcattacaattcatccaatgatagtgttgtaccagtacaagctaatactccaattaaatcattgccatttcatcatcaagaaaaacattttgagattgatttcactcaatcacacatcaaatcttacaacaccccatcactcagtgtttcttcgtcttctttagatgttggaattgtaccagatggaagttcaatttccgaaatatcatacccatatataagaactatgaataacagcaacagcagtattgatttatcgaattctgcgaatcatcaaggtgaaaaattactgggtttagatagagaagcaagagttttgcgatacagagagaagaaaaaaaacagaaaatttgagaaaactattcgttatgcttcaagaaaagcttatgctgaaacaaggccaagaattaaaggtcgatttgctaaaagaacagacggaagcgccggcgccggcgagtttgatgacgttgacgggattttctccggcaccgatttcattgcggctgagtcgcgatacggcgtcgttccttcgtttttaacttaatttaattattatattaaaaaaaaaagaaaaatagttttattttctatttttagcttataagttgtactagtatttctaattacccgaaaatatccaatgtgtagtggggtttttatgtactaatggaagggtattttggtaactaaaataatagtcaaacttttttttttgtttataaaaaaa

SEQ ID NO: 11412 - DNA, 954 bp, Lycopersicon esculentum
  Predicted polypeptide sequence is orthologous to G1481
gaaaactccaaaacccccaattttaaacattcctttcaaaaaaaaccctaaaattgtttgaattttttgattgatagaaagagaagtgaagatgatgaattgtgagttatgtggtgagaacaaatcaatgatgtattgtgaatcagatcaagctaacctttgctgggattgcgattcgaaagttcattctgctaattttctcgtagctaaacactcgagaaatctcctttgtcattcatgtcaaaattcaactccatggaatgcctctggtccaaagctttctcctactttctctctctgcaattcctgcatccaaaacccagatccaattgaacaaattggggaaacaatcgaagaaaattatcaaaccgaagcggataatgatgaagatgaatacgtgagtactgacagtgaaatcgatgattatgacgatgagaatcaagttgttcctttatcttcttctccgtcgagtgatttctctccctcgccgtcgccggtgcgttcggtgagttcttccggcagttatggagatttatcagctatcggagattacggcggtggcgcgacggcggctgataattcatctccgtggaagcgagtaagggaaagtgattgcctacattttgaggtaattatgtatttaaaagagcggaacaaagctagaattttaagtttataaattatagtttttacgggatagttgattttaaaatataaatacgaagtttacgagttattgagttttgtcgaatgcgtaagtaagattttgtagttccgtctatacatcgacgataacaatatagaaagtttagtctcacgagtgatgtttgagaatagtaaaatgtacatattattagagaggttgttttcgatagacttttgagtcgaatgcatttgacattctttttcttcaaatagaaaaggaaggtgatgtgatttggtatttgatctatc

SEQ ID NO: 11413 - DNA, 706 bp, Lycopersicon esculentum
  Predicted polypeptide sequence is orthologous to G1481
gaacacatcataatctccaaagacctaaagatttacctaaatttgagatagaaaaattgtaaaaatcttttgttcagtgactctgtatgtgtgataacaattattaacaatgaagaaatgtgagttgtgcagttccatagcaagagtttattgtgaatcagatcaagccagtctttgttgggattgtgatgccagagttcacacagccaatttccttgtagctaaacattcaaggattcttctctgtaattcttgccaatcacttaccccatggactggctctggctctaagcttggtcccactgtttctgtttgccagaaatgttttcacagaaataataatgatggcgcagatcaacatcttaatgatcataatgatacggaagaagaagaagatgatgatgatgatacggaagaagacgaagatgatggaagcagtgatggtgataatcaagttgttcctttatcttcttcaacttcagatcaacctaatcctccctcattgacttcaagctcttctagtagtgaagattccactaacagatttaacagaagaagtataattggattttcacctaacagaacagaggaaaatatccaatcccattattgtggcattacaagacctaaagagaagatagaaaggagttcatggagatggagataatcgggatatttacagctcaaaagctaattctgttatctg

SEQ ID NO: 11414 - DNA, 462 bp, Lycopersicon esculentum
  Predicted polypeptide sequence is orthologous to G1481
taatgctggtagatttgcctcgtcaagggacagaactggccaggcacgaactcatggtggtcgatatcagacaaatgcagctgctaagggaggccataatatggatggatctcgcatggtgaatcttaacaggggtattcgtgcttagttaagtggagcatacaaatttttgctgtgagagaacacaacatttgacacacatcccaaataatcatttttcagacctttattttgtagtagtttagaatttcgctagttggtatccaaacaatcgtacaaagtattctgttgaacctttctatagtgaaagtctcatcccattaaactaggactttgttctggtgttatgcacggtaggtatttcctcatattcattcattttaaatgtgttatttgctcgactcatacatgaaactttcaccaaaaccttttttgatttgttaaaaaaaaaaaaaaaaaaaa

SEQ ID NO: 11415 - DNA, 754 bp, Lycopersicon esculentum
  Predicted polypeptide sequence is orthologous to G1481
ttttttgtttgtgctagagaagtttctagaaagtttaacgatgaagaattgtgagctttgtaatggattagctaggatttactgtgaatctgaccacgcgaatttgtgttgggattgtgatttgaaggtgcattcagcgaactttttggttgcaaaacattccaggtcgttgctatgtaacgtgtgtcgatcgccgacggtttggtcagctagcggtgcgaaaattggccggacggtatctgtatgtgagagatgcgtgaatgatgaacaaactgacagagaagaggaagagaaggaggaaattgatttggaagatattcaagttgttccgtggtcatcaactccgcctccacagccggagagttcgtccagtagcagcgatgaatcgttaactgattttttttctttgaagcgaatgcgaaaagatgatgatagtggaactttaacgtcacatcgggaagttaatatgctctcgccggcgacggaggatcatggcggtgacgaagcagctgagtttgtaaagtcatttccggtgaaaatgccttcaaagatccagagaaccggtgagattctatcgggtcgggttgaaaatattggatgttcagcgacggtggagcttatcggaagaattaatcggggaggtggatagctgaagtttgtggacggctaggatttaacagctgctagtctataagcatttatagccgtcagattgactacaaaccactaatttgacgatctgcttttttttttt

SEQ ID NO: 11416 - DNA, 643 bp, Lycopersicon esculentum
  Predicted polypeptide sequence is orthologous to G1481
gaaattgttgctttttttttttgtccatttgaaaaaatacagagaaattatgaagaactgtgagctttgtacgggattggctaggatgtattgtgaatcggataacgcaagtttgtgttgggactgtgatgcgaaggttcattcagctaactttcttgcggcgaggcattctaggtctttgctatgtcaggtgtgtcaatcgcctacggcttggtcggctgccggtgcaaagcttgggaagacggtttctgtatgtgataagtgtgtggatggttactatcatagggatggagtggaagagatggaggagagtgagagcgtgaatgatgaagagagtgatacagaggacgaggaaactgattacgaagaagatgaggacgaaattgattcgggggatattcaggtggttccgtggtcaaatacgacgcctccaccgccggctagttcatctagcagtgaagattcatcaaatggctgtagaaatgtctcttcaaagcgaatgcgtgaagctgatccggatcttcagtcagatgacgacagcggaagttcgtcgtgtcaacggaaagtccatatatcgccggcgatggatgcagacggcggagacgacgcagccgctagtgttgactcatactcatcaaaaatg

SEQ ID NO: 11417 - DNA, 969 bp, Lycopersicon esculentum
  Predicted polypeptide sequence is orthologous to G1482, G1888
taaaaactctctatttcttttctttttttctcttttcacttataacaacaatcttgatccattaaaaaaaaaggatataatttgaatttaaatttgaattcaaatgaagattcaatgtgatgtgtgtaacaagaaggaagctatcgttttttgtacagcggatgaggctgctctttgtgatgattgtgatcatcgtgtccatcatgttaacaaacttgctagcaaacatcaacgtttttctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttggtatttgggtcccctcagcccctcctctttcagagtcaaagcaagagactcagatccaatttttcccttcacaaaatttgaactttggtgggcaaattggtct

SEQ ID NO: 11418 - DNA, 563 bp, Lycopersicon esculentum
  Predicted polypeptide sequence is orthologous to G1482
ggaaaacaacacaaagagaaagaaaacttcaagcaaatgttcccatctttattttttctcaatcttctatacacaatttgtgaaaatgagaagcatcaaggtctcttataaaaataataataataataataataataataataataataaatgtagtttataaagtaaatataggatatagattttctcataattttccgtcaaaggtcaattaaacaatcaactcgaaatagactttttaacacgcaattaattcattttgcctgtatatgaagaataataattattttttcattttacatataataacaattgcatctatattataaactaaatggagatgatatgaaaataaatacatgaagatatgactcaaggagttagaaaaagtgtctatggtcagtcaaacataattaattgagttaaaaattaatttatatgaagaaactcattaattaaagtaataatgtaaaaaatttaaattttaaaagaattaatttctttcttagaatagtgaaactttaatctttgacttttaacaaatattaatagtcgaattattt

SEQ ID NO: 11419 - DNA, 717 bp, Lycopersicon esculentum
  Predicted polypeptide sequence is orthologous to G1483
gtttattcgtttcatttactgcataaacccatttttgcaacttccagatcttttgcttcttcatacgtcggagtgctgaagaagtgatgaagattcagtgtaatgtttgtgaggttgcggaggcgaacgtgttgtgctgcgccgatgaggcggcgttgtgttggtcgtgtgatgagaaggttcatgctgctaataagcttgctagtaaacatcagagagttcctttatctggttcttcttcatctatgcctatgtgtgatatctgccaggaaacagttggctacttcttttgtcttgaggatcgggcattactttgccgaaaatgtgatattgctattcacacagctaatcctcatgttgctgctcaccaaagatttttgctgactggagtgaaagtaggacttgaacctgttgatcctggtggtatttcatcctcagggacatcacagtccattcagaaggtttctgagccagagtctgctccactttcaaaacggaatgcctcagtatcattggatgctcaatttaacaaagtgttacctacccaggtcagtggcattgaggattttgctcctactaagtctccgtttgctggaggttctgcagctggaagtatgccacaatggcagttcgatgaatttattggtctgagtgatttcaatcaaaattatggatacatggatgatggatcatctaaggcggataatggcaaacttg

SEQ ID NO: 11420 - DNA, 376 bp, Lycopersicon esculentum
  Predicted polypeptide sequence is orthologous to G1488
ttttttttttttttttttgctaggattgctaggaacattttatttttagctcctatctcttcatatcgtgatattttcaactttctaaaactagatggaattaggaaaatgggattgttaattcaaactttttttttaaaacgagaaaagtgcaaagtagttatcccctacactaggtgactgatactagatgaggtgcctgaaatttggaccacaattttggtgatgatgaagcagaaattcatcaccgccgtttgatacaccgaaaatagtgggttgactaagcaattgatgctggtggtgatgtgcttggtgtctctggagatccttttgcctccggagttccagaactttccgatgagaattcgagtctggt

SEQ ID NO: 11421 - DNA, 875 bp, Lycopersicon esculentum
  Predicted polypeptide sequence is orthologous to G1488
gcttcacactcaattccttcattctctcttcctttttatcagcttccgattctccatataaagaattagtctcaaacctaccgttactttgcgttttacactccaccattcttctcttacactacacaccaacaacttcttcttctaaacaatggaagcgtcggatttattcgtcagcggttttttctcgcatgccggagacgaacaaattccgaataacatcaacaataactgtaacaatttttctgtggatgatcttttggttatcccaaaggacgatgaagttatggcagacgcatttttcaacagtattacaggaaattctgctgattcttccaacgttaccgtcgttgacagctgtaattcctctgtttctggtggagatggacaatttaacggaaacctgagcggccgcagcttcaccgatgctcccttccctaacagcgaactctgtgttccgtttgatgacttggctgagcttgaatggctctcaaattttgtggaggaatcgttctcaagtgacgacgttcaaaacttgcaattcatccctgtagcaaacattaattcctcctccaccgtcaccaccgacagttcctcttccgcaaccacattttccaccggacctaactcgccacctgccttccccgccgacacctctgttcctggcaaagctcgcagcaagcgctcacgcgccgctccctgtgactggtcgtcacgccttcagctgctcttatcccctgccacatcatcatcagagagcaacaacatctcgcctccatctgttaacaacactactttcgccacggccaaagccaccaaagcgccgtcgaagaaacgagagagcgtagaaacgccgggacggaaatgcctgcact

SEQ ID NO: 11422 - DNA, 1823 bp, Lycopersicon esculentum
  Predicted polypeptide sequence is orthologous to G1493
gcagactcccatgttcttcatacccaaaaaaattaggatatatatatataaatttattaattctcatcctcttgatacctctttttgttcttctcttcctcttagagccaaaattaaaaattaaaaatttatttaaattttatataaattatccttgtctctctcttgaaatttttttttcaatatgattccttatggatgtaccaattaagatatgtactactaacttttaagatacttttgttcttgtttttgggtattttttatttatttctttactttatttttatgtaaatttgttgaaaaaaattcaaaatctgccatatcgatgcctctagtagatcaaagaaaccttttcagctttgaaaatccgaagttaagattttccgagggacaacaaccattaaataatagcaataagcaaattaacttgcttcatgggatcccaactaccatggaaccgaagcagctggctgatttgcaccagtcctcacagtcctttgtggctatgaatatgcaagggaatgctagaatgcaacaaaacaacgctctactaatgcatatgtctcaacaacaacaacaatcgtctagggctcaaatgctaaatgaaaccaataatggtcacgtttcaaggccgccattgtccatgtcacaacctgctgcagtcttatcacgaaatagcattgttgacaacgtacgagggccaatttacaatccagtctcccaaacatcttcaatagtagatttctcgctgaatcaaactactgagttgcaaaacaacagttttcctcttgtgagtagtaattcagggatgtcaactctgacatctaaaagattgcttcaggaagaagttaactctgatattaaaggatctagaggattccctcctggttacgatatatttgaagagttgcatcagcaaaaaacgcaggattggggtttaccgaatatcggatcaaacttcggtgcctctgatcattcaagtataccaggaactctagatgtctcaccgtccatgttagttcaacaaggtatttcttcaatgaagaagaatggaccaaatggaattgctcctatgggtggaccgcaacttaacctattttctggcggaaatttgcttcctgttaaagctgaacaacttcctgatacgacctatcaaaatacatttttcccggagcaatttggacaggatgatctcatgagtgcccttctgaagcagcaagaaagtgtcggacaagttgaaactgaatttggctttgatggatattcaccattggacaatcttcctgtgtaagatgcgaaaagagcgtagttgctgtaagcttacgctttgtaacatataattcagagtcactagtgtacatagttgtttttgcagctgaaacattgacttctgtgaacaaaaacgatggagtttcagctcgtcattcaattcttgatgttggattctcgtctggctgcatcttccggtctgattcttgattattgtggaattagacagcatttatgaagggtaattcgtgtatgatacttctgcatggtatcgcaaaggcgtacatgcaaagttttgacttctatatagctaggtgaaatttaggacaatttgcacatcctagaagttattttgtgctgtttgtgggatgcaacgcgtttggcgtaatgattctctttaaacgttcgagttatttactaactgcaataaccctgtgtcatttcttctatttcactttctggagtttatcttgatgtacagactaaatttggattgccacaatctgcaagtgtatgagattcttttagttgctcattcagctgatcttttc

SEQ ID NO: 11423 - DNA, 523 bp, Lycopersicon esculentum
  Predicted polypeptide sequence is orthologous to G1493
ctgatatgaatggctgtaaacttcaagaaatgatagccgaagcatttgaaatacctgttttgtcaatgtcagctgaccaaaaggaaggtgcaatcttgaaaggactgaagggtctatcagtggacgatcaaagagataaaggactctgcacagtgttgcaggagaagaaaggtaaaagagctgtccctgggaaatctgcaatgaaacagaggaaaaggggcaaagataacagtggcgatcttgttctaccaacgaagcctcagattatatggacagattcacttcaccacgcattcctggaagccattcacgacattgggtttagcaaagctgtgccaaagaagattcatgaacacatgaatgtccctggattaactagagaaaatgtctccagtcattggcagaaatatcgtaattacttgcaccgagttattgattcaagctctattaacaaagttcctgacaaaaacttagccagtagagctaatcaatcgaccatttgcgtttggaatggctggtaaac

SEQ ID NO: 11424 - DNA, 392 bp, Lycopersicon esculentum
  Predicted polypeptide sequence is orthologous to G1499
tgtcctatttggcctagttttcctcttcaaaaccctcaacaccatcaccttccctcctcctcaacccaacaacaacaacaacaacaagaagaagtagtagttgtcccttttgatcatgtgttaaacaaccatgttcaaaccctaatagaggatcaagaacacgatgatcaagacgaagatgaagaggaagaagaagagctaggagccatgaaagaaatgatgttcaaaattgcatctatgcaaccagtagacattgatccatccactatacgaaaacctaaaaggcgtaacgtacgtataagcaatgatccacaaagcgtagcagccaggctacgccgcgaaaggataagtgaaaaaatcagaatcttgcaaagattagtccctggtggaac

SEQ ID NO: 11425 - DNA, 628 bp, Lycopersicon esculentum
  Predicted polypeptide sequence is orthologous to G1506
caaatgggaagcaatggtgccttcaaggaagagaacctgcataagtcgttcaaagcattcttcagttgaaaagctcactaaagacctgtgtacgatcctacatgaacaacaatcttcatacttctctggatcttctgaagaggatttgctttttgagagtgacaagcctatggtctctgttgagattggacatggaagtgtgcttattcgacatccaaactcaataggtagagaagaagaatcagaaggcagttccctgtcggttaataacaagcgacattatgtaaatgaggcttattcacgattgtctgccccacctgtaaatattaataggggtgtcaatttaccaaatctgggcacggagataaccaagaagcctaacagtcagggaatggaacaacacccgattaaaagggataaggatcaccttgaaaaattgcacattcttggacatcatacttcaccactgtgccatatagacctgaaggatgtacttaattatgaagagttcgtgacacatttctcaagcgatgaacagaagcaactactaaaatacttagctcctgttgattcttttgcacccccagatagtctcaaaagcatgttccatagctttcattttgaggag

SEQ ID NO: 11426 - DNA, 442 bp, Lycopersicon esculentum
  Predicted polypeptide sequence is orthologous to G1506
atccgttgaaataggacatggaagtgtgctcagtcggcatccaaggtctataggtagagaagaagaatcataacccagctctctgtcggttgacaacaagcaccattcttcaaatgaagcttattcccaattgactaccccacctgtaaatattagtaagggtgtcaattcatcaaacctggttattcagagaacccagaagcctactgttcaaggagtggaacatgaacagtttaaaaggagcaaggaccaccttgaaaaattgcagattctcgggcatcataattcgccattgtgccacatagaccttaaggatgtacttaattatgaagaattcacaaggcatctgtcaagtgatgaacaacagcaactactaaagtacttacctccagttgattctttttcacctcccgagagtctcaggagcatgttcgagagctct

SEQ ID NO: 11427 - DNA, 548 bp, Lycopersicon esculentum
  Predicted polypeptide sequence is orthologous to G1510, G1779
cagcagcagcatcaacaacaccaaataatgggacaaatttcactagtactgaaacaacaacaacaacgactatgaagataaaggtacaacaacaaaagcacaaaataacaaaagtgaatgccaatcatgttgtacccttcaagaaaaggtgcaaatttttaagtagtactactactcctgcacctgaacctggacttgtacctacacctgctcctcgtgttggttcatcatcatcgtcatcattttataataataataacaacgacgtgcaacaaaagaagaagatctgtttcgaagatttctttatgaatttgagcaataacttggcaatccatcgcgttttccctcaggatgagaaggaagcagcaattttgttaatggcattatctagtgaccttgttcatggttaatggcattataaaattttcttgagtttctattattagtttaagttattaattagatggagtagcaccaaattagttgtgtgaaactgagctagaattaatactagtgagagtgagagtttttataagtcaagctacaaa

SEQ ID NO: 11428 - DNA, 520 bp, Lycopersicon esculentum
  Predicted polypeptide sequence is orthologous to G1510, G1779
caaaatttactcttcttattgccatgattcccaattacacaaattcttcttcttcttcttcatttccttttgaacttactaatgaagttcatcatgattatctaagtcataataataataatatgtctcttgttagcccttataataataactatcaattcgcttcatcatctacaaattcatcttgtcaaaatttcttcaatatttcaactactactaatattcaagatcaaagtggatatgattatcaatttcatcagccacaacaccatcatgaggttgataattttgcttcaagatcaagtggatcacatgatcatgtagacaagaaaaacaagggactcaaattaaccttatggaaaaaaggggggcaaaaagtgaagaatttgaaagtagaagatcaaaagcaacaaatcatagaaactgattatagcagcaacagctcttccaacaacaatatcatcccaattagggtttgttctgattgcaacactactaaaacccctctttggagaagtgg

SEQ ID NO: 11429 - DNA, 629 bp, Lycopersicon esculentum
  Predicted polypeptide sequence is orthologous to G1512
gcaggcgggattacccgctgagtttaagcattcaatttttcatcttttttctcaccgtctctttaccttcgctttctgcaattcgccattgttgaaacttcgtccttacgtttttcatctattgacctcatggctgtggaacaaaattttgttgatgaagatatgttcacttttgtatctgaagaagatgtttcccttgagaaggggagtgcaattccagttccagttccaacatcaagttctgacaatataacaggaggttatgattgcaatatttgtctcgactcggcacacgatcctgttgtcaccctctgcggacacctctactgctggccttgcatttacaagtggcttcaagttgatagatctactccgggatcagaagagaaatgtaaatgtccagtctgtaaggctcacatctcaaactcatcgctggtacctctttatggccgtggaacatcatccccagaatctgaatccaagaagtctcaacgggatgttgtagtaccacgcaggcctcaagccatcgagatagcaactctcgttaattcattgtctccagcttctcacgtgagtcagcaacttcatcacagacgatccgtcccctctggctttggtagctatgctgc

SEQ ID NO: 11430 - DNA, 558 bp, Lycopersicon esculentum
  Predicted polypeptide sequence is orthologous to G1512
cagtattcaatgagttcccaaacattcgtgcataaacaatttcccctgttgtcgtgccaccaggacttagcatatgttctaaagttatatgatttcgatgatcatcatgagataaaggagaaatattattattatctattagtccgtgactcgtacatctcggactaggaggtctttgtggtatgactagaccaagactcatggccttggttgatgtttttgtagcttgaccgcggccatagagtggaatcaatgttttttgtgagacttcagctttgcaaacagggcattttggctgtttgttatcgatgttttcagatgataaggcgttataatgtatccatttgtagatacaaggccaacaatagaggtgaccacataatgtaacaacaggatcatgcacaagatctagacaaatgttgcactcgaaaccttgaggtgaattttcttcaagtttatcgagattgcttgtcttccatttttcaaaagaattatcgcgttgatcaaattccactatttggtcttgaaaaatttgttctaaggccatatttgcctctc

SEQ ID NO: 11431 - DNA, 1049 bp, Lycopersicon esculentum
  Predicted polypeptide sequence is orthologous to G1519
tggatcccccgggctgcttggtctggcacataaacatttctgaaatagtgacttttggctccttgtcttctgaaagatcccagttggacattattggctgctcaaaatgttcttttcgtgcagatatcaaatactaggggtcttccttctaattcaattatgtattcttgctgctgaaggtctgagacgtagtagtttatcatcggtttcaacttctgctcaacaagcaccctttggaacctatcaaacttctgcaggccgaggtttaccagttttaaatgaggaaggcaatctaataactgcagaaactgagaagtatggattggttgctgaatccacatcaacctcagagtctcaaggaaacagtccaagcaaatgcacactttgcctaagcagccgccaacatccaacagccacaccttgtggtcatgtattttgctggtattgactcctgaaagtttctctttatagaaaacctaaaaaagagaggtaaatgtgaaagaagagggaaaagacataatgctcttacctttttgtttgatttgcactatttgctggaactgcataatggaatggtgcaatgaaaagcctgaatgtcccctttgtcgttctcccgtaacacattcaagcttggtttgtctgtatcattcagatttttagtcacggctattgccaaaagatatctacaaaataaatcatgaagcacaggtctgttgtgtcaagaaaagattcaatagtctacttgacgacgagatcctgttttcttttctgttgctcacacatacagctctggaagtgctgttgaggtaaactggtggttgtgagccgtgtaagtaaggagagttttgcaactaatttaccacgagtcgatgagaaacttaggcggatcattttatcgaaagcaagcacgtaacaactttacttgctttacacactgaacaacaatcattagattttccttcacaggaatggatcaattactgttaggtatgatcggtacatgtgatgtaatacaagattttgcttggtaaaaaaaaaaaaaaaaaaaa

SEQ ID NO: 11432 - DNA, 565 bp, Lycopersicon esculentum
  misc_feature (554)..(554): n is a, c, g, or t
  Predicted polypeptide sequence is orthologous to G1519
ggttctttcgaggttttgtaatttttgaggcacaatactacttagggttgagcctcgatttgtatatctgtattgtgaaccatgggatcgggagaaccttctagaacttcaaccaatgccggaaacagtgacggcggtggcgcatcaacttccggcagcagcgtcaagagatttccgctcgcagcgcagccggagattatgagggccgccgagaaagatgaccagtatgcctccttcgtctatgaagcttgccgtgatgcttttcgtcacctcttcggtacaagagtagctgtaacttaccagaacgaggcaaaactcttagggcagatgctctattatatgctgacaacaggtgcagggaagcaaacattaggagaagaatactgtgatatcactcaggttgcaggaccatatggactttcgccaacacctgcaagacgtactctttttatcttctatcagtcagctgttccatatattgcagaaagagtcagttctagagcagcttcccatggcatcaccctggctgattcaatggtggattatgcatttanggatgatccta

SEQ ID NO: 11433 - DNA, 756 bp, Lycopersicon esculentum
  Predicted polypeptide sequence is orthologous to G1521
attgtctctcttatggactccagatttaaggaaattgccgctgccgttgcccggcaatcatgtccgatatgcctctgccagatacaccatcggagcgcggcggttgttatcccatgtatgcacgcctactgcatcgtttgcatccgcagatggagcgatgtgaagagaaaatgccctctctgcaacgccgactttgattcatggttctccagaatcagcttctcctcccggaccttccagaaagagcaattatcagctcgtaacgagactaagaagttacactcaggttttgttccctctaggctgagagaccgattggcggaccgaagagtgattaggagaaggagagaagagttgaatacttttggctccagaacgaggccgttcccaaggcggcgatcctttgatcacaaaggagctttgaatccagatgatattactaggagaatcattctctggcgttccagcatttatgaagagagattgcaggctgttcctttttcatctaaaaattgccttatgcagcacatggataataggagtaccaaagaaaagatgttacagagaatagaaccttggataagaagagagctgcaggctatactgggtgatccagatccatccattatcgtccatgttgctacctcactttttatcactgagaatacacattcaacacagtggtgcgacagaaatgaatttcttgctccattgcggcccttcttgcatgaacgtgcagaagtgttttggcatgaa

SEQ ID NO: 11434 - DNA, 698 bp, Lycopersicon esculentum
  misc_feature (625)..(625): n is a, c, g, or t
  misc_feature (684)..(684): n is a, c, g, or t
  Predicted polypeptide sequence is orthologous to G1535
caagacatgcccaatggatactctagggttacatgggttgaacatgctgaggtggaggaaaatccagtgaatcaaatatttaatcactttgtaactagtggagtggcatttggagcacaaagatggttatcaatcttgcaaagacaatgtgaaaggcttgctagtcttatggctagaaatatatctgaccttggagtgataccatctccagaagcgcgaaagagcttgatgaatttggcacaaaggatgatcaagacattttgtatgaacattagtacttgttgtggtcaatcatggacagctctttctgattctcctgatgacactgttagaatcactactagaaaagttacggaaccaggacaacctaatggactaattcttagcgcggtttcaacttcttggcttccatataatcatttccaggtctttgatctcttgagagatgaacgtcgtagagctcagttggatgtactttcaaatgggaactcattacatgaagtggctcatattgcaaatggttcacatccagggaattgcatctctcttcttcgaattaatgtggctagcaattcatctcaaagtgtagagctaatgctacaagagaattgcacggatgattcanggagcctggtggtctacacaacagtagacgtggacgcgatccagctagctatgaacggngaggatccatcgtg

SEQ ID NO: 11435 - DNA, 811 bp, Lycopersicon esculentum
  Predicted polypeptide sequence is orthologous to G1538, G1545
ttagtcttcactccatctatataatttttttttcccttcaaaataaataaataaaagtcttctccatttcacttttacaccacaaaaaataaataaaaatataaacaccatgaaccatcaggttatagaagatgataatatggtacttatttcccagtactatcctgatatttacacccaacttgtaccacaacaaggagagtcaaagccgcggagaagacgtaagaagaacaaattaggagaagggagtgggaatgatcaaatgatgatgatgaggaagaggaagttaagtgaagaacaagttaatttacttgagcaaagttttggggacgagcacaaactagagtcagagagaaaggacaagctagccgctgagctagggctcgaccctagacaagttgcggtgtggttccaaaacaggagggctcgttggaagagcaagaagctagaggaggaatattcaaagttgaaatctgaacatgacaataatgttgttgagaagtgtcgtctggaaactgaggtgttgaagttgaaagaacaattgaatgaatcagagaaggagatacaaaggctattattagaacgatgtgatggggtatcgagtaattacacaagtccaagtgcttcatctttctcaatggaagcaccatttctaggggaatttggaatggatggattggacaatgtgttttatgcacaagagaataattatgttcaaggattagattgggtgaacttatatatttgatataaataattataaacatcatcatgtgattaatttctaaaaaaaaaaaaaaaaaactcgaga

SEQ ID NO: 11436 - DNA, 467 bp, Lycopersicon esculentum
  Predicted polypeptide sequence is orthologous to G1539
gctatagctaataatagggatcataaatttcaagttacataaacagtcaacatctaaatgactcatgtctagatatttttcagttcttgagtggaaggaactcaaaaaactgataatgactgccattaaaattattattcaagttcgcggcagctcctatttcatccttgtctgaaaaattattttcatcattgttgtcattgctgctacggaggggaaataattcaagagtctgtgcttcatgaccattgccttcgccttcttcttcttcgtctccgatgatgttttggtgtttttgatcacatctaaaaggtgttataaagatgttgagatgatctttgggcttgaaaagttgttttgtctgatggtcgattgttgttggcgttgatggacaactccttataattggagtacaagttgcagtagttatagtattactacaaattgttgcacaattggtgttgttg

SEQ ID NO: 11437 - DNA, 510 bp, Lycopersicon esculentum
  Predicted polypeptide sequence is orthologous to G1549
gagatcgatggggaatgcatgtaatgattaaaacaaatggctccccaactgatgtaagctattcttttccctcataagctttttatttcactttgcttttttgttacttcttttcatttttaatcatgccgtgctagctcatcatcaaacacatagcattatatttaacctccatagagaatctaaattttttaaaggataacgatcacaagttttaggaaataagtgcaacttccattgtcacatgttatataattctatatttctcattgcttattggtttgtgctcttaccatgttttaattcacgtctcaattgccaccatgtttaaatcaattgtccgtaggaagtgtttctaaggtgctgttgctatttttacatctgttcccgagttcttttttttttctttttgaactttccactaaagctattatgtcgtccacagtgaattttcacgtctgttgttataggcaagtctttgagatgggactatcaaagaagggcgattac

SEQ ID NO: 11438 - DNA, 1063 bp, Lycopersicon esculentum
  Predicted polypeptide sequence is orthologous to G1560
ctctgttccatattatatgacaataattgactagatatttgattttgtataacacatatcatgacattcgtaaaattgccatatcaaaattgatacatagttatattctatgtttaataggtcaattttgacctgattagtgcaatattacatcgtcagtgcacataacataaacttttttatattttttttatctaatacttaatcaatgggaacaagaaagatgaagaattatattaaagcttttgaggatcaaatgatgaatatatagttttttttaagaacttttatttcttaaagatttgcatatatgttcctgaggttcaaaagtctagccagagtttgttaaatctaaatccctaagaaagggaggtgtatatcttcattgacttttcactacttaaaagaaagaaaaaaaattaagaattagcgacgacagaaataccatatatatagctaaaaaacaaaatccttcttaattctacttagtgacaaaatattaaacaattttggtagtgatttgtttcaacaaagactactactccacaattattgtttatgtacactagcactactaccagcaattataattgttgttgaatatgttcctttagccgcagttactagtgacaaatacattttaccactctttgtaaatattcctaaagcctatagtgcttttggatataacgacaattaactaatatcagtaaaggcttaattaagcactgtttgttaatgtacatatttaatttattgccgctaaaaagtatttttccatgagcttgtgtctttcttttgttatggagaagaggaatgtgtttaaaaaaatgcagggatttaggaaagtaaatccagaccattgggaatttgctaatgaaggttttctgagagggaaaaagcatctcttgagaacaataaggagaagaaaaccaagtaatttcatcaagtcttcgtcatcaattaataatcaagcatcaaaaggctactaaatcacaacttcaagctatggagcaaaagcttcaagggacagaaatcaaacaagagcaaataatgagttttt

SEQ ID NO: 11439 - DNA, 272 bp, Lycopersicon esculentum
  Predicted polypeptide sequence is orthologous to G1634, G2701
agtagtagtcagttatgttgctcgaactcctagaaatgatgtcacagttgtaaagaaatctgacatgcacgtattgatattttggaagatatcaatatatgcattttctatttatcatctgagttgattcttgatgttaacattagtagtgttgttgttgcattataggcgatttcttatggggttagagaaatatggtaaaggagattggagaaacatatcgaggaatttcgtgatctctaaaacttcaacacaagtggcttgtcatgctc

SEQ ID NO: 11440 - DNA, 351 bp, Lycopersicon esculentum
  Predicted polypeptide sequence is orthologous to G1634, G2701
gcaatgtgaaagtgctattgcaatctatgaggagaaaactcctgatcgatggtttaaagtggctgccctcatccctggaaagtcagttattgatgtaatcaatcaatataaagaactcgtttcagatgcttatgatattgaagctggattggtaccaaatcctggctatttcgcctcttcgattacattggaattgattgatcattgtggattacaaacattcacaaaaagagggagtaaatcatctgatcaagagagaaaaaaaggtgtgccatggactgaagaataacacaggagatctctgatgggacttgagaagtatggaaaaggggattggaggaacatatcgaa

SEQ ID NO: 11441 - DNA, 2046 bp, Lycopersicon esculentum
  Predicted polypeptide sequence is orthologous to G1635
gctcttctcttcttcttcctcctttcttcaaaaaaaataaataaataatatttgtgtgttgtttcacacttgtttttagttttatctatcaagtgttttcttgggaattctagaactatttgtctatttattgaatttttggtttgatttaacaactttgatgttgtgttttggtgaggataaggatgaaagtttcgatctttaaaggggaaagattgtttttagtggttgtaaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccagagaatcagtctcctacctctgtgttgtctacccttggttcagatgcatttggtacggtggattccactaagccaagtgagcagtcatcacctgtttcctcagctgtcgctgagaattctggtgatcttgtactttctgaaccattcgatttggttgtagaggagagcagatcgtcacctgcccgagcttatgctacttcaaatccggccaatcaggcttgtgtgaaactagagttgtttccggaagacaatgattttgtgaaagaaggctcggatgaggcatcatccacacagtgtctgaagttgtttggtaaaaccgtattagttactgatgctcatatgccaccgacagacgagacgttgactcgaagctccttccctgcaaaatatttgccctgggattcagaatgtcctcaaagtaccttttctatcgtccctcctacgccgtcatattactttaccacaccaaatggaagttcagggcctaaccaaagtggcgttgcaactactcatttgccgtggggatcatcatgtgcagttccttgcactcaggtgcatagcccaattccaatgaagggacgtccactctttaatgacagatatttggaaggaaaggaaactcaaaaggaagggtcttcgaccggctccaatgcagaatcagtagatgcagagttgagtggagaaaagaacatggaaattgaagctcagagtagtagaaatgtggtagaagagtcggttagagccagcgtaccctctttgtttgagcgaagagcaaattccacgaagcgtgtgaagggttttgttccatataagagatgtttagctgaaagaggcgtgagttcctcaacattaactggagaagaaagagaagagcaacgaacccgattatgtttgtagttttactttctttgtgcctgtttagtttttgtttgtaaaggttagcacatccctttttggttctacttataatatccgtatgccggataactggatgaagagaagcaacaccatggcagcaaaaggcgattcatccctctaatttttgctgaatggagaagcagtcttcgtaatttttttgaatgaattgttcaaatgtatgttgataaaaatcaagtcttgcaacttaaaaaaaaaaaaaaaaaaaa

SEQ ID NO: 11442 - DNA, 867 bp, Lycopersicon esculentum
  Predicted polypeptide sequence is orthologous to G1635
ccactgcatccataccctcgcaaaatggctgattcatctatagctaacaaggcagtttcaggtcagcctgaaaggtctccttccccaaatgcatcaggaagggagagttgttctccagattcggttttgccagcaattggtctagggattgctgaatattcagttgctgagcagcagaactctcgcttttcaccagtctcttgtactacggatgcacacactgcaaatataatttctacggagaatgatgatgagagtatgagctcaaactccaacaatgtggatgcaatccacgtcacgttaaaaccagtagctgctagtatcagtctgattaccaattcagagttcatggaatgtaatatagttcatatggagaattcttgtaatggtgaaaagctagctgttgaaccaccttctgcaagtatcaagctgtttggaaagactgttttcgtaccagatgccaataaccttgctccgccagctccatacaacacagaaaaggaaaaggagatcagctatgaagatgtacttcatggattccaagctaaccaagcaaattcaccatttgtacttgccatggttccaggcaatatgattccaccagcatcttggttgtcacaaaacatgcttgaaaacaatcgtgagagtactgcggccttccctgcagctacaatttcttggtggtcctggtaccaagatctcttatatcggtccatctcatcgtgtggccaaacaaccgtggaggctgcttctcattgtcagggactaaaagatgaagaacctcaaagagagggatcatcgactggttcaagcattggctcagctagtgaagttgacgatggaaacacgagttgtgaaacagttgag

SEQ ID NO: 11443 - DNA, 757 bp, Lycopersicon esculentum
  Predicted polypeptide sequence is orthologous to G1638
gctttctttctatgattctaagttcgactatttaagagtttatcggaaatagtctttttatttagagaaataagatcttcgtaaacattattatcatcatattcgacgtgtgagattacacggtttatagagttgatcaagaagtactcgtcgcgattctgatccagagtatgttcctatctaccgagaagattattagtttttgaagtttgaagaaaattgaggattcttgatttggatatggaaactttatatccaacttgttttgtaccaaattcaaattggattatgcaacagagtaagagtaatacagaatggactaaagaagagaacaagagatttgaaagtgcacttgcaatatacgacgagactacaccaaatcgatggtttaaagtagcagaaattatccctgggaaatcagttcttgatgtgataatgcagtataaagaattggttgcagatgttagtaacatagaggctggattgctcccaaatacgaggcgtggttatacgtcttcttttgcgttggaatttgttgatcatcgtaacattcaaacgtttaataagagaggcaagtcttatgatcacgaaagaaagaaaggcgtaccatggacagaggaagaacataggcgatttcttatggggttagagaaatatggtaaaggagattggagaaacatatcgaggaatttcgtgatctctaaaactccaacacaagtggctagtcatgctcagaagtactatttgaggcaacttt

SEQ ID NO: 11444 - DNA, 753 bp, Lycopersicon esculentum
  Predicted polypeptide sequence is orthologous to G1638
gctctgtttcttcaaagttcaaatctttttcataaaaatgctgtcttgaactatctttcttttaacttttttccccttctgtgaaactttgaccttttttgagtgttggggttatggagattctatcaccagctccttatctttcaaatccaagctggtttcttgatgagggtaagagcacaaaatggactccagctgaaaataaggcttttgaggatgcacttgccttgtttgataaagatacaccagatagatggcatagagttgcagaaatggttccagggaaatcagttgttgatgtgatgaggcaatataaagaattagaagatgatgtgagcagaatagaagctggattagttactattcctggttatagtacttcaccttttacattagaatgggggaatagtcatagttttgatggatacaaacaatcttatgttgttggaggtaaaaggcctttgtctaataggccaccagaacaagagaggaagaagggtattccatggacagaagaagaacataagttgtttctaatggggcttaaaaagtatggaaagggtgattggaggaacatttcgcgtaactttgttgttactagaactccaactcaagtggctagtcatgctcagaagtactttattagacaactttctggtggaaaagataaaaggcgggcgagtattcatgacatttcaacaataaatctcaacgataatcaaacactttcacccagattaccagaaaccaact

SEQ ID NO: 11445 - DNA, 567 bp, Lycopersicon esculentum
  Predicted polypeptide sequence is orthologous to G1638
taatcaagattctcttgttatgccctttttgtgtttgattaaatgcctgtgagaaattagatagtttaaaaagactcttcatttgtcaatcatttgccaagaaaaccaaaaggggttgataattaggtggtacatgatcaagaaaacatgaatagagaaatgggatatctatcccctgcaacatatatcaagaattcaagctggttgtttgaggaaaacaagggaacaagatggacacctgaagagaacaaagtgtttgaagaagcacttgctttgtttgataaagatacacctgataaatggtataatgtagcagcaatgatccctgggaaaacagtgaatgatgtgattaaacagtacagagaattggtagaagatattagtgatatagaggcagggctaataccagtacctggctatactactagtaattctttcacattagagtgggtcaataatcaagatgcttttcatggatttaagcaattttatggtcaatctgggaaaagaagctcgtcgaatcgatcttctgaacatgaaaggaagaaaggtgtgccatggactgaa

SEQ ID NO: 11446 - DNA, 508 bp, Lycopersicon esculentum
  Predicted polypeptide sequence is orthologous to G1640
tgctgggttattaagatgtggaaaaagttgtagactcagatggattaattatttgaagagtgatttgaagagaggtaacataacctctgatgaagaagctataatcatcaagttacgtgcaactttgggtaacaggtggtctctgatagcagaacatttacctggtagaacagacaatgaaataaaaaactattggaattctcatttgagacgaaaggtggatagctttagaattccaggtgatgagaagctaccacaagcagttgttgaattagctaaaaaaggaacacaagtaaaacatattaccaaacgaggacgcagtagaagaaaaataattactagagtgtcaaattctacgaatgaaaatatcgagtttgatcatattgatgaccagatgttatggcatgacgatattgtgccgatggacgctaactatgaagtgctagatcaagattttattacaaattgtttatgggacgatcaaagagaaaatctcgaaataactgga

SEQ ID NO: 11447 - DNA, 460 bp, Lycopersicon esculentum
  Predicted polypeptide sequence is orthologous to G1645
gatggacagtcaaaactttgtgctagaggtcattggagaccagctgaagatgctaagcttaaagaacttgttgctatttatggccctcagaattggaaccttattgctgaaaagttagaaggaaggtcaggaaaaagttgtagattgagatggtttaaccagttggatccaagaatcaacagaagggcatttagtgaagaggaagaggaaagattaatggctgctcatagattgtatggtaacaaatgggcaatgatagcaagactatttccagggagaacagacaatgcagtgaagaaccattggcatgtaataatggccagaaaatatagagaacaatcaagtgcttataggagaagaaaaatgggacaatttgtttacagaagatcaacaacaacagtagttgaagaagcagataattcaagtggccaaaattctgttaaccactttagtatgaaaa

SEQ ID NO: 11448 - DNA, 1746 bp, Lycopersicon esculentum
  Predicted polypeptide sequence is orthologous to G1652, G2776
gaaaaaatctccaactttataggacataatattaagattagctgtgtcctgatctcctcttaattaattaaagtaagtcactaattcctttaatttccttatatattttactttttatgtgtatccatttccacaattttatttggatttttttttatttttgttcaggatttctccacattgtttttgggatttttcaagaatttcgtaatttacgaggtacaattctatccactggagcgaaataaacttttagcgagaattaaaattttttctttttactcgatagaattgccacttaaatataaaatagtcaattgtgggtaaaaaaaaagttatttttgttgcaaaaatgtgtggtttcaaagcccaaactcttaaaaatctagacaatttttcacgttttttttttcaagattattgaaatttagaattgaatatttatatttttgttgcaggaaatggaatattatgggtttaatcaacattggcctattagctcatatgatgagctaagtgcaatatctatagcaaattcatttggtcatgagaataatttgcatgaatcattcatctctcatcatcagccactattatgccataaaaggcctatagaattgtcccaaattattgaagaaaggccactaaaaaattccaaaacaagtcatagctggaacaatactattgaaattgatcaaatattgagctcacaatctgtggtttctcccaattattcccatttgatgaactcatcaaataattacactaaccaacaagttgtgacaatgaagcccaaagaggaaacaactaatttgtcatcaagcagtataacttttgcagctgatcattgtcataacaatatggtttgtcatcaagattcttttgctaatcagaattatatgatgtttaaggctgcatcatgtcaaggtgctaataagagtgttagcactaatggaaaattaacacaagctcaagatcatatcattgctgagaggaaaagacgcgaaaagcttagccaaagattcattgctttatctgctctaattcccggactcaaaaagatggacaaggcttcagttcttggagatgcaataaaatacttgaaacaacttcaagagaaagtgaagacgcttgaggagcaaacaaagaaaaaatcagtggaatctgttgtatttgttaagaaatatgaactttatggagatggtgaaaattcttcatcagatgaaaattactcaagtggtactgtgccagttgatgaggcactcccagaaattgaagcaagaatatctgaaaaagatgtattaattagaatccactgtgaaaaaagcaaaggagttgttgagaaaacagttgctgaaattgagaaacttcatctatcagtcatcaatacatgtgccttgtcttttggaacttctgctcttgacattaccataattgctcagatggatgaggaatttgcaatgacagtaaaggatcttgtcaaaaatttgcgctcagctctcaaagtgtttatgtgaaggggtgtgatcgttgaccaacttatcgtaatttcttttaaagcgtttgatacaacaaaagtcattttaccgttttctttttccagttctataattggatgtttagggttgtgaggtcaaattcaccttttttttttttcaaaaccaagtcctttgaagcttgtttgccgtggggttaattaagtcatttttttagggaggatttattttttaacctctcatttttgca

SEQ ID NO: 11449 - DNA, 616 bp, Lycopersicon esculentum
  Predicted polypeptide sequence is orthologous to G1652, G2776
ctgaaatggtatgagaactcttgtatactgccttgttggggagaggactattaattgtatttgattttatgtaccgatagttattaacaatattttttttcatttaatcaaatactacaggagactagcaatatgaatgatcacaactttgttaatcagagccaggcgatgacacaatttaatgaatttcctttcaattctaagcccttttctacttttacccctcctcctccctccaatgtaatttctaattacagctactccaattcaatgtcaaccaaaaatcaattcgaaaagttgaacacctttaaagtcgttaagcatgaggttccatctggaactacaataaacttctcttcttccgttaattctatggacgattctgattttggtgatatcgaggccgccatgggatttggtgctgctattacgactactactgatcagaagaaaagttacaatagaacaagtgttcaggcacaagatcacgttctagcggaaagaaagcgaagagaacgcttaactcagcgttttatagctttatctaccctcattccaaacctcaagaaggtaaatctttttttcttcttcatattcctgctcaaatcaattgaat

SEQ ID NO: 11450 - DNA, 978 bp, Lycopersicon esculentum
  Predicted polypeptide sequence is orthologous to G1655
ctcgcctcttccccctctcatttccttcaaactcttctcccccatctcgctctctctctctacataatccttctctcctccgccacctaccgccgccgtctccgccgtcaaactcaaaactcagtttgcatctatttacagaagagaagcaaacgtacaattcgcgagaatcattccgaattttgcatcagaaaattgttccttctgatggcgtcatctcaaaccgtctcgaatcccgatgttaactccagtcactcgcgagaatccaagcgcaaaaagagaagaaaaattggagatgatggggaaattgagcaacaaacgagccttgatcaatccaggtggagaacggataccgagcaacagatctactcttcaaagcttctccaggctctccgtcacgttcgccggagtaatgacaatccatctccggttaatgccggacgcgccgtcagggagaccgccgacagagtcctcgccgttacagcgaagggaagaagtcgttggagcagagcgattctcactggccgtctcagcctcaggcttagccaaatcaataaaaagcataagaaagcaaaactgaatagcggcaatataaaatcaaagaaaccagcggcgaagaagcgattgcctgctttgcaacggaaagttcgtgttctcggccgtttagttcccggttgtcagaaactcccgtttacgaaccttctagaagaaactaacgactacatatcagctctacagatgcaaatcaaagccatgacttttctgaccggcctcctctccgccggtggagcaggatcagttgccgctcaccccgatcggctcggctaagtggcttgttacaacatgtcctcttttttctttttttttctaattcttttttaatttctaaaaccctttttttatttttgttaataattgagagtttttatattggtgtattttattgtatacattccttttcttccctgtttaaaaaaa

SEQ ID NO: 11451 - DNA, 614 bp, Lycopersicon esculentum
  Predicted polypeptide sequence is orthologous to G1660
cggccatcaactccgggagctgcaccatcttcctcaccttttcgcccttcaaatgataatttggatgctcatacaaatgcattgtctgaccaggaattacagttgaaaactcgaagagaaatcatggcacttggaactaaacttggcaaaatgaatatagctgcctgggctagcaaagatggtgaggatagaaatgcatccagcttgctgaaaactgataagcaagaccaaccaaataccactggtactgagacactcgcagctgcttgggaggatgcagagaaagcgaagcacttagcctggtttaaacgagaagacatcaagatacaagcatgggaaaatcatcaacaagcaaagacagaagccgagatgaggaaaactgaggcggaggtggaaaagatgaaggcacgagcacaagacaagctaatgaacaagatagctgcggttaggtacaaagctgaagagaaactggcagcagcagaagccaggagaaacaaacatgctgtaaaaatagagaagcaagcagaatgcattcgtaaaactggtcgattaccacactcattctcctgctgccgctggtgcttctgaagagcttcaaatcactatctaatgcg

SEQ ID NO: 11452 - DNA, 503 bp, Lycopersicon esculentum
  Predicted polypeptide sequence is orthologous to G1660
ttttgtccatttggatgttgacaagattcatcactacaatttcactcttttctcagagatactgtcacacccacaagcttgaaatcatcctttatggagtatgaaagaatcgacaagagaaatttacagctgtctcctagaaaactgaggtctatgctactgggagcagaaaagaagaggaaacaagaagggaaggatgacgtagtagaagatcaagagcttgaatctgctactgtgtccttgagatcccatttgcctgagatccatgaatccggttgtaatttggagaattacaaagatgtaaatgttgtaagtgttgttcctgagagttcgacttccttagcacttgattcatcaatgtcattggagatgattaatgacacgagaatcaaagatcaatctttggttagtacaagaattacgtctcaagatgacagtagtttggactgtgatggtggaatcgatagtgttggtactgtatctactctctttgaatttcaaaa

SEQ ID NO: 11453 - DNA, 676 bp, Lycopersicon esculentum
  Predicted polypeptide sequence is orthologous to G1662
gaggaatgcatcaataagtccatgtgacagaagcatggtggaagctcaaagttttgctgctgttttccctaatgacatggatgaacatgattctccgtttgcgggtgaattgctgcatctcacaagaaaaggtatgcaacgatggaaacgcgtttctgtttatataaacaaaaaatctcaggttgtgatcaagttgaagagtaaacatgttggtggagctttttctaagaataacaaatgtgtagtatatgaagtgtgtgatgaaagtgaaccatggctattcaacaaagagattgaaagcctagatttgtaccttagagtaaagacagctcagggtcttctagagttcaagtgcaagagcaaaagccataaacaaaaatggattgatggaattcagaagcttctagataaaaccagtttatatgaagatactgaaggatcaatgacaatgttgagaatcaacaaaagcttttagactaacttagtttttcactttttgtgttattttaatgtataaaaatgtttgagatagttcttggtttgtctgtcttatgatacttcagatgtaagttgtacttactaattggagttagtatctaatatattggcagtaagacagatcttgtttgtaagaattttgtaaattcacctaaagactcattattccaaacttaat

SEQ ID NO: 11454 - DNA, 430 bp, Lycopersicon esculentum
  Predicted polypeptide sequence is orthologous to G1662
gcaataactcagtcaagaagaaagaaaaggcacgcctagaaaacgcgcatatgcacactgtcctatccatagcaggactagctgcagcattggctgcagcagcagcagcagagaactcaaacggttcgagttcaaagatgagcacggctttagcatcagctactgaactcttggcctcacattgccttgaaatggctgaatcagccggggcggatcatgatcgtgtagcctcagttgttagatcagctgtagacatacatagtgctagtgatcttgtcacactaacagctgcagctgccacagctttgagaggagaagcagctcttaagtcaagattaccaaaagaagcaaagaggaatgcatcaataagtccatgtgacagaagcatggtggaagctcaaagttttgctgctggtttccctaatgacat

SEQ ID NO: 11455 - DNA, 644 bp, Lycopersicon esculentum
  Predicted polypeptide sequence is orthologous to G1700
gatctctctcctctgctatatcctatttttttttttctgttttcttaccaaagattccatttttttgatgtgggtgttgttcaaattgaatcagattaaccgccattgttgttgattgcgatgtctcttactggaaaaggctattcagatccacatcaagaaagcagtaataattatcataatgcttcatctaattgttgctcagaagctttagctcaattgaagctttatcaagctttcatcttttcagtccctattttgtttgcttttatacttttactgttattctacttattttatcttcgtcgtcagagagtcgattggtcctcactgcggatgaggacgtctacattccacactgctaatgaatctgatgaactctcaaggtgtgaaatggggttgaagaaggaagtgagggagatgttgcctattattgtcttcaaggagagtttttctgtcaaagatactcagtgttcagtgtgcttaggggattacctggcagatgataagcttcaacaaatacctgcttgtgggcacacatttcacatgatttgcattgaccactggctagctgcccacaatacctgccccctttgccgccaatcaatccttgctccaactaatgcttgcactgaaatacctga

SEQ ID NO: 11456 - DNA, 156 bp, Lycopersicon esculentum
  Predicted polypeptide sequence is orthologous to G1706
agaggttgttggttctaaatagccctttgattgtgctgtttgcttgtgtgaattctctgataaggacaaattgatattgctccctacttgtagccatgctttccatatcaactgcattgatacttggctcctctctaactcaacgtgccctctttg

SEQ ID NO: 11457 - DNA, 684 bp, Lycopersicon esculentum
  Predicted polypeptide sequence is orthologous to G1706
gaaatcacttgtgtttggccacatattcttctgcaccacttatcgaatctcatatactttttttgaggtaaagagcatctgcagttttcttgatttttctgttattctctttatcctgtcagataaagggtttaaaattctccgttttataatcttaaaattcttggaagaagaaaaaaaaaagatttggtttttacccttttaagctctttgtctccattttactaaattgttatccatgagcagaatcagtccaattctcctatgggtaattgtaattattgctgttgtgttctttgtgtttggtcttcttcatcttcttcttaggttttatttaaagatttcttctttttcgtctatttctcaatctaatagattccctgaatcatctggttctcaagttattcaaaggcaacttcaacagctatttcgtcagcatgattctggtgtagaccaagctatcattgatactctgcctctgtttctctataaagatattaaaggcttaaaagaaccatttgattgcgctgtttgcttatgtgaattttcagaacatgataagctcagattgctccctttttgtagccatgcttttcatattcattgtatagacacatggttactgtcaaactcaacttgtcctctatgtagaggcattattagcttcgcggtttctatgggaaa

SEQ ID NO: 11458 - DNA, 301 bp, Lycopersicon esculentum
  Predicted polypeptide sequence is orthologous to G1730
tttttttttttttttttttagacgtacttatgagtctttgttcatcataagtagtagtaatgagacaaggttaaataataaatgaagtaaaaatgaggcacacagttgattagttttgtcaaaatctattacaaaagagtcatgactcaaatgtttaaataataaaattagaagaagaatccagcaacagctgaaacaagaatgatggatgaaaccttcaatgtagtggcagtgctagcagtgggtgcctcagctgatgtgggagctgagtcacttgtggtggtagagtctgttggagagg

SEQ ID NO: 11459 - DNA, 541 bp, Lycopersicon esculentum
  Predicted polypeptide sequence is orthologous to G1730
ggttgggtattgtaaaatctgtttgaatggtagtaacagaacaagatttggaattttcttggaaatttgattattgggttgtcgattggaaggtaaagttgcaatcttggaaaaaaattgggaaaaaaagatgacatcttcagctgtaaatttggtgatgacagtgattgggtttacagtgagcattatattcatagtatttgtgtgtacaaggttaatttgtgcaagaattcagtatttgacaaggaggaggtcttctgcatatacttctagatctgatcttagcattttggaacgtggtttacatgggctggagcctcttgctgtgtcgaagttccccacgaagaagtacagtgatgcatttttttcatttgcagaaaatactcaatgcatgatttgccttgctgagtatcgggaggaagatacattacgtattttgccattatgtggacactacttccacgccacatgcatcgacatatggtttcagcagcactctacatgtcctgtttgtcggatttccttacgcgagactgctgag

SEQ ID NO: 11460 - DNA, 640 bp, Lycopersicon esculentum
  Predicted polypeptide sequence is orthologous to G1743
cttcttttgctcatcactatatatatatatatatattataacaacaattataagtttttctgacgaagagaaaaaattatgggttttccggtgggatatacggatttattcctacccaaattgttagtacacttactaacggttctcggattcgtcagaaagttcatttgcacgattttcactgtttttggtttaggtgattttctcgaaccggaaatgtcgtttccgacccgacccgaatcacactcggagcttcattcagtgtcggcggcgttgatccgggagctacttccggtggtgaagttctctgagctggttgacccgccggagagttgtgcagtttgtttgtatgagtttgacggagaggatgagatccgacggttgacgaattgccggcatatttttcaccggagttgtttggatcgttggatggatcatgatcagaaaacgtgtccactttgccggacgccatttattccggacgatatgcaagagagctttaatgagagattatggttggcttccggcatttctgatttttacggcgagtattctccggtcgccgccggtttgtagcaatttttttttatagtttaaaaatgtatatatactataagataaaaaaaagagggggaaaaat

SEQ ID NO: 11461 - DNA, 506 bp, Lycopersicon esculentum
  misc_feature (36)..(36): n is a, c, g, or t
  Predicted polypeptide sequence is orthologous to G1750
gagcagttgtctcccaccctttggtttttttttttntttttggtttgtgttgtttgtggggttgaaaagagaggatttttaagctgacccaaacaagtttcttgatttctcagttgatgaatatgggtttttgtgcttttagaaagctttttaaatggtggggttttcttagaccattttctgtaatgttgattgtagttgtaatggtgggtcgttttactaattggcacaaacaaaaatgaagaattttattcattaaaaatggtttttttgtttaatttgttggtcaagatgataggtggattgaataatttttaacccattgatgttaatattttttttttcccccagggaaattttgtcaatctagttgttgatttctttatgaattgggttttttttgactgtttttctgaagaatatttaatatcttttttatattttcttcccttgattcttaattatgtgtctcccttctctttttcttatattccacttccccccct

SEQ ID NO: 11462 - DNA, 542 bp, Lycopersicon esculentum
  Predicted polypeptide sequence is orthologous to G1755
ggctgctcttgcttatgatgaagctgcaagggcgatgtatggtccttgtgcaaggctgaatctcccggactattacgcctcgtcgaaagagtcttccaaggatgattcttcgttgcctactgtatctcgttccgactcaaatacagcatcaagtttctctgaggtgtgccctgctggtgacatgatgagaggaagagccaatgttcctgcggcaagacatgaagatagatcaatagaaattgacggtgctaggactggttctaatgaaattggaacgcctttgagctcattgagagaggaagcggaagacgagaccaaggaggtgtcagataaaagtgagacttttacacctctgagctcgttgagagagcaagcggaagatgaggctaagcaggtgttagataaaagtgagacctttgaaattaaagatgagcctgcggcttgtagttatgattcatgggatatcggacaagaggacctaggtaacttttgtttggatgatgagatgtttgatgtaaatgagctgttaggcatgatggact

SEQ ID NO: 11463 - DNA, 802 bp, Lycopersicon esculentum
  misc_feature (757)..(757): n is a, c, g, or t
  misc_feature (777)..(777): n is a, c, g, or t
  Predicted polypeptide sequence is orthologous to G1765
aaagagtagaaaaaatggaaaatactatagtatgtgagagtaagataaaaaatagtgatgatgatgaagaaaatgatttgttgcttcctggttttcgatttcatccaacagatgaagagcttgtagggttttatcttaaacgcaaagtggaaaataaaagaatcaaacttgatcttatcaaagaggttgatatttataaacatgatccttgggatcttccaatgatgggcagagtaggtgataataaggaatggtatttcttcagcatgagaggaagaaagtacaaaaacagtgtaagaccaaatagagtaacaggatctggtttttggaaagcaacaggaattgataagcctgttcattcacaaagcaatgagctgtgcattggcctcaaaaaatcattagtatattataggggaagtgctggaaaaggtactaaaactgattggatgatgcatgagtttcgtctaccgcctatttggaagacgaatacttcaaatggacaacacctcccgaatctcaagaacattgctgctgaagctgaagtttggactctctgcagaatattcaaaaggatttccaattacaaaagattcacaccagattggaagcagcagcagccagttgttaaacaaagtttcgttgacacaagttctaaggcatgcagtgttcaatccgaaatcagtgatgatcaatccaataatgtcatcaatttcaaaaagatggcatttccacaaaagagcattatgaatgcatcatngtggagaaatttaaactatncagttgatcaaagaaacagttacta

SEQ ID NO: 11464 - DNA, 525 bp, Lycopersicon esculentum
  Predicted polypeptide sequence is orthologous to G1767
ttttgagtttaatgttataagtggattgaaccatttgaaagaactcacaaaagagagtttgaatataaaagaagaggaagcattggctgtgaattgcattggagcactgagaagagttgaagtagatgaaaggggagcttttataagaatgattcaatcactaaaccctaaagttgtgacaatagtagaacatgaggctgatttttctagcacaaggaatgactttgttaagtgctttgaagaatgtcttaggttctacacattgtattttgagatgcttgatgaaagctttccaacaacaagcaacgaaaggctagtgatcgaaagggaatgttctaaatgcatagttaaggttttggcttgtgataatgatattggtgatgatcaaggatatagtgaaagaagagaaagaggaaatcaatggtgtgaaagacttaaggaatgttttaccccatttacactaaatgatgatgctgttgatgatgttaaggctttgctcaagaggtataaagctggatggtcact

SEQ ID NO: 11465 - DNA, 564 bp, Lycopersicon esculentum
  Predicted polypeptide sequence is orthologous to G1767
gatgctttgaaccaaaatcactaaaggtactactactagtcttgtacatttattgtttgatgtggcaagagagatacgtaacccttttagtgttaaatggatactttgtttaggttagttagccttcaacaacaacaacaacaacaatctgatcaatactcttttaactccagcagaacttcaagcagctctagatcttctaacaaacaaaacagcacatacaattatcatccacatcataatcatcaagacgaagaatgcttcaactttttcatggatgaagatgatttctcttcttcttcttctaaacacaacaactatcctcctcctcattacaatcaatatcaacaaatctccacacccacaactacaagcagtaccccaacacatcaatctcaatctcaatatgatcatcaattctccccagcacgtgatttaaatctcgaattcgcttcctcattttctggaaaatgggccacagacattcttctagaaacttctcgtgccatagccgataagaacagtacacgtgtccaacagctcatgtggatgttgaatgagctg

SEQ ID NO: 11466 - DNA, 1077 bp, Lycopersicon esculentum
  Predicted polypeptide sequence is orthologous to G1772
ttgcccaaactgtcaccaatgccgtggagaagaatgggggatgccaaccttgtaagatgtagatgtggacagccgttttgttggttgtgccggtggagctactggcttagaccacacatggagtagcattcgaggtcacacttgtggcatttataaggaaggggaagaggataagtcgacgactgtcagaaatgatctcttgcgctatactcattattatgagcgctatatggttcatcgtgattcgttggaggctgaagcaaacatgaagcaaaaactaaagtttgaagtgttgaaactcgaagcaagggaattgctatcaaaggacttcagctgggtagaaaatggatgtaatagactccttgaattgaggcgaattctctcctgttcctatccagtttcattttacgtttttgatcagacgctgttcaaggatgaaatgacacaaaaagatagggaaataaagaagaacctttttgaaaacctgcagcagcaacttgaaataaacgttgagagactttcgatgttcttggaagaaccatttgctaaatatcctgaagataaacttttggagactagaacgaagatcatcactctctccgtactaacagacaacctctgcaaagagttgtacgattgcattgacaacgatttactgcttcctctacagcaggcgaatcataccatagctcattatagatccgagggagtggcgaaagcatcagaacttcctaattgacattccaccaacactaggcatgtgagcactctcaatcagaggcaagaaaagatgcacattccttttctcatgagctgatctacaattttatgctagagggtttgattactacagcatctaatattcttttgctacacttgatatgaatttagtctagattcttaactacatatagtttgagttgaagacaatgtatgaacattggttttcgtttggccatatcatatcatatattattataagtgggaagattcaaactgcaaagttgaattatcattttgtccctctacagttaataaatgagtacattgatattgcttttaaaaaaaaaaaaaaaa

SEQ ID NO: 11467 - DNA, 698 bp, Lycopersicon esculentum
  Predicted polypeptide sequence is orthologous to G1772
ggaggggttacttgctttcccctccaaaaaaatcaatattggtgacgaattaaaaaaagagaatgtgcagaatcccattctaattttttttttctaagtttccatttttgtgcaactttgaggtattttgattttttgggttgtcataaatatggatgacatatatggcagtgatgaagactactataatggagaatacgaggatgattatgatcgtgacccggaacccgaatctgatgatgatttatcttgtggcaaagctccttcatgcagggtaataaggaaagaatcccttttagcagcacagaaagaagatctacagagagtagtagacttgctttctctgaaagaacatcatgcacgaacgttgcttattcattatcaatgggatgtcgataaggtctttgcaatttttgttgaaagagggaaagaaagattgtttgtagaagctggtataacactagaggagaaaaatgagaatccttcctccgacccctcaaccgaatatacatgtgaaatttgctttgaggatttccctgatgagcaaacgacgttgatggaatgcaatcataggttttgcaatgattgttggacagagtatttcgtagtaaagataaatgatggtaagagtagacgtgtaacatgcatggctcagaaatgcaaagcgatatgtgatgaaggaaagattagggatttag

SEQ ID NO: 11468 - DNA, 686 bp, Lycopersicon esculentum
  Predicted polypeptide sequence is orthologous to G1777
tagctatggaagcagcgatgatgatgaatgggacaatcaacagtgcaataatgacgatgaagacgatgatgatggtgaatttcttgatgggtttacggaaattgaacaagagagaaacggaatctctggaaagggtccttcatgcaaggtaatcaggaaagagactcttttagctgcacagaaagaagacttgcaaagagtgatggacttgctatctctgaaggaacatcatgctcgaagcttgcttattcattaccgatgggaagttgacaaggtctttgcggttcttgttgagagagggacagaaatgttatatgctgaagcgggtgtgacactggaagggaaagaggaacatacttccactctgtcgacatctgaagtgacgtgtcaaatttgcttcgaagatgcccctgttgagaagaccactgtaatggactgcaaccatatattttgcaatgaatgttggacaactcatttcattgtaaaaataaatgagggtcagagtaaacaagtaacttgcatggcccaaaagtgcaatgtgatctgtgatgaaggaaagattagggatctcgtcactgcaagagatcctgctttagcagagaaatttgatcgttttctgttagagtcatatattgatgataacaagaaggttaaatggtgccctagtgttcctcattgtggaaatg

SEQ ID NO: 11469 - DNA, 532 bp, Lycopersicon esculentum
  Predicted polypeptide sequence is orthologous to G1794
gaggaaacatagctaaactcaatttccctgaaaatgttcggttattaccacaacaacaacaacaacccacaacaagattagccatatcaacctcatcatcaaccgcagctccgcgattccaattaatgtctgcagcatcaacgcgatcaccatcaccaccaccatttttttttcaatcatataatcaacctccgcgtcaatctgatcagcagcatcagaatcagcaacaacagttatttcagagctcagatatggctagagattattgggaatactcgcaattacttcaaaatccaatagatttccatggaggacaacaatcatcatctttgttagaacaaatgttactagcttcatcattgggagtgttacattcacatacatttccttcttcgtcatcttcttcattagcaacttctgcagcttcttccactacttcccctgcatatcccctgttttactctgctcaacaatcacgcttctttcagccacaaactcatcaaaatcaaagcaatagcagtagcaacagctc

SEQ ID NO: 11470 - DNA, 602 bp, Lycopersicon esculentum
  Predicted polypeptide sequence is orthologous to G1794
gttcattgttcttgtcaacttttgcaaaaataaacatttcatatatacaaatatacatgtgtaatattgttcactacaaggtggcgaattcgaatgataacaggagtagtagacaagacgatgaagggattaatgtgtttaatacgatgtttcaagggaatattaatagagaagaagaaatgtctgttatggtttctgcattaactcgtgttgttgttggtaatcatcctagtgaaaatatcgaaaatcatcatcaaaataatacattgatttctaggggtgttggagaaaaaagaggacgtgatgaagtattattacatggaactaattcttctcatatgatattatcatcaggtggtgaaggttcaagcattaggacaacaagagaagcaacattcatatacactaattcaacaaacaatagcattattgatgaatctgttaataatcaagtaagacgacgatacagaggagttagacagaggccatgggggaaatgggcagctgaaataagagatccatataaagcagcgcgtgtttggttaggtacttttgatactgctgaaggggctgctagagcttatgatgaagctgctcttaca

SEQ ID NO: 11471 - DNA, 455 bp, Lycopersicon esculentum
  Predicted polypeptide sequence is orthologous to G1794
tcatgatcatgggctggacagaaaagaagacgtgatcaagaagaaagtgttactggagaacaagctcaaaggggttatggaggtatcggagaatttaaaaatggagaatcatcttcctctgttaagctcgaagaagatacaagcctggcaacaccacaaacgagcagcatatcgacaactactgcgtcgcagacaccaccgcaagcatcggaagtaacaggtgaagaaacaggggagaggaagaggagatacagaggagtaagacagagaccatggggtaaatgggcagcagagataagagatccacataaagcagcaagagtttggttaggcacattcgatacagcagaagcagccgctatagcttatgatgacgccgctcttagattcagaggaaacagagctaaactcaatttccctgaaaatgttcggttattaccacaacaacaacaaca

SEQ ID NO: 11472 - DNA, 541 bp, Lycopersicon esculentum
  Predicted polypeptide sequence is orthologous to G1794
atttatgatgtatatttacatttttagcacatgtctacatcttttaaattgttgcatttgtccttttgtttttatatggaatgtttttgcatatgacaaacagtctttctatctctgatcagggatctagaattttcattaagagatgatgagtccatgcattatattgagtatgttgttatgggtattgatactaaattatgttatataggtggtgaaggttcaagcattaggacaacaagagaagcaacattcatatacactaattcaacaaacaatagcattattgatgaatctgttaataatcaagtaagacgacgatacagaggagttagacagaggccatgggggaaatgggcagctgaaataagagatccatataaagcagcgcgtgtttggttaggtacttttgatactgctgaaggggctgctagagcttatgatgaagctgctcttacatttagaggtagtaaagcaaaactaaatttcccagaaaatgttacattattagtgccttcttcaattcaacaacccatttact

SEQ ID NO: 11473 - DNA, 476 bp, Lycopersicon esculentum
  Predicted polypeptide sequence is orthologous to G1819
ctctcttctctaaatatctcttaatttttcttgaaatcaaattttctagtacccccttttggagtaaaaatacaaattttttccccttaatttgaatatgaattcagtgagattattgaatttctcatttataattattaatttcatgtttatgacacttttcaaatttagttttggacaaggcatggctccttcttctgctccttctccttccaatgatggtatgtaaccattttctttctttaaaatcgatcgagaatctaaatagctcgtagctaatacatttttttaaaatttactcaaattactacattaattaactatatacgtaattctgagtttaacttatatacatgatagtataaaaaattatgaaattaactcatacgcgcatttctgtaaaaagtgaagttttttatttttgaaattaagatagactatctgcaataacgtgactaatacaagttatatatgat

SEQ ID NO: 11474 - DNA, 1499 bp, Lycopersicon esculentum
  Predicted polypeptide sequence is orthologous to G1835
gaagatttgattgagttttccccagagaatgtgtgtggtggcgttgacgctgttgattgtaatgattttccaagcatttggaacgatcccttgcctgattctgacccatttttctccggcagttacagcaattcagcttcagacttctccgcggagctctcagttccgctcgaggatatcgttcaactcgagtggctttcaacgttcgtggaggattccttctcttgtgggggtttgacactcggaaaagaacattgttctgtcaaaaaggagtcctctgatagcaaattcctgacctcaagtcctgtttctgtacttgagagcagcagcagcagcagcagctcatccacgtcaagctcgggaccggggaaaacacttcctcctcttagtccatgcccccgtggtccacaacgtgctcggactaaacgtcctcgtcctacaacttttaatccccggtcagtaaatcacctcatgtttccaacatcagtaagtccccagcaatttgttgctcctggagttaactcattggactctgagaatttcgccgagtctcccatgaagaagaaaaagaaaatcaagttatcgatccctctagctccaatcgagactaatcaggataactaccagcccgcgccacaagcagttaggaaatgcttgcattgcgagataacaaagacgcctcaatggagagccggtccaatgggaccaaaaaccctctgcaacgcctgtggtgttcgttacaagaaaggcaggctctaccctgagtaccgtcctgctgcaagtcccacgttcgttccatccttgcactccaactctcacaaaaaggttctggaaatgagaagcaacgttttccccgaagaggaaacacattacaagcaggccaaacctagacgagcccgcccccttatcactgtccaagctgagaacaacaccacagctagtactactccaaccgagtaacaaaatcatcataggagcagacagagcagaaaccagtttttcctagtcctcatttttttcaggtcttttagtgttatttgtttactgttttttcattgctttgttcattggttctttgtataaagatgtaggaggctatagtaaagaagtagatgacatatagtttagttggtagctagatttaagagatgaaaatggagtcaggctaaggcagctttagtgttatttaagactaggtttggagtcttttacaagtgttagtgatctttttgttagactttgtggccttccttttttttttctcatctttttgatgaaagaattcttttgcagttactatgatttgtttttagaaatgttgtagtcttgaatgagtaatggtttcaagtaagtcttctagtcacatttccctcccaacaaattttggttcttttggtcctttgaattattttcttttgttcaaattgtaagtgtatataaactaatgttcgctataaactgttgttgttcatttaaaaaaaaaaaaaaaaaaaaaaaaa

SEQ ID NO: 11475 - DNA, 780 bp, Lycopersicon esculentum
  Predicted polypeptide sequence is orthologous to G1835
ttcaactcctttctcatttttctagatagctagctagtttcttcaaggtaaaggtttttagagtagaaaaaaatcaagaaactatggggtcaaatgtggtagatgagatagattgtggcagcttctttgaccacattgatgatttgattgatttccctcttgagagtgagaatgttggccttagttctactgattgcaaagattttccaagcatttggaatgaccccttaccggattctgactcccttttctctggcagccaccggaattctgcctctgacctctcggctgagctctcagttccgtatgaggatattgtccagcttgaatggctttcaacatttgtggaggattctttctccggcgggggattgactctcgggaaagaaaacattcctgttgagaaagagccgtcatcccaaggcaagttccagacttcgagtcctgtgtctgtgcttgaaagcagcagcagcagcagctcgtcattttccagctcgggggaaaaaactttaccccttagtccatgccaccgtggtccacaacgtgctcggaccaagcgtcctcgcccaacaacttttaatcccttcccagtatttgttgctccagttgttccaacagaatcagagaatttcgcggagtctcccatgaagaagattctgaaaccggctgaaccagaacagaaaaagaaaaagaagatcaaattctctattcctctagctccggtcgagacaaatcagaatccagtggcacaacaagcagttcggaaatgccagcattgcg

SEQ ID NO: 11476 - DNA, 304 bp, Lycopersicon esculentum
  Predicted polypeptide sequence is orthologous to G1838
caagagacggataattcttttcttgttgtggcggtgacttgacgcttgatgaaaacgttgcaggcatcatcaacaaggccgttggcaagcgagaattggccgagttgctggaaacaaggatctttaccttggaacatttggtaaattattggtcttattattcaaattggagttagaactataaatgaaggtttaaaagtgttaatcgaaatctgtattatattggcaacagctactgaggaggaagctgcggaagcgtatgacatagcagccataaagttcaggggagtgaatgctgtgacca

SEQ ID NO: 11477 - DNA, 1525 bp, Lycopersicon esculentum
  Predicted polypeptide sequence is orthologous to G1841
atgcatgtaactaatcaacagtgtgaacatattagcttaagtcggcatctctaatcttcttttattttttttattatatataaaaaaaattgttttgatttctactttatgcatgtgctcaaagagaaaaaacaaatcatatgagctaaataaaaattattttttttctttttgtttgtcagtttcaaaatcggtgaacagggtatttataattaacaaaaaattaacatctggttttttttttttgtatttaattttgtgtatatgtgctttttaaaggtggcgaattcaagaaaatcaagtgaatttgttagatttacagatacagatgatacacaaaccaccgccgtgactgcgatcggcggcggtgttgaaggcggtggtcagtttgattattcgatgtattcagggtattgtgattctcaggcgagagatatgtcggagatggtgacggagtttacacgtgtggtatcgggtcaggattatcgacccgataccagatgttattcggttaattcaccgtctccggcttattcttcgtccagctcgggttctagagctggactgaagagaagccgtgatcaacaagaatttggaactgggttgtcatcttcttcctctgttaaaattgaagaactacaagtatggttgcaccaattcccgctttcacaaccacaatcacaaccacgaccacaacaggtgagggttcgagcgaagaaacaggaggagataggaggaggaaatacagaggtgtacgacaacgaccatggggtaaatgggcagcggaaataagagatccacataaagccgccagagtttggttaggaacattcgatacagcagaagctgcagcaagagcatatgatgaagctgcattgagatttcgaggaaacagagcaaaactcaacttccctgagaacgccagattgtcatcgttaccacaaacacaaaatactgtaacgtcaacaatctccaatccatcccctctaatagctcaaccaacgtcgttcctcaatcctatccagagttcagatacaacaagagactactgggaatactcacaattgttgcaaaatccaggagattttacggatcaacaaccatcaaacttattggaacaaatgttcgttgcctcatcgatggcaatgttgcattcaaacacattgccattaatatcttcgtcttcatcgttagctacatcagcaacttcttcaacgtcatatcccctgttattttcgagttattacacaccacaaactaatcaaattcaaggaaccaacacaagtagcaccagcaccactagcagctcaagtttttctacaacattttggagtagctctagccaatatcctccatcttctagttaaattctcaaaattttcctgctttttttggggtaatattttcactaattagggagaaaattaggggttatatctattgtttagtagttgtcattatttttgaataggtaagaaatttatactccttaattctattactcttcctcaaaaaaaaaaaaaaa

SEQ ID NO: 11478 - DNA, 893 bp, Lycopersicon esculentum
  Predicted polypeptide sequence is orthologous to G1852
ggggattcatgtgttcctattcaaaatgaatttgggcttgagctgtgtgatgaatcagtagatccaagtgctgcatggtacttcaagttgaaaaaatgtgtgactaggacttcatcttccaaaggagaatttgccattgggaaaattccaaaatggccagcgaggctgatgaaagctccttcgagggcaattgtaactaaaaatggagtggatgtgtttgaagctgactcaagaagatgggcgcggagagtcgcacattataagagttcattgaacttgaaactaggaacttcatcagttcgtaatgtcatggacatgaatgcattttttggaggatttgctgcagcattatcatcagacccaatctgggtgatgaatgttgttccagcacaaaagcctttaacacttgatgtcatttatgacagaggccttattggagtttaccacgactggtgtgagcctttctcaacatatcctcggacttatgatctgattcacgtgggagccatagaatctctcataaaggatcccgtttccggcaagatcaggtgcagccttgtcgatttgatggtggaaattgatagaattcttcggcctgaaggaactgttataattcgggactctcctgaagtgatagacaaagtagagcgtattgctcctgctgtaagatggacggcaagtattcatgagaaagaacctgaatcacatggaagggagaaaatcttggtagccacgaagaatttttggaagctaccttcttcatcctactgattgatcctttggtttttgtaatgtaggtatatcctttttgtctcattattaagtcccaataacttgtttcaaatgatgcatctattctacttctttcttgtctcttcaattagcttatgtag

SEQ ID NO: 11479 - DNA, 805 bp, Lycopersicon esculentum
  Predicted polypeptide sequence is orthologous to G1852
ggcgatctatgttttttttttttttttttttacagaacccctcatccttgaacacttggattttattctacatacgctgactgaagagacaagaaagacgtcgaatagatgcgtcatttgaaacaggatcttggcacttaatgctgagacatataggatgtacctacattacaaaaaccaatggatcaatctggcggacgaagaaggtcgctaccaaaaattgttcgtggctaccaagattttctcccttgcatgtgattcaggggctttctcatgaatacttgccgtccatattacagcaggagcagtgcgctctactttgtctatcacttcaggagagtccggatttataacagccgcttcaggccgaagaattctatcagtttccaccattaaatagacaaggctgcacctgatcttgccagaaacgggatccttcatgagagattcgatggctcccacgtgaatgagatcattggccgaggatatgttgagaaggctcaaccatcggggtaactcaaaaagccttgcctagagactaagtgttaggcttgggctggacacattataagcaatgggttgaaaaatgctgaaaaatcctcaaaaacgcttatgtcatacattcaactgtgagttctcgtgaagtaaagacctattatgggttttgcccatttttgagaggtgacacacaatttttaagtaaaggctaaggagttgtaacaggggctttgaatttcaagtaactccttgagcgaaccgccccttattaggagcggcggtgggtcttaaacacgggggggatttt

SEQ ID NO: 11480 - DNA, 412 bp, Lycopersicon esculentum
  Predicted polypeptide sequence is orthologous to G1855
tttttttttttttttttttttgagcatgaattgatcttctatcctattgatctgcaaatgaagttaataattccaactataagcaataacaagaaagaaacttaataaccatacacgacgatattgaatggttgattatctattctcgttttggttcaccggtccagtaagtttttacagcaataagaatcttctctgggttgaatggtccgctctcatgatccacgatacgactctgccatctcataccgtctgcaatacttttgattttcactaatgcttctactccgtctctgaatataactgtaccttcaggcctcaatattctatccatctcaagtagaatatacgttatatcacatctgcctgatataggctgatcaaaccaccagcatgaatgagatcataagtt

SEQ ID NO: 11481 - DNA, 1698 bp, Lycopersicon esculentum
  Predicted polypeptide sequence is orthologous to G1868
gaaacacttcaggttatggtagtggagctttgaatgctggaaatatgcatgggttaatagcaggaattatatatggccattcactccatcacagtggatggagctggaacatcaggccttgatctacaagtacatcactgcaaatattccaatacccccttatctcctcaatcctataagaaaagctcttgaatctgctggtttctcaacttttgcaggccttagacccaatgctttgggatggggtgctttccatctaggattctccaatagtaatgatccagagccagggaggtgtaggagaacagatggtaaaaaatggaggtgctcaagagatgcagttgctgatcaaaagtattgcgagcgacacatgaacaggggccgacatcgttcaagaaagcctgtggaaggacaaactggcaattctgcctccggaaacaacaccggtgttactactacttccgccaagctgaccaacatgccatctgcagcatcggcggggttggcttgcggagggggcgctgcatcatccaacagtctcaatctctctcgtcacaatcaactctccaacttgcagcctgctggaactaagctgtccacaacattcccttatcttgagaggagtgatacagccaaggaaaattttggtgaaaggtattcggatacaaaaggctcttcagttgtttcagcaagtgtaaaagagcctcaatattcaatccagaaggcgcagaatctgtatggattaacctccagggccgaattcggattagtttgtgcagactctttgatcaatcccttgaataaaaattcttcgctagttaactgccgtggctatgtcaattcagatgtcagtgatcaagaaagtaaatcacagcatcatcctcttcgacaattcatggacgagtggcctaaaaaccaatctgatcaatcaaatgtttcatggccagacattgatttgcagtcagatccaactcagctctccatttccatcccattagtcacatcagacttcatgtcttcgacttcctctcccgcgaatgacaagctcacggcctcaccacgtaggtctcgggagcatgaagcaactcaaatgggactaggcattggtaccatcatcagtgaacataaccaaagacaaggaagttggattcctatatcatgggaatcttccttgggtggacctcttggtgaggtcttgcatagcactaatagcagctcaggcgattgcaagaacaagtcagctcttaatctcctgactgaaggatgggatagaagccctcggatgggatcatcaccaaccggagtcttgcaaaagtcctccttcggttccctctccaacagcagtgcagggagcagtcctagagcagaacacagtaagacaacgaacgaaggctccagtctttgtaatggccttcttggaacaactcttatgaatccaaccctacctgccatgtaatatgtaaaactaggaacatgctattttgcaactcttgaagtgagctctttccctttttccccttaatgctcacaccctttgccaaatcaaatatgtactcaagatattaaatgacttaagtattcctgttaagatttgttcatttgtttacttgtgtaacattttcaaccttgtctaaataattctcttaatctaacatgtctctaaaaaaaaaaaaaaaaaactcgagactagttctctcc

SEQ ID NO: 11482 - DNA, 737 bp, Lycopersicon esculentum
  Predicted polypeptide sequence is orthologous to G1868
ttccttttacagcctcccaattgcaggagttccaaagacagttcataatatgcaagtacataatggcatctatgcctgttccgccccacctactccttcctttgccatctccacctcaatctaacatggatttgaagttctcaagtgggtcggatccagaaccatggaggtgtaagagaacagatgggaagaaatggagatgctcaagagatgtagctccggatcagaaatattgtgagcgacatgcccacaaaagcaaaccccgttcaagaaagcctgtggaaattcacaccaatccttctccaaaatctaacaacagacactcttttcagtttccgactgtgcagccttccaatgaccaaaccaggtgtattgagtggttagggagaggagacacatgtggaaccatccctgtcgatgataattgtaacaagcaactcatgcagtcaataggattcaacacaagaaattcacctgcatttcaagtgcaacatgaacccaaattatatccaatgaactttaatcagtacatgtgtaatagcagcagtgaccaggcattggcaagtcagttaaagaatgaacactgtaacaactcgataattgcctcgttacagggcaggggaacaactagcaatgcttggcccaaagatgtattagcagcaatggctcttttacttcgctaacactttccatgtctggttggaatggggaaatggatgatgataaccacatgcaca

SEQ ID NO: 11483 - DNA, 609 bp, Lycopersicon esculentum
  Predicted polypeptide sequence is orthologous to G1880
aaccatacaacccttcattaactattcttagcatcaccaccaccaccctcactacactactagctataatcatataatgaacaaacataaaagaaaaggaattatactagtataatttagtaactaaagttgagaaagtttgagatgttcgttttgattgatattgttggcggcaacttcatgatgatgaccttctgataaacccgaagaaatataactcaatgccaatgagttattttcatcagcaatactaactctggtagttgattggaatttctgtttgcaagaatgacaagtgatttgtgaaagtgtagaattgatttgcttgatggcatgttctttcaaagcattagccttgtccaactccgcttgtgcttgttgtctaattctcttagcatttgcaaattcctgctcagccagctcgatctgccgcttcgcttgctgcctagcctcttcggcatacgccttttctgagatcgctacccttagctgctccgttgcttcatctttcagcctcaaggcatccgaactacgcttctcgttcgcgttttctgatgactcgttgaagtctgaggagccaatggagagttgtagattgtgagctgagtg

SEQ ID NO: 11484 - DNA, 463 bp, Lycopersicon esculentum
  Predicted polypeptide sequence is orthologous to G1893
ttctaatctaaagatggattgaaatttgattctataagggttggttattaggttgaaaactattgcttttatatcgtaagctaagcaaaatgttagtgtgattactgataatgattaggtcaaccaatccaaaactaatagccctcaagaatccagaagaattaataaattctgaagaacttcgaactatttttgtcctaattgcaaatgtttcatttgtatctgcatctgcctcatatttttccttccaaggattcctcactgttttatatcgttgcactgtctccctatgcatacttttattttatgcgtattgtattgcctgagttataaggcttttactttagtgatttttcaataatcaacaccttacgatagaaaccttgcagtgatctttctgacatgacattcttggttcaattattggtcttcaggttgcagacaactattacaggccagatct

SEQ ID NO: 11485 - DNA, 286 bp, Lycopersicon esculentum
  Predicted polypeptide sequence is orthologous to G1893
agctgctgctactgctgccaaagctgacaaggcctaagatattagttttgtgttactgttttccttgttgtgtttggattttgagtattcagctactgtcatctttatactaagttaagtttaagttttgttgggatattattttagaagttttgttaaggacccttgcttacacaactttgccatttataaatgtgtttagcttggctcattctgttttctttttcttctctgttcaagtgaaacataatgacagctcaatctcattatgtttcccttcaatttt

SEQ ID NO: 11486 - DNA, 159 bp, Lycopersicon esculentum
  Predicted polypeptide sequence is orthologous to G1893
cttataataataataataataactatatcataccctcatcaacaaattttcaatatttacaaccaccaccttctcctcctctgaaagaacctcttcctctacttagtttaagtcctattcatcaacatcaaggtaattattattcatctactatggaag

SEQ ID NO: 11487 - DNA, 367 bp, Lycopersicon esculentum
  Predicted polypeptide sequence is orthologous to G1895
atcatcgccaacccgtccatctgtcattgtcatcatcgccaacccttccttctgtcatcatcatcgtccccaactcctccttccttcatcgtcatcgtcccaacccctccttccgtcatcaacatcatctccaacccctcctttcgtcatcgttatcatccccaacccctctttccatcatcgtccccaaaactctagctgttgtcactttcttaagccctagtccgtcccgaatccatggtgaaagttgacattgatgttgcgattgatagccaaggaagagaacgattaagaagttcaactatagaggagcagatctggattgatagccaaattcattgcgaaagtggatactaaatttgtattg

SEQ ID NO: 11488 - DNA, 1251 bp, Lycopersicon esculentum
  Predicted polypeptide sequence is orthologous to G1902
agagaagaaactctacttctctctgagtttagtatatttggtgacgactctcacgcgtaattctgcagatcaatacacatcattcattcaaacttcaaaatctacttataccctctctcctcttttttctcaattttctgaaagatttcaattcagaatttggttactgaagtcactaatttggtgcaaaattggaggtatacaaatctggttttcataatattcagaaaattttaatagccatctatctttgtggcttataaagttgttttggtttgattaatatctattccttttggtcctcttttaagttttcctttcgccacttctcagaacaacaaatttgatttcaattctactatttttaagctgaaaattatgcaagacccatcaatttattcacaaattaagcctcaatttccagagcaggaacacctgaaatgccctagatgtgattcaccaaacacaaaattctgctactacaacaattataacctttctcagccacgccactattgcaaaagctgtagaaggtattggactaaaggcggtactcttcgtaacatacctgttggtggaggttctcgtaaaagcacaaaacgatcttcatcttcatcatcatcgagtaagaaaagttcatcaacttcaactacatcccctgcaactcctccattaacatcatcttcttcatccacaaatccaaaaccagagccattcggtatacctgcaattccatcttttgatgtgatgactactagtactggtccattcagctcactgttagcgtcaaccgagccgcaatttgggaattttctcgaagctttgaatccgaataataataatgggtccactttacagttgggtaacccagtttcgagttcgggccatcaaaatgggaatacttcatatttgggtgttcaaaatggtggagaatctaataattgttggaatggtggtaacaatggttggcccgatcttgcaattttcactccaggttcaaatttccaataaagtagtatttaatagaaggtattttaactactttactaagtatttaactttttaaacttttttttttttttaacattcttttgagagtgacgttgttgattgcactcgtagcaatacaacagaaatcacatatctagtataattctacgagtgagtttgagtactaggtaattaatgtattagtacataatttacttctgaaaaaaatgtggtgtctgagcaatgttttcaaatgcacat

SEQ ID NO: 11489 - DNA, 996 bp, Lycopersicon esculentum
  Predicted polypeptide sequence is orthologous to G1902
gtaacactctgttctctcaataagcctaaaaaacagagcaaacagaagctcacaatatgcaagatccatcatcaatatattcacagatcaatcctcagttcccagatcaacaagtcctgaaatgccctagatgtgattcaatcaacacgaagttttgttactacaacaattacaatctttctcagccacgccatttttgtaagaattgtaaaaggtattggactaaaggaggtattttgaggaatattccagttggtggaagctctcgtaagaacacaaaacgatcttcttcgaatagctgtaaacgctcctcaacgatgacgatttcatcttcaacttcatcagaacaaaattcaaaaacagagcattttgatacccctgttgttcggaacagcccgattgttgacgccaatgggcctttcggctcgctactagcatcaaacgggccggagatagggaattttttaaatgttttgaatcctaacgggcccgattcgggctcagacgctgctgccgctcaaagtgggaatagtaataataatcatgaatttttgggtgaagattctaattgttggaatggtactaatggttgggctgatcttgctatttacaccccaggttcaacctttcagtaattaattaattaattaattacaatagattattagaactttgtattagtactactaatacttatgaaaatgcacttatctttttctaagcatgaatgttggaagtgttgtttgcggattgtatactattactagtagttttcgtatcagcttgtcgtgcatctcagttttttattaatacatgtactgagtgactcagttcatgtttacgaaaacttaatatttttactttgcatcaaactagttttgtttgggtaatgcttagtgtacgtacataattgtgtgtgatttgagatttcatgtatgttattccaagggaaatgataaattatgaaatttattaaaaaaaaaaaaaaaaaactcg

SEQ ID NO: 11490 - DNA, 1074 bp, Lycopersicon esculentum
  Predicted polypeptide sequence is orthologous to G1902
gatttattactctctttcacattttcattctatcatcaaaagagtaaaactaagagcaatctcatttgcttttctcttcttttcttttttttaaaaaatgattcaagagctgtttgcaggaaacactacacttatcggagatgataatatttctaatattactccttcctcctctcctatttcttgtactacttctaattccaatattgcccctgcaagtgcaaatgcaaactctgaaaatcttagatgtccgcgttgtgattccccaaacaccaagttttgttactacaacaactacaatttaactcagcctcgtcatttctgcaagacttgtcgacgttattggactaaaggaggcgcgttacgcaacgttcctataggtggtggttgcagaaaaaacaagtccatcgctacatcaaaatcaactgctgcaaaattcaaaaattcacttccgtttgagtttattggaaaatcaagcatttttggagggttcgagcaggaaataataccttcaaattatgataataataacccttttctcttttcctcacctcatcagaatcataatcctattctttccttacttaaaggaaatcttcataaatcaattggagtgaatcaatttccttccaacaacggtatatggaaaaataattatgaagaaaacgttggtgaagtccagaatagtcgaggatttcaagagctatatcaaaggctaaaagcgtcaacaaatcgatgttatacagataatatgcatggaccatcatcatcgtcaatgattttggattcggctccggtaactggaggagagttgggttgctggaacccgaccctttcaacatggttggatctgccaacagcaaatggggcatatctttaattaataagtaatttactattttactattagggtgaagggtgcatgagatgtttgtggtatactggggatacttggacatgggtgtggcttacattttatttgcttttattctgtttttctctttgctttttgtgtgtgtttcatctataaaaatcaatgtactaaatttatttttcaaaaaaaaaaaaaaaaaa

SEQ ID NO: 11491 - DNA, 596 bp, Lycopersicon esculentum
  Predicted polypeptide sequence is orthologous to G1909
ggttgacgagaagtttgagatttaattacaatcatatctctagggactgaaggggttgacttgcatgtgtgtgcatttacttaatctgaatttgtgatttgtggaagaagagaagtttcactataaaaactgattgaaataagtttcttttctcaatcaaggaaaaagtggaaaagagtgagatggaggatcaattaggtggaagatcatcgggagagaatgatcggaatcagcagcaaagaagaatgaagatgccggaaaacaactcagcttcgccagcacaaccaccaccgcagaaatgccctcgttgtgattcaaacaataccaagttttgctactacaataattacagtttgactcagcctcgctatttctgcaagacgtgtaggaggtactggactcaaggtggaaccctaaggaacgtccccgtcggcggtggttgccgtaaaggtaaacgcacaatgaagggcggcggttcatcttcatcagctggtgaaagttcatcatctagatctcatcatcaagtactatatccgccgcagataccgaatttatcagctgctgcagctgcttttttctcaggtaacaattcgaga

SEQ ID NO: 11492 - DNA, 752 bp, Lycopersicon esculentum
  Predicted polypeptide sequence is orthologous to G1927, G2184
gagtgggcctggccccaagaatggtgagcaatatggtgcaccttttagagaagaggactggcttgatgatgagcgcctaaatgccaaagtctctgtacagccggagagcccgagagatcaggagaatactgcaaagaacattaatgtagttcctgatcctgatgatgcaattgaggaattgctgaagcgtccttttactgtagataacaattttgcattggagcagtttgttcaagaggaagatactgaaagcaccttgctaaatcagtcttcgagggatgtgaatttatacaatcattgtgctgtcgctgggccaagctgccagcagtataatgcgagggcgagctttgatctgacagagtcaggcacatcaccattacatttgcatgaggcaccagaagtctcatctgctccggtgaatcctgaaaagcccccatacgcggtggaagaggatttcttggaagattttttggagatggatgacctccttgttgtcgatccaaatgttcaaaactttgatcacggaaccccaaatggtcaagtctttgacaaacctgctggaaacctggagactctgcagtttgatgactttgatggcttatcagagtttgacctgtatcatgatgcaccttcacttcttgataatgtggggacaccagtagtggggcaaattgctgaaccatacatgaacaactttgtgaacggaattacatatcctgactcaactacatacatgagcgctttccaaatga

SEQ ID NO: 11493 - DNA, 1154 bp, Lycopersicon esculentum
  Predicted polypeptide sequence is orthologous to G1927, G2184
cttgtacaggaggaagatactcgaattaccttgctatatcattccgcaaaggaagtcaattttccccaccgcagtgcggtgattgccccagcaaaggaaagctttgacttgacacagtcaggcacatcacagcgacagttgcatgaggcactagaagtcacatctgctcctgttatttatgaacagcagccacatgtggtggaagaggattttctggagatggatgaccttcttggcccagagccaagcactcagaactttgataacttggggccgtgtgttcaaaactttgatgaggcaggccaaagtggtcaaaactttgatatgcctgctggaaacttcgaagatttgccattcgattattttgatgggttggcagagtttgacctgtaccatgatgcatccttgcttgatgatgtaagaacaactgaagtggggcaaaatactgaaccacacatgaacaacttagtgaatggttctgttaaccctgcttctacaacgtatataaacactttccagcatgaaatgatgaacaaccagccaatgtatttgaataattccgaacagattagcaatcaactgtgggtacacgatcaaaggttcaatatctcttaccccagcgaggcaaatcagttggttgctcctccagctacttcaggtgttgtatatgatagtattttggcaaatcatcctatggacgcaaatcaaaatcaactacccaatcaagatgaaggtacaccatcatggttaacctctcagttgtgggccttcgtggattctatacctactgctcctgctatagctgctgaaagtcctgtggttaatagtgcctttaagcgcatgtctagctttagtaagatgagaataaacgccaggaacatgaatgttgcggcagcaggtaacacagcaacttcaagaagttcgcgctactctaagaatgggcttttttatttttcttttgttggaatactgtgtgcaatcttatgtgtattactaggaacatttgtcgacatcttgaggagacccatatcctcttaaatatgcaaagaaaagttgatgttctatcatttggcatcttgccagaatcaatgagaagcagagcatacattctatgagtaaaaaaaaaaaaaaaaaaaaaaaaaaaaaaaaaaaaa

SEQ ID NO: 11494 - DNA, 1596 bp, Lycopersicon esculentum
  Predicted polypeptide sequence is orthologous to G1928
ggttttgttgatgccaaagtcaagaacaaatattattgaacctaatttttaggttcaaacaacttaattttgcctctatataaaagagtcaacaagcataacatgtccattgtaacttgtgaagaagctgctgcaagtttatcttcttcttccaacatgaataatgatactaatggagccttttgctatccacctcaacatcaattagttactcaacaaatcaagaaaaagagaaaccaaccaggcaatccagatccagaagcagaagtgatagctttatcacccaagacactagtggcaaccaacagattcttttgtgaaatttgtaacaaagggtttcaaagagatcaaaatctacaactccatagaagaggacacaatttgccatggaagttaaagaagagagaaaataaagaagtagtgaggaagaaagtgtatatttgtccagagtcgagctgtgtgcaccatgatccgtctagggcattaggagatcttactggaattaagaagcattttagcagaaaacatggtgagaagaagtggaaatgtgagaaatgttcaaagcgttatgctgttcaatctgattgcaaagctcacttcaagacttgtggtactagagaatacaaatgtgaatgtggtactattttctcaagacgagatagtttcatcacacacagagcattctgcgagactttagctatggagagcgcaagatcagtaataaatgaacgaaatccaacaattttctcacctcaaatgaatctccagtttcaacagcctcactactttaatagccatgaacagattcaagctgctacgtttcccatgaaaaaagagcagcaaagtagcgatttcagacatattgagattcctccatggctaattaccacgaattcacaaccatttcagcttggagctattaatcctagtccttcagtaccgctcagtaattttagctcatcgtcaatttttccagctactactaggttagatcaacaatacagtcaaagcagccacaaagatttaaatcttcatcatcagaacccaaaccctaatctcagaggacctacattaggttacgattcaatgggagaatcaggtgtggtctctccagtacacatttctgcaactgcattgctgcagaaagcagcccagtttggtgctacaattagtaacaaagcaagtgctgtcactgctactgctgcttacacaggcacagcaaaaataccccacaatactcacgtgtctgttactagtactgattctgctaccaaacaaactcagcagaaattgtcctcacgtgaagacctgaccactattactgggcctgcaaataatataagtggcatcatgacatctttttctaatggctttgatgggtcaacaatgtttgaagatgcgatattattcggtggattcaacaatttgaattcaaaaaaggagaacgaggacgaagatcaacaactctacttcaatggaagtatgaatgaggaggatcatatattaaccaaagatttcttgggtttaaaacctctctctcacactgatgacattttcaacattgctgctcttgttaatactgaatttaaaaatcat

SEQ ID NO: 11495 - DNA, 1292 bp, Lycopersicon esculentum
  Predicted polypeptide sequence is orthologous to G1928
ggaactattaattattactctttgctggcctctttcttcttttaccttttgtcatctctagggtttcagacaaagcagccaaatatattttttatatatatatatatataaacaacaaactacatctcttacttacaccaactactctacttttgcttttattttttatgagagaatgataaaaggtatgctaggagatgatagtatgtcaaatttaacaagtgcatctaatgaagcaagcatatcttcaaccaacaatagaattgaaattggtagtcatgttctctacccacaactacaaaacattcaaacccaaccacctcctaacaagaagaagagaaatctaccaggaaatccagatccagaagcagaagttgtagcattatctccaagaagtctattggcaaccaatagatttgtatgtgagatatgtaacaaaggatttcaaagagatcaaaatcttcaactacatagaagaggacataatttgccctggaaattaaagcaaagaagcaataaagaagtgaagaagaaagtatatgtgtgtccagaagcatcatgtgtacatcatcatccatcaagagccttaggggatctgactgggattaagaagcatttctgtagaaaacatggtgagaaaaaatggaaatgtgaaaaatgttcaaaacgttatgcagttcaatctgattggaaagctcactctaagatttgtggtacaagagagtatagatgtgattgtggaacccttttctctaggagggatagtttcattacacacagagccttttgtgatgctttaacagaagaaagttcaagaacaataatcccaccaccaaattcttcaacttctcatcatcttaatcttcatacacttcaaaacttccaaatgaaacaagaacagcaacaacaaaataacgacctctcctctcagttattcattcaaaaccctaatggcaatagtagtaacatgttcggtgcaccacctcctcatatgagcgcaactgcattgctacaaaaagcagcacaaattggagtaacttcttcttctcatactgctaataacatgagcgccacaacttttttcagtcctactaccagtacaacaactggcattgcaatgtcaggatcaggatcaggagcaggagtagcacgtcaatatcatccatttgaaaataataataataataataatacaaacactgattttgttactggtaatacgtcttttcctgattttggtgcgagtgtcacccctgggttcatggaacaagtccatgacatgcaaaacatga

SEQ ID NO: 11496 - DNA, 702 bp, Lycopersicon esculentum
  Predicted polypeptide sequence is orthologous to G1928
ggaaaaaacaagatttgtttgttgggttgatgccaaaggaagaagaaaccacaagactggagagttggtagattagcttgaagagggagacgaaagagatcaagattatgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatcaaaaaacacttctgtagaaaacatggagagaagaagtggaaatgtgagaaatgttcaaagcgttatgcagttcaatctgactggaaagctcactccaaaactt

SEQ ID NO: 11497 - DNA, 585 bp, Lycopersicon esculentum
  Predicted polypeptide sequence is orthologous to G1928
gtaataatagtaatcaaggaaataggctgttgttcggggatatgaattccacttcattagaaggtaatgcaagtggaaagaactcagatcctttcaatttgatgccgcgtaacaacaaaggaaaacaagttaatctgagtggaaatgaagcaatggaaggaggtttaacaagagattttcttggggtaggagggaacgaaagtaggccttttctatcgaaaaatgagctagccaagttcggtaacatatctgcttcagccatgggattaagcgattatagtgaaactcattgactggatctgttatttatatacacaaaaaagttatgtgtgcttataacaaaagcacacacattctgaatgtggattactcaaaaggtccaaacttgtggggagatatcgtttcaaaggactttcactatagtggaatgatacaatgttcagagtgtggagaaaaaaaaagttggaagaaggccaaaagcttcaatgttgatgagagaagagagagaaaggcagcagccattgtgagagatcttgtgaattgtcagagaaaaaaaaaggatggggaccactgaatgtttggaag

SEQ ID NO: 11498 - DNA, 400 bp, Lycopersicon esculentum
  misc_feature (308)..(308): n is a, c, g, or t
  misc_feature (316)..(316): n is a, c, g, or t
  Predicted polypeptide sequence is orthologous to G1928
acggtcaaacaacttaattttgcctctatataaaagagtcaacaagcataacatgaataatgatactaatggagccttttgctatccacctcaacatcaattagttactcaacaaatcacgaaaaagagaaaccaaccaggcgatccagatccagaagcagaagtgatagctttatcacccaagacactagtggcaaccaacagattcttttgtgaaatatgtaacaaagggtttcaaagagatcaaaatctacaactccatagaagaggacacaatttgccatggaagttaaagaagagagaaaatnaagaagtngtgaggaagaaagtgtatatttgtccacagtcgagctgtgtgcaccatgatccgtctaaggcattatgagatcttactggaatt

SEQ ID NO: 11499 - DNA, 652 bp, Lycopersicon esculentum
  Predicted polypeptide sequence is orthologous to G1928
gaatcagttggtagattagcttgaagagggagacgaaagagatcaagattgtgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccaggtttgaattcaaagctttttgaagtacttttgttatatgcttttttttgggttatgaaatcctttcaactttttcttttcccctttttgggaccaatcatgtggtaacagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatc

SEQ ID NO: 11500 - DNA, 748 bp, Lycopersicon esculentum
  Predicted polypeptide sequence is orthologous to G1935
ttgcgagtgtccaagtccacaatatgtagagtgtcctcttccttttatggagttatggtctaatagccaaagaggaaaaagaacatcaagaaggaaaagctctatgtggtattgaggattctcatcaaattaaaatggatactctctcctaatagaaaagttaacgaacaattaatcatgagggaacttcatggcatttgtagcctaacttgaataagtttcttggattggcttgacctaaatagaaggaagctcgagctacattgcaaaagcttttatcagcttgtgatgaagaaaattgaggatccaacatcccgtcaacagttctattcaaagcgcaaggataccatccttaagaagtccaatgagttggctgttttatgtgatgtggatgttggtcttctaatgttttctccagccggcgaagtgactagctattctagcaaagaacgtcttgaggatgtcatgctccttgctatgaacaaggctggtgaactgaacaagctatctcctgaaaatccaaatgaacaggctttgatggactctctcacacaatcaaaacatgaagccgaaatggtggagaagatagcgattgttgaggctcatgaggagaagcttaatggggtcaaagaaagactaagtgaagcacaacagaaaataaggtattacgaaccacaagtggagagtatcaactctgtccaagaagctgatgcatatgagaagttcattttgagtgctctggaactga

SEQ ID NO: 11501 - DNA, 543 bp, Lycopersicon esculentum
  Predicted polypeptide sequence is orthologous to G1935
aaattcattttgcttcactctaatacactaaactagaagcttctctctaaaactcacatgcagtggatcggaaaaagttccactgctgttttcatctccaaagctaaggcgaaaatattagaatttttcatctaaaagctcccaagctaacttcatgcttctctccaagcgatttttttcgaagtagagtactacggatccaaaagatttcatttcaatctaccaaaatcaagttctagtttgcatcttctcatgggtcgcaataagattgtgatgaagaaaattgaggattcaacatcccgtaaacagttctattcaaatcgcaaggatagcattgtgaagaagtcaaatgagctggcggttgtatgtggtacagatgtggggttgttgatgttttctccatctggtcagctgactacctattctagcaaagaaagtattgaggacatcatgatcgaagctatgaacaagtctgtgaatccgcgacccataccaaatctaaatgaacagcttttgatgcagagtctcaaacagtcaaaatct

SEQ ID NO: 11502 - DNA, 642 bp, Lycopersicon esculentum
  Predicted polypeptide sequence is orthologous to G1935
gcaaagttcattttctctatccctaaaatcctcctttgatatttttctttatattccattgttcatatacatatatacatatatatatattaaagagtggattttctaacgttacatttttaatgggatgaaatcgattgtttctagcaacaacatgaacgcgatatacgttcaaattatgttgctagatcatatcaatacgaaaaaaatgaaacttttatttttttaattgattgtatattattacattcatatatatatattgttcatatatgtatatatatctttctaaattatagaaagatttttttttttataaaaaaaaaaacatgggaagaagtaaattgccattgttgaagattgagagtttgaccaatagacaagtcacttttagcaagagaagaaatggaattctcaaaaaagtttatgaattatctgttttatgtgatgtagatgttggtattataatgttctctccttctggtcgtctcacacattattcgcgtaaaagaagaattgaagatattctttctgagctcattagtctcccagatagtgaaagaggattctacatcaacaataaagagtctgtactttggaacttaaggaagattgaaattgaagataaattttgcgatattg

SEQ ID NO: 11503 - DNA, 575 bp, Lycopersicon esculentum
  Predicted polypeptide sequence is orthologous to G1938
ctgctgcagcaagccgagccttcgattattgctgctactggcacagggacaatacctgcctcggctttagctgcagcagcctctgtttctcaacaggggatctctgtatcagctggtttaatgattgaatcgggggcgaatatcgcggggtctggtagcagtagaagtagtaatagtaggaccaattggccaatgatctgtgggaattttggaagaccccatttggctacagcaggaatgtggcctgcccctgcccctgttgtcactagttttgggtttcaatcctcatctgctccatcaagcgcgagtttaggtagtgatagttcaaattattacttacagaaaattgggtttcctggatttgatctgcctgcagctacaagtatgaatccgatgtgttttacttcaattcttggtggaagtaatcagcaactgccaggattggaactgggattatctcaagagggtcatttaggggttttgaaccagatataccagcaggcaagaatgcaacatccgcagcagcaacatcaacaacaacaacaatctccggaggaggattctcaaggatcagg

SEQ ID NO: 11504 - DNA, 663 bp, Lycopersicon esculentum
  Predicted polypeptide sequence is orthologous to G1946
gcttttgtttttttctaaaaaaaaatgactggtacaatccattcaaagagaagagagaggatcaacgctctagctagtaattcttttttggaagtgtagacattcagtatttgtaggcctggagatgaaagtgatctagatgcttaatgatggttgggtgttaagtttggcatcaaatagaaatatttcaataagtgaaaagctttaatggttgcagaaagattgtgacaagttggaagtttgcttgtgaaattagttattactggatatttttactgtagtcttgttagaaattttccaggaggcactttctttgtccatatgactatatttaataggagaaatcaacgggataagtcaaaatgattcatggacatttgaacaagactccatattcaattggtttttcagtggtgaaaattgacgagggtcatagatgtctagcatctattgtttgcatcagacgttttaggttgacaaactttagtggtgggatagtagttctattctgaatatattgcctttaagccttcatgctctggaattctgtagatcagtagggatcctctctttaccagtgacacatttctttttgtgaggcggtctctctttttcaatctgaccatttatatctactgattgttgaaccccaaaaaaaaaaaa

SEQ ID NO: 11505 - DNA, 656 bp, Lycopersicon esculentum
  Predicted polypeptide sequence is orthologous to G1946
tttcgtcatgtattgctttcaagtgaccagtcaaaagcttattgcatgtctgagtaacaacatcgccctggataactcaatcccttcatctcaaagtaatcgctagatgtaaaccaagtttgtagagaatgtagcctaacattcagctgggcaaatactctcctcaattcaaaaaggaagctcgaacgtatggaagataactactgcatcaactgcaattggtaaacatcttcagcatgggaagaaacacagataaaggtaaaagatcaagtacagtgttcttttctatttcaactatgcatactgagttacaatattcacgagttcaaaaatgataggaagattcaacaatacatcttcgcaatctgtataagcgggttgggatcccttcagaatttactatgccccagctgttcagcaagtatatccatattactcaagttgtctgactgagtctccagcaaatccatttccatcgttttatcttccagactgtgaaatggttcctctgaacctgaaaaagttccagactctaagtcagtctccatgccagcatgggagcacgctggattatccatcacttcgccttcattattctctgttattggactggacaaaagcagctgttccaacaagttgtcatcatcaggatgata

SEQ ID NO: 11506 - DNA, 586 bp, Lycopersicon esculentum
  Predicted polypeptide sequence is orthologous to G1946
gctaatccccaaaaccctgtgtatttgtgaatttatatatgatcagcgttgtgttaagtaattgaaaatttaatttcttcgtttaggaataggttctaattcaatggacgccggaggaggttctccggtgccggaaataacaccggcgccgatgcctagctcaaatgcggtaccaccttttttgatgaagacttatgatatggttgatgacccgagtactgacatgattgtttcgtggagtcctaccgatagtagctttgtgatttgggatccaccggagttcgccaagcagttactgcccaagtattttaagcatagtaacttctccagcttcgttcgtcagttgaacacttatggctttagaaaggttggttccgacctctggaaattttctaatgatggattcataagaggtcaaaagcatctgcttaaaaatattagcaggcgcaagcctgctcatggacagcagcagcagcagcagctgcatagtcagagtgcgtcagttggggcttgtgtcgaggttggaaattttgggcttgagaaagaggttgagtggctgaaaagggacaagaatgtgcttatgcaa

SEQ ID NO: 11507 - DNA, 620 bp, Lycopersicon esculentum
  Predicted polypeptide sequence is orthologous to G1946
aaaagggacaagaacgtgcttatgcaagagctggttaggctcagacaacagcagcaagccactgacaatcagttgcaagggatggtgcagcgccttcaaggtatggagctgcgacaacaacaaatgatgtcgttcctggcaaaagctgtcaacaggcctggattcttggcacagtttgttcagcagcaaaatgagagtaataagcgaatagctgaaggcagcaagaaacgaaggattaagcaggatattgaatcacaggatccatccgttactcctgcggatggacagattgttaagtaccaacctgggataaatgaggcagcaaaggcaatgttgagggagctttcaaaactagattcatctcctagattagataacttcagcaacagtcctgaaagtttcctgattggtgatggttcaccacagtctaatgcatcttcaggtcgtgtttcgggagtcactcttcaggaggtcccaccaacttctgggaagcccttgctgaatacagcttcagcaattgcaggtcaaagtttgttgccagccacttctgagatgcagtcatctcatcttggcacatgttcccaaatcatcaacaatcaattgtcaaacataatcccgtt

SEQ ID NO: 11508 - DNA, 645 bp, Lycopersicon esculentum
  Predicted polypeptide sequence is orthologous to G1948
ggttcatggccattcaaaagaaagagcgccaccaaatctctttcccacttctccaatggatgctctctttgtcaattcatctctctcccgactcaaactcaaattctcttctcaatttcctacattctctcccctgccccatcactcttatctcccacttaaaaaacttaatttaccacttgtatttgccacgcttcagaaccaacaccaacaacaatcagcagccgaagaagtagcacaagaagaatttgaagattacgatgccgacgaaacgtatggagaagttaacaaaatcattgggagtcgagcaattgaaggtgggaaaggaatggagtatttgattgagtggaaagatgaacatgcccctacctgggttccctctaatttcatcgcacaagatgttgtcgctgagtatgaaaccccttggtggaacgctgcgaaaaagtcagatgaatcggctcttcgggaacttattgaagccgaggacgacagagatgtggatgctgttgatgacgatggacgaacggctttgctctttgtttcgggactcgggtcggagccttgcgtcaagctgctcgctgaagccggcgccgacgtcaattaccgcgacaggagcggcggtttgacggctctgcatatggctgc

SEQ ID NO: 11509 - DNA, 576 bp, Lycopersicon esculentum
  Predicted polypeptide sequence is orthologous to G1948
gcagagggcagacgccgctgagcttagcgaggatggtcttgaatcaaacacctaaaggaaacccaatgcaattcgcgaggagattgggattagagaatgtgattagggtattggaggatgcaatttttgagtatgcacaagtggaggagatattggagaagagaggaaaaggtgaaaatgttgagtatttagtgaaatggaaggatggggaggataatgaatgggttaaagcatggctgatatctgaggatttggtgagagattttgaggctggattggaatatgcagaggcagagtgcatcttggagaagagagagggtgacaacgggaaaggcgagtacttggttaaatggactgatattgaggaggctacttgggaaccagaagaaaatgttgacccccttctgatagaagattttgaaaaaggtcaacagaaagtagtaagttgaattcatggtttctcttttggcttgtatttttctttttctgtggtaatataatgctcttttgttttataaactatagttgtggtaatgtatgtaattctgaggttgtctaaaaaaaaaaaaaaaaaaa

SEQ ID NO: 11510 - DNA, 590 bp, Lycopersicon esculentum
  misc_feature (571)..(571): n is a, c, g, or t
  Predicted polypeptide sequence is orthologous to G1950
ccgcactgctcttcattatgctgctagcaagggtcaagtgaaaatagctgaacttttgatttcacgtggtgctaagatcaatgcaaaagacaaggtaggatgcaccccattgcatcgtgcagctagcacggggaactctcagctgtgtgaactattagttgaggaaggcgctgaagttgatgaagttgacaaggcaggggaaacacctctgatgactgctgttgtatgcggcaataaagaggtagctttgctcctcataagacatggagcagatgttgacattgaggacaaggaagggtacactgttcttggtcgagcttctaatgatcttcgtccagtattagtcgatgctgcaaagatgatgctcgaaggataaactccacgacctcatgatagctcatcagaaaacgcaagccaactctgtaaatgttcaacctgaagcgtgctcaactagacacataccgatgaatattctggaactatttagttgtagggcagaaaacctaaatgttgtacttaactcttggtgatgctcctttagttatgacaagtgcatccattttagaaaaanaaaaaaaaaaaaaaaaaaa

SEQ ID NO: 11511 - DNA, 597 bp, Lycopersicon esculentum
  Predicted polypeptide sequence is orthologous to G1950
caggatgctcaaggatggactcccttgcattttgctgctactcaaggctatgttgaagctgttggtgtgttactaaatcattccaattttgctaaatatgttgtaacgaaacaagggaagactgcgtatgagcttgctatcgataagggtcattctaaattgtatgatgttttacaattgggagacactttgcataaggctgcaagaaaaggagatgttgctgatatcaagaaatgtatcactgaaggggcgaatgtgaatggaaaggatcagaatggatggactcctttgcatagagcagcattcaagggtagagttgaagtggcgaaggtgttggtaaacaacggagctaagcttgatcttgttgattatgttggatatacgccgcttcatcttgctattgaggctggacaagaggatgtggcgatatatttgattgctcaaggtgctaaggctaatttgaagagcttcaaagctaaagaagtggtttcttgtgatttcagacatttacatacttacaactttgtatagtgaagagcaaagtacacttaactcaatttggagatcgctcttgtatatttttagctactgcagaag

SEQ ID NO: 11512 - DNA, 639 bp, Lycopersicon esculentum
  Predicted polypeptide sequence is orthologous to G1954
caggcaaggtccatcatttgagatatatatatttttattatttaaatctttcatgtcccaatttttgtttttattttttagcaaaatctcacttaagttttatcctcttcatattgttcaaattataagctagaggtggaccctaggagtgatcaaattattcagtgaagatttgagtttgcatggatttgtgaatagtcaaaattttagggttgtataaaaaacaaacaaaaagaaagaaaaaaaaaactataacaagacaatggagaaagaagaaaattgccaggctaataatactttgcctacatcttttcaaatggcaattattggtgaatcttcatcaaataatactaataatcaaatggttgattatatggtagattcacaatctatacaacaacaacaacataaccagagttcgttagggtttttaccctcgaacccttctctagacaagttgagctttgctgatgtgatgcaattcgcggattttgggcctaaattagccttaaatcaaaccaaggtattggaacaagatgttgggattgatgatcctgtgtacttcctcaagtttcccgttttgaacgagaagaagaatgataatgataatgatgatgatcgcgaagaaggcttaatgat

SEQ ID NO: 11513 - DNA, 723 bp, Lycopersicon esculentum
  Predicted polypeptide sequence is orthologous to G1957
caaaatcttttaagccctaaaatcattaattttgtctatttttttttttcgattgaaaatatcaattcattactagatctgtttgatcatgaatttctttggtagtgttgtaggagaagaagaagcatcttcttcgtcttataacagccaacaacttaaaaggcctagtagtagtactactacggagcttatgttgatggattcatcgtctacttgtgatgcgttggttgaaagggaacatatgttcgataaggtagttactcctagcgatgttggtaagctcaatcgtttagttatacctaaacaacacgcggagaagtatttccctcttgattcgtctagtaacaataaggggggacttctattgaattttgaagatagtaatgggaagccatggaggtttaggtattcgtattggaatagtagtcagagctatgtaatgactaaaggatggagtcgttttgttaaggagaagaaacttgatgctggtgatgttgtttcatttcagcgcggtgctggtgagttgtctaagcaccgtctcttcattgactggcgccgtcgccctcatcatgagaatggaaataatcaatttatgttaccgcatcaattttctgatgggcggctcttttattacccaacaacattttcgagtaatttgttgctggaaggaggtagcaatatcgttcatccacctaattattataatcctcaaagttacatgta

SEQ ID NO: 11514 - DNA, 514 bp, Lycopersicon esculentum
  Predicted polypeptide sequence is orthologous to G1958
gaaaaagttgcgaccgtacaccgttcatttttcatctccgattcgccggcgacggcgccgatgaattctctgaactctgatttcatctcttttatgagttcgaatcatgtggagctgtatcgtttctgaattcattggattttgaattttttttaggaataagcccttcccgtaagcaaatgaaatactagaagattcttttttgaggttagtatagtagtatttaatatttttaataaaggttatggaggcgcgtcctgctttatctgtccagaggacgggtgcacatcaactcagtaattttggagcatcaggagctcattcttcattacctgtgcttcaaacaagcctggaagagaaatatcctaagttgccaggatctgccctttcttcgtttccttcaaacagtggggctgtcggtcatttgttttcctcaccatcggagttctcgaccaatcttgacttttcatctgttctgccttatgatgagcatttggcacctgcaactttcatt

SEQ ID NO: 11515 - DNA, 583 bp, Lycopersicon esculentum
  Predicted polypeptide sequence is orthologous to G1958
caagttcaaccattccagcaaattcctactgcatctgtagaaacatctgctgttggtcctgcatctgtggaaacgtctgctgttgttcctgcatctgtggaaacatctgctgttgttcctgcatcatccactgggagtggttcttcatcgaaacaacggatgcgttggacaccagaacttcatgaagcctttgtagaagcagtcaacaagcttggtggaagtgaaagagctactcccaagggtgtgcttaagttaatgaaagtcgaaggtttgaccatctatcatgtaaaaagtcacttgcagaaatatcgaactgctagatataaaccagaagcatcagagggttcctctgagaagaaagagtcatccattggcgatttgtcagctctggacttaaaaacgggtattgagatcactgaagcattgcggttacagatggaagttcagaaacagctgcatgaacagcttgagatccaaagaaatctgcagctgcgaatagaagaacaaggacgatgcctccaaatgatgtttgagaagcaatgcaagtcgatgcctggtattgacttggcaaagggctcatcat

SEQ ID NO: 11516 - DNA, 531 bp, Lycopersicon esculentum
  Predicted polypeptide sequence is orthologous to G1958
gcaccagagatgctctaccttctgattggaatgatattattgctgatacaagtattggcgactcggagctgaagatgcaatttcaggaggaaaaacaacctttgaatttcccaatgcagcaagtccaagcatcacagcaaatcccacctgtgcctgtagaaacttcagctattgctcctgtatcatcccctgcaagtagtgctgcaacaaagcagcgcatgcgttggactccagaacttcatgaagcctttgttgaagcagtcaacaagcttggtggaagtgaaagagctactccccaagggggtgttaaaaatgatgaaagttgagggtttgaccatctatcacgttaaaagccatttgcagaaatatcgaacagctagatataaaccagaagcatcagaagctgggtcttcagagaaaaaacaatcttcactagatgatttggcatctctggacttaaagacgggaattgagatcactgaggcattacgattgcagatggaagtgcagaagcgtctccatgaacagctt

SEQ ID NO: 11517 - DNA, 571 bp, Lycopersicon esculentum
  Predicted polypeptide sequence is orthologous to G1958
gccgagcttcacgaagtctttgtagaagctatcagtaagcttggtgggagcgaaagtgcgtgacctctttgtttctatgttctatttctctttttagcagtttggatgagtaagagttaacgtttaacattattatattggattcacacatttgactttacagaagctacaccaaagggagtcttgaagctcatgaatgttgaaggcctaaccatctatcatgtcaaaagccacttacaggtataataaatccttcccattaaccttttccgaggtgacaatttatttaccttatacatttcattttgaatttcagaaatatagaactgccagatacaaaccagaatcctcggaaggtagaaatttcctctttgattagctgataacttttgcatccgtcaaggactcagtatacattttgctaaaacgaaaacatatgtgttacatctcctcatacttgtacttcctgcctctctagtttcttgtgcatgtgtcaaagtgatccccaactgtgaataaaactagggatcttaagttaaatttattgatggtctgttggactttcccacag

SEQ ID NO: 11518 - DNA, 669 bp, Lycopersicon esculentum
  Predicted polypeptide sequence is orthologous to G1958
aaaatcaacgttcaccgttcaaattctttcgatttcgccggcgatgaaatgaaatctcccgaaatcggcaacaacgagttagctgtttgtgcatacaggaatcaatcttggacactggttactaagaaattagaagatactaattgaggagaatatagtagtgtattgtactcatccacaaagttcaaatggaagcacgtcctgctgtgtctgttcaaagtgtggttgcaagtcaactcagtaattgtggtgcatcaggggcactttcttcttccctgttggtcttatgttctcatcatcatcaggattttccgccgatcttcagttctcatctgtttcaccccaggaaaagcattcaggaactgcacctttcatttctcagtcaacatatagtgagacatcgatccaattacctcattcgggagttcttcagtccacagcatcaagccaatatttgaatgaaaaccatgaaccctggtgtatagatccactgcctaatttccttgattattcgatggataaccctgtccagaatagtcaggtagcttctagcaataaacaaagcgattggcaggagtgggccgaccttgtactcaatgatgaagatgctctaccttctgattggaatgatattattgctgatacaagtattggcgactcggagctgaa

SEQ ID NO: 11519 - DNA, 569 bp, Lycopersicon esculentum
  Predicted polypeptide sequence is orthologous to G1968
gctctcaactaacattatatccacattcatgtttgaagtaaaacatcatggcttgtatagatcaagaacaacaacaacaacaaccaatttataagcattattgtagagtttgcaagaaaggttttgtgtgtggaagagctttaggtggacatatgagagctcatggaattggagatgaaggtgcaaacatagatgatgatgatccagctagtgattgggaagataagtttggagggggtgttaagggaggtaataagaggttatatcaattaagaacaaaccctaatagacaaaaaagcaatagagtttgtgagaattgtgggaaagaattctcatcttggaaatcatttcttgaacatggaaaatgtagctcagaagacgcggaatccctagtgtcctcgccctgtttagagggcgaggactacattaataatggtggaagaaaaggctatggatggtctaaaaggaaaaggtcattaagaacaaaaattggaaccattaatagtactacttcaacttatccatcaagtgaagatgaagatcttgtccttgcaaaatgtcttattgat

SEQ ID NO: 11520 - DNA, 674 bp, Lycopersicon esculentum
  Predicted polypeptide sequence is orthologous to G1990
gaagaagccttcactaagccaaaagaaaatggcggtcttctctatgatgctttggcaagacctacaaagctttgattgtttaggtgtgtaaagaagacaacccatttgcccaaaaggagaataaattagcatgtgagctgaagtttctgaagaaattggcttcgcttgcctttataaccctctttcccattgtcaatttcaagatatttactacagttgtcttcttctcttcatttaatgagatatcagtgatgcctcatcagaaccagggacaaaatgggcagcagggtatgtggatgtaccaatgcatccattgtaaaaaaaacttcccttcaagccaggccatagcaggccatacaaagggtcatttcagagatggctgggttaaaggaaccccccagagcaaagtatttgtactattttctgagtatcagcaacagcagggttctatcactgactcttcaattcccgagaaacagattttttctgcagcaacttctgacactgacttagcagatgctcatcaattgcaaataggtgatgtgcagaattccagaagcctggtcgtgcggcctccatctccagcttcgtctagcagagaaccacgaatccctaggcatcatttgaggcttcgtgatctgaagatactagctaggctaagggctcgtcttacc

SEQ ID NO: 11521 - DNA, 730 bp, Lycopersicon esculentum
  Predicted polypeptide sequence is orthologous to G2010, G2347
gatcatttcctataaagacggataaaacattactacaatggagaaaaaaatattttctctactttcaaacgggaccgttgcacaattctctattcccaaacgaagattatattggggtaacctaaagaagattccctcttttcctataaaagtatgtatcctctcaattatgaaactcagtatgcaccacaataattttactgattttctaagcagctgctttcctgttgcaaagtctcggcataggtaaaatataagtactgaaaactcacaatggtctgagtatctgacaattgaaacatgaaagagagtaaaaacagaaattagcaaggacagagagcttttctccctgcaccatttcccttaagtgactagaaaagaaccaatcagaatttacttgaggtgatttttcttgctctattttgttccaagaatgtgacatcttggttctcttgcatcctctcagaactacttatgggaagtttcatttttttttacattataaattatggtaagcagatttcatcagttggcggagtttgatgatgcaaaaaagagttgcaggagacggttggcagggcacaacgagcgccgccgtaaaagtgcacaagattatccaggagaagggtcaagttgaacgggcacctactagtggactgatgagaacttaagctccctctgaaaatatagagtttatcacgctctctctcttctgtcatttgccatattt

SEQ ID NO: 11522 - DNA, 1261 bp, Lycopersicon esculentum
  misc_feature (1246)..(1246): n is a, c, g, or t
  Predicted polypeptide sequence is orthologous to G2011
cagagttgtttacaggagatatttcttggtttgtatgtcggcgttacctatataaacctcccttcaaccccttttaccgactttttatctatcacccttatcgaaattttgaatcttttgatcacaaaaactattaaagtttcaatctttgatccataaaaaccacaaatctctttgtatgatatgaacccatttgataaaaaacaagaatctgatactgatacaaaaaccccatttttgactgaaatggactctgaatttgctgcgttttcaccaatttcactcccttttgctgacccatcttctccttttatcaattttggatcttttgccactcctttgagccaacatccagttggagaaggggaaggagaaggagaagggggagaaattgaacagccagctgagggaggattgggtgtgccgcagcctatggagtgtttacatgggatacaaattccgccatttttgtcaaagacttttgatttggttgaggaccctttattggatacgattatttcttggggtagaaatggagaaagctttgtagtttgggatccagtggagttttcaagattggttcttcctaggaatttcaagcacagtaatttctccagctttgttcgacagcttaatacatatgtgggtattaattttagcacactggccaactttttctggctaatgtgttaaatctctagttctctaactctgtctctctttttaatgatattttttccttgtatgtaatttctgttgtagtttttcatgtatctttattttttccctcatttttctgtagtttgtttgctcttttgttgttgatatactgtaaagataatgtcttaggatgtaaatgtaaatagatttttcgcgttgtaaacagtataggctcctgcgattgtaaatgagagttggagaactgttttttcttcttgatagttcaatgtttttggcatcttgtgtaaatgatgtcattgagatctttagtggatagtaaaatggtgggttcttaaggaaaatggtaaagaggtgcgctgttcatgatgtgggcttgtagataaagctccctgcattgatgcatctgctgagtttgggaggttcatctattgctgcaggtagaattcaaaggttctgattaaacagagtgtttaagctttgtagtttatatatggtctaacttcaaagatctactaattgtgtatttctagtgtaatgcagctcctggaactcatgaaaatttgancagtagcatcttgct

SEQ ID NO: 11523 - DNA, 875 bp, Lycopersicon esculentum
  Predicted polypeptide sequence is orthologous to G2035
ggtgcaatcccagcttatacaaaatgaaaagacccgaaggcgtgtttctggtattgccaaagaacttaggaagattcatagggaagctgttcagaatacgattaactctgtgaccgtggttgctgttttgtttgcgtctattgcttttctggctatattcagcttgccaggccaatatgtggagactggacctgaagcaggaaaggccagaattgctgatactgttgcattccgtgtgttctgcctcctgaatgcaacttctctctttatatctctcgctgttgttgttgttcagattactctggttgcctgggatactagagctcagaaacaaatcgtctcagtcgtgaacaagttgatgtgggcagcctgcgttagtacctgtggagcattcctagctgttggttttgttgttgtagggaggaaaagttcgtggatggcaatcactattactgtgcttggtgcaccaattctcattggaactctcgttagcttgtgctactttgtcttccgacagcattttggcatttgtggtagcgattctcaaaggcgtatcagaagagcaagtgggagcaaatctttctcatggtctcactctgcaaatatctctgatatggatgactacaactctgatgacagaatttatgctttgtgagactgacgttatgcaaatgttcgatctaactctgatatggatgactaaaacacgagaagactgaaagtatagtcaaacgctgttgaaccctgtgcatgtcactgagaaagtgaaagtgatgttgagtcatgatacctacacagacatcaggtactcgttttcaacaccatgcacgaaaatttccctttacttttttgctcatagtatgagttatgatgaa

SEQ ID NO: 11524 - DNA, 377 bp, Lycopersicon esculentum
  Predicted polypeptide sequence is orthologous to G2035
cttgggtattgtgagggaactcttggccatgtggcctgaactttgtaaattatgctactcctcaaacacgagccctctttattcatctgccttcaagggacatttggacgtggtgaatgccattttagatgcagatgtgacctccatacgaattgttaggaaaaatggaataactgccctgcacacaactgctagagtatggcctactgcatattgtgaaagcacttatagagatagatccagatataatatctatcaaagataaaaagggccaaaccgcacttcatatggctgctaacggtcaggatacctttgtagtggaagaaatgctggatactgacagctcgatattgaatgagcgtgacaacaagggaaac

SEQ ID NO: 11525 - DNA, 1373 bp, Lycopersicon esculentum
  Predicted polypeptide sequence is orthologous to G2041
gcacaagcaggatgatgatggccttgatactttgtccattcctgtttcttccagagcaccctcatcatcaggaggaggggaaggaaatgtctgggcattgatacctgatctaggaaataaattacgggtacaccaaaagagagcctttgagtttctgtggaaaaatattgctggatccatagtacctgcagaaatgcaaccagagagcaaagagagaggtggctgtgttatttctcatactccaggagctgggaaaaccttacttattatttccttccttgtaagctacctgaagttatttcctgggtcacgaccgttggtccttgctcccaagacaacactctacacctggtacaaagaagtactgaagtggaagattcctgtgccagtctaccaaattcatggtggtcaaacctttaagggagaggttctaagggaaaaggtgaaattatgtcctggtcttcctcgcaaccaagatgtcatgcatgtcttggactgccttgagaaaatgcagatgtggctttcgcaaccaagtgttctcctcatgggttacacctctttcttaacactgacacgggaagattcaccttatgcgcataggaaatatatggctcaggtgttgcggcagtgtccagggctactaatacttgatgaagggcacaacccaagaagtacaaaatcccggttaagaaagggtctaatgaaggtcaatacacggcttaggattttactttctggtacattatttcagaataattttggagagtatttcaatacacttaccttagcaaggccaacttttgttgatgaggtcttgaaggagcttgatcccaagtacaagaacaaaaacaaaggtgcatcgcgcttttcattggaaaatcgagcaagaaagatgtttattgataaaatttcaactgtcattgattcagacatccccaagaaaaggaaagaaggcctaaacatattgaagaaactaacaggtggattcatagatgtgcatgatggtggaacatctgataaccttcctggtttacaatgttacaccttgatgatgaaatcaactactcttcaacaagagatcttggtgaagcttcaaaatcaaaggcccatctataaaggatttcctctggagttagagctgttgattacccttggtgcaatccatccttggttgatcagaacgacagcatgttctagccagtacttcaaggaagaggagctggaggctctccagaaattcaagtttgatctgaagctgggttcgaaagtcaaatttgtgatgagcctaattcctcgttgtctcctcaggagagaaaaggttttgatattttgccacaatattgctccaattaatctttttctggagatatttg

SEQ ID NO: 11526 - DNA, 450 bp, Lycopersicon esculentum
  Predicted polypeptide sequence is orthologous to G2041
aaaattctcctctgacctgacatggttaatgactgcatctgtcctgaaagaagctacatttgatgtgagatcgatacataaccagattgtctatgagattgtggatgatgatctagtcagaaaagaaacaaattctaaccaacattcttactcagtgaatttcaagttagaaggcggagttcaaacaaccactgctattcaattcaatagggatatcccagatataaattctaccagtgaccttagtgaatccgggcctctagttctgtatgatctaatgggcccacgaaggtcaaagcgtcgatttgtacagccagagcgttattatggatgtgatgatgatatggcagaatttgatgttgagatgacaaggttagttgggggtaggagaaaagtggagtatgaagaactaccacttgcactttctattcaggctgatcatgcttatcg

SEQ ID NO: 11527 - DNA, 618 bp, Lycopersicon esculentum
  Predicted polypeptide sequence is orthologous to G2052
ctataaacctaaaaatatctctaattctggttatctcgttcgtacacatctttctcttgaatactagtaaaaatcaaatatttttgaacattttttttttcaaaggaagatgatcttgttgttacaagaatacattttgtggaaatttattgtaaatcttgaaacaaagttcagtgttgcaaaaagtttttatttttggattttccaaattttcaacagatatagctgtggtacttaactaatattgtgttgaaaatcttgtttttgctctgttgttgtatagctagttgtttgttttgttttgtttttttgggagaaaattctgttacttcatcatggcaggaacatcattgcctccgggatttcgatttcatcctactgatgaggaattagttggatattacctgaaaaggaaaactgatggacttgaaattgaattggaagttattccagtgattgatttgtacaaatttgatccatgggaacttccagagaaatctttcttgcctaaacgtgacctcgagtggtttttcttctgtcctcgggacaagaagtatccgaatgggtcaagaactaatcgagcaactaaatctggatactggaaagccacagggaaag

SEQ ID NO: 11528 - DNA, 763 bp, Lycopersicon esculentum
  Predicted polypeptide sequence is orthologous to G2052
gcttcgtatggactctttagctggcctctatttttagactctgatcactcaaatttagcaacttctcaactatttagaattgatagtactagaaaaaaaaaacaacctttttttcatgttttgacaaaccatatagtgacattttgtgccttgtgggataaggcagttttgaacctttattttttttcctggaagatgattgaattgttccagggatattgcatcttatgtgaacttacaaaattcagtgtagctaaaagtttttatttttggatatttcaaattttcaataggtacagtttgaacatttagctaaatttcatattgtaatttgtgtgtagttatagcagttggaaaaatatttacttatatggcaggaatatcgttacctcccggatttcgtttccatccaactgatcaggaattggttggatattacctgaaaagaaaaactgatgaacttgaaattgagttggaagttattccagtaatagatctgtacaaatttgacccatgggaccttccagagaaatctttcttgccaaaacgtgatatggaatggtacttcttctgctctcgggacaagaagtacccgaatggctcgcgaacaaatcgagccactaattctggatactggaaagccacagggaaagacaagaaagttgtatgtaagtctgcagttgtaagatacaggaagacactaattttttaccgcggaagaactcctctaagggataaaactgattggggaatgcatgaatat

SEQ ID NO: 11529 - DNA, 868 bp, Lycopersicon esculentum
  Predicted polypeptide sequence is orthologous to G2059
gtttttttttcccctcaataccaatctattggatttctcatggagaatcagtctctaaaatcagaatccatcatgcaaaaagaattgccaacttgttataaacaagtagccatagaatcattatctagatttttcaaggatccacacatttttagtgatttaaatcatgaaattacttttataaattcttctccaacaaaattttctgaatttcttccacttaatttccatcaaaatgaatcgtcattatcattatcatcatcatcatcatcattatcgacttcttcaagttatcaacatcatcaagatcaagggaataataacaacatttttcctttaaataattttcttgatcatcaaacatgtgcttcttcaacaaattcactatcaagtaattacccaactttagggttatttttgcaagagccttccattttagagatttcaaaaagggcagctgaatctctaagcaacaagaatcacaagtcatcatccgcggcgttattccctatgtcttcatcaataggtcatgagagccaaattcattataaagaggttgcaactacaaatccaacaaattggttgaaaatgaatcaaaccataacaaattgtaccacaacaaaaggttttagtgactattggctcagcactacaaaaactcaaccaatgaaattcaaaggatcatcaagaaaatcatcacttgttcattatgaaaagtcatcgtcgtcgtcatcatcatcatcttcttcttcttctatgatcgcttcccaagggaagctttttcgaggagtaagacaaaggcattggggaaaatgggtggcggaaataaggctaccaagaaataggactatggtttggctagggacat

SEQ ID NO: 11530 - DNA, 734 bp, Lycopersicon esculentum
  Predicted polypeptide sequence is orthologous to G2060
tggggcgtaactactctagacatctttttttttttttttttgggaaccaaaaggcaacagcagttttgataatcattggcacaaaggcattgtacataatgaaaggattaaaaacaactatagatcaagaactattttgatgcctaaactggctttgaaatatctaatttctaagtcatggccaatgtacaatgataagtcggccaattgcctctaaacggtcatcgggtgttgcagcaactacatgtacattcaggtgaaccacctctgacaacttctaaaagcagcctcctcctacacattatggtcaggtggacttcactcaaaagccagtaaaattatggaagctgaaaaagtacgaaagaggaggtgatctactggaaccgcttgatgtgccttgaacatgtttgctaacccggggactcaaaaatgcttagagctcagcaggttcttattttttttaaaaccttatggtgggagaaattggaaaaacaatcctataaaaaaatttgagcagcctgttcaggaaatctcccggatacaacaacccttgcagttaccttccggcctgttaactacaataaaaactttttccaacttaccggtttactgattttttcgaaccgagtggatatgaaatttgcttttgaagcaaaataatggccaaaccggtttaaaggggccacgttacaatgtccatgtacagtgcccccgtccaactcttaccagcggtt

SEQ ID NO: 11531 - DNA, 623 bp, Lycopersicon esculentum
  Predicted polypeptide sequence is orthologous to G2067
tttattttctctcgtggcaggggtacaagaaatcttcagcttctgaatcgtaagtacattttcattaatgcttgtttcaactgtccaacatttacaattcaagttaattgcaatggtagtaacccctcggttcaatgaagcttcagaattctttctcctcgtgtaggagagtgtatcattatgtttcaaagttaagatggtatatagatggcaatatttatcacgtaaaactaaagaactgatgttgaggactgaactcaaaattaagatagatttcatttcttgtgaacttaaccgctcaagttcttccaacagcagcaaatttactcttgtagtaatgaaaaggagaaagtgtaagacctcatttgtttacagtcaatgaaggtttagttttcagatcttagtcatcaagtcttttgttttttggtctaaatctattcagatattgaactttaacagtgtttgttctttaattttacaatcactttgtggatctgaatgatcaagatctataactggtaacttaatatttcacaaaaaattacatttgctgaaagtacttacagaagtcctataaaggcccgttcttctgcactgctctttaattttacaatcacttaatg

SEQ ID NO: 11532 - DNA, 589 bp, Lycopersicon esculentum
  Predicted polypeptide sequence is orthologous to G2067, G2115
aaaataaaatattttcccatcattttttttattgcactttgagtacacaataaatgatacagcatatgacacacttctataaaagaatatatatatctttaaacaagaattttctaggaactcacatgggagagtccagaaaatatgatttctctctctgtatgtattgtccctatttttcttttctccctaataatagtgtaataaatgcaaataaaattagtttatgtaagtgatgttgttcaagaaaaaaaaattaacttgacaacatcacatgtaaaaataaaaaataaaaaaaaactttttttttgtttcaaagaataattaaataattggaattgagatgttgatgattagcaaaaactccataaaggtatatctgctgatgattcttcataataaacctcctccattgaaggtggatcaaagaaaattgtaccatgtaacatgtcattgtactttggtgaatcaaagttgtaccattgttcaatcattgacatctcttgatcaaatgtattgatatttgataataaacaaccatcatttatatcctcagaagaagaagtagaagattgtggtggagatgaaa

SEQ ID NO: 11533 - DNA, 521 bp, Lycopersicon esculentum
  Predicted polypeptide sequence is orthologous to G2071
aaaacttgtacctgccaaaacggattttgtttgtcgtaaccatgggatcttacctgaacttcaagaactttgctgacacatcacaaccagagagcagtgggaataatagtaattcttttttggcccaacaatcttccatatactcgtttacctttgatgagctgcaaaatacatgtggacttggaaaagattttgggtcgatgaatatggatgacctcttgaagaacattgaagagtctcaagcgttgtcatcttctgctgctttagggggtaatttgcagagacagggttctttgacactgcctaggacacttagtcagaaaactgtagatgaagtatggagagactttcagaaagagagtgttgttgctaatgatgcaagtgggactggaggatcaaactttgggcagcgggaatctaccttgggagaaatgacattagaagagtttttggttagagcaggggccgtgcaagaagatatgcaaccagctggatactcaaatgatgttacatttgctagt

SEQ ID NO: 11534 - DNA, 687 bp, Lycopersicon esculentum
  Predicted polypeptide sequence is orthologous to G2071
agtagtgtcatgcagggtggtgttatgaccatgccagtaaaaggagtatcccctggaaatcttgatacatcttctctttcaccttcaccttatgcatgtggtgaaggtggaagaggaaggagatcatgcacctcttttgaaaaagttgttgagagaaggcgtaagaggatgataaagaacagggagtctgcggccagatcaagggatcggaagcaggcatatactttagagttggaagctgaagtagcaaagcttaaagaaattaagcaagagttgcagaagaaacaggctgaatttatcgagaagcagaaaaatcagttattggaaaagatgaatgtgccatgggaaaataaactaatatgcttgcgaaggacagtgacgggaccttggtagtcagtagaagagcaaattcccgagtaaacactcggagaattggtagacaggagattgaagtgaaatagcttttccttcctcttttttgtttcaacaaacaagttcagagcctgctcctcgaccctcctcccagcctgtgaattaaaatatgttctaattcacatatgttggtcacaggatagataactttatgtatcgactatagtacaggacaggtgctgtgtacctgtacgttatgtaaacaatgttcttgcataaagtttcctcatgtgcttaaaaaaaaaaaaaaaaaac

SEQ ID NO: 11535 - DNA, 625 bp, Lycopersicon esculentum
  Predicted polypeptide sequence is orthologous to G2071
gaaagaatagagaaaaatggaaaagatccaaagtttgtgaaattataaggagcaatttgtgtatttttagagtaagaaaaggaaagggagaaacgagatccctacgaagtcggcaactatggcgtcaaaggtgatgccgtcagcatcaacaacgcctaattcggatcgttcattacatccccaaaacccatcttcttctctaaatcactctcatccttctagaaacttcgattctatgaacatggatgaaattctgaagaacatttactctgattccgacccttttgcttgttctgtatctgcaaccgccgcagtccatacaccttctgctaccgcagccggtgttggggatgtggggcctactaagactgtggatgaggtgtggagggaaattgtagcaggaggaggggtagggggagggagtagggagccggagatgactctggaggattttttgaccaaagctggggcggttactgaggaggatgttagagttccggtgatcgctcctccaccacctccgccaccgcctccagccacgggggctccgtctgccagagggtttgtggtggataacatgatgggtactgggaattgtcagtttccgggtgccatgcagaatgga

SEQ ID NO: 11536 - DNA, 861 bp, Lycopersicon esculentum
  Predicted polypeptide sequence is orthologous to G2094
gcttgtttgttgaggtggaggtagtttttatgatttttttctgctaatttgggggtaaaaagtgtttattccgctagtttttgctgttttgtcatctgggtcgtgctcagtttttggtgcaaaaaaacttgtttgtgagttgtgatcattgagcagtggttgatcaaggtgtttttttcttcattttacttgcgttttagctggtgtagaaggagtttctctgggttttttctgttaatttggggataaaaagtgtttattttactggtttttgctgttttgtcatcttggtcgtgcttggtttttggtgtaaaaatcttgtttgtgagttgtgatcgttgagtagattggttgatcaaggtgtttttttcttcattttgcttgagttttagctgatgtagaaggagttcctctgttttttctgctgatttggggataaacgttctttattcagctgttttttttcactttatcatctgggttgtgcctagtttctagtaaaaaacacttggttgtgagttgtgatcgttgaacagtggttaatcaaggtgttgttttcttcgattttcgtttttttcctgctaatttggggataagcgttcttcattcagctgttttttccgttctatcatttgggtttagtagatttgagctgtgattgttgagaagtggtgaatgcaatggtggatacaagtgacaaagttcaagaaactggtgagatgattgggcaaaatcaaaccccagaaagggttacatcagagactaaccaaaaaacttgtgttgattgtggaactacaaaaactcctctgtggagaggtggacctgctggacctaagtcattgtgtaatgcatgtggaataa

SEQ ID NO: 11537 - DNA, 568 bp, Lycopersicon esculentum
  Predicted polypeptide sequence is orthologous to G2094
gaaactcctctgtggagaggtggacctgctggacctaaggtcagtaatttggtctatttacctgatcaatttcgatcgcctagtttggtttgtttcatcttatatgatagtgtttgattgagcttgaaatgttgttttgacttgtataattgttatatgaatagttaaacaatgattattgtcgatatttagttgaaagttgtatatatagaaggattacttattgtggaattgtgtcaagataattgtggcatggtcaatcaaaattacttattgtggatagttgttttgtgcttgttgttttggatacgttgcttagactctccgaaatgttacctcactgacacctaaaaatgcattgctcttggatgatcgaacatgtacttagtgtctttttgaagagtttgagcaatagggtttggtcttagtggcttaactaagatttaaaatatacataattgaacctatgaagaagccacgagtttgatggtggtggtttggatatagtatctagtggctagtgttgatccacttggtctatagtctcaactcggcttgtaaatgtgtt

SEQ ID NO: 11538 - DNA, 797 bp, Lycopersicon esculentum
  misc_feature (4)..(4): n is a, c, g, or t
  misc_feature (797)..(797): n is a, c, g, or t
  Predicted polypeptide sequence is orthologous to G2094
tganacgatctgttcgaccccttttttttttattttttttttttttttttttttttttttttttttttttttttttttgggaccaaaatgggccaattaattagtaaaaaagttcccatgggtttctgcaccaattaaaaatcaaaagggttaacctagtaattttccaaccgatccccaagaaagagccctcaataatttccccgcttggccttcttctcttaattttcccccaaatcccatcaatttaccggtttctataccctttttctttattctccttttcttctcaacccccaaaaacgggccccccttcttattatactttatcccacatgcgttacacaatgacttgggacctgatggaccccttttccaaagaggcgttgttggggtatgacaataaccgcaggatttcattgcttctgcttcttttgaacctttttttttttctttttctgcctttcttctctttttttccttccgagttttttttttttttttttgggctaatcaaaagatttctatatttcccaaaccaaacaaaaccttaatataatgaaaaccccggtccccaaaatgtttgtttaaaaacttccccccccccctcccaaaggttttttgtttacacccccaaaggcccccaaggcgtattcttctttctttgtgggagagtgccctttaacccggtccctttttgggcgtttgcccctaaaaagggacttgccttagcccttttttattttttttttggcgcccttccacaagaaaaagcggtttccccttattaagcttcn

SEQ ID NO: 11539 - DNA, 1056 bp, Lycopersicon esculentum
  Predicted polypeptide sequence is orthologous to G2110, G2574
tagaactcaaagaaaatagagaagaaagaaaaagataaaagcttgtgtatgcatatggagactgttttcagaaaatcaactcatggaggtgtagtcaaacaggacataaagattaaagctagtgaagaaggttttgttgaagatataaatgatcttaaggttgaaaaggagagaaaatcaatacataacgaggacgataattcgaagtcctctcagcaaaaggatctcactggggacaaaaaggacgatcagctggaatcagccaaagccgatatggaagaagtaatggaagaaaatcaaaggctaaagaaacacttagataaaatcatgaaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgatgaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatcgggacccacaagtagtacagcctctgccacaacctct

SEQ ID NO: 11540 - DNA, 794 bp, Lycopersicon esculentum
  Predicted polypeptide sequence is orthologous to G2110, G2574
aagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctccctacaattacactcgatttgacttccacctcgtcctcgtccccgtcctccttatctcatctaaacagaatgactcagaattttcctcctagatataattacaataacaataattccaccacaaacctca

SEQ ID NO: 11541 - DNA, 513 bp, Lycopersicon esculentum
  Predicted polypeptide sequence is orthologous to G2110, G2574
ctatacatggagaacaagaacaaagctgaatattatagtcctgatgatgaagatcgcgatatcgataatcaagaaaatattatccatcaaggaggtgctgttaatgttatggtaaagagagaaagatccccaccggaacacaactcaatggcttcttcatctactcacaaagaacaggacgatcagctagcatcagccaaagatgaaatgcgagaagtaatggaagaaaatcagaggcttcgaatgcacttagatcgaatgatgaaggaatatcgaaatctccagaaccaatttcacgatatcgttcaaaaagaaactgatcaaaaatcaagcagtactactgtcaacactagtacaacacatcatgatcatgaatctgatcaagaagctgatcaacttgtgtccctcagcttaagaagaactactagcgatatgaagaaagatgatttatctaaaatcttaaagaaagataaagttcatgacgatgaaggagttagtaataataataaaagc

SEQ ID NO: 11542 - DNA, 538 bp, Lycopersicon esculentum
  Predicted polypeptide sequence is orthologous to G2110, G2574
caatggattctactaagaaggatgaagataagcctaaattcaaccaaaatgtgagatatatgaagcccaaagaagaaaatgaaaggctaaaaaggatgttatctaaaatgatgaatgattataaatctttggaaatgtattttcaaggcatattaactcaaaaaaataccaaagaatattattgcaaccaagtaataatattcatgaagaaaaagaacaagtggaacttgtttctttgagccttagggagaaatagtagtccttcaagagagttgatcaagaaggagttattatatgatgatcaaaataaaagtaataaaaaccatagtaaattattatttgatgggccttgaccttggattaggttgtaaattcactcaagaaaatagtttcgaggggccaaagaaggagaatataaataatgaacgacgagtattgataccaaaattaccttccatcggattactgtggcgaagaatttttgcagcaaattcctcaaaagaaggctagagtatctatccgggctgtgtgtgacact

SEQ ID NO: 11543 - DNA, 522 bp, Lycopersicon esculentum
  Predicted polypeptide sequence is orthologous to G2110, G2574
aacacataatcatccacttccagtaggtgcaacagcaatggcatcaacagcatgagcagcagcttcattcatgttagtggattcaagtattagtcctcttcttaatcacaattccaatttaaaccaaccacttaatttccctaattaccaccataatctagcacctaattaccatcactcttcttcttcttcaccttataataatttctccaatttaagaaccaatattcttaattctagtgatcctaataattcttcacaagggaacttagttcttgatctcaccaaaaatatgtcaaataataatcatcaattcccctttgcaagttcttcttcaaataatcatgaaattggacattctaattggatgtctaaattatctaattatgaagggaataaccttttttctggtcctaaattacaaggtgaacataataataataataataataataataatattcctcctatgttggctcatgaaaatatgagtgcaattgcttctgatcctaaatttagggt

SEQ ID NO: 11544 - DNA, 746 bp, Lycopersicon esculentum
  misc_feature (651)..(651): n is a, c, g, or t
  Predicted polypeptide sequence is orthologous to G2115
gcgtaaacgccactttctccaatgttttgacctcaatacacgccaaaattcccttcaattttccaatcattagtacccaaaatcccatcaattctcaatctttgcttcaattatcacaaccccagatcaaaatcttgacaaaattagcaaaaatttgctagttctatgttgttctaccatgtaaaaaatcccaaaactccataaattcacaatctttactgccattctcataaccccagatcaaaatcttgataaaattagccagttctatatagttgtctgatgtaaaaatccataaatcccaatcttttctccaaatctcacaaccccagatagtattttgacagaaagttgcctgttttagagttctttgtgtaccatgtgtcatgatttgaactataatctttgatgcctaagaaaacccagtttagtataagctcatctgattcagattccccaagaaaaaatcttggttcttctgtttctacagagccaggaccaggaccaagcagtagtagtagcagctgtaaggttaataataaatcatctgtttggtctggtttattggtttctcctttttcaatatttgatagtgagccaaaagggtgtttgaaaaaagggaatttttgttgttcaaagaagtataatggntattggttggacctagtgctgtgaaaagaatgataaacagtggctcatgagggaggattttttgggatggacaaaactgggatgcctaatgggtc

SEQ ID NO: 11545 - DNA, 366 bp, Lycopersicon esculentum
  Predicted polypeptide sequence is orthologous to G2116
caggcagcacattccgtataaccaatcagcattcttttcgcatcagccacaatcaggggctagcgaatcccagaacatacagatgcagcaatttcattccctccaggatagcttgttgactcctcatcgccgtttacttgcagggcatgggcagggtctccctgacacaatgcaacaggatcccctaggtcgttttcaaggtctggatattggtggcaggggtctgcatcttgtgaaaactgaaacaccttcaatttctgccagtgagagcagcagtacattgtgattgacttgtgcaatcggccttatttattggaattgttcatagactgacacgtgtttaacatccaaaaacatgatattcaa

SEQ ID NO: 11546 - DNA, 615 bp, Lycopersicon esculentum
  Predicted polypeptide sequence is orthologous to G2132
ggaccaagaacaccaaattaacaaagaagaaatagtgggtttttgagaaatttatgtcggcaaggtttaatcttctagctgtgattgaatttagagcaccattaaacctctgtttttcactttcttcacttctctttgttgtctctgtgcaattttccccaattttatcgatgggtttgaggcccaaaaggaattgttctggagctgtattttttgagggatttcatataaagcaatttttacatcttattttgctgttgagaacgccacttgattttaaagtgtaatctttacattttctccttttatttgttagaaattttgaatattattttttaaagaggaaatttttgctaatattgaggttatgcttaagcctttgtcatcaaaatttgagaatcttggtagaaacatgaagaaaaaagttgatacaaacagattagtgaggaaaattaggattgtttgtaatgatcctgatgctactgatgattcctcggacgatgattcgaggtgtaagcgtttcgttagagagataagttgcaaattggcaactcttttaatcttagaaaagcctctgagattgaatgttcatttcaagatagtaaccatggagag

SEQ ID NO: 11547 - DNA, 627 bp, Lycopersicon esculentum
  Predicted polypeptide sequence is orthologous to G2136
gttactttgagtaaatcaatctgttgatcaagcagcaaaatactctgcacaaacaagctaagggctagttagttgagtaaatcaagaaaagatgagttccaaccagtactggcaatcaattagtaattcggatgacgaatacctggatcatattaaaagaatggagaaatctccaacaatgcaccctgatatccctctctaccccaatgtctcctctcttttcaaaaacaaattgaataacaaaggactagtgaatcgtcagaagaaccaagccgcggagtcacagaagaaggttcagtttgcggactcaaacaagaatggtaaggagaagcccacaggttttatgcttcacaaatggaggacttacaaagtttcagcttgaagggtttcaatcttattagcacccacttttcatcaataatcttgctttccaaatgaagaatttcatgtttgttgtatccatagtgttgatcagtacatttgtacgtttgatttggtctaatctcatagaaaatatagtattgtgtctaaacttatcttttctgatctaaaggctttgtatcttttgccttcatatataataatcagaaataaaatatatattaaaaaaaaaaaaaaaaaaaaaaa

SEQ ID NO: 11548 - DNA, 453 bp, Lycopersicon esculentum
  Predicted polypeptide sequence is orthologous to G2136
gtaaagggaagcagaaaattgaaattaagaaaatcactaaagaatcagcaagaaaggtggcattttcgaagagacgcaaaggacttttcaagaaagctgtgcaacttgaatccaagactggtgctaaagttgccattcttgttttctcttcctcaggaaaaccctacacttgtggggacgtggaaacgctttgtggtatttccgattcattcaatcttcaaacgcattctgagtcaaatagtatttgggattcattcaatcttcaaacgcattctgagtcgaatggtatttgggactcattcaatcttgaaaggccttgtgagtcgaatggtatgtgggattcattcaatataattgaagggccttgttcatcctctgggaagaatggtatgtgggattcattccatcttgaaaggccttgttcatcctctgggcagaagggtatgtgggact

SEQ ID NO: 11549 - DNA, 884 bp, Lycopersicon esculentum
  Predicted polypeptide sequence is orthologous to G2140, G2765
ggaaaatcttcttgtttatcttccaaattggacctttggggcttatcacaaatccttcaataatgcttcaattcaagaagaaaattgtatcttttcttgttcagaaactttgccaataacaaaaagttttatctctgttttagtaatggaagtacctattagtagaattgaaaaaataagcaaacccagtccaagaatctctgtttggtcatcacccacaaaccgtccacctggttttgtgctgtaatttgtaagtgggtgtttttcttgctgcaaaaaagatggaatttttaagttcttttaatgggttgaatgaggtttatggggggtttcagggtataataggaaatgggttgtcatcatcttcttcattagttttggataatgagagtggtgagcttgtgaaggcaatggtgaaaccagggggaaaaggggttaatccagaaaaagctttgattgctttgaagaatcatagtgaagctgaaaggaggaggagggagaggattaatggtcatttgggtactcttaggaaccttatacctggcactaataagatggacaaggctgctttacttgccaaagccatcggccacataaaagaattgagagttaatgcagcagaagctaccaaaggtgttctagttccaacagacattgatgaagtaaaagttgaacaacaagcagagggatctgatggagccacttattctgtcaaggcatctttgtgctgtgactataagcacgagcttatctctgatttacgtcaagctctggatactctccccctaaaaactctgagggcagagattgctacactagggagcagaatggttagcgttttcgcgattactgagggcaatgaagggaatactgagggtactgaa

SEQ ID NO: 11550 - DNA, 827 bp, Lycopersicon esculentum
  Predicted polypeptide sequence is orthologous to G2140, G2765
ggtgagttttgaaaaaaagaaagaggaggacaagtggaagggcacacaggaggcatcagaaatataaagctatgtatggaagtggaaatagatcatcaattctaccatggaatagcttcaacacacttgaagatccatttatttttcatggatcatcatgttatggagatttattcaacaaaattataccacaatttccatgtcaagatcataatgaagtgcaaaaaatgatgaattctcaagaaataatggatgcaaaggcacttgctgcctcaaaaagtcacagtgaagctgaaagaagacgtagagaaagaatcaataatcatcttgctaaattacgtagccttctcccaaacactactaagacagataaagcatcactattggctgaggtgatacaacatgtaaaggagctaaagagacaaacatcacaaatagcccaaacaaatccactaatcccaactgagattaatgaattaacagttgattattgcaataatgaagaaggaaatttcatgatcaaagtttcattatgttgtgaagataggtctgatcttttacatgacctaatcaagaccttaaaatctctaaggttaaaaacactcaaggctgaaataacaacacttggtggacgtgtgagaaatgtcttgttcataacaagggatcaacaacaagacaacgacgatacgtggcctatcaatgataacaataatgataatgatgatgatcagatgaaatattgtctaagatcaattcaagaagcacttaaagaagctatggagaaatctaatggaaatgattctggtaattcagggagtattaagaga

SEQ ID NO: 11551 - DNA, 673 bp, Lycopersicon esculentum
  Predicted polypeptide sequence is orthologous to G2140, G2765
taatccaaattttagtcaaatcaatatctctgaccaaaatttttgtgaagaatatttgtcaaagaatcttcagaacatttttcagaaaaaaaaaaccctcttaatcaacaatctttatttttgttatatatcatcatcatatattcttcctttttttttcttcatcaacattctaccttttttttttaaataaaaaaaaatgtatcaatttccaagtttttatgaactaggtaacacatgttcagattcatataataattttcttcatgaaattataacttcatcatcaagtgaaatgtttaataatattaataatttagaaagttcaagtgttagtccaagatcaatggctgaagctaaagcaattgcagctaataaaagtcacagtgaagctgaaagaaggagaagaaaaagaatcaatggacatcttgctactcttaggaatcttcttcctaacactatcaaaacagacaaggcctctttactagcagaggcagtaaggtgtgtaagggaactaaagcagacaacatcagaactaggagcaacaacaacaacaacaacaatgtctgaaaacgacgacgatgatgatcacacgacattaatgacgaaaataatgtttccgagtgaatcggatgaattaaacctaagttattgtaacgagagtaataataac

SEQ ID NO: 11552 - DNA, 869 bp, Lycopersicon esculentum
  Predicted polypeptide sequence is orthologous to G2141
ggtttctcctataatcttccttatactaactactatacattgcactttgaaaaattcaaaaagttaaaaataacaacaaaaaagacattgtataacatttaaaaaaaaagaaaaaaagtgtgtactgtgtacagactacagagtaacagcaaaataaggcacaaaactataatcttgttccttcaatttctctacctgtatggatgtgtaatgaagtggaggcatttcaccagctgaacaatcgatccctctcgtcggatctttgaaagtggccaattgtttgatgtgtatcttatagattgttaatcttgaggcaaggggatttttttttttttagtttaagtttgattcatttcccaaataatggatatgggtagcaagaatgatactcaaggacaaaagaggaacaaggatgctactaattttcagtcaccaaacatatcgttggactggcaattaagtggaagcaacttgacaaatgcatcaatggggatgatccctaatagcaatcctttagtagattcagtttttcccactatttgggatcggcctcccaattcgtcacacttaggtttctatggtaataataatgctaatgctcaaatcagtccttgcattatgaatcagcacgagactgcagcaattggctcggtccctacgagaggtagtatgagttggaatccactgaattcgatgctgaaaggggctatgtttgtaccacctattcctggaatgattcctcaaagcttagctcagcttccagctgatttgggtttcattgagagagctgcaaggttttcgtgcttcagtggaggaaactcaatgatatgatgaaccggcctttaagcgtccctgagtctactaagcct

SEQ ID NO: 11553 - DNA, 975 bp, Lycopersicon esculentum
  Predicted polypeptide sequence is orthologous to G2142
gagagagagaactagtctcgactttcaccaccacattcaagaacttgcagcagtaatccaaatcccaatttctccaaagaactcaaaatcccagaaaaaagataaaacacaatgaaagctgtgaagggtcatcaagaagaggaagaagaggaggaagatgagactggtattgttaagaaggatgccacaccttctagcagtaataccaaagatgggaagagtaatgagaaggctagtgccctaaggtctaaacattcagtgactgagcagcgtcgaaggagcaagatcaatgagagatttcagatattgagagatctgataccccatactgatcaaaagcgagacactgcatcattcttgttggaggtaattcagtacgtacagtatttacaggagaaggtacagaagtatgaaggaccatatcagccttggagctcagagcctacaaagcttatgccatggagaaacagtcattggcgcatgcaaagtttacctgcacagccacatgccttgaagaatggtagtggcccagaatcaacatacctgggaaggtttgatgaaaatctcgctactgttacttctacgatgcaaccaaatcagcagaatccaattgaatctcatactagcagggatgtatcatttaaagcacttgatcaacaaaatgaactagctaacaagtcaatcacaacacccattcctcttcaggccggtatgaagatgtcagtgccaaacaatagtgctttctcagagcctcaacccagaccagtgtctgatcaatgtcctaacacaattgatgctctgaatcatgacgaggatgacgtaatagatggaggcagaatcagcctttcaagttcatactcgcaggggtttctaacttcgttgtcgcaagcgctgcagagtactggtctagatctttcaaaggctactatctcagtgcagattgattttgggaagcgcgcaaaccaagcaatgacc

SEQ ID NO: 11554 - DNA, 544 bp, Lycopersicon esculentum
  Predicted polypeptide sequence is orthologous to G2142
gccaataattagctatacaactcacatttctctgtagtatataagttttgcaagtgttgttaataatcggagccttttagcgaaatcgccagtctctctgtttaatcttcttttgttaacagctaataagttgttatttcgactgaattttgttagctggtttcagattttgaaatggtgaggactgtgaagaatcatcatgaagaggacgaagaagacgatgaagagttttcatctagaactcccgatggctcttctcaaaaggggaaattagaagggaagagcaatgatgggaaggtaagtgctcatcgttcgaagcattctgagacagaacagcggaggaggatcaagattaatgagagatttcagactctaagagatctcataccacaaaatgatcagaagagagaccgagcgtcattcatgttagaggttatacaatatatccagtttttgcaagagaaattacagatgtatgagggaaccaaccaaggatggagtgcagaaccctcgaagttgctgccatggagaagtactcctgggc

SEQ ID NO: 11555 - DNA, 520 bp, Lycopersicon esculentum
  Predicted polypeptide sequence is orthologous to G2142
aaataaaatcttaaaatcttgaaaaaataagatgaaatctggaaagggtcatcatgtggaagaagaagaggatgagtatgattttggttctaatagagatgccacaccttcaagtaatagtactaaagatgggaagaacagtgacaaggcaaatgcaattaggtcgaagcattcagtaactgagcagcgccggaggagcaagatcaatgagagatttcagatgttgagaaatttgataccccatactgatcaaaaacgagataccgcgtcattcttgttcgaggtaattcagtacgtacagtatttacaggatacagtacagaagtatgaaggatcatatcaaccttggagctcggagcctacaaaacttatgccatggagaaacactcagtggcgcgcgcagagttttcctgcaaaccctcaagccttgaacaatggtactgacgctggaccaacatattcaggaaggtttgatgagaatctcttaaccgtcacttcgtcaatgcaagccaatcagcgg

SEQ ID NO: 11556 - DNA, 780 bp, Lycopersicon esculentum
  Predicted polypeptide sequence is orthologous to G2142
taagccgacaacagttcctatgcacccaaacacgttttcattttctgggactagtagcacggcagcgctttattcatcaaagctgatagctgatactgataagttggagtcaaagtctcattctcaattttcacttagcagatcgcatatgactgattatgctattccaaatgctaatccagaaaggctggagctgcctatagaaagtggtaccatcagcatctctagtgcctattctcaagggctattgaacaccttgacacaagcgctgcatagttctggagtagatttgacccaagccaatatctctgtgcaaattgatcttggaaagagagcaaatgggagagtaaattcatcagcttccactgttaagggtgacaacgtttcaacaagcaatcaaccaattccaaaatctagagttacaaccacaagggaggagcctgatcacgccttcaaaaggcggaaaacaagctaatgctaatttgaaacactagtgttctttcttcttttttttccattggttaaatttaattgttttcctctttcccttccccttctcaaccaatatcgatgtccacacctgatacagaaaatctcccaaatgagagatcacaagccactgtatatgtaatgaactagtactactactatttttctgccccttcaaattgttgggctgcacaaatttacctgactagagtgtgatattttattacttgggtagtaaactactgtattaatttattactaaggctttcaatgatgatgatgagacagctg

SEQ ID NO: 11557 - DNA, 420 bp, Lycopersicon esculentum
  Predicted polypeptide sequence is orthologous to G2142
gatgatattgtcattaacccaacattgcttgcaagtgtccagagctttgtagaaccgaacttgactgctgctgctttatatagagcaacacacgattctcatatggcagcggatgaggcaattgcctttaacatgccactgcaacctaatttatttgaaaatgcatctgttgaaccatctcctgatgctgagcacccttctcagacacaatcattatgttggccagataaacgagatacaattgagtcggaggttctgagctatggcagaaatgatcaagaagaagtgaaattcgatggtgaagcagttggaagatcacatgcatatagtcaaaggttgcttaatatcataaaccagactctagcatctgtgggagtggatccggcactggccgatgttagagtacagcttgatatcagc

SEQ ID NO: 11558 - DNA, 1035 bp, Lycopersicon esculentum
  Predicted polypeptide sequence is orthologous to G2144
gaaaagggcaaatcctttttatagagtcaaagataaggaagactacagtagtacacacagttgcagagaagaccgccattgaagctcttgataaaaactccatataagaaacaattaactctggaaaattccaaaaaagaagaagaaaagagaaggaagtatatagaaagcttcatttttcacttcaaatacttccattttttctcttttttttgttagtgttttgaacctcattggtggggttactgtggagtaatctctgtttaaattgtggggtttgtttaaaagtttcagttggagtttgcagcattaacgaaattcgagaaactgtagaaattgagcttggggttgtcttgttgagtctcattctggaattgggttagctgtgttgtatcaaagttgggtttggtttgttttttctgtgaaatggataatctgatagagtgtattgaagcaggagaagctagatccgagaattgcggagctagaatgggagaaattaaagatgggtttcatcaatttggtgaggaaattttgtctgttacgtcggaaggtggaagttctttcactgctttacttgggcttccgccgaatcaagcggtggagcttttggttcagtcaccggaaactgacaaaatagcatcagataagcttgctatcagtgaacctcactatcgttatcctcctcctcctccgatttttccttcagatatcgctttgatcgatagagcttctaagttctccgtcttcgccgccgccggtaactccccggagtccaattcaaccctttcgaattccgggtcgaaatcactgttcgtcaagcaagaacccctagattccgaatgtaaccacaactcatctccggcgacttccaatccactagtccatcagaaatcaacaaagagaaaggaacgcgagaaaaaggtaaaagaaacttctaaaaaggggaaaaaatcagctaacgatacctcagaagacggcggcgagaagctaccatatgttcacgtccgagcgcgtcgaggccaagccactgat

SEQ ID NO: 11559 - DNA, 875 bp, Lycopersicon esculentum
  Predicted polypeptide sequence is orthologous to G2192
ggtaaagcttcggagtaccaagaagagaagaatgagttctccaaccatggaacaccaggaagtcatgaagaagctgaacctacagaccaaatgcttggaagccggattattgggaatgaagagctctctccaaagctgaatggttttgtgcgtgaagggtcacataggtccagaaccgggagcttctctagagaagagagcacggggacgcctacctcccatggatcatgccaaggtagtccttcccctgcaaatgagtcctcccctcagaatgagctgctcaattcacctacacaagagtcggtcatgaaagtggaaggctctttggaaccagctcgtcagaccacaggagaattaaacttatccactgcattcctaatgcctgggctttttattccagaacacactcatcaacagtttaggggaatgctagttgaggatgcaggcagctcacatgatctgagaaatctctgtccggctggagaaaccatgtttgatgaacgtgtcccagaatacagttggacaaacccaccatgttctaatggaattgctacgaatcaagttcctcttcctgtcgagaagatgccacaattttcttccaggcctgaagtaacatccgtgactataaaagcaacctatagggaagacatcataagatttcgactttgtttgaactctggcatatataagttgaaggaggaagtatccaagaggctaaagttagagatgggaactttcgatatcaagtacctagatgatgaccacgagtgggttttaatcgcgtgcgatgcagatctacaagaatgcattgatatctcaagttcatcaggcagcaatgtagtaagattgttagttcatgacataatgcccaatct

SEQ ID NO: 11560 - DNA, 730 bp, Lycopersicon esculentum
  misc_feature (706)..(706): n is a, c, g, or t
  Predicted polypeptide sequence is orthologous to G2192
gcgctgttttgcaatctgcttacggagcactcacgctggcgagcgatgattatattttagagttttttctgcccccaaatgatggagactacactgaccagctggccttgctgaactctctcttattgacaatgaagcagcactttaggagtcttagggttgcttctggtgaggaacttgagcatgactggggttcagttgagattattaaagcatccacagaagaaaaacttggttcaaggtttgactctgtgccaaccaccaaatctcttcctcagtctgctagtgtagcaaatggaaggagacatcctgatctaatggaagagcagcactccactgtggcaaaaggtgcagagggtgtaaatgttacagctgaagcccataatcatgcttctgtcccccaaaataaacagactggtaagaaatcagagagaaaacgtggaaaagctgaaaaaacaataagcttagaggttttgcaacagtattttgctggaagccttaaggatgctgcgaagagtcttggcgtttgtccaactacaatgaagcgcatttgcaggcagcatgggatctctagatggccatctcgcaagataaacaaggttaaccggtccctttcaaagctaaaacgtgtcattgaatctgtgcaaggagctgatggaacattcagcctgacttcacttgcaccaaattcacttcctgttgctgntgggtctatttcttggcctgcagg

SEQ ID NO: 11561 - DNA, 814 bp, Lycopersicon esculentum
  misc_feature (21)..(21): n is a, c, g, or t
  misc_feature (731)..(731): n is a, c, g, or t
  Predicted polypeptide sequence is orthologous to G2192
gaaacggagggggagtctacnagttttttttttttttttttttttttttttttttttttaatactatgtattaatactctaatattcatcataaagaaatttcccgaagtcaactaaacttcacacatagttccaaaaaagttggaaacaacaagtataagcccgaagcttacaagggacaaatctagggtagttggagagccgtaaactgcctgtagagagagcatttccgttaggcttatcttcgttttcatcagaaaaagcccaaaggggagaacaaggctgttcagaagcagccgatacgagaaacggcgacataggatttgaagctgaagcagctgcggcgaagatctgatcaaatgaccaggaagcgttcgagatccaaatcaagatccatcatcaacgaatccctatgattctcccccaccgcatgctgctgctgctgcgccgcgcccgcgtcgcggcggtggatgtacaaagtcctttggctttgaacggaaaatgaaattcatttcttcttcggctcggacattggagaaaatatgggaagtgattatgagggagatttctctcttattatgttggggcgagagagaaggagcctaaaaaatcccggccgaattttggaccactggggcacctgagggccgggctcccttttgtccttggggggtaattgggctggggataaaggcaagtgttctggggaagatccccccacccccaaaaanacggggaaaggtaactggggccaggggaaccaatatgggggggtgcgtcaaccacttttattctttatactcccccccccccc

SEQ ID NO: 11562 - DNA, 484 bp, Lycopersicon esculentum
  Predicted polypeptide sequence is orthologous to G2192
gctgtttcttccccctgataacggagatccaaatatgttgcttggatcaattttgactacaatgggacagcattttcaaaatttcaagtttgcttcaggtcaagagctaggaaatgattcaagtgttcaagttgttaaagcttcttcagataagaatgtggattactttcatatttatcaaactagagatagttcgtttatgcctgaagtattgcacgttgaagatagtcggaaccaactaatggaaggcaacgaaaatcacatggagaagaaagaagacagaaaacaatcgatggttcaatccaatgtgttaagtatcgattcgcatgttatatcagagaagcaatgtgtaagtgttagtcatttgcaaaaagaaagcagaaccagaactaaagattctgtcaactatgatgatctcaaacagcattttgacaagaacctttctgatgcagctaaaagccttcagattagtcgatctacactg

SEQ ID NO: 11563 - DNA, 617 bp, Lycopersicon esculentum
  Predicted polypeptide sequence is orthologous to G2192
gagaaatcagatagaaatcgtggaaaagctgagaaaacaattagcttagaggttttgcagcagtattttgctggaagtctcaaggatgctgcaaagagtcttggggtttgccctaccacaatgaaacgcatatgtaggcagcatgggatctctaggtggccatctcgcaagataaataaggtcaatcgttccctttcaaagctaaagtgtgtaattgaatccgttcaaggagccgaaggtgcatttactctgacttcactggcacccaattcacttcctgctgctgttagttcaatttcttggcctgctggtgcaaatgtttccaatctaccaagttcaccatcgtataaaccttcagtatttcctgaggagaagaatgagttcttccaccatggaacaccagaaagtcacatagaagctgaaccctcaaatcaaatgctaggaggcagggtggccaggaaggaagaatttactcctatgcagaatggttatcttcatgcagaaggcacgcataagtccagaacagggagtgtctcaagagaagagagtgcatggacacctacatcccatggttcatgccaaggaagcccttgcgctggaaatggattctcccctca

SEQ ID NO: 11564 - DNA, 1252 bp, Lycopersicon esculentum
  misc_feature (1088)..(1088): n is a, c, g, or t
  misc_feature (1206)..(1206): n is a, c, g, or t
  misc_feature (1210)..(1210): n is a, c, g, or t
  misc_feature (1212)..(1212): n is a, c, g, or t
  Predicted polypeptide sequence is orthologous to G2207
ttatagcaagtcagagtatccactttctcattatgcaaaaatgtttggactgcaagctgcagtagctatacgtctacgtagtatctcaactggttcatctgattttgttttggagttctttctaccctcagactgcagaaatcctgaagaccatagaaaaatgcttacttcattatccatcatcatacaaaatgtttgccggacattgagggttgtgacagataaagagttgcaggaagaaactatatctgtgggagaaatggcaaaccacacagttgaacaacataaggagcacactgaaacctctcaagaaaggacatcgtggacctcttgtgacgcagagttccaggagagttctgttatgtctacattccaggatgaaaaaccagatgaaatgctaaggaaagattcggtggagtttaggcaccgtaagaattctgcttatgaggagggtgtctctcgtaatctgggtaaaacgggagacaggagacgtgcgaaggctgagaagactattaccttgcaagttcttcagcagtattttgctggtagcctaaaagatgctgcaaagagcattggtgtttgtcctaccactctgaagaggatatgcaggcagcacggaattaaacgctggccttctcgaaagatcaagaaggttggtcactccttacaaaaaatccaacgtgttattgattcagttcagggtgcctctggcactttacaaattgaatccttctattcaaacttcccagagttggcgtctccgaatgcatcaagaatgagcccttttgcagactcaaagtcaaatgaacatccaacagccttgaacacacaacaagagagatgcattacgagccccaatcctgatgcatctaagtcaccctcttcttccagcagtcgaagttcaagttcaagtcaatgttgttcatccgggacaaaacctcaatcgcctcaatctcaccctttgagtattgttggcgatgaagatctaatcgtacaggaagagtctgtagataatgcagtgaaaagggttaaaagtgaaccagagcttcatttatcaagtgaagcactgaagactataccaagatctncaaagccatttatgtgttgctgagaatcctatatcagaaaaccttgtattgaaggaggagtccatcaacatctcaagaagaagctccacgagtaaaagtaacacatggagaagaaaanattnangttccgaatgcaaaacagttggagataccatgatcttcta

SEQ ID NO: 11565 - DNA, 863 bp, Lycopersicon esculentum
  Predicted polypeptide sequence is orthologous to G2226
gtttatctttgcaaaaatcttggccttttgcttttctctttctcttttttggttataggaaacaaaagttcgcttcttttttatggggtcttgataaaaaatccagtgcattgagttcttccaaaagtttggcttgaagagaaattcctcacatctacactaggttcctattcataatgggactctcaccatatacgactccagcagatgcaggagtgttctgtgtgattctggttaatacagccatatccatctctattgtcaagggaatggttcgatctatccttcatgtgattggcatcaactttgcatcatgggaagaatattctattgaaggccctttggacccatttgagtgtcgtgggagcccctcggtatcatacatggaggagttccgaagcagaacccctgctgttcgttacgattcattgtgttctaatcaccctacacaagaatgcgtggtatgtctggcagagttcaaacatgacgaggagataaactgcctctcatgtggccacgtttttcataagctgtgtctcgagaaatggctaaagaattggaatgtcacctgccctctctgcaggaattacattatgcctaaagaaggtgaggaagatacttgtccaatgtgaattttgtagtttgtcaggcctgtttgatatgttctgatgtacagcttagttgggtaaaaatttattgatgactgcctgatctttgacactgcataattctgtaaccttttatactgtaatactttgcgtcctatcacagtgacgggtctctttgttgcgaccaacaattcatatattgttgtacatatgttacaaaattgccagttaaaaaaaaaaaaaaaaaaaaaaaaa

SEQ ID NO: 11566 - DNA, 669 bp, Lycopersicon esculentum
  Predicted polypeptide sequence is orthologous to G2226
cataatgtaattcctgcagagagggcaggtgacattccaattctttagccatttctcgagacacagcttatgaaaaacgtgcccacatgagaggcagtttatctcctggtcatgtttgaactctgccagacataccacgcattcttgtgtagggtcattagaacacaatgaatcgtatcgaacagcaggggttctgcttcggaactcctccatgtatgatcccgaggggctcccacgacactcaaatgggtcaaaagggccttcaatagaatattcttcccatgatgcaaagttgatgccatcctcatcaaggatagaagtgcccctccccgaagaatcttataattttaaagtacaaacaaccttaccaaaccttagtgtcatgcacctgatggaagggctaagataatgagtctctgaatcagtaacagaaaatgtaacaacttaaataatggaacagaaggataggtttcattcacccaacgaattaacccagctggctactacgtcctatagaagaaaatggaacaacataaagtgctatctcatcaaacccatcctagcacaagggactgcttctcaggagaaaggaagcagcaggcttaacgtaagtataatccctgaaaagggtccgaattatcctttggactcgaaattggagaatcaacc

SEQ ID NO: 11567 - DNA, 996 bp, Lycopersicon esculentum
  Predicted polypeptide sequence is orthologous to G2226
gttaacaaaaaagtctcaagttttcatatttttagatccagtatattgagctctttcaaaagtttttttgaagaaataatcatcattttaacataaggttccaatccattatgggcctctcacaatatccaactccagcagatgcaggagtactcggtgtaattctagtaaacacagccatatccatctccattatcaaggagatactccgttcgatccttcgtgtgattggcatccgtatcgcatcatgggaagactattctattgaaggacccttggactcacttgaatgccgtggaagcccaccagaatcatacatggaggagttcagaagccgaacgcctgcatttcgttatgactcgctacgtatctctaaccaccctgaacaagaatgctctgtgtgcctgacaaaatttgagcctgatgcaggggtaaacagcctctcatgtggtcatgttttccataagctgtgtctagagaagtggctcaggtattggcatgtaacttgtcctctttgtagaaattacttgatgcctcaacaagaagaggacgatacatgtccaatgtgagattaaacgttttacggtgccacttcatccatttgctgatgttattatgtacagcttagtagtgtacaggctgagtatgtgtatgcttgatctttgatgtgatatagtctgttagcttgtcatatttgtgatggtttgcgtcctctcagagtgacgggtctctttcgtgtgaccaaaaaacttatactatgttgtacatgatttagtcctgtagcttcttgtgtttgtaatgctttgcgtcctctcagagtgacgggtctctttcgtgtgaccaaaaacttgtacattatagtacatggtgtagtcgtgtagcttattaatgcttttcgtcctctccaagtgacgagtctcctttggcatcaccaagaacttctacattgttgtacattgttgtacatataacctaaaactttctcttatgttactt

SEQ ID NO: 11568 - DNA, 582 bp, Lycopersicon esculentum
  Predicted polypeptide sequence is orthologous to G2226
ctctctctggtatcctatgaatctaacaaccctacccttaagtctctaaaaacaataaatttctctcccaattttcttaatatttcaaatttcaaagaattttctaacatcttctagctcctactacacctataggcaataatataaagtccagttcagtcagctgttccagaagttgttgctagtagaaatctctaagtttcagcctagattccaatccagtatgggactctcacagtatccaactccagcagatgcaggagtgctctgtgttattctagtgaacacagccatatccatctccattgtcaaggagatggtccgatcgatccttcatgtgattggcatccacattgcatcatgggacgattattccatcgaaggctccttggactcgtttgaatgtcgcagaagcccatcagagtcatatatggaggaattcagaagccatacccctgcaattcgttatgattccatctgtatctctaaccacgctgagaaagagtgctcagtctgcctgacggattttgagcctgacgcacagataaaccatctgtcatgtggccatgttttccacaagca

SEQ ID NO: 11569 - DNA, 628 bp, Lycopersicon esculentum
  Predicted polypeptide sequence is orthologous to G2226
actcatattttagtctttcttgatgatggatgatgatttaccttggatcttcacattttattcaatattgaaaagttctggttttgggtgttttattacatgatttgtaatttgtggtctgagatttccttgttatcttgaaaagggttttttttttctcctttgtctatttacatttggtatcaggaaaatgaaattattacagttttttagcagaagtttttctggttcttggatccatgttcataaagatttgttttttcaaaggaataaaactgaacttttaaaggaagatgaggactttctaatcaatggggtttccatttcttgtttgagatgtgtaacatagctccaattttcatttcttgatgcttttcttggaggactgtgttccatttataattgtcttactgctgtgggttgtttaacttttcctcataattgacttatagattcttgtttctatgcaggtccagttcagtcagctgttccagaagttgttgctagtagaaatctctaagtttcagcctagattccatccagtatgggactctcacagtatccaactccagcagatgcaggagtgctctgtgttattctagtgaacacagccatatccatctccatt

SEQ ID NO: 11570 - DNA, 694 bp, Lycopersicon esculentum
  Predicted polypeptide sequence is orthologous to G2227
ggacaccataagtccgtcatgtcgacgacggaggccacccttcccaccgtcggtaaccggcgttcttaccgatgctacaactgcaacgatgcctttcacataaccacaaccggcattgtcagctattaattatgttgacttccatgctttcatcgccacctcctccctaattacaccattgccagttttataccttttcctcaacacttaactcttaccgattataccctttccatcaatgaatcaattacttttaattattccgattccgatactgaatccgatgagagtaattccgacgatctttcgtttgagttgtttaacccacctcaattccgttcaccgactcttcaatcatttctcaactcacttccgagtgtgaaaatcaatgaatcatcgaaaaactgttcgatttgtatggaggaatttggaattgatacagaagcgagtcaattgccttgtaagcatttttttcataatgattgtattatcccttggcttaatcggagtaatacttgtccactctgtcggtataaattgccacaagaagatgagggtgaagatggagatgaaattgaagtgattttggatggtgaaattggtggtatagaatttcaagaaaatttcacagcatcaaccttgtctgaagttggtgaggatgatgatcttagagaaagggatctggatgcaatgc

SEQ ID NO: 11571 - DNA, 1842 bp, Lycopersicon esculentum
  Predicted polypeptide sequence is orthologous to G2239
ctcgtgccgaattcggcacgagggatccttctgcaccatccaccatttttgttttaatacccccaaacgaatcgaaccacagttatttcaatttctttgatattcaaaattataaagcttacttccccagattagtatgagatatgggcaattctatgaagcaagaatctcctcttcttagttatcttctctttgtgtttctcttcacatgttcttctttaattgacgaatcagtcgcacagccaccaactactggaaataaatttcaatatgcaaggctcagtcatcctttggcaattatcataattgttcttattgctgcgctctttttcatggctgctttttctatttacattcgacactgcactcaggcttctggattgagcggcagtgtccggcgagctctatccatgcgccgccgtgctgcggcggctcgtggattagatgcagcggttattgagacttttccgacttttacttatgctgaagtgaaggatcatcaaattggtaaaggagctttggagtgtgctgtttgtttgaatgaatttgaagatgatgaaacgctgcgtttaattccaaagtgtgatcacgtttttcatcctgagtgtattgatgcttggttggaatcacatgatacttgccctgtttgccgtgctgatctcaaccctcaaccggatgaaccgccggttcaagttccagaagatgaaccggcaacggaacagcaacagcaacagcaaaacgatgaagtttcaattcgcatagtgagcgacgacgaacaaagggaacaagtacagcaacagcaacaagaagaaggttctgttaattcgacggtgaagcggaatttgagcttcaacgtgccgaaccgggttcccaagcaagaagaaggcggttcagttaaatcaggagtaaagagaaacttgagtttcaacgtgccgattcaaccaccgagatcaatttccatgaggccaaagatgttcagcaaattcagatcacattcaaccggtcattcactagtactaccaggtgagaatttagaccggtacactctcagattgccggagggcgttcggaaagaggtaatgaaccgtgcactattgaaccgggctaaaagctttggaggcaccttaccaagagatacaagctccagaaaaggatacagaaccggtaccggagatggaagcaaccggggttctagatctaacaaaaggatggagtggtctgaaccggaaccgaaatcggaccggtggattttcaccatgacaccaccattcttttcaagaggttcatcaatgaaatcacccagagttggagctgaagccggcgagggttccacctcagggagtatgagaaccgccgtcaaattgccgtcgtttaaatgcttggaaccaaaaggcgatgaagcctcattgatgtcgactgactcggctcgaccgccggtttaataatccggttcgaagtcaaaccgtaatgattcgcaaagacttttcatgggctataggaaaggggaacgtgtttttcatgatagattgggcccccgctttgaattaacaagcccaaacttgactctaaatttattttttcgagaaaagcatttttgtttttatttttttgttatataattgaaaaatctttaagtttttcctttttctcgttttaaagatatagtgcatatcaatagttgatgtaagtgtaaccaaaaaatcacttgtaattttatttatttttccttattggataatgtcctatgatgatgtaagtatgtgtatttcaatttttggtgaaacagaaatgtaaaggaaaaagtagaggtttcgattggattaaaaaaaaaaaaaaaaaaaa

SEQ ID NO: 11572 - DNA, 933 bp, Lycopersicon esculentum
  Predicted polypeptide sequence is orthologous to G2239
gcggccggcgaaaattcccaccaaaagctgccatggttaattttaaagctctttccgttaatctcctcctattagtattactatgtccggcgtcagctcagccatcaaattcccctgattccgagaatcggttcgagtacccgagtgtcagtcctgctatggcaattatcatagtgatacttattgctgctcttttttttcattgccttcttctcaatttacatacgcaaccgcggtgcagttaacggaagcatcggtcaaaccttctccatgcgacggcgtactgctgctgctactcgaggacttgaagattccgtcatcgagacttttcctacctttacttacgtcgaagtaaaggatcatcatattgggaagggagctttggagtgtgccgtgtgtctgaacgaatttgaagatgatgaaatgttgcgtttgatccctaagtgtgatcacgtttttcatcctgaatgcatcgatgcttggctcaaatctcatgtaacttgccctgtttgccgagctgatcttactcctaaacctgatgaaccggtgccggttcaaactcctgaggtgaaccgggaattggggcaagaacaggagaatacacagcaaaataacgaagttacgattcaaatagatgtagatgagaatttgatgtcacagcaagaggagacctctgtaaaaccagaagttaaacgaaatttgagtttcaacgcggtgaaccggccgccgaggtctttttctctgaagagaccaaagatgttaagcaaattcaggtcacattcgaccggtcactcattagtggtaccaggggagaatttagaccggtatactcttagattgccggagaaggtgaggaaagatgtaatggaccgggctctactaaaccggacaaggagctgtgcagtcacgctaccaagacacggtagcaccaca

SEQ ID NO: 11573 - DNA, 399 bp, Lycopersicon esculentum
  Predicted polypeptide sequence is orthologous to G2239
gctccggccggggaaaattcccaccaaaagctgccatggttaattttaaagctctttccgttaatctcctcctattagtattactatgtccggcgtcagctcagccatcaaattcccctgattccgagaatcggttcgagtacccgagtgtcagtcctgctatggcaattatcatagtgatacttattgctgctctttttttcattgccttcttatcaatttacatacgcaaccgcggtgcagttaacggaagcataagtcaaacctttttcatgctacgggatactgctgctggtactcaaggacttgaagattccttcatcaagacttttgctacctttacttacatcgaaatgaaggatcatcatattgggaagggagctttggagtgagccgtgt

SEQ ID NO: 11574 - DNA, 506 bp, Lycopersicon esculentum
  Predicted polypeptide sequence is orthologous to G2239
ctaatgaagatgataatcgagctaagccatggtttctgctcgatttccctttgtttattcctgctcgcgatgcatgttatatcgcaatcagaaataacaccattaccaccatcaccaccaccattttcatttgatacgaaaataaaaatcaacccacctacggctatcattttagttacacttatcagtgttttcttcgctatgggaattgtttcagtctacgtccgtcaatgcgccgaccgccgcttcatcggcgacttcgaattagcagacgaagattctggacgacgcggcgctcgatcgcatggactagacccagtcgtaattacctctttccctatgtttttttactctgatgttaaacatcacaaaattgggaaatcagtgttagaatgtgcaatttgtttaaacgaattcgaagatgctgaagctcttcgacttcttcctaaatgctctcatgtttttcatccaaattgcatcgacgcttggttattttctcatattac

SEQ ID NO: 11575 - DNA, 898 bp, Lycopersicon esculentum
  Predicted polypeptide sequence is orthologous to G2298
tctcttgggtgcactctcatcataataatcctctaattcaatatccatggaaaacaattctactcatgatcagccaaagttcaaaggagttcggttgaggaaatgggggaaatgggtttctgaagtcagattgcctaacagccgcgacaggatttggttgggctcctatgattctgccgaaaaagccgcaagggcttttgacgctgcacagttctgcctccgcgggcccaaagccaaatttaactttcctgatagtccgccggatatatccggaggacagaggctttcgcccgcggagatacaggctgtagcagctagatttgcgaatgattactcgccgtcagtggtacaggagatacgccgtgatgatcatcatcatgatcacgagggcaatattggaaatattaattcacacgtgataaatatggagaaagatgagatttcactgtcaacaactagttgtgatagggtggtccaaatgggcactagtaatactgttgctgaaatggattgggcttttcataatgatatgatggaaaactattcatacaatgcaagtgggcctccacctgaatatttttgtgatccatattatatcgtcggaggaggaggaggagcaggagtactcgataatttatcgagtaatctctactcaccaccacattttccgcaaagaacaactcctagttatgacgatgatgatactggcaatggtgacgatgaacattattctcaacaatccttcctatggaacttttaactataaattggttaattaagcagcagcatattggtacctacgctagttgagttttgtccactacacgtacgtagtaatcctttccggttttcttatcgtaattgtttttgccggaaaaatatatagtatatatatatg

SEQ ID NO: 11576 - DNA, 1119 bp, Lycopersicon esculentum
  Predicted polypeptide sequence is orthologous to G2311
gctcctttactctcgctccaatatcgatcttaaggataaatggagaaatttaaatgttagtgccaatgggcaaggaccaagagataaatcaaggacaccaaaagcgaaggctaatcctgatgctgcagcagctccattggccatcacatatgcccctctttcttccactctagttccacaagatgcatcagcagacactgttatggaagattcttcaaaatgcgcactagatggaaaaactgcctcaaagtacaatcaaatgatatatgatgcactttcaagtctaaacgagccaaatggatctgacacaagcaaacttgttaacttcattgagcaaaggcatgaggtgccccagaactttagaaggctgctgagttctaggctgaggaggcttgttcaacaagacaaacttgaaaagattgagaattcctacaggattaagaaagaggtcttggaaaaaacaaagacggctgctacccctaaacaaaagcacgttgggccaaggcagttaccaaataatgcctatctcggtgacactgcggaagaagcagcaatcactgctgcctataaggttgcagaagctgaaaataaatcatttgtagcagctgaagcggccaaggaagctgagagagtctcaaagatggaggaagacagtgataattcactacagatctacaaggatatcttcgacaaatgttcacatggggagattgtgctgctaacggcatgatatggtctttcccctattttgtaaagtcagaaccagctgttcagcacctctatagtagtacatgtttctcgttgtatcaactagtgatatgcagtctgttgtcagtttatgtaccagggattatgagctatgcacagattctcgcctcctattatgttgtattcaatgtaacaacaaaatagagggagagagatttgatgcttgtagaccatgctctttattctagctggaaaattgatagagtgctctgcttttacttcctgctgagtaggttgtgcacttcagcatatttttcactttttgtagttcactaagaaatgagttgcgtcaagagtggaatcgatgtttccattgaaaaaaaaaaaaaaaagagaactcgagggggggcc

SEQ ID NO: 11577 - DNA, 795 bp, Lycopersicon esculentum
  Predicted polypeptide sequence is orthologous to G2311
cgacctcaaggacaaatggagaaatatgtgtatttacactgctggacaaggttcaaaagataaatctatagttgttcgtacaagaccaatggaaatagatgcatttgtgccttcccctattcaaagtcttccgcctattacttcagcatttgagaatgaagccatcgaggattctcccgacgtccaaccagaaggcgtgaatgctccaaagtataatgatatgatctttgaagctttgtcatccatgggggattcaaatggatctgatcttggtgccattgtaggatttattgagcaacgacatgaagtacaaccaaactttagaagaaccttgagttccaagttgagaagactggttgcgcaaggaaaacttgaaaaggtccagaagtgctataagatgaaagatgcaacatcagaaaccaatatatctactccacaacaaaatgatgtccggtcatggccagttccgaattcggttccaagacaaagtgatgtcctgtcttggccagttccgagttcagctccaaaacaaaatgatgtcctgtcatggccagttctgaattctgctccaaagcaaaatgatgtccggtcacgaccagttccaaatatgggttcaaaacaaaatgatgtccggtcatggcaagttccaacttcgggtgtaaaagtctccagtggaacagcagaagaagctgctaggattgctgctgacattgttgctgatgcagaaaataagcgttgcttggaagttgcagcagtcagagatgcagaaatgaagctaagaatggttgacgatgc

SEQ ID NO: 11578 - DNA, 497 bp, Lycopersicon esculentum
  Predicted polypeptide sequence is orthologous to G2311
ctgcctcaaagtttgtctttttgaatttctttttcaaattgttgaatatgccaggaaatgagacttgtcaaatccatatccttccgagttaacgaatgcatttccttcagactttttaacttaaatcacagtgatgtgggaaaagataattggtagttgttattctttgaattgtataaagtgcatcaatatggtaatctattgactgttgattctggcttggaacaatttggtctgatatggatagacgggcacaaagatggacactagccaaatgaagagtcttgtatctcagattgaccttattagaaatcttatgattaaagctaatcatttcatttcttggtacaatcaaatgatatatgatgcactttcaagtctaaacgagccaaatggatctgacacaagcaaacttgttaacttcattgagcaaaggcatgaggtgccccagaactttagaaggctgctgagttctaggctgaggaggcttgttcaac

SEQ ID NO: 11579 - DNA, 846 bp, Lycopersicon esculentum
  Predicted polypeptide sequence is orthologous to G2319
gaaaacatgaattcaagctccgaaaattgtacatctatggctaataattctactcccaccgacgcttctagcaagaaggtacggaaaccatacaccataaccaaatctagagaaagctggactgaagaagaacacgacaagtttctcgaagctcttcaactgtttgaccgtgattggaagaaaattgaggatttcgtaggctcaaagacagtaattcagattcgcagtcatgcacaaaaatacttcttgaaggtccagaagaatggttcaatagcacacgtgccaccacctcggcccaagcgtaaagcagctcatccatatccccagaaggcaccaaaaaatgtgttagtaccgttgcaagcatccatgggttacccttcttcaatgaattcccttccacctggatatccaacatgggatgacgcgtccgtacttataaattctccatcaggcggagtaatgccatcacaagatgaataccatcttcaaagaattcaggctgataatggatcaaagggagctacattgattagtaactgcagtatgagtggcattagaagttccaacagaacggcaccgagttctgaactaccagaccagaataaactaggttctgttcctcatggcataccggactttgcagaagtctatagctttattgggagtgtgtttgatccagacactagaggtcatgtacagaagctgaaggagatggaccctattaatttcgaaactgttttgatgttgatgcggaatcttacaatgaacttatccagcccggactttgaacccattaaaaatgtattgtcaacgtatgatctcagttcaaaagtagtcggtcttcct

SEQ ID NO: 11580 - DNA, 593 bp, Lycopersicon esculentum
  Predicted polypeptide sequence is orthologous to G2319
tccgaaaattgtacatctatggctaataattctactcccaccgacgcttctagcaagaaggtacggaaaccatacaccataaccaaatctagagaaagctggactgaagaagaacacgacaagtttctcgaagctcttcaactgtttgaccgtgattggaagaaaattgaggatttcgtaggctcaaagacagtaattcaggtacatttgtaaagctttgcttacaactttaagctctttggagttaattgttggtgtgtgacatgcattcaaacgtacctggtatataatctagagccgacttattcaatgggaatttatttggccatgtgttaatgtgcgcgatcttttgtattctattaggccctttttcattattcaatttggagaaacttgtcatgaattcctttcgttctgttttggttcagagcacttggcatagcataacgatgtatagagtatgctatgtatgtatacatggaaaatctgtttatatggaacatttgccctaatattatcggttacagattcgcagtcatgcacaaaaatacttcttgaaggtccagaagaatggttcaatagcacacgtgcca

SEQ ID NO: 11581 - DNA, 157 bp, Lycopersicon esculentum
  Predicted polypeptide sequence is orthologous to G2340
ttattgaacctaataacaatgaaattgttgggtcaaaatcaagtgctccacaagaaaaattaccaattagtagcagtattattcatgatgctacttcaaatgatatttctacttccaccatttcaacatctcccacacgtggtggcggttcgatgcc

SEQ ID NO: 11582 - DNA, 421 bp, Lycopersicon esculentum
  Predicted polypeptide sequence is orthologous to G2343
tatcttcatcgggattattggccgtcttgaaggtggttttatagaaggcattaacccgcctggcggtaagagtcggaaacccaccacgtccacggccagctataatcagcaatatgttcaaagagttcggcaacaaaggccttccggctgttctttttgcaaccgaagctaaagccggccagcgttttttcattctcgctattaacctgcttgtaagacgcctgccatgattgctgaccaatatcgtcaatgacctcaaccgacccattttcccgccacccattttcagtgtctgcgtggtcttttctttatcatctttaaagataccgaaagccccaccaaccggcatcggcatgatccggcgtcagtttgggttatcgcaacccctttctacccccagatcgccaaaatcctgaccatc

SEQ ID NO: 11583 - DNA, 720 bp, Lycopersicon esculentum
  Predicted polypeptide sequence is orthologous to G2348
cctttgattgtgataatgagcagaaagatagagagaaataagggtggtgcaaatgcaatgagagaagagaggaaaggaaaatacgctacttacttaacaaacagacagagaaacaaggaagaaagaagcattccatgaccgtgagggtaccttgcctctagggaacaggctctttgccttctccgaaaggccagggtcttcgtcactgtcagagtaaggggaacaagtcctctgcatcaatggtaacttgttccacactgagtcttcaccttcttctacctttaatcaaatagcatgacctttaacaatcgcgattctcaatttctgcatctctcccccttccttttctttagggtttctttcccatcttcaggtaacttctctcatctctattcaatcatatcgttcttttcatttgtaagctttgatttcatcatattggacctaatcatattaccatttcaattattatgcttatttcattcgtgttcatttttctttctaagtctggattaatggaggaggattaacatgtaatcatgattctggacttaagaattcgataccagtacttccctttgtgattccatggaatttagaacatcctttagttttccctttttcttaagctgctattcttttatcttaacgatcagattatttgctaggatgtcttttatgtattaattggtggttctgcaatgtgtctttctgtttttt

SEQ ID NO: 11584 - DNA, 533 bp, Lycopersicon esculentum
  Predicted polypeptide sequence is orthologous to G2348
agatggaggaagaggagatggcagggattgggccaggaaagaaacgggctaggactgtacgggcttctgccggagctggggcgaggtgtcaagtacccgattgtgaggcggatatcagtgagctgaaagggtatcataagagacacagggtgtgcttacgttgtgctaatgcaacttctgtggttctcgatgggcacagtaagagatattgtcagcagtgtggcaagtttcatattttgtcagactttgatgaaggtaagcgtagttgtagaagaaaattagagcgacacaacaacaggcgtaggagaaaagccactgatacgtccaaaacgtctgctgaaaaggaatctcagcagctcacaacggctgatgatgttagtggtgatgacgacatcgtcaaagataacacatgcatgggcagccagttaggagaaaaggaaatcctattagaatctgaaggacatgtgccgatatgctctactcaaggcatccagaataatcacagtgatagtttcacagcttctggtgaaaca

SEQ ID NO: 11585 - DNA, 508 bp, Lycopersicon esculentum
  Predicted polypeptide sequence is orthologous to G2348
ccgttaaccccacccacccacccccaccaaacaatctactttctaggccaaccaccctcatctactaactaacttcctgttttctaggaatcctggctgaagcttcgtcagaaaatgcataatcaacctttttcatcgtcacaaacgggagttccgaccgaattaaggaatacccagatgatttcctctttgctttccggggatgaccccgcagcttcatccaattttgactggtcggatttactcgacttcgacctacacgaacaattgaacatctcattcgatgacccacttcaccaagagcagcagccggagacagaattcgtggcgccggtgataccttcttcggaggattcaccgcatagccaagatacggatgcgggtcggatcaggaagagggacccgaggatggcgtgctcgaattttctgcgggtcggatcccgtgtgcttgccccgagttagatgaaaagatggaggaagaagagatggcagggattgggccaggaaa

SEQ ID NO: 11586 - DNA, 743 bp, Lycopersicon esculentum
  Predicted polypeptide sequence is orthologous to G2348
ggagaactagtctcgagttttttttttttttttttttttttttagagcaacactctttagcattgaaataacaggcatattcacatcaaaatgtttcaagagtccaaagcttaaagaagttgagcacaaatagtatcagtgtatctgctctttggggacaactgatgtcagcaataaaaggcttttagggtgactatccaacaaattgtacaaagaaactacacaactagttgaagctacatagctgatacagttttgtgtttacatagcacaggtaatatagtacatcaagaatgccacaaagggggaccccgagcaatggagatcacacctatattctgtgactgcagaccgtcattttggtaaaagttacatgcaattttaagttttgtcaaacaaacacctccggattgtcatagcaatgtcaccaacttttctaggatgcaggaatgttgcacatagaccaagacacaaagcaaaaccagagattacaaaaacaagagtacgagacgtcaatagtgtctttctaaccaagaagccacaggacttccctgattgttgttccttcactctcaatggcaattctgcatccaaaagtgggactctagaagttagctcccaataagtaggaccaaactctatgttgtgcttatgtggtaccgctgtgtcctcctgcataatttgtcctgaatctcccgcaaaatattcctttagatgcaatctttccttgagcagaaattttt

SEQ ID NO: 11587 - DNA, 826 bp, Lycopersicon esculentum
  misc_feature (803)..(804): n is a, c, g, or t
  misc_feature (806)..(806): n is a, c, g, or t
  Predicted polypeptide sequence is orthologous to G2372
gagttagtgtatcaagtttatccaatgttaagagcaataaccttgggttgtgcactaacaatagcttagatgaagaaatcaaggcaaagcttgacagtgtttctcccaaactgaatattggcagttcatattcagacaatttatcactggatagtcagagcagtgtgcattttggggacaatgagctgattacaaaaccgggttccagctcttttacaaaagatcgtttcagtactttccagttatttggtaaggtcatccatgttgaacgtgttgagggagctttagatggttttggtttctctgaaagtgataacgttgaagtgtataaagagatagatgatccatccaactcagacgtctcaccaaataaagatgatccatccaactcagatgtctcaccaaataaacctttcaagctgtttgacaatcctgatgtccaacatgaatgagcctcagctgtcgaagcatgttcatcttgagataactatattccgtaattgccatcaattgcaaagttgtacaggtttccaaggaaggagttgattccagcagtggatgtttgctttctctttggtattcagaactaatgtaggctttaagtttaagacattcagaggtcaagtaaatcatctgtgttttcttgataatgatgagattatactctatatgttcctgtcagtactgtgtctttgaaaaagaatctaatgtggagttagccttttagatgcaagtcagaatttgctatgaatcgtagatgtttcttataattctcatggtatctatctttctctgttttggtnnanaaaaaaaaaaaaaaaaaaaa

SEQ ID NO: 11588 - DNA, 843 bp, Lycopersicon esculentum
  misc_feature (765)..(765): n is a, c, g, or t
  Predicted polypeptide sequence is orthologous to G2375
aatgaaaaactcggtccatttacccagcgtttgatgcttccgcagcacccccttcacctccttcccggcgccggtggttcttccggcagcggtttaggcggagacgatgagtttcctaagcgggacgagcgtgttccgccgtggagtactcaagagactagggattttatagcaattcgaggtgagcttgagatggagttctcttcggcgaagcggagtaatttgaagagtctatgggagattgtagctgctagaattaatgagagagggtacaggagaagtgctgaacaatgtaaaagcaagtggaagactttgattaatcgttacaagggtaaggaaacatctgatccagataatggcggacaatttccatattttgatgagcttcatgcactcttttcatcaaatatgaataatgtacatcgagtaccgatcgaatctgaggctggttcccaacaggcaaggaagaggcctcgcggaacaagtagagacagatcttcagaggaaatctcggaagatgaagaaggttatgcttgcgagagtgatgaagtaaaattaggcagaagcaatgttgctcccaaaaagaaacccgaaaaagaaaagcgtccaagaacaagcaatgcagaaaaagcttcaagacaagccagctttgggagtagcattaacaacaacactggtagagctgttgataatattcaagaaatgcttaaagaattctttcagcatcagctgaggattgaaatgcaatggagggagacaacaganaagcgtgctcgtgaaagagaagcattcgagcaggaatgggcgatcatcaatggagaagcttgaaagagataggatgat

SEQ ID NO: 11589 - DNA, 403 bp, Lycopersicon esculentum
  Predicted polypeptide sequence is orthologous to G2375
tggtaatcaccatactcaacaacagcagccacacatgcctcagtctacgacaagtacccaagatatcggtgggcagactcaacctagcttcatgaacttcaataacaggggttgaaaatgtcaaagaaaggctacatgttattaatgagtaattagcatagagccttgtatatattgataatgatatgtaatgaatagtgttacaggctgtggagtgcattctgatcagatcactttgtactatgatcaaaatacctagttactggttatacttgtttcataaacatcagttagatattgttcaacatcttttatgtattttactatagagtttgaaaataatactttgctggtgaaaagattccatactttatctcagattatggaaaaaaaatttgcattt

SEQ ID NO: 11590 - DNA, 281 bp, Lycopersicon esculentum
  Predicted polypeptide sequence is orthologous to G2375
gtgtcggtgatgcaaattttgggactggatttggtggtggtgtgcttggtggtcaaggtcttggtgctggtggtggtgattaaattgattaattaaattaccatatgtggtaataatcaaaaatgtttattattttttctgtatcaatttatatgacttttgtttttacgagagatgggtgtgaaattgtgtttctttctggagtatgtgatttctttttcccaaagttgttatgttgtaattgtttcggaagcttaatagattaaatttatcttcctttt

SEQ ID NO: 11591 - DNA, 2282 bp, Lycopersicon esculentum
  Predicted polypeptide sequence is orthologous to G2382
ctgatttttgcgtccccctctctctcacatctttgctaccccagaagatgaaccctactaaattttcaattttttttattttcatgtaattctttcacagtatcagatccttaaaagttttcttcaatttgttcttgcaacctgtttgattttccctcaaagtttcaaactttaaggcaatttcaagaacaagattccattttttgaggtaagggagttaaagggtgttctttttatttatttattggaacttaatctgttggatgttgttgatttttagatgggttttggttgtgaaggtgtttgatttgctcaaaccaaaaaaaataatcatttcttgaaataagggagttaaacagcaggtatctcttctgattggaaaatgaaaagttctttgtttttttgggttgtttaggggtttgattaagtttccagttttaagaggtgtttgagtacaaatttcccccttatgaggtaaaggattatagggttttcctttgacttgtgtctgagaagtttttgtatggattttgggtttctgtaggcataatttcttgaatttgatagagggtttcaattgtgtctgagaagtttttgtttggattttgggtctatgttggcatattttcttgaatataacaaggttttcaattgtatgtgagaagtttctatttggattttgggttgttgtaggcatattttcttgaattagataaaagggattttgcttgtatctgagattgtttttttttaattaggtttttgtgatggtataaatatgatggagaaacttgttcatctagttgctaggaataaagtgttaatttggagttaaaatggattgaaattgatcaagaaaacattgtgcttggaagtttaacttagactccctctaggtatttgtgtgtcgtagtagttgatacttggttggtttcttgtgcttcaatggatgacattgaggataatgggagatatccttccaacccttatggcatgaaccagggttatgagtcatccaatcgccagaagcttcctgttcacgacccttcttattcaaggcatgtcgacaatcagtatgtggaggaggcggatgatgatgaagaagttgatggcgaagaagaagaagaagatgatgatggcgaagaaaatggtgttcagcggatagggaaagatgtgtttgatgacgatgacgatgatgatgatgagtatggtgatttgcagaggcatcaaaagaagaggaagttaaagagcttgttatcaagttatgagtttgcacctcgagtaccaccaccatctactacagctgcaactgctcctaagccttcatttggtggtaggaatccactttcagattggtctgaaaatgagacatttattttgcttgatgcatggggcactaggtttgttcgacatgggaggaagagtcttcgatcagaggaatggcaagaagttgcagacagagtgtcacgggggtccaaaattgagaggacagacacccaatgtcgtaaccgtttggatactttgaaaaagaaatacaaaaaggagaagatgaagtttgcagagactggaagtagcactagcaagtgggtgtacttcaaaaagatggacatgttactaacatcaactccccagaaagctggtgtttcatgtggaatggactctggagagtatgttttcatgagcccaaaagcttatctgaatcgtgctaatggcttggatgagatgagggacagtcctgctaactcataatctgctgatggtgaggaggatggttcagaggatcttccaccaaaaagatcaagaaatgtacaaccaggagggaacgggaatgggaatggacattctttcaaattaatagcagattctatccataaatttagtgagatatatgtgaagattgagaatagcaagagacagcaaatgatggaactggagaaaatgaggatggacttccaccgagaattggaactccaaaagaggcaaattatggagagagctcaggcagaaattgcaagaatacgtcaaggaagtgatgaagagaacgacatgtctgctgaaaatgttagtggatgacaagccagattatctctctattcgttgtatgttggctattttccactgttgtattatatcttgcattttagtttctcaccattgatggctatatgcaaggcaacttaatgtgatgtaagaatgtatctggatgttgtttcaacagtcaataataacattatggaggtctgttaacctaaaaaaaaaaaaaaaaaactcgagggggggcc

SEQ ID NO: 11592 - DNA, 656 bp, Lycopersicon esculentum
  Predicted polypeptide sequence is orthologous to G2382
ctgatgtgaattttgaatcatcaaaaaccctaagagaagggatcttgaaaaaacccagtatttgttcactgcatatttgattgatatgaatgattctgatgatgaaactccatactcttcaagacccggcgctgccatttacaatacgtcttctcttcgatcaagacgctcaattcgaaaccctacctcttatcttagaaatacccattatgagtataataacgaatttcaatataaccatcatggtggtgctgctgctgcccatgatgatgatgaatctgatgatgaagaagaaaatcaagaatttagcagtggagaaaatgatgttgataattttcaaggtaagaagaagagaaagttggaaactttagtttcaaattacaattttgcccctcgttcaggttcaaaggatatttggagtgaagaggagagttttgtgttgttggaagtgtggggtgagaggtatttggagctcggacggaggagcttacgtgctgaagattggggtgaagttgcagagaaggtaacagaaatggttggtgttgataaaactgaagttgagtgtaggaatcaattagatgtgctcaagaagaagtataagaaggagataacaaaaatggagaaaactggaggtgggtttcatagcaagtggacat

SEQ ID NO: 11593 - DNA, 466 bp, Lycopersicon esculentum
  Predicted polypeptide sequence is orthologous to G2383
gccaagcaagtcttgcaaattgaagaatttgcgagcaatttcaagtgatagtctcattcttcggtctcttgggccatgtgccgtgttgattttgctgtgtctatctttcttcgaaggtcctacaccagcactaccactcgtagttctcttgttgttttttctacgaatagtactagtactgctactactcttctcatccttcttgttattattgcagctttttatgattgattgatcttcttctattttatctagtttgtccgaatcagcagcttcttctgcaggaatattggtattctgatcgtaactaggttggatgaattgaaaatcatggaaatattggatgaattcgggttcatattgcatagaaggagatggaatattaatgtgaaagaaagatgaagagctggaaatattggggctgtaattgctcgaagggtacatctttaaaaaaaaaaaaaaaaaa

SEQ ID NO: 11594 - DNA, 1210 bp, Lycopersicon esculentum
  Predicted polypeptide sequence is orthologous to G2404
cttgtgtttctctccttcttcttcttaaaatgcttcttctctggctctgacacccccttattctctccctctcaatttcaccctttttatcttcaatatcttctctttagtgcttctctctctacaaaatcaatatcaattttctttacaaacccaaatcttgaattctccattgttgtcttctttcatctttacagtgcagagcaaccatgcctgtggtattctcagaaagctccacggtttcagaacagattagatatagaaaacccagaacgcaaaaccaacaagaaacccaagatatggatccagtttcttcttcttctcgctccactaaacccacaatttcatctctacttctagcaccattttcgcctacaagtcctatccatgaaaactcaactacccccagtgcctctacagttttttccactaaaaagaagaactttgctacatttaggggactgggttgcactgcatcaccgcaagtgtcggttcctgctgtgattaggacttcggctgactgggattccaagagaatcaagaagaaaaagcagaacagcaacaagaacaaatcccttaattctgctgttaatgttggtggaggagtatccattggctgcagcagtaactcagtccagaataataacccttcatcgtcgtcttcttcatcaggaccattatcgttatcatcgagctgtgtggcggttcctgacgtttggtgtggtcctggaattggattaactactgatgctgcttctgttgattgcgtcgtttcaagaagacccgtgtctgggaggggaagaatcgaaagtgacaaagctacgcctagagagagatctgcatgtcctatacgaagaatggtgagcccagaagacaacccttttctggatatagaaagtagcctaggtataccacgctcccaaatagagttatttgcatctaggcatcatcgacattctcgccatggttattcagaaggacttgcagagattgtgatgcttcaaaatagtcttatgggaggaagaacagatggtcttgatcgatacaggaactggagactagatgtggataacatgtcctatgaggaattgctggaacttggtgacagaatcggatatgtcaacacaggattgagagaagacgagatagctcgatgtgttagaagaaccaagcccttctttttgagtaatttatctcttatccgcacaga

SEQ ID NO: 11595 - DNA, 486 bp, Lycopersicon esculentum
  Predicted polypeptide sequence is orthologous to G2404
ggatcattgttatcacccagtaatttcccctctagcaacaaatttggggatttgggtgcagaaaaaaaacaaaattaatactatgaagcgccaaaccaaccttgacatagaatggcagaaacttatctgcaatacatataaaattggtagaatttgtaccaatcactgtattcaaaccagaagcctaatactttgtgtaccactcgtttcaatccatccacattggattggcactcaaacaacagaaccatcactttcagtaatcacataagtagaggatagaaacactctgtaaagaattttcttgcttgtaatgataacagaagaagctatacaacagaccaaaaggttcatgaggggagaagttgttttttgatgtctagctattagacatagctgcagatttacaaactgggcaactatttttttgactcagccactgctttatgcaacgaatgtgatagaaatgtccacaatccagcttcc

SEQ ID NO: 11596 - DNA, 659 bp, Lycopersicon esculentum
  Predicted polypeptide sequence is orthologous to G2404
gcatttttctttctttcgctcgtcaataacatggcacagtccatactcatgcctggaagaagcttcacaatgtccagaaatcaagcaagaaacaaagaaaccagaagcaaaaatcaaaagaacccagaaaaaaaaatcaaaagaaaccccataaactccaccatttcttctacccatgaatggccaacaacacccatcgctaaaaagaagaagaatttcacaccatttaggtgtgtgggttgcagggaaacttcacaactctctgtccctgcaccaattgctgatagccaatccaagaagaagaagaagaagctgagaaccaaaacccttaatttttttgatggtgattttgatgattttgttgtttcaagaaaaccccattcttctaaagggagagttgatgctgacaagattacgcccaaggagcagtctatgcaaagaatggtgacaggctcagaagactatcctgttcttgatactgcaactctggaaaggccacactcgcgagcagattggtttggatttgggcatcattctcattttgatttttctgaaaggctttctgagtttgtgatgcttcagaatagttttatgggaagaagaacagattgtcctgatcgataccgaagcttgaggcttaatgtggataacatgtcata

SEQ ID NO: 11597 - DNA, 757 bp, Lycopersicon esculentum
  misc_feature (738)..(738): n is a, c, g, or t
  Predicted polypeptide sequence is orthologous to G2455
tcgagtttttttttttttttttttgaaagaacaataagacagtaacaccattaattaaaagatcttttgaaagtttggcagctcataacttacaaaagttctataagaatcacattatgttttctttcatttagaaacataagagggtggctaaaaccaacttcaacttaggatgccttcttggatttatacattttggcacagaaaacatagattactaagttgaagaagctaagtgcagccaaaagccagaagaaataatcaagatgcccaccgttcaagttgtttggaatccatccaggtttgccacctcgagttgtaatggacgttactacagtcaggatgaaagagctcaagtaattacccaaagcagttgtcagcagtgacaatgcactgcacaagctacgcctcctcttcctcggaacgtgtttgctatgttcattgcaacttctgcagcacaattcttgcggttagcgttccatgcaacagtatgatgacaatagtgacagtaaggtgtggacactgcgcaaatttgctttctgttaatattgcaccttcccttcagtctctccccattcaagatttacagagacaaaatgagtcaagtattgaagatggaatgagtagaggttatggatcatcatcctcttctacaaattcatttcacagattttctcccattcctactgatcatgatcaacctagatcccctcctattcgcgtaccggagaaaagacnacgtgttccttctgcctac

SEQ ID NO: 11598 - DNA, 1123 bp, Lycopersicon esculentum
  Predicted polypeptide sequence is orthologous to G2455
ctaccccaccccaccccgaccagaccaaaccattccaatcccatcaatctcttcatctctaatatgtgtttattttgtactctttcattcattcatctctcaaaaacttataccttatttatcatctcccccttttttcccccatcttttgtaagctaggtcttttcaactctcttcctagctacataacatgatgaacattacacatatttcttgattttgactcatacttttacttctaattcttcgatccgtattttctgacctaaaaagcttataagaaatgtcacttgacatgacatattcctcctcttcctcggaacgtgtttgctatgttcattgcaacttctgcagcacaattcttgcggttagcgttccatgcaacagtatgatgacaatagtgacagtaaggtgtggacactgcgcaaatttgctttctgttaatattgcaccttcccttcagtctctccccattcaagatttacagagacaaaatgagtcaagtattgaagatggaatgagtagaggttatggatcatcatcctcttctacaaattcatttcacagattttctcccattcctactgatcatgatcaacctagatcccctcctattcgcgtaccggagaaaagacaacgtgttccttctgcctacaatagatttatcaaggaggagatccaaaggataaaggcaagcaatcctgatattagccacagagaagcatttagcactgctgccaaaaattgggcacatttccctcatatccattttggactcaagctggatggcaacaaacaaaccaataaattggatcatgctgttgcaggagagggtcctcagaaaacaattggtctctattaattataaataaaataataaataatatgatctagctatattatgatcacaaatatatataaatataatattatataggtgagatgtattatatatattatattaatctctccaaactaataaactgtttttagctctttcagcattatccctttagggccttggattccttgtttttttattcgtattataagttgtaactattaactacgattattctaataatatacgttgtttattataaaaaaaaaaaaaaaaaaaaaa

SEQ ID NO: 11599 - DNA, 387 bp, Lycopersicon esculentum
  Predicted polypeptide sequence is orthologous to G2455
ttttttttttttttttttcacaactctgaaaataatattaagacgaggacaataataataataacatattcagcatatttttataaataaaatctaaaaaaaaagtaatttttaaaaaataaaaacattatttttgataaatcttcgacgaaaacaacataaaagacatgcatatatatatatgtatatatcatatattaaagttttttttccctcgctatttgttgccctccagcttgagtccaaagtgaatatgtggaaaatgtgcccaatttttggcagcagtgctaaaagcttcacgatggctaatatcaggattactggccttgatcctttgaatctcttccttgatgaatcggttgtacgcagaaggaacacgttgtcttt

SEQ ID NO: 11600 - DNA, 289 bp, Lycopersicon esculentum
  Predicted polypeptide sequence is orthologous to G2455
gcttataagaaatgtcacttgacgtgacatattcctcctcttcctcggaacgtgtttgctatgttcattgcagggtctgcagcacaattcttgcggttagcgttccatgcaacagtatgatgacaatagtgacagtaaggtgtggacactgacgacatttgctttctgttaatattgcaccttcccttcagtctctccccgttcaaaatatacatagacaaatgctgtcaagtattgaagatggaatgagtagaggttatggatcatcatcctcttgtacaaattcatt

SEQ ID NO: 11601 - DNA, 686 bp, Lycopersicon esculentum
  Predicted polypeptide sequence is orthologous to G2456
ggaaagagagaagtagtctcaaatcaggaattagtaaggaatcttatcatgtcgtcttcatctgctgcttttgctccggaccaccacctccaccaccatcacctctctcctccttcaggagaacaactctgttatgtccaatgcaacttttgtgacactgttctcgcggtgagtgttccttgctcaagtttcttcaaaaatgtgacagtaagatgtggtcattgcaccaatcttctctctgtcaacattattcttcccactgctgctaatcagcttcatctcccacattctttcttttcacctcacaatcttctggatgagattcggaataatccaccaagtttgttgatgaatcaacaaattaacccaaatgaatcactcatgccagtccgaggaggagttgatgaaattccaaagccaccagtcgcaaacagacctccggagaagcgacagagagtcccatctgcttacaatcgattcatcaaggacgagatccaacgtatcaaagctggaaatcccgatataagtcacagggaggccttcagtgctgctgcaaagaattgggcccattttccacacattcatttcggacttatgcctgatcaacccgtgaagaaaccaaatgcatgtcaacaggaaggggaggatgttctgatgaaggaagggtttcttgctccagcaaacat

SEQ ID NO: 11602 - DNA, 1035 bp, Lycopersicon esculentum
  Predicted polypeptide sequence is orthologous to G2456
gaaaaaaaagggttttttttttgccctctctgactcttatcttctttcctcaaaactcatatcatcataagatacaaggaagtgtcaaagacatcaatcaaatcaatcacaaaagcaggaggaaccaatcaatttggaaaagaataagagaaataatataatgtcctcttcaaatagcttatcattggaccaccttcctcctccacctccttccgagcagctctgctatgtccattgcaatgtttgtgacaccgtcctcgcggtaagtgtaccgtgcacaagtttgttcaaaactgtgacggttcgatgtggacactgcactaatcttttgcctggatggcttttgccttccactaatcatcatcatcatcattttggtcacacttacttctctccttcacacaatcttctggatgaaataagcaatgcaaccccaaatttcttgatgaatcagagtaattctgctcatgaatttgtgcagctgcctgctcgacctggatttgatgatcttcctagaccaccacccgttgttaacagacctcctgagaagagacagcgagtcccttctgcttacaaccgattcatcaaggaagaaatccaacgcataaaagcagggaatcctgatattagccacagagaagccttcagcgccgctgcgaaaaattgggcccactttccacacattcaatttggtctcatgcctgatcagactgttaagaggactaatgtgcgtcagcaggatggagaagatgttcttacgaaagatggtttgtttaatacatcagccaatgttagtgtgtctccttactgatgatgggatgagaatcaaaagtgaacaagttttgagatggatgcagaagctatattagtagctaaatgtctaagtgtctaaccaattaatgtgactcttctagcatgttcaatgtgtgaattttttttctttttatcttcgtgttgaagtgtacttttggcttcaatgtttcaacttttgcttgaacattattcactttttgctttagcactacattttcatga

SEQ ID NO: 11603 - DNA, 277 bp, Lycopersicon esculentum
  Predicted polypeptide sequence is orthologous to G2456
tccatctgcttgaactgtaagatcaccattttcagaaaatgacgctcgggtttttgtccaaaatcttcttataccatataaactgtcattttgttatgcagaaatatgctgcgtattaatccttgcctgttttgtggatatttgtattgatatgtactcggaatttcctttatcacccctcccccacccccacccccaaatattcttacagttacaaacttgtaacttctcttcaggttgagaagcttcgccatgatatgcccgatggttggggatt

SEQ ID NO: 11604 - DNA, 643 bp, Lycopersicon esculentum
  Predicted polypeptide sequence is orthologous to G2457, G2459
tttttttctcttcaaataaacaaaaaaaataaaatacatcaaaaaatggcaagttgcattgatgttgcttctgatcaactttgctatatcccttgcaacttttgcaatattgttcttgcggtgagtgttccatgcagtagcctatttgatattgtgactgttcgttgtggacattgcacaaatttatggtccgttaatatggcagctgcatttcagtcctcttcttctgcttcgtggcaaaatcatcaggttccaaactacactgctcctgagtataggatggattttggttcatcaaccaaatgcaacatgaacaggatgtcaatgagaactccaatcacaaacaatgttcacgaggagaggattgtcaatcgacctcccgagaagaggcagagagtaccttctgcatataatcagttcataaaagaagaaattcagaggattaaagctaataatccagatatcagtcacagggaagcatttagtactgctgccaaaaattgggcacacttccctcatattcactttggactcatgttggagagcaacaatcaagccaaacttgcttgtgggagcagaaaactataaattactttgcaagacaaataaaagatcttcatttcatgaagctgtgtgtgaactt

SEQ ID NO: 11605 - DNA, 820 bp, Lycopersicon esculentum
  misc_feature (32)..(32): n is a, c, g, or t
  Predicted polypeptide sequence is orthologous to G2459
ggaaggagtggttctgacctcttttttttttnttttttttaaagaaacttaggttttagaacagtatatgagttggaatacaacaaattaattagggacaatagacagagacataatggtaatatataggtgataatgtccacactccatagaacatcttgaatgtcacacttttgacttcaagttcacacacagcattcatgaaatgaagatcttatatttgtcttgcaaagtaatttatagttatctgctcccacaagcaagttgggcttgatagatgctctacaacatgagtccaaagtgactatgagggaagtgtgcccgattttaggcagcagtactaaacgctcacctgtgactgatatccggattattaatatacacttgttccccttgcttcaagaggcaaaatcccgcgtataaatcctgggaatttctgtggctggtgacaaaaaatctcgggcaaattcggaccataaaaacgggcaagcacagctttggtgagtcatttttctgacatgaactgtcgagcaatatataggtgactcggtaactggtcctagtgatatgggttataatgtcctggttttaatttttttcgctcttattttacatattaaataatattttggttattaatttattaaataatttgtagagccatcattaaccctaaatcttttttactggtcaattatattatgtttatatttagtgcaaatatctgatttttggttgtttgtaactatgtatttttccatgtttgataccactcatatttatttttatccccgtttactttaatatctatggtgtattt

SEQ ID NO: 11606 - DNA, 767 bp, Lycopersicon esculentum
  Predicted polypeptide sequence is orthologous to G2465
gaaaaggtgtcggttgtataagtgaagaaaaatggaagtggaggagcattgcatccttttaagaaagagaaaaacacggtcgccgccgttgaaacaacgccagctctggctggcgttgtgttggcggcgacaggtagttccaccgcggagaatagcggtggaagtaaaaaagaggataaagatggacaaagaaaacaaaggaggtgttggtctccagagttgcatagaagatttttacatgccttacaacaactaggtggctctcatgttgctacaccaaaacaaattagggagttaatgaaggtggatggacttactaatgatgaagttaagagtcatttacagaaatatcgattacacacgagaagacctagtccttcatcaattcacaacaacaacaaccaacaaccaccacaatttgtggtcgtcggaggaatatgggtcccaccacccgaatacgcctcgatggccgctggtgctccagcggcctcgggcgaagcatcgggagttgccaactcaaatggaatctatgcacctattgccactcatccaaagggtccactccatgatcatgtatcgggtggaaccctaaggcagcacaacaacaagtcgtcgcgctcagaacgttcctctgagcgcgacagaagccacagtcactccgactgtggcggtgtgcattctaattcttccgcaacgttctcttctacacatacaactactgctttaccagcttactaaaaaaaatgtgtagattttttatttattta

SEQ ID NO: 11607 - DNA, 675 bp, Lycopersicon esculentum
  Predicted polypeptide sequence is orthologous to G2492
gtggaaagatcagagtctgcaaggcaaagcaaagataatgcatcaaatccccgtgctagaaagaggaaggatgagaatggtaatgagattctatcaaatatgtgtcatcagtgccagaggaatgacaaaggaagggttgttcgctgcaccagctgtaaaacaaagcgatactgcattccttgcataaccacatggtaccctggaatgcccgaggaggcttttgcagagtcttgtcctgtttgtcgtcaaaactgtaattgcaaagcatgcttgcgtttggatgggccaataagggctttgaaggattcacaatgtcagattagcgaagaagaaaagtttgaacattcaaaattcattttgcaaatacttttgcctttcttgagaagatttaatgcagagcaagtgatggagaaggagattgaagctaagactcgagggccatcagtgtcagagttagtgctgaagaaggcgaagtgtcagaagaatgagcggatgtactgtaacaactgcaaaacatccatttttgattttcacaggaactgttctagctgttcctatgatctatgccttacttgttgccgggagcttagagatggtcaccttaagggaggcgatgaagaagtcattgtggaattcgttgacaagggggttgattatatgcatggtgatgtgagg

SEQ ID NO: 11608 - DNA, 1482 bp, Lycopersicon esculentum
  Predicted polypeptide sequence is orthologous to G2520
ttttcaactgcacaaagagtctccctcttcttcttcttctctctctctaatggtggtggtcgctattatacgccagtaggtacagtacgcaccatcaacttccatttttgtacacacagagcttctatatatatcttctctcattcacatttcctacgtgaatgcctaataattcaccattcgcttcggatttggatcgggtattgaaatggatccacaagcttccatgatgaaccacgccggaggatttcagtctccgccgtttaatttatctgagatctggcagtttccgatcaatgcaggtgaaggtgagacgccgtatagttttccgttgtctacggcggctgcgccgcagaatgtgagtgatgatgttcggaataatgatcctatggttctagaccggagaactaataattacagcggtggcggcggtggtggtgcagctaggaagcgaaacgaggatgatgaatcagctaaaggagtttccactagcggcaatggcttgactgaatctgctagtaagcggatgaaggttacaagatcaaatgagaattgcgaagctagaggtgacggggaagggaattcagtgaaatctgcagaacaacctgcaaagcctgctgaaccgccaaaagattacattcacgtgcgggcaaggaggggtcaagctactgatagtcacagtctagcagaaagagctaggagagagaagataagtgagaggatgaaagtcctccaagatatagtccctggttgtaataaggttattggcaaagctcttgttcttgatgagataataaattatattcaatcattacaacaccaggttgagttcttatcaatgaagcttgaagcagttaattcaaaaatgccaagcatagagggatatccatctaaagatttcggacagcagccatttgatacaaatgctatggcattcagttcacaagctacaagggaatataccaggggaacatcaccagattggttgcatatgcagcttggtggaggctttgaaagaacaacataaatttgcatcagaaggttaataataagttcattggaaggttccctcttttggtgattgccagaacacaagaccagtccaggtttctttgaaagcttatatccagtatctttatcaagcacaaaattgttgaatgtctagtacagctgataaacagacaaccacgttttccacttcgttcgtctatcgtgttatacttgtggcaggcaccatataagtattcttgtgaaagtgcttgtttaataataggtaaagaattgggtgtattagtatgctgaagttgtagctaaataaagtggtctgtcccgtccttaaaaccattggtagatagcatcaagtcttgtaaatagggaaaatcagtgtttctgtgtttcgattgttcaacaagttaagacaatatactttataccaaatgaatgatgcctgcaagtttttggaaaaaaaaaaaaaaaaaaaaa

SEQ ID NO: 11609 - DNA, 1222 bp, Lycopersicon esculentum
  Predicted polypeptide sequence is orthologous to G2522
gctctctaagcttttaacctttctttttttgccaaaagggtcacctctgttttgcacttttaatccatatggtgtctgtttcttaataaaaaatagtataaaggtgtgatctttattgagtttgcaaagcaagaaattgatttttattaagtgttcatgactggggttcttgttcttgatgtaatggcattgatttctctgttggggtttggctctttctgttgaatgtacagaaatttagtgttttaagggtttgttttgaatggtaatggatcaggttcagtctctgtttgttctgcatttgtcttcattattttgcatttattgggaggctttgttcttgaaggagctttctgttattattctttgtgccaattgggaagtgaaattcacagctaagtacattcttggattctaaagagattttgaatgtgcataatagagttcccttgagaatttaaagaagttcagtctttttgtgccatgttctaatcaaaggctacaacttttactggttttgatgttgtgaagatcactttccatgtttacgaataaagagttgtgactttgattcccttccttagagatttaaatcattgttcgaaggggatatattgtttgcggagttctgtaaaaataaatgaatgtatggatcgaagggaagctatgatgttacctggatcctctccttactatatgcagagagggatgagtgggagtgggagtgggaatgcccctggtttacagggatcaccaagcattaatccttcattaactcctaataatattgcctttcaatctagtggcagtggcgcttcgattccacaaacactagtaatggatccttcatcaactttatcacctagaggtagtattggtgcatcatcagcaatgcctcaaggtgaacctgtgcgcagaaagaggggtaggccacggaagtatggagctcaaggggcgatgtcgttggctctgactccacctccatctactcaggcattgtcattaaacccaactcagaagagaggtagaggaaggccaccagggtctggacgaaagcagcaactcacttcctttggtggatggttgtccaatacagctggaattggttttaccccgcatgtcatcatgattgctgtaggagaagacattactacaaaaataatgtcgttttcgcaacagggacctagatcaatatgtattttatcggcaacctggtgtcatc

SEQ ID NO: 11610 - DNA, 446 bp, Lycopersicon esculentum
  Predicted polypeptide sequence is orthologous to G2522
cagagtgcatgaacttcagatcttcagaccactgacaattccgttaatccagctgatgctctttcgaaccagaatcttgcaccatcctcttcaatgggagtatggcctagttctaggcagatagatctacaaactggccatattgacattgatttaatgcgaggatgactatgtcaaatgtaggttgacaagtgagcactgtatatattgtgttctgatatctccagtcctaccatcttgacataaaccacgttctcacaatcatcagcaatcatcttagattgtagtgatataggagttctcttgcagtttaactttaacatgaatctgcttttccactcagtagtagttcaatttatgctgtaggctttagtctgtgcgtgtaacatattgtggttttgtcttccagttgccgactgttccatcaatgtagctaattttttctt

SEQ ID NO: 11611 - DNA, 512 bp, Lycopersicon esculentum
  Predicted polypeptide sequence is orthologous to G2522
attaagtgttcatgactggggttcttgttcttgatgtaatggcattgatttctctgttggggtttggctctttctgttgaatgtacagaaatttagtgttttaagggtttgttttgaatgattttgcatttattgggaggctttgttcttgaaggagctttctgttattattctttgtgccaattgggaagtgaaattcacagctaagtacattcttggattctaaagagattttgaatgtgcataatagagttcccttgagaatttaaagaagttcagtctttttgtgccatgttctaatcaaaggctacaacttttactggttttgatgttgtgaagatcactttccatgtttacgaataaagagttgtgactttgattcccttccttagagatttaaatcattgttcgaaggggatatattgtttgcggagttctgtaaaaataaatgaatgtatggatcgaagggaagctatgatgttacctggatcctctccttactatatgcaaaa

SEQ ID NO: 11612 - DNA, 732 bp, Lycopersicon esculentum
  misc_feature (684)..(685): n is a, c, g, or t
  misc_feature (720)..(720): n is a, c, g, or t
  Predicted polypeptide sequence is orthologous to G2525
gctctttttcaaaagcaattcacactcttactagttgttactactaaaaatttgctcctattagtgtttttttttcttcttcttgatggataatagatggtcagaaaagaacctgaatatgaatcttccagaaagtccaaaagcaccaatggagtttttgtcaagatcatggagtgcctctgctttgcaagtttgcaaggcattaacaacaacttcttcattatcatcatcctcatctcttcctacgaagacgaataataataataatagtgttgttgttactataccagagaacattatctctgttgttgaggaagaagattctgctaataagcttgctggaaacacattctcttttgcttcctctgctacttcacaacttgttcttgatcgcattatgtctcaatctatgcataatgggcaggaaatatcaccattaacatcaggaagattatctcatagtagtgggcctttgaatggttctctgactgaagaaactgatagtcctccagtctcaccttctgaagaatttgaagatgttgttaagtatttgaaagcaaacagcactctgcaaccattatttacaaatgtaagaacaggatacactggatcagctgttgggttagcacccaacacgcctggtggtaagacagttggcagatggttaaaagaaaggagagagannaagaaagaagaaagtagggcccaaaatgcccaacnttcatgctgtgt

SEQ ID NO: 11613 - DNA, 521 bp, Lycopersicon esculentum
  Predicted polypeptide sequence is orthologous to G2536
aaaaaagtagatttttattttttaatttcaaagaaaaaaaaaaggattaaaatggtggaaattatttcaccaggatttagattttatccaacagaagaagaattaatatctttttatttacataaaaagcttgaaggaaaaaagccagagcttgatagagtaattccagttgttactatttatgattttgatccttggcatcttccaaaatttcatggggaattgtgcatgggagatagagagcaatggtttttctttgtgccaagacaagaaagagaagctagaggaggaagaccatgtagaacaacaaattgtggttattggaaggcaactggttcaccaagttatgtttattcatcaaataataaagttattggagttaaaaaaagtatggtattttataaaggaaaagcaccaactggtaaaaaaactaagtggaaaatgaatgaatatagagctattcaagaagaagttaattcaactcttgctattccaaagttaaggcatgaaatgagtttatg

SEQ ID NO: 11614 - DNA, 348 bp, Lycopersicon esculentum
  Predicted polypeptide sequence is orthologous to G2536
tagagagaaatatatatatattatatacatacataaaaaaaaaatattgggaaaaatggagaataatgtgtatgataattataatcataataataataataatgtgttaccaacaggatatagattttatccaacagaagaagaattggtggaattttatttaagaaataagcttgatggaaaaagagatgatattcaacgtgttataccgaaatggcaggagaagtgattaaacatgacacggagcaatggtttttcttcattccaattcaagatagggaagcaagaggaggaagacctactagacttacaacacaaggatattggaaaagctacaggtactcctgg

SEQ ID NO: 11615 - DNA, 648 bp, Lycopersicon esculentum
  Predicted polypeptide sequence is orthologous to G2543
ttaattttcaaatgggttcaacataccttaacacgcatgattccaaaggagtgtttcatgatccagaagggataaaaaatacgatacaagtatctcaaaggatggttaagaagttttttgaaattctaagcatgacagacaaccatggagatttttcaatctcaccacagttaaatcgtggagataggatttcaatagtaaaaaatgaagaaactatccaaccaaaaggctttattgccattgcaactacttctctatggcttcctctttcattccaagatgtcttcagtttcttcaatgattacaagacaagaaatcagtgggatattttgactggtggaaataatgtgattgaattagatcgagtactaacaggaacttttccgggaaacaacattacaattattcagccttataatatgcataaggaaatgttagtgcttgaagagacgagtattgatgaaatgggagcatttttagtctatgcacccatagatttacgagcaatcaattcaattgtcaatggaggtgaagcaacgaaagttcccattttgccctctggtatcatcataagtcccgatggtcgtctctcctcgaatagggacagcactgcaaatgcacaaaatggttcaattttgacagtgacat

SEQ ID NO: 11616 - DNA, 575 bp, Lycopersicon esculentum
  Predicted polypeptide sequence is orthologous to G2543
ttaattttcaaatgggttcaacataccttaacacgcatgattccaaaggagtgtttcatgatccagaagggataaaaaatacgatacaagtatctcaaaggatggttaagaagttttttgaaattctaagcatgacagacaaccatggagatttttcaatctcaccacagttaaatcgtggagataggatttcaatagtaaaaaatgaagaaactatccaaccaaaaggctttattgccattgcaactacttctctatggcttcctctttcattccaagatgtcttcagtttcttcaatgattacaagacaagaaatcagtgggatattttgactggtggaaataatgtgattgaattagatcgagtactaacaggaacttttccgggaaacaacattacaattattcagccttataatatgcataaggaaatgttagtgcttgaagagacgagtattgatgaaatgggagcatttttagtctatgcacccatagatttacgagcaatcaattcaattgtcaatggaggtgaagcaacgaaagttcccattttgccctctggtatcatcataagt

SEQ ID NO: 11617 - DNA, 509 bp, Lycopersicon esculentum
  Predicted polypeptide sequence is orthologous to G2543
ggttattgagggctcaaaagtgtaattctcatccatggagtacgtcggcaccggcggtggtggtgggactagcagcggcggcggtgccgatcctcatgacggttccgattctcatcggaggaaaaagcgttatcatcgtcacaccgctaatcaaattcaaaaacttgaagctatttttaaggaatgtccgcatccagatgagaagacgagattgcagttgagtagagatttggctttggctcctcgtcagattaaattttggttccaaaatagaagaactcaaatgaaggcacaacatgaaagagcagataattgtgcgcttcgagcagagaatgataaaattcgatgtgaaaatatagcaattagagaagctttgaagaatgtgatttgcccatcatgtggagggcctccagttactgaagattcatattttgatgaacaaaaattgagaattgaaaacatgcaattaaaagaagagcttgataaagtatctagtattgctgctaagt

SEQ ID NO: 11618 - DNA, 757 bp, Lycopersicon esculentum
  Predicted polypeptide sequence is orthologous to G2543
gtatgtgtctctaatttctacccatttacattgcatttttgtttatcaattagtattagcctatttcttattgatgggtcttcattctttaatccaatttcgtctgacctaggttgagaatcctcaaattgccttgtcaaaactctagaaataggcgcttcagcattactagtttactaggtatttgtgttacaaacatataggttatcactaagtattccatctgaatcacagaggatgaatgtggcatcctcagatctatcactgattcaccgaacgagaccccgatgacggaccatcatacccatgacagactgtcataaggttcgttccaacaccccaaccacctcactgtccaattttctccaagtgtccctcaacggacacatgcgacggaccgttaatcctacgacggtccgtcctgcacaaccgttctggttgttagagaccctattcccaaacttttctaagtgtcctcttacgtacatttacgacggaacgtcataccctcgatggtccgtcctgcataacaatcatgacggtcagagatacctctcgttagggtcttcatacttttttctaagtacccacgatggacattgaacacggaccatcattatcacgacggtccgttctgcttaaccgtcacacttgtcagagactttccttcagggggtctcacattaacatagttgaaagtagacatgacgaaccccatgacgatccatcgtactcatgaagaagcatcacctgatcc

SEQ ID NO: 11619 - DNA, 584 bp, Lycopersicon esculentum
  Predicted polypeptide sequence is orthologous to G2552
gaatggaaaataataatgttaatgatattgggcttattaatttcttggatgaggataattttgaacaattcattgagcttattaggggtgaaactgctgatcctattgtaaatttttgcccaaactatgattgtgaacatatgacaggttgtttttccgcagccaatgcccaatttgagccaatattatcgtcgatggatttctatgatacaacattgccagatcctatttcgctatataactgcgaaatcaagctggataataatgatgatgaagacgatgatgaatcttctggcacaacggctaccaccaaaatgactccaacaagcaaaggcacgaggactgaccggtccagaactttgatttcggagcgcaaaaggagaggaagaatgaaggaaaagctttacgctttgcgatccttagttcctaatatcacaaagatggataaagcctccatcattggagatgcaatattatacgtacaaggactacaaaccaaagcaaagaaacttaaagttgaaatagcagagtttgagtcatcaagtggaatatttcaaaatgcaaagaaaatgaatttcacaacc

SEQ ID NO: 11620 - DNA, 636 bp, Lycopersicon esculentum
  misc_feature (298)..(298): n is a, c, g, or t
  Predicted polypeptide sequence is orthologous to G2552
caggtttgtttcgttttaaaagatttcgacttttaggagtcgccacttaatttttaagaaaattaagaaaacttgtttccaaataatttaaacaggaaaatcgtttgaaaacatttttaagggttcgggattcttattaacatcttaggaaggttttgacggcacctaagacattccgcttaatacggctttgcggcaactaaccatttgacttctattcattttaaaattttcgaatccgttgaaattaaactacctaaatttcaatctaggcccacaatttgacttctattcattntaaaaatttgcaaatctgttgaaattaaacttcctagatttcaatctaggcccacttacgaattcgaaacattttcgttttaatatttaatttagttttggttttataaaatagaatgacgtataaccaggggattggtgtttttctaaccctaaaactaacgacattcaacgaaagtgtataaacaagtaaaagagagagagagagagagagagacagaaacccatattctcatcattatctccattgatacctaaagacgagtaacttgatgattgaagattagtaggtacacttcatacattagtccacgaaattgaactcatttgaaatcaacc

SEQ ID NO: 11621 - DNA, 270 bp, Lycopersicon esculentum
  Predicted polypeptide sequence is orthologous to G2557
ctgtggttcatcgaagatcatcgagtcaaagtaatagaactccaaaacatgatctgcatcaactctcagaagtaacatggacagcaaaggagcttgtttcaattatttcaagcagctcaaggcatcatcagcagcttaatgtaccttaacaatttggttatttttgtttagtcattctaccttgtacatgtcgatgaagctaagcacaggttgtctatatattagtctttcttggagataattttagttataagtgaggctatttctcac

SEQ ID NO: 11622 - DNA, 982 bp, Lycopersicon esculentum
  Predicted polypeptide sequence is orthologous to G2559
ccaaaatagtccctctttctctcttgttttctatgggccaatttatatatagtatgtccaatcaattagggtgacagttaccttcctccaactactgaaatatcttctttttttccaagaattctctgttttcttgattctgtttgtagccatggcagaattggaagctaagaaagtagaaattgtggaccctgcccctgcacaagaaccagttgaagctcctaaagaagtggtggctgatgagaaagccatagttgaaccagctccgcctcctcctgcagaagaaaaagaaaaacccgatgactcgaaagcactagttgttgtcgaaaataaagcagaagaagctgctgatgagaaaaaagagggatctattgatagagatgctgtgcttgcacgcgttgcaactgagaagaggctatcactcatcaaagcatgggaagaaagtgagaaatcaaaagccgaaaacaaagctcagaagaaggtgtctgcaattggtgcatgggagaacagcaagaaagcaaacctagagtctgagctcaaaaagatggaggaacagttggagaaaaagaaggcaatatatactgagaaaatgaaaaacaaaattgctctactccacaaggaagcagaagaaaagagagcgatgattgaagctaaacgtggagaagatcttctcaaggcagaggagcttgcagcaaaataccgcgccactggaactgctccaaagaaaatccttggaatattttgaagcagcaagtaccaggtctgcatcgatactgattgggagttgcattttgtaaagtttgtgcaattggattttttcttcttgttagattacatttgtgtgattatatattttagaaccatttattgtttattgttacgtgtgcatagtaatgtatttccagtgtatatagcatctggacaaaattaactttgtgggattgttatggaaaaaaaatatgttgaaggaaatcttcatgtt

SEQ ID NO: 11623 - DNA, 940 bp, Lycopersicon esculentum
  Predicted polypeptide sequence is orthologous to G2559
gtcttctcttccgttctttttaaccaacaaaaagtttcataagcagaatctccagatattatacaactaatttccattttgcttttttgctcattgattccttcttctttcactatatacatacatttaatttcaacaataacaatggcagaagctactgcagttgcagctcaacctcaaccagaatcaacaactcctcctcccatggccaaatctgatgactctaaagctattgctactcttcccccaacaaagcctgactcttcaacaaagaaaagttcaaagggatccttcgacagagatgttgctctcgcacaccttgaagaagagaaaaggaattcctatatcaaggcatgggaagaaagtgaaaaaagcaaggtgaataacaaggccgagaagaagctctcgtcagttggaacatgggagaacaccaagaaagcaaatattgaagctaaactgaagaaacttgaggaacaactagagcaaaagaaggcagaatatgcagagaagattaaaaataaagtagctgcagttcacatggaggcagaggaaaagagagctatggttgaagcgagacgaggagaagaacttcttaaagcagaggagatagctgccaagtatcgtgctacgggacaagcccctaagaagattggatgccttggatgttaaagccatgaaatgtatcattctcttttgtgaattttcatgcttgttgctctttattcggtgtttcaaacatatcaagtttttctagttcgtgtaagaaaagcactcatgaaaagtttcaagtgtcatgaagtttctactaatacttcatactgtatctgagattatgtataaaatgtctggaaactacaatcttgaaatgttttcaagaatcactttgtgttcctaaaaaaaaaaaaaaaaaaactcgagactagttctctctctctctctc

SEQ ID NO: 11624 - DNA, 570 bp, Lycopersicon esculentum
  Predicted polypeptide sequence is orthologous to G2559
gatttatttcaactatccattacacatatcttctcttcaaccccactctctgattgaatctcacaattctgaaattcgatttagatatgggtgaagaagaagccaagaaagtggagactgctgaacatgccgcggaggagaaagccatcgtcttatcaactgtacctccttctgaagaatcgaaagacaaacccgatgattccaaagctctcgtcatcgtcgaacctgaaactaaagcgctggtacccgttgagaaaaagggatctattgacagagatgcaactcttgctcggttaacgacagagaagagattgtcgctaatcaaagcttgggaagaaagtgagaaagcaaaagctgaaaacaaagctcagaaaaagatagctgaaattcttgcatgggagaacagcaagaaagcaagcttggaggctgagctaaaaaggactgaggagcaattgttgaaaaagaaggcagagtacattgagaaactgaaaaacaagattgctctagtccacaagtcagcagaagaaaaaagagcgataactgaagctaaacgtggagaagatcttctta

SEQ ID NO: 11625 - DNA, 1752 bp, Lycopersicon esculentum
  Predicted polypeptide sequence is orthologous to G2565
gagagaactagtctcgagttttttttttttttttttttttttgtttttggtaaatcatcaaaagagagataaattggaatctttctattaaaaacaagcatgtactcacaatttttttccctaaagtcttgagcttttgcaaatttgtttctctttgagtccgccatttttctagctccaaacgaattctttgtcaaattcttggattttaagatgtatggtgtacaagtttgagaaccgtcattgtaaaatttgtcttttgactgagtgacaccacggagtgggttgaaactgttgtgttaatcttaaagtctttattaattcaatttatggggaaaaatgaacacgcgccgtgcattaggtattcaaagatctagtgaaacacagcacagtaatatgggtgtctgtggagctatgtcgacatctttgtccattttgccgtcatttgaagagaagcatcttaaagtgacagattctcttcatgtgctcacagaaaaggaacaaaccacaaaccttatttcctcacgggcaatcccgtctgcatctaaaagtggaacagtagggcatctgttatcttccacttctggaccccacaaacattttcacttttcttcaaccccctctcgagaaagtaggaaacataactatccatttatttctagtgaagcttctgcagcaacctgccaatcttcactctcaaacattcattcgacatcattggataattaccccatggagaacagcaataattcctggggcgaagatgcatatcatgactgtataaatttttctactaatgttcctgttcagaatgaccaagtcgaaagccttgcagtagtcatgacgtctgatgaccaggttaagagatctgattggcaggactgggctgatcagctaattaatgatgatgatgttttggattcgagctggagcaatattcttgttgatatcaatcctccagacactaagtttctgagagcatctgaagtccatgctggccagtccgatactcttcctcctcctcttcctgctgctgctgcatcgtctgggcaaaactacccagttggtagcccatcgtctaccgcagcacagacgaaacctcggatgcgatggacacccgagcttcacgaagtctttgtagaagctatcagtaagcttggtgggagcgaaaaagctacaccaaagggagtcttgaagctcatgaatgttgaaggcctaaccatctatcatgtcaaaagccacttacagaaatatagaactgccagatacaaaccagaatcctcggaaggaacaccggaaaagaagaccaccagtgtgacagagatgccatctttggacctgataacgaccatggggataacagaagcactaagaatgcagatggaagtccaaaagcagcttcacgaacaacttgagatccagagaaagttgcagttgcggatcgaagaacaaggtaaataccttgaaatgatgtttgagaagacaaaggacataggaaaagatctaaaggtatcatcatcatcaagaacagatgaacatccttcaccatccaataagatgaagcatacatctcccaacgactaatcagaagcactcgagaaagatcgtttgtggaactcaccagacaaaaaagctcatgaagatcatgactcagatgatagagacttgtgttgttcacctacatcgaaacgagcaaaaacagaggaaatatcaggtcttcatgaatcttgacagactcatttgatatgtgaa

SEQ ID NO: 11626 - DNA, 770 bp, Lycopersicon esculentum
  Predicted polypeptide sequence is orthologous to G2565
gaatcaacgttcaccgttcaaattctttcgatttcgccggcgatgaaatgaaatctcccgaaatcggcaacaacgagttagctgtttgtgcatacaggaatcaatcttggacactggttactaagaaattagaagatactaattgaggagaatatagtagtgtattgtactcatccacaaagttcaaatggaagcacgtcctgctgtgtctgttcaaagtgtggttgcaagtcaactcagtaattgtggtgcatcaggggcactttcttcttccctgtctatatttccaacagcccttggagaaaagtaccctaagtttcctgacttgcagcaggcttcgatgggaaaggagctcaagcaacatcctgcaactgttgtctcttctttgccttccaacagtggggctgttggtcttatgttctcatcatcatcaggattttccgccgatcttcagttctcatctgtttcaccccaggaaaagcattcaggaactgcacctttcatttctcagtcaacatatagtgagacatcgatccaattacctcattcgggagttcttcagtccacagcatcaagccaatatttgaatgaaaaccatgaaccctggtgtatagatccactgcctaatttccttgattattcgatggataaccctgtccagaatagtcaggtagcttctagcaataaacaaagcgattggcaggagtgggccgaccttgtactcaatgatgaagatgctctaccttctgattggaatgatattattgctg

SEQ ID NO: 11627 - DNA, 395 bp, Lycopersicon esculentum
  Predicted polypeptide sequence is orthologous to G2567
ccttgacaaagagttagtggagtaactacctaggagtaaattcaatagtagaccttgaaaagaactttagcaaagtcatcataaatgctcttcacgtctcatgtactatgttaaggaatggtcacatttctctctgcattaaagctagttcatgttaaaagttgaggccggtagtagtttcaactttcaatttaattccacctttcctggcccacttctgtacggaacaccaatcagaatctttagttcatcttaacaccaaagcatctccacttagacacttactagacttcacataggaggaaaaatatggaactggtggtcctcacacgttctcctcacagggatggaaactaacaaatgggaagggaagagaagcattactgaagctgaaa

SEQ ID NO: 11628 - DNA, 569 bp, Lycopersicon esculentum
  Predicted polypeptide sequence is orthologous to G2570
ggatttatcaacccatctccgagcagcaaatatgctttgcagaagcagggtttcattatgttccattgcttgccgagtttggtccgactctcgaaattcaaacggtgacacgtataattgaaaagtttgttgcttcagttgctactgagttcatggcagacattgggcacacgtttgatgatgatggtctcaagcaaccttattacaacatgttttctctgatggggaccgagttctttgattctgttggttgcattataagctttgattaaatctttgccgcagagtcataccttgcttaccgatggaagttgagacacatatgtcttccaaaactgctcaaaaaatcagcattttggttgtggatgataatgctgcttatcttcaggttgttgctgagctactcaagaaatgcaactaccaagctgtggctgtcaaatatccaatagatgctttgcctaaacttcagatcaaagtcgactcttgtgatctcattgtcattgatgtgcacaagtctgatatgaatggctgtaaacttcaagaaatgatagccgaagcatttgaaatac

SEQ ID NO: 11629 - DNA, 409 bp, Lycopersicon esculentum
  Predicted polypeptide sequence is orthologous to G2571
gaaactcaaaaaaaaaaacaaatctttctccaattgtcccttcttttttttttagccctctaaagttttcgcaattagaaacaaaattaagtttttcaaactgtctataactcactaaaggcctcgggtttcttcattgatcctctttttttctctggatcagtaaaaaaaaggggcaattcctctgttttactctgttttcctgaactctgttctctcattttatgaagttattataaatggacagaattcaagaaaacaactctatgtctagtatatttgatgagggtgctcaaattcgatcttcattatctcaactaattctaacaagtagtacaaacacattcgatacaattttttctcattgtcaagaaaataaccaaatgagtaatagtcctgtttttgagcc

SEQ ID NO: 11630 - DNA, 532 bp, Lycopersicon esculentum
  Predicted polypeptide sequence is orthologous to G2574
gagagttcgattttccacattgtaatccccttttccacaccccaaaattgtatatgaccttagatagaaggatatgaaggttgcggataaagaatatagggttagtaggtagttgagatttgtgttattattagcctattcacgtctttggttgggtggaaatgtagagctccgtgttggtcgtagtattagtatattcatgtagtctatttttttgtggaactaaaatatgtagattattgcgtgtaggtaatctcaccttgttgttgttgttatggtcgcactactttgctattagctatcattcttttattttaattacggcattgacttgcttggtggatctttcgaaaaacaacctctgtaactcggagaggtagtgataaggtctgtgtacactgtaccctccccacaccccactttgtggaatttcactgggtttgttgttgttgggagaggttgaattaagaagtccttatttggcatcgttagttttatagtatcactttgtggttatgaatctacttatgct

SEQ ID NO: 11631 - DNA, 1125 bp, Lycopersicon esculentum
  Predicted polypeptide sequence is orthologous to G2575
attcatttctattttccctaaacaagttactttctctttttccactctaaactatagtaatacatacacacttcccaactcccaagaaaagaaaaaaaaaagaaaattcaagaatcaatagctcttgttaatattgcataaattcaagaatcttgagttattttctcttcatcattttgttcaagactcttttttgtgttttagatcccaacaacaaaaaagaaaaccccctttttttgcttctctatgtctgataataacccttttaatcatgattatgcatttcctttctttggtgaaaatccctcaatttatggtaatcaagccaataacacacaaaaccctcatcataatcatcatgattttgactattcttcatcttatatgagtaatctcacagagtgtttacatggagggtcaatggatcattacaacactttgtcaagtgcttttgggatgaataattgttcatcatcctctgaagttgtttgtccacaaccatcaatagatcatcatcaagaatgttctagaaagaatattaatagtgttgataatcaaattccattaacacctaattcattaatctcttcatcttctaatagtgaggttggtggatgtcatgaagaagattcttcaaaaatcaagaaagatgatgatcagtgtgaattagatggagatgatgatgatgatgataataagtctaagaaagtggggaaattggcaaagaagaaaggagaaaagaaacaaaaggaaccaagatttgcatttatgaccaagagtgagattgataatcttgaagatggctatagatggagaaaatatggtcagaaggcagtgaagaacagtccttttccaaggagttattataggtgcacaagtcaaaagtgtagtgtgaagaaacgtgttgaaagatcatatgaagacccatcaattgtgatcactacatatgaaggccaacataaccatcattgtccagctactcttagaggaaatgctgctgctgctttattatctccatcctttttatcctccacacaacaacaattatatcataatccaaatgaacaacaaattttctataatccaaatattcctataaataattccttctataataataattat

SEQ ID NO: 11632 - DNA, 722 bp, Lycopersicon esculentum
  Predicted polypeptide sequence is orthologous to G2575
ttttttttttttttttttaagagaaattagatatagtatatatatgatggtgaagtactaaaatatatatatattacatgagataattaaggaagagtccatctataatatctctaaattattactaccaaaaaagaaagaaagagaattaagtagctataaagtttcaagtagggttaattagtgctcaaagcctcatggttcttgtttaagattaaacatagaaggaaccatgtcttgtagaagtccataatcatgatgaggatgaggtagctgcatctgttgatgatgatttagattttgatgatacatagaggaatttgcaaaaacattggcatgtccataaaattgaggcatttgtgacatgatgaactcttgatgaaaacttgcttgtggtgccattaatggtgatggttgtgctaacatggaaggattcaacatccttgcgacgctaccgcggagagtagctggtagatgatggttgtgttgaccttcatatgttgtgataacaatggatggatcttggtatgacctctctacacgcttcttcacttgacatttttgacttgtgcacctataatagcttcttggataagggctatttttaacagccttttgtccatatttcctccatctatatccatcttcaagatgatcaacttcactctttgtcatgaatgcaaattttggtggcctttgcttcttttctcctttcttttttc

SEQ ID NO: 11633 - DNA, 1796 bp, Lycopersicon esculentum
  Predicted polypeptide sequence is orthologous to G2592, G2713
gatttaatagagtatttgtactattcacacactgaaaagtatgcatacacctctcctctctactttctctctcccttttcactattccaaacccaaactcaagcctttcttggaggttgacccacttttcctttttttcattacatctctcaaatttcatcatacttcacagatctctcatttttattctgattctcctatttcaccttcagatcttgtattataggcatgtcatccttctctattctgaatttgtaacgactcttctggatcccttttctacaattttgcttttgtttcttactttttatatattagttcatactataaagtttgtgtctttatggatttttttttttgtagagaaagtttttctcttggtttctctgcaggagtgctagaatttgcttattaacagttgtgtcctttgacaagtttgcttctgctaactggaaaaagggcttatattttaaggaagtgcaaagaaagaagtacagaacagttttgctattagatgtcgttccgcagtatagttcgggatgtaagagatagttttggcagtttatccaggagaagctttgatgtaaggctctctggtcatcaaaggggtaaatcacttggttcatttcatgacttgagtgaccagcctcctgtcaaccagaacagttgttgggctaatctcccacctgaactactttttgatgtaattagaagattagaagagagtgagaactcatggcctgcccgtaagcatgtcgtatcatgtgcttcagtttgcaggtcatggaggattatgtgtcaggaaattgttagaagtcctgaagtttgtggaaagcttacatttccagtatcgttaaagcagcctgggcctcgtgacggaatgattcaatgtttcatcaagagggataaatctaatttgacttaccatcttttcttgtgtctcagtcctgctttactagttgaaaatgggaaattccttctctctgcaaagagaacaaggcggactacttgtacggagtatgttatctcaatggatgcagaaaacatctcaagatcaagcaacacttacattggaaaattaaggtcaaattttctgggtacaaaattcgttatatatgacacacagcctccatacacctttgcaaacgttccgcctccaggccgcacaagccgcagattctattccaagaaagtctctccgaaagttccaactggaagctacagcatagcccaaatcaaatacgagctaaatgttcttggaacacggggtccacggaaaatgcactgcgtaatgcactcgattcctgcctcagcagttgatgtgggtgggtcagtgcctggccaaccggaacttctcccaaggtcccttgaggattcattccgtagtatctctttctcaaagtcgttggatcattctgctgagttcagtagctcacggttttctgatattgttagagcatcatccagtgcagaagatgatagtaaggtgaaacccttggttctaaagaacaagtcaccgcgttggcatgaacaattgcagtgttggtgcctgaattttagaggacgggtgacagttgcatctgtaaagaattttcagttgatagcggcccaccaaccacctgctgggggaccgacgacctctcggtcaagtcaatcagatcatgacaaagtcatcctgcaatttggcaagatagggaaagatatgtttactatggattacaggtatcccctatctgcggttcaagcttttgctatatgcttgagtagctttgacaccaaattggcatgtgaataga

SEQ ID NO: 11634 - DNA, 758 bp, Lycopersicon esculentum
  Predicted polypeptide sequence is orthologous to G2592, G2713
gctcctctctactttctctctcccttttcactattccaaacccaaactcaagcctttcttggaggttgacccacttttcctttttttcattacatctctcaaatttcatcatacttcacagatctctcatttttattctgattctcctatttcaccttcagatcttgtattataggcatgtcatccttctctattctgaatttagaaagtttttctcttggtttctctgcaggagtgctagaatttgcttattaacagttgtgtcctttgacaagtttgcttctgctaactggaaaaagggcttatattttaaggaagtgcaaagaaagaagtacagaacagttttgctattagatgtcgttccgcagtatagttcgggatgtaagagatagttttggcagtttatccaggagaagctttgatgtaaggctctctggtcatcaaaggggtaaatcacttggttcatttcatgacttgagtgaccagcctcctgtcaaccagaacagttgttgggctaatctcccacctgaactactttttgatgtaattagaagattagaagagagtgagaactcatggcctgcccgtaagcatgtcgtatcatgtgcttcagtttgcaggtcatggaagattatgtgtcaggaaattgttagaagtcctgaagtttgtggaaagcttacatttccagtatcgttaaagcagcctgggcctcgtgacggaatgattcaatgtttcatcaagagggataaatctaattt

SEQ ID NO: 11635 - DNA, 1864 bp, Lycopersicon esculentum
  Predicted polypeptide sequence is orthologous to G2592, G2713
gctgttttcttgataacttttcagattaattttcaaaccccatatggttttttgttttaaaatttggttttgatgcattgggtgttgagtttaggcatgaaagaatgttaaagattcaatctttatggtgttttagggggattatagatttcagatctggatttaaggtgcatttttggttgtaggtttgatgtttatgaaatttctgtgaggtgggagtgttttggttgagtttataagcattgttttgagaaatcaatttttagctattttttttgggttgtgagatgaagtggggttatgggtcaaagtcaaggtgtcgccagagttcagtggtggctgtggcagaggaaacagaggggattgatgaagtgtttgtggagagctgttgggctaatttgcctttagagttattaagagaggttcttatgaggattgaagatacagaatctaaatggcctttgaggagaagtgttgtagcttgttctggagtgtgtaggagctggagggagattatgaaggagttggtgaagactcctgaagtttctggaaagttaacttttccaatttctgtcaagcagcctggtccacgagacacactccttcagtgctttataaagagaaaccagacaacacaggcatatcatctatacctcagtttgactcaagcattagctgatgatgggaagtttcttcttgctgctcggaagtacaggaaggccacctgcactgactacactatatcattggatgcaaatgaaacgtcaaagggaggtggcacttgtatcgggagattaagatcaaatttccttggaaccaagtttactgcatatgattctattcttccttatgctggagccaagctggtgaagagccgttccactaggcttgtgggctcaaaacaaatgaattctagagtgcctgctggaaattatgaagttgctcatatttcatatgagttgaatgtacttggagccagggggccaagaagaatgcattgtgtgatggatgctatcccagcttctgccattaaacctggaggtatagctcccacacaggttgattttccaatgggcaatagtggttcctctcttccgatgcgatttcttcgatccaaatcaagtcgcttggagaagtctttgtctgggcctatagaaactcaaagagaaggttcactggttctgaaaaataaggctcccagatggcatgaacagctccaatgctggtgtttgaactttcatggtcgggtaaccgtcgcctcggtgaagaactttcagttggtagcttctccagagaatggtgcggctggaccagaacatgagaaggttattttgcaattcggtaaagtagggaaggacatgtttacaatggattaccgctacccactatcagcattccaggcattcgccatatgctttagcagctttgacactaaaattgcttgtgaatgactcatctttgagtgctagcagccgcggcgtggttgcttggaagtgcaataattccagtgtttgaatgtgaagcacaagaatggtgcaattgctgaataaaacgccaaagttgataaatcattattttttgtatgttttctcaaggaccacaccagaaaagggggatacagaaactaaagaaccaaaagaatgttgttgcagctaaagattagaaagaaagaaaaaaaaatattatgatcctctttaaacatatttggtatattttctttttctgtgtatataatttacttcaatcacttttttttttccttgaaaagactttaatgctgctcttgcttttgagaaataacatatatatttgttgaaggttaaaaaaaaaaaaaaaaaaaaaaaaactcgagactagttctctc

SEQ ID NO: 11636 - DNA, 1608 bp, Lycopersicon esculentum
  Predicted polypeptide sequence is orthologous to G2592, G2713
gttgcattgggtgttgtatagtttattatctgttgaggtttaggtggtagcatgtcctttaagagtatgattcaggacatgaaggatgagtttgggagcatttctcggaaaggatttcgctccaggtcacatagggtggttcaggattgtaccgtgactatcgatgcgttgaggcaaagttgttgggccaacatgccgcctgagctattgagagatgtgctgatgaggattgaggagtcggactctgattggcgtccaaggaaaaatgttgtggcgtgcgctggtgtttgcaggagttggagggaaatcatgaaagagattgttaaaacacctgaagttagcggaaaattgacgttcccaatctccttgaagcagcctggtccaagagacaaacttgttcaatgtttcatcagaaggaaccgcagctcacagacatatcaccttttccttaatttaaatgaagttgctaacgatgacggtaagttccttcttgctgctcggaagtgtaaaaggccaacatacacagattacatcatttctttaaatgccgaagttgcttccaggggtagcagcacctacattgggaagctgagatccaacttcttggggaccaagttcactgtctatgatgcacaaccatctaatgcaggagctaaagtcagtaaatgtcgctctactaggtttgttgggatgaaacaagtctctccaagaatacccactggcaactatcctgtagctcacatctcgtatgagttgaatgtcctgggggctagggggcccaggaggatgctgtgtatcatggacgcaattccagcttcttctattgaacctgggggtttagcccctacgcaaacagaatttgttccagtgaatgtagattccttcccctccctccacttttttagatcaaaatcaactcgcgtggataatttctcatccgggcctttaccaagtccaaaagatgaagttctaactttgaagaacaaagctcctaggtggcatgaacaactccaatgctggtgtcttaacttcaatggccgggtgacagtcgcttctgtaaaaaactttcagctagttgcttctcttggggatggagctggacaggaaaatgagaatgttattctccaatttgggaaagtgggagaggatttgttcaccatggactatcagtatcctatctctgcatttcaggcatttgctatctgcctcagtagctttgacaccaaaatcgcctgcgaatgatgagataaacaggttctgcaagaagtactgaggtgtttggattgggagattgcactaaccctatttacgttggttactgaactaacgctcagttaaattgcagtaggtatgtttgttgttgaggattaatcacccgttcttcatgctctcggaccttccgtttcttggttttttgtaaatagacaaggatgtttttacagtttggttcatccaacttttctatttctattagcacaatgttcatccaacttttctatttctattagcacaatgttgaactgtaatacatatatctcctgtgtgagatgtacttaaatttctgaagttttatgttctttctcataaaaaaaaaaaaaaaaaaaaaaa

SEQ ID NO: 11637 - DNA, 942 bp, Lycopersicon esculentum
  Predicted polypeptide sequence is orthologous to G2592, G2713
caaaaactccatgttcccatgtctcatatgttggtagcttcgtagaggcagcctcagttggatactgctcacgtagtgcccaatttactatttttgtgtgtgtgtaccattaaactatttttcttagtgctaataaaagtatatgcaacaccccctttttcaattttgtttatcccctttcttctcttacctctttcttcttcaccagttcttttttctctctctggtttgttgaactgcatttaatgttggggtttgagtccggatgagaaagatagagacttgtagtaaatactgattcataaagatgatgatatttctgaaaaaaaatgtttcttgactctgacccactttacctttttttgatctacttatctatgaaattcttggttacttgatgaggctgttcttgttcttgtttttgttttaaggattctaaaagaagttatggagctttgattgtcctatatgcagctgtaactatttgtcaagctttctttaagatactgggagcttgtatggtatgaagagtaaataggccagtaacatttaatagtggtgcttggcctttgacctttcagtttcaagttcagatgtcgttccgcagtatagttcgtgatgtaagagatagtattggtagcttatcaaggcgaagctttgatttaaggctgtctggtcatcctagggacaaatcacatggttcattttatgacttaagtgaccagcctcccgttatccaagatagttgttgggccaatcttcctccagagctactttttgatgtagttagaaggttagaggagagtgagagcacatggcccggtcgtaagcatgtcgtagcatgtgccgcagtctgtaggtcatggaggagtatgtgcaaagacatcgttagaaatcccggaattttgtggaaagctaacttttcctgtttcctaaagcagc

SEQ ID NO: 11638 - DNA, 965 bp, Lycopersicon esculentum
  Predicted polypeptide sequence is orthologous to G2592, G2713
gagaatgggaatttccttctctctgcaaaaagaacgagacgtactacttgcacagagtatgttatctcaatggatgcagaaaacatctctagatcaagcaacacctatattggaaaattaagatcaaattttctaggtacaaaattcattatatatgacacacagcctcctcacaccggtgcacatgtacctcccccggggcgaacaagccgtagattcacttccaagaaagtctctcctaaagtcccaactggaagctatatcatatcccagatcacatacgagctgaatgtgcttggaacacggggtccacggagaatgcactgcgtcatgcactcaattcctgactcagcccttgaagccggtggctctgtacctggccaaccagagcttctctcaaggccccttgaggattcgttccgcagcatctctttctcaaagtctcttgatcattccactgagttcggtagtgcacgattttctgatattgctggaggatcaactaatgaggaggatgataacaaggggaaaccactggtcctaaagaacaaggcgccacgatggcatgaacaactgcagtgctggtgtctgaattttcgaggacgagtgacagttgcatctgtcaagaacttccagttgattgctgccactcaacaacctgccgctgcaccaacaacatctcagccaacaagtcaatcagatcatgacaaaatcatcttgcaatttgggaaagtaggcaaagatatgtttaccatggactaccgatatcccctatctgcatttcaggcatttgccatctgcttaagcagctttgacacaaaattggcttgtgaatagaagagctaaaacagttttacatttagggtgctattaactgtaatgcttctattctggatttgttgtacttctttcttcttttcacaattgaaaatggagattgtccctaaaaaaaaaaaaaaaaaaaa

SEQ ID NO: 11639 - DNA, 1039 bp, Lycopersicon esculentum
  Predicted polypeptide sequence is orthologous to G2592, G2713
caagtttcttctttctgctaagcgtaatcggagaaccacatgtacagagtacatcatctctatgaatgcagataacatatcaaggtcaaacagctcttacattggaaaactgaggtcaaattttctgggcacaaagttcataatttatgatacccagccaccatacaacagttctagtattcccccacctggtggaagccggagattctactccaagaaagtttctcccaaagtccctacaggaacctacaacattgcacaggttagctacgaactgaatgtactcggaaccagggggcctcgcaggatgaattgtgtcatgcactcaatccctgtctcgtcccttgaacccgggggcactgtcccaggccaacctgaacttctccctcccaatcttgaagactcatttaggagcatgtctttttcaaaatcaattgatgcttcaacagaattcaatagtgctcggttttcagatattgggggtccaagtgaagtagatgaagaaggtaagagtagtcttttggtccttcgaaacaaggcacccaggtggcatgaacagctgcagtgttggtgtctgaatttcagagggagggtaactgtcgcttctgtaaagaatttccagctgattgctgctacacagcgtgcagccagtgctccaacaccagcacaaccggctcagtcatcatcagatcaagacaagattatcttgcagtttggtaaggttggcaaagatatgtttacaatggattatcgatatcctttatctgcatttcaggctttcgccatctgtttgagcagctttgacactaagttggcatgtgaatagaaaggacaaatagaagatttagttgatactagttttctcttccctagagttgctgaaaagattgagtcttttgcacagtcattgtgttactcttcatcataatcaagaagatgcaggaaactcttgctcatttgaaagttaccattctcttctttcttttttacctcctcttcgtccttggtcgtttcatcgttcattcatagtttaagatgc

SEQ ID NO: 11640 - DNA, 600 bp, Lycopersicon esculentum
  Predicted polypeptide sequence is orthologous to G2592, G2713
aagagctatgacgtcgcatgcacgcgtacgtaagcttggatcctctagagcggccgccctttttttttttttttttttttttagtagatttgcttcactgaccaagaaacacttttaggtttcagaagcaacattgtcttgtctcacgaaacaatacaatacttgaatcaaacacctacttcttaaattatttacatgccaaggctcagaatgcttatcactttggaacacataaaacgaacgactctctcaccgttcgttcgttcattcattcattcattcattcattcacaggccagcttggtgtcgaagctcgtcagacatatggcgaaggcctggaaggccgacagcgggtaccggtagtccatggtgaacatgtccctcccgaccttgccgaactgcaggatcaccgggtcatggtacgacgacgacgacggcggcggcggcggcggggggccggaggcctgcggctgcggctgcgtctttgcaggagctatcagctgcaagttcttgaccgaggccacggtgacgagaccgcgaacccacgcgtccgcccacgcgtccgcggacgcgtgggtcgacccgggaataccggaccgg

SEQ ID NO: 11641 - DNA, 556 bp, Lycopersicon esculentum
  Predicted polypeptide sequence is orthologous to G2592, G2713
gagaatcaactatacttttttagagagagaaacaacaacaacatagttgtacagaaactcagaaaaagaacaagatttaatttttacggtatatttaatgtgcacggttgtcggggattcaaatctgtcactccaaaagattcacatatagaaagtagcctgtgaaacgttgctctggtccagtaaatgtcttttcgcagtatagctcgtgatatcagggatagtattggaagcttatccaggcggagttttgaagttaagctgtccagtcataacagagggaagtctcagagtgctgttcatgagttgcatgaccatgctatcgtcattcaaagcagttgttgggcaagcctcccaccagagttgcttcgtgatgtaattaaaagattggaggcaagtgagagtacgtggcctgctcgtaaacatgttgtggcatgtgcagctgtttgccgctcatggagggagatgtgccaagaaattgttcagcgtccggagttctctggaaaattgacctttccaatctctcttaagcagcctgggtttcgggatggaacca

SEQ ID NO: 11642 - DNA, 651 bp, Lycopersicon esculentum
  Predicted polypeptide sequence is orthologous to G2592, G2713
gggttcctctcttccgatgcgatttcttcgatccaaatcaagtcgcttggagaagtctttgtctgggcctatagaaactcaaagagaaggttcactggttctgaaaaataaggctcccagatggcatgaacagctccaatgctggtgtttgaactttcatggtcgggtaaccgtcgcctcggtgaagaactttcagttggtagcttctccagagaatggtgcggctggaccagaacatgagaaggttattttgcaattcggtaaagtagggaaggacatgtttacaatggattaccgctacccactatcagcattccaggcattcgccatatgccttagcagctttgacactaaaattgcttgtgaatgactcatctttgaggtttggctctacctctttccttgcagaagttcaaattcacaatctagcatttataagtcttttcacaattatcaaagataacaaggttttaattggcatatcgtgttaaaaacgtcgcagacggaactttctgtcagttcactctacgattcgtcaattgcattggaccttgtatcttaaaatcttgtttttagtcgtccgagagttaattcaagtactgtttatgctttgtaactgcatgtctttaagctggcatgcagttagttaat

SEQ ID NO: 11643 - DNA, 504 bp, Lycopersicon esculentum
  Predicted polypeptide sequence is orthologous to G2592, G2713
cattacatctctcaaatttcatcatacttcacagatctctcatttttattctgattctcctatttcaccttcagatcttgtattatagagaaagtttttctcttggtttctctgcaggagtgctagaatttgcttattaacagttgtgtcctttgacaagtttgcttctgctaactggaaaaagggcttatattttaaggaagtgcaaagaaagaagtacagaacagttttgctattagatgtcgttccgcagtatagttcgggatgtaagagatagttttggcagtttatccaggagaagctttgatgtaaggctctctggtcatcaaaggggtaaatcacttggttcatttcatgacttgagtgaccagcctcctgtcaaccagaacagttgttgggctaatctcccacctgaactactttttgatgtaattagaggattatgtgtcaggaaattgttagaagtcctgaagtttgtggaaagcttacatttccagtatcgtt

SEQ ID NO: 11644 - DNA, 808 bp, Lycopersicon esculentum
  Predicted polypeptide sequence is orthologous to G2604
gtaaaggtctgtgtctgcctcactcctaatgcttgactaagctcctcttatgtttcaaatgctcagaggatgaaccagtaacaatcatgagacagtaaagatggaagcagctgctctgttagaagtttttgaagcactaggcttttgagatctcaggagaggactacctctgttagcttcacaatgccagttccgcttgctccatatcctacaccaccaacaccatttacaccaccttctaacggtacgcagagccagcttgtgtgctctggatgcagaaatcttttactctatccagttggagcaacatctgtttgctgtgcagtttgcaatgcagtaacagcagtaccacctccgggcactgagatggctcagttggtttgcggaggctgccacacattacttatgtacattcgtggagcaacaagcgtgcaatgttcgtgctgtcacacagtcaatttagctatggaagcaaatcaggtagcacatgtgaattgtggcaactgccacatgctgctgatgtaccaatacggggcacgatcagtgaaatgtgcagtttgcaattttgtgacatcggtaggggttgcaacgagcacagctgagcaaaagtttaacagctaactttaaagctgctgagccagtgctagaaacttctacaactaaagttgtcgtgttatgtgtcagcggcatttcagctgcatcaactggaggaaatttctagttgctactagtatagagctattacagagctttttttccctcgcgtatctgtaatagaataagcagttttgcaggttgagcctacaaa

SEQ ID NO: 11645 - DNA, 507 bp, Lycopersicon esculentum
  Predicted polypeptide sequence is orthologous to G2604
caaatgctcagaggatgaaccagtaacaatcatgtatgaaattgaagtagcaaatgctaaatatgctactagatgaatatgcaaagttcttcgttatagctttcaccatttattcccctttttcctaatcctattttatactttgtactcaaatccatctttcatcacagaaattccaggtccttcagttgctaactcaatcatgtataaatttccgtgtttttttcaggagacagtaaagatggaagcagctgctctgttagaagtttttgaagcactaggcttttgagatctcaggagaggactacctctgttagcttcacaatgccagttccgcttgctccatatcctacaccaccaacaccatttacaccaccttctaacggtacgcagagccagcttgtgtgctctggatgcagaaatcttttactctatccagttggagcaacatctgtttgctgtgcagtttgcaatgcagtaacagcagtaccacctccgggcactgag

SEQ ID NO: 11646 - DNA, 778 bp, Lycopersicon esculentum
  Predicted polypeptide sequence is orthologous to G2633
ttgaaaatgaagtttgattttttttttctctgactttctttttagtattttcttcaccactagtggcttactaaaaatggaatatgcgttgtctaaagttaagctttttttctctgattatttcattaaccatgttcttcaatctttttgcttaagatttcttctctgagtatcaggatagttggatctttgaaatgtgttatggatgtgaatgttaaagcttggagctggtgaactttttgtaacgaggcggggtgtatgctggaaatgtttctgttgtcttctggatatctatgatgtgctaaacggttagataatatttcacgatgaggccttctcagaaccctgaggaaatcaacgagttcaacaaattctataaccaacccatagagtatcaagaatcctatttcctgccttccgttaacaatccgaacaacaaccaatcgttctatgctgatgtctctgccttaaaacccgcccaacactgttatgttgaatcatccgcgggaaattctagtgaacttgtttctgattcacctcctattgttaatttcaaccccatgatgaaccaaggttctgattcgtgtcgttcagacatgcatcattctcctgatgatacatttcagtcgtcgggtaacagttcgtgctacactagtgatgttactgacctgaagcacaagttaagggaacttgaaactgcaatgctggggccagattcagaaagcttggaatcatttaataatactatccctgtgactgcagccaatcaagttccatc

SEQ ID NO: 11647 - DNA, 699 bp, Lycopersicon esculentum
  Predicted polypeptide sequence is orthologous to G2633
gtttagtcgagagaggtttgctgagatctaagattagcttttgtctgcaacggttgcttgaaatccgatagtcattttgagatgcaaacatctcagagaacacaaatgtctggaagtgttcacggattgtacaatcagcaaatgcagcaagttgagcagtattacgccccttacgatgttcttaagaacagctgtaaggataatcgtagctcagggatgcaattctctttacaggcacaagacgaacaattcttcacgctggactcgtcaccagctaccgactatgttgtcaacgattcacctcctgccttgagtgtttcttccaacaggagtcccttttctcctcaatgttcacagtcatacatgtctgatctgcatcactcctctgataacacgtgtggttcgcctttgagtgggtgttcaggaattgatgatggtgacttgagacatgtgcttcgggagctggagaataaattactggggcctgaatctgatactgacgacagctgcagttgctccttgaacgatatggtctcaaaaccgtcttctgttacaaggtggaaccgagtgttggacatggcccctggcttgaacttgaaagagttgctcgatgcctgtgctgaagcagtgtcagatgctgatatctctactgctgaagctcttatgagtgctttagagcaacgggtgtctgtgtctggg

SEQ ID NO: 11648 - DNA, 256 bp, Lycopersicon esculentum
  Predicted polypeptide sequence is orthologous to G2633
gacttcgattagtttctgatagaacagatcctagcaagattaaatgacctgtctttttaaattaatacaaacagaaaaaagaagaggtgccactatctgtctcaccattatcaagctacaagttacatgcacctaattacggtaggtaggatctacacagactttacctctacctttgcaggatagagagactgtttccgataagagattatttccatgcacaagaagcaactaaatctcgattcatccagccaag

SEQ ID NO: 11649 - DNA, 108 bp, Lycopersicon esculentum
  Predicted polypeptide sequence is orthologous to G2633
gatttactttcacagtacgctcggggagatggattggctgcagttgccagacggctatcagcaatttctgaggagttcaacattgctgttgcgtgtcatgcagggcca

SEQ ID NO: 11650 - DNA, 745 bp, Lycopersicon esculentum
  misc_feature (643)..(643): n is a, c, g, or t
  Predicted polypeptide sequence is orthologous to G2639, G2640
ccaaacacaaattcccaaatttaggaacagagaaacttaacaacaaaaaatacttaagcatttaaagaagggaaaaccaaatggtaaaatcaactgaaattagtggtgtatttatcgtaaaagaagtaattataacaacgattaatagttcgagatgatgaggagggaagaagaagaagaaggaagagtatcgtcatcattaagtagcagtagatgtcaagattgtggaaatcaagccaaaaaagattgtacatatattaggtgcagaacttgctgtaagagtcgagggtttcattgtgaaacacatgttaagagtacttgggtccctgtctccacaaggcgtcccaggcaccatcttcttcatcacactactattcagcaacagcagcttcaaaatgggccaaaccctaaaagatacagatcaaatgaagtgataggtgatgatcacgaaggaggtaattttccgggggaagtgagttctccagcagtatttcgatgtattcgtgtaagttcgatagataatgtggttgatcaatatgcatatcaaacatcagtgaagatagcaggacatgtttttataggaatattatatgatcaaggaccagataacgagagtcctcgttacaacaattatatggctggnagaagttcgtcaagtggctttcagcttcatcaacctcttattttacctcctactactactacaacttctccaccaccatcaacttcgacttatcccaatcta

SEQ ID NO: 11651 - DNA, 748 bp, Lycopersicon esculentum
  Predicted polypeptide sequence is orthologous to G2639, G2640
caactctaattttgtaaagccaaaaaaaaataaaaaagttccttttttgagataaaaaaatgaagaaatccaagggattcaaacatcatatttgtgtcataagttggtgcacttttgtgctatggattgtgattaatcactaatcataatcaacaacaacaacatggctaatttcttttcattaggtggcagccaagaacaacaacatcaagaaattagcagcagccaagcaatagtacccacagatcagagtaataattggtttttgtacagaaatgatcatcatcataatcaagaaatacccaacacttacaaaggtttcgagttatggcaaagtggtaacactcctcaacaccaaccagaacaacaacaacaacagtttcgtcatccaatttatcctttgcaagatctttattccactgatgttggattaggtgtcgggccaagccgaagtggctttgatatatctgcaggtgatcatgaggcgtcgaggtcgggattcgtgatgatgaggagtggtggaggaggaataagttgccaagattgtgggaaccaagctaagaaagattgtcaacatatgaggtgtaggacttgttgtaagagtagagggtttcagtgtcaaactcatgtgaaaagtacttgggttccagcagctaaaggagagaaagggcacaacaacttactgctttgccgccaccacccacaacaccacccacaggacataattattataagcataaaaggcaaa

SEQ ID NO: 11652 - DNA, 647 bp, Lycopersicon esculentum
  Predicted polypeptide sequence is orthologous to G2649
tcaacaacttgtcaagattgtggtaatcaagcaaaaaaagattgtacacatagaagatgtagaacttgttgtaagagtagaggttatgattgtaacacacatgtaaagagtacttgggtaccagcttcaagaaggcgtgagaggcaactaatgggtgcatcaacaacaacaacaacaacaaatagaaatgttgtagcagctggatcttcttcccaatcaacatcaagtgctaagaaacctagacttgtcaattctcaaacaactacaacagcttcacatacttctacttcaaataatacacctccaagaagttttgacactagctctagtcatcaagatgcaagttttaaaggttcattgccaggacaagtaagggcaccagctgtattcaagtgtgtaagagtgacttcagtagacgaaggtgaagatgaatatgcatatcaagctgttgtcaaaattggtggacatgttttcaaaggtttcttatatgatcaaggtcttgatgaaccaaaagataataataattttccaaatttatctgatttacatttgggtgctgttgctaccaatgaacatctttatgctgcttctactagtggtgggggaggattacttggtggaggatcaaattatggtaatcaaataaa

SEQ ID NO: 11653 - DNA, 1096 bp, Lycopersicon esculentum
  Predicted polypeptide sequence is orthologous to G2650
gaagagatcgtcgtgtaaggctttcagttcctactgctattcaattatatgatcttcaagacagattagggcttaatcaaccaagtaaagttgttgactggttgcttgatgcagctaaaaatgaaatcgatgaattgcctcccttgcaaattcctcctggaagtttgaaccctaatctttatcctatgttaggtaatgctcctcaaattactactaataaagaaggtcgcattaattgggataataacattccattggaaccacctaataataatgctttgggctacaatcccaatttttttaaatgggatccttcaaatttatccttagctcattcagaaaattcattatctcatcaacatgatcatcatcaaaacttcaatttgatgtctagtatgccattaacttcacatcatcaacctgttgtttatccaccaggattgcctcaatttttccatcaacataataataatattaatgttggagcatcgtcgtcatcagaatttgatcccaaagaaatcaacttccaaatgttgagtaacaattccggttcagaaaatcccttgtcaactagtactaattcctttagacattctattgactccacaaaccaatctataagacctttccattttctgccttctcaaaattgtgatgacacggagccttccaattaagatcatttacttcctctctgctctttataacaacttaagtttttacacaaagtatcgtattggtcatataatttcaacatgataacagagcagatcaacatattattggttgatcggatgtttcattaagctattccactttcaagatcagagcaagttatcaactgtatgttccccggtgagtactgaataatttgatactagtatatatatatatatatatatataacaacaattgtatgttcttttggtcataattattcctatagctacaagactcgtgattggattgtttgggatgcttcaatgtactccaatttcaaaatgtattatgctatataaagttgtacgttcggttattaaaagacaatataatatatatatttttggccccaaacaaaaaaaaaaaaaaaaaaaac

SEQ ID NO: 11654 - DNA, 628 bp, Lycopersicon esculentum
  Predicted polypeptide sequence is orthologous to G2650
acagaagactttaatgccattaagagattcttgtgagctgcaaaatctgacttgagttcaatttcatccttcctcaattccttatacatagatatcttttcatcctcaacgcgtcccaagaaatagtgtatcagatcaacagcaacaacaacaacagagacatcgaggattcagtcttttatatatctattgatcaatgatgaagaaaagagtgattagtacttgatcattatgaactcaagaaagcaagaaactggttcaggggttgataccaacaacagtaaaacaacgtcaacgactactgctactactattccatcaagttcttcttcaaggcagtcatcttcatgggggaggagggtttaaaaatccaagaatagtacgcgtatcgcgtagttttggagggaaagataacacagtaaagtgtgtacagtaaaaggattaagagacaggagaataaggctttcagtaccaacagcaattcaattgtatgatcttcaagataggcttgggttaagccaccaagcaaagttgtagattggctaatagatgcaactaaagatgaattgataagcttccacctttacaaataccaccaccatcactctctcatttcttcagtacgaaa

SEQ ID NO: 11655 - DNA, 555 bp, Lycopersicon esculentum
  Predicted polypeptide sequence is orthologous to G2655
tcggcacgagatttttatctaaatactccttttcccttttagtcaatttcaaaataaaacttctcaggctatactcttagacttcatcgatcgataatggctctagaagctataacgcaacaacaacaatatctttatgctttactcggaactacaaattggagtattgattctggctctgattattacaacaataatgaatttgttccgaatcatcaaaatgtaacagcacctcaagagtacgaggactactcaaattggaatttgccagctccattattagtagattcccaaaatgaatttcatcaatggggtcaaaattgttcctctgttttagatcataattttacaattgtggatcaacaggaacagttggagtctccaatcgaaatgtctagtagtacaactagaccacgaagaagaagaacaagaacaaagaagaatgacgaagagattgagaatcaacgaattacacacattgctgttgaacgaaatcgtcgaaaacagatgaatgactacctctctgttctccgtactctcatgcctgaatcttat

SEQ ID NO: 11656 - DNA, 598 bp, Lycopersicon esculentum
  Predicted polypeptide sequence is orthologous to G2682
tcagaaacgttggttttgttatctgttcttttgtctttctcaatgttagtggacagagtagtactgaaatgagtgttttttgtcccttttgatggtagtggaaattttggtaaaggatagttatgaggaaatggagaagatggtaactaagtgattacatagcggagtggatatagcgttagactccgaatctaaaggccgtgggttcgaatcccactgtgatcactgcctacttttttttcttttataatttgtgtttggttttggagatcggtgtgagtttatatatacttggttcctgtttagggagtagattttcaaatttttgtttgaatgcgttgtttgttcatgatttttggtgaagtttcatttcgattcacaaaacttcaacttttttcttagtagaaagtgcatgtccaactacaacttcaagtttcaaaaacaatttttgcaataaactttgaaaattcattctttttttaagttttaagtaaatatatggttaaacgctaggttagttagattctttcggaattgttgaaccgttgcttttgttattgtctttctcaatgttagaggagagagtagtactgacatg

SEQ ID NO: 11657 - DNA, 473 bp, Lycopersicon esculentum
  Predicted polypeptide sequence is orthologous to G2699
agtaagtacgaaacccttttctgtaaatccaaaaaaaattccgatggcgatgaggcgtgtagcttctacagcagctcgtgctattgcttcaccttcatccttagtttttaccagagaacttcaggtaactagccatttctcctcaatagccactttttgttgcttttgttttatatgacctagttttcgccctttgatgaattatcggaaaccggcacggatcaactccgatttttcgagaatcaagtgagttggagattggaacagaggaaactaaaggaatttaaccgtgtaaaggaaaaaattaaacacactgtatttggtgctctacccctcgtctcttctttttggctttccccgtactctacacaccaaatgaaatggctcggatatgaaaggactaataacttttcagttttcattactgcgtccttttttaagctttcagttttaatttgcgtgaatatacctaa

SEQ ID NO: 11658 - DNA, 708 bp, Lycopersicon esculentum
  Predicted polypeptide sequence is orthologous to G2702
gattttttttatccaatggatacagacaaatgattgcatgcctaagtctagaatttggttcaatgtccaagtagattttagcactctttatgggatctttaaatagtggaattattacaaataaggctttggatctcgtcaatgcttttaggacttctgttattcctattgtccagattatttaaccgttttctcttggtggaattctatatgttcgagtattgattatggcaatactataagatgtctgacttttttttactttgagatttgcaattttgtcttttatagagggctttattataactaatctactgtaatctgcaatcatattatgtgttatgttacttgactattcatttgactgaaacatacatatctgcaaaatacacccaaaaaagccgtactaaatatcagtggcccccccataaatctatactattggattttaaaaatcagtagaatgttatatatgggatttaaacctgtgatctaaagcaatttcttaacctcctttgactcttcactaaactttttcttatagcaagggcatccaacaacttatgtgtaactaaaaaaattgcttttaccctatcaaacagtatacttttcaatgaaggggattcaattttcatcaacttagacttgccactgctaaatatgcccaatattgaaaccatatgtgtatgcaatttccatacttgtttc

SEQ ID NO: 11659 - DNA, 738 bp, Lycopersicon esculentum
  misc_feature (673)..(673): n is a, c, g, or t
  Predicted polypeptide sequence is orthologous to G2717
gctagaatctcgctatacgaatactcaatcgatttatgttcatgtactgctattttgttaattgtccgtttcaatatacaattgtgatcaacaggttgttctgaagtttcctccctcagtttttgatgggtgcacctaagcaaaagtggacttcagaagaagaagctgcccttaaagctgggatacttaagcatggaccaggtaaatggcgaacgattctcaaggatccagaatttagtggagtattgtgtttgcgttcaaatgtagatctcaaggacaagtggaggaacatgactgtaatggcaaatggctggggttctcgagagcaagcaagattggctgtcaaaaagatgagacaggcccctaagcaggatgggagtcctttgactgatactactgctgctgatagtgatgaggaagcagctgaaacaaggactgtcacaacttctagtggttctcctcagacacatggttcaaaacgatctatgataaggttggataatcttataatggaggctataaacaccttgaaggagccaggtggttccaacaagatcacaatagctgaatacatagaggaccagtactgggcacctccaaattttaaaaggctactgtccgggaaactgaagtatttaactgcaacagggaaacttatcaagatgaagcgtangtatagaatagtacctatgtcaacaccatctgacagtagaagaaacctgtcccttccacttttgg

SEQ ID NO: 11660 - DNA, 748 bp, Lycopersicon esculentum
  Predicted polypeptide sequence is orthologous to G2717
gctacaaactttaaaaggctactttcagcgaaactgaagtatttaactgcaactaggagacttgtcaagatgaagcgaaagtatataatagcaccaacactggtattatctgacagaagaagaattccttccgttcctctcttggaaagcagccagaggatctcctcccgggttgatccggatgatataaacacacttactaaggctcaagtagattttgagttaactaagatgaggagtatgacacctcaagaggcagcagtagctgctgcacgagctgttgcagaagcagaagtagccatagcagaagctgaggatgctgccagagaggctgatgctgctgaagctgatgccgaagctgcacaagcctttgcagaagctgcaatgaaagcactagaagggagaagcatcccaaggatgatgatccatgcttgatgggatcttccagagttgtggcttgatactatagctttgatggattttttccattttgttatttttcaaacctttagccagctacttgctggcttgtaaatttggtaaatagttgtggaaatgtatacactgtttgtgatagtaaagcctttccggtaaatagcataaaaaaaaaaaaaaaaaacttcgagactagttctctctctctttttttggagaaattgtgcgatttttggaagagagagttatggagtagaacattgaagtttgaaaattctcgcgatgacgtttgatgaagtgtcaatggagcgaa

SEQ ID NO: 11661 - DNA, 695 bp, Lycopersicon esculentum
  Predicted polypeptide sequence is orthologous to G2717
ggattagatgatcttatactggagtcaatagccaaattgaaggaatcacgtggatctagtcggaatgcaatttcttcttacatagaggtaatattttcctattttgagcttttttgatataagtaagtccaagaaagtgattttttttttctcttgaagatttagttaattttatattgctatacacattagttgagggaacagattgttgtcttcttaaatgggttttgagcaattctcaccagatgagctagttttgatgttgagttaggcccacggtcatccatttgtatttttggtgtgtccatgctggattcccatgttatgttgtacacactccatatgtcttgtattgggcctatgccagcagtggagagagggagggcattgctagtcccaaatgggtgaggggatgatttgttttctccttatatgattttagacaagccctacttaattaactttttgtcgagttaggtcaaggtctattttcttgaaatgtttggattacctaactattataccaatcactataggagtcaccttctgtttaatctatgttttcaatttttgatgaaaaaactaagtgtatatgctcttaagttctgcctagttaagcattttcaagacatttgtattaattttatttttttcttctatgaaaatctgctgcctcgtaccccagaaagagaaag

SEQ ID NO: 11662 - DNA, 598 bp, Lycopersicon esculentum
  Predicted polypeptide sequence is orthologous to G2719
agatgaatgaaaaggcggagcaaaacggttacgccgccgccggcgaaggccatggcggcgacggaggatgtagtttggttgatgccggtgatgcgatgttgaacggaggaagaggaagtagagttagtagtggaagagtgaaagagccttggtcgccggaggaagatgcagtactgactgaacttgttaataagttcggtgcaaggaattggagtatgatagctcaagggatcgcaggtcgttctgggaaatcgtgccgacttcggtggtgtaatcagcttgatccggtgcttaaacgcaagccttttactgatgaagaagaccacattataattaatgcgcatgccgtccatggaaataaatgggccgcaattgcaaaattgctccctggtagaacagacaatgcaattaagaaccactggaactctacactaaggcgtcgatttgcaggggtatggagggttaaaccaatacgcagcatgatgttagatgatagtagcatttacaaagccagggcattatctgaagaaactatgtcatgtgaaggtgttaaccaaattaagcccctggaaatgctggaagttagtcgtacagagtg

SEQ ID NO: 11663 - DNA, 645 bp, Lycopersicon esculentum
  Predicted polypeptide sequence is orthologous to G2724
tcgagttttttttttttttttttttttacccagaatgtaatatattaaacatcttaaatcacattacattctatgtcatcaatcatctccaagtaagagattgaatatgatgatataagataaatcaaacttcattgggagttctttttcccttctaattttttctttttaccaattataatcataatgatctagatcaaaggaggaaagaaattcatgagatataaaaggtgaaggtggacatatgagtccacaataatcaattgaaggagctacaaaatcaattttagtatccacttcaaatggttgtgtccaaaaacttccacttgtaatatcctccaaattagctaattcttcttgaaaaatgtcttgttgataatcaatagaggataagtcttcacttgatgaccattctgaattttccaatattacattttcatgcataggattattattattattattatcaccaattgcattttgattttccacattactctttcttttagtaatatcactttcactcttcttattattgcatttcttgcttccttcacttgagttataatcagcgcgcttcttcactgttgtgtgccaatgattctttatctcgttatctgatcttcctggcaagtgacttgcaat

SEQ ID NO: 11664 - DNA, 640 bp, Lycopersicon esculentum
  Predicted polypeptide sequence is orthologous to G2747
catgaatttcttctcagatggacgtggcttcaacgatcaaggcccattttctcatcctgatttctcccatcagcaaagaagcaccactaatagtagtgatatggcagatgaagtgggtgaaagtaacacgattgaacgagaacacatgttcgacaaggtagtcactcccagtgacgtcggcaagctcaatcggttagtcatccccaaacagcacgcagaaaagtattttcctctggattcctctaccaacgagaaaggcctccttctcaatttcgaagacacgaacggaaagccttggcgcttcaggtattcctattggaatagcagtcaaagctatgtaatgaccaaaggttggagccgcttcgtcaaggagaagaagctcgatgctggggatattgtctcatttcagcgtggagtcggtgaattgggcaaggatcgtctcttcatcgactggaagcgccgtccaaacgcccccgatcatctccacttcatgactaatcatcatctccataataacttgtaccgctctaatattcagtacccagctgctgcttgggatcgtcctctctttttgcagcctcctgaccaatcacatttacaatattccctgggacctgcacctggcagcatgtctcagcaa

SEQ ID NO: 11665 - DNA, 699 bp, Lycopersicon esculentum
  Predicted polypeptide sequence is orthologous to G2754
gaactgagacagattatgtgttgaaaacagaaattccaggtgagtaaagagatttacttatttacttgagtttgtgttcgtttttttaggtcaaactcataaacagatttcttgttaggttttttttctttagatattttacctacgccatttttctattgaatcataaactactcatattttattcctttaaaacactgctaactgattttgattatttttcctattgtaaatgtattcaactgtgtttgtattgtaataattttgattgaagaaatgaagacaaattgtttgttagtctcatttgttttctaatgtgttcaaatgatttcgagtaaatacaattattctcgaacaatttcactatcaattggtctaatgagttctagaacaacatatgcatatctaccaatacccctaacaaaatctgatccacatcgatcaacggtgtttaaaaggaacaaaattatgggtgattcaataatttaataggaaaatagcctagttaaagtatttgagaaaaaacccaacaagtttataaatttgtttatatacttggccttttttttaatgtacgaacgaatttaaaatttaaattttataaattctgaattttatgagccccgactttacttgaatgtcatttagtggaacaatagcgttaaaattttaaaaaatcctatatctgacaatattttt

SEQ ID NO: 11666 - DNA, 606 bp, Lycopersicon esculentum
  misc_feature (580)..(580): n is a, c, g, or t
  Predicted polypeptide sequence is orthologous to G2765
gctcaaccctcttcaacataaaaacaaagcaatttctcattttccttctcaattatcctttctatatctcaaaaattcgtacttaaaaaaataatagaatttgctaattttgaagaattttcgagtttgcgttgcatcttcagtaaatttttaccaggttgatattttaacagatacaagctgttaagtgcgacttgtgcttatagcaggtaatgatagccatatagtatggaatcacacaatctgtatggatatggtgcgactgatgtgaatttgccatattcttactctatgactactaccccttcgatacctaataggctgttgggaatattgaaatttgattcgggaaattctccgaattctccatttgcaaactataatgatcctggtacccctaccacattaagtgatagcctggagcaacacagctctactgaaaatatttcagggactagtccttgcagtaattcctcgcgggattataatcattatttctgtaggcctagtccctctccagatatccaccataacaatcttctggtttattctggtgatgattctctactccagtatgcanatcacagtcacaacatgaaacatgcg

SEQ ID NO: 11667 - DNA, 1157 bp, Lycopersicon esculentum
  Predicted polypeptide sequence is orthologous to G2766
gccctcaccccacccacccacctctctctctattaacttctcaacctccaaatcttaacaatccaattcgaacaaattatcaaatgtatccatcatcaacatcttcttcatcacaaggttcaatgagccacaccagcaccaccgctggcggcgccggcggtggtctcactcgctacggttcagctccgggatcatttttaactacagcagttgaagccgtcgttaacggtaatcacgagttcgcttctcacggatctcatcactcacaccttggtccttcacggttttttcagtccaatctagcatctacttcgttaaattccgaatctacaagtaaagcgaaggaacaatcgaatttacagaggtcaattggtttcaatgacttaacaatcggcggcggaagcggcgctggaggaggagttttgccgacgacttcaacgacgccgttggttcgacatagtagctcaccggcgaggttccttaatcaacttgctactgctgcaggtgatactgtttcaatggggagaggaagctataacccaaaaggcggtggagatagtggccggggaataacaaggctgaactctcagctcagcttcacaacgcaagaagctctttctcaaatagcagaggaaaatgaggatattgaagggaccagtatagccaatggccacagaaagtcaacacattcttatgccagtgcaagtagtttcgcgatgggttcttgggaagataacaactctataatgttctctgtcacacctagcaaacgatccaagcagattagcaatgacattgtcaatgggctcgatgacggggaaactcagctaatatgaacttgaaggtcactatcagaaaacacataaaccttcaccgtttgacatctgtgttttcaacatgtaaacggcgatagatatacttcctttacatttttccccttaacaaccttacaactacattctgtgtatgtgtttcttttctttctgcagaagtatgtaaaataaaatagacaaaataatccatgttggcatactcaatcatgtttctcgtgtgtaactcacacaaaaattgatgaaaactgcatttttattacttgtgggaggatgaactgatgtttttcaaaaaaaaaaaaaaaaaaactcgagggggggcccggt

SEQ ID NO: 11668 - DNA, 411 bp, Lycopersicon esculentum
  misc_feature (408)..(409): n is a, c, g, or t
  misc_feature (411)..(411): n is a, c, g, or t
  Predicted polypeptide sequence is orthologous to G2766
caagcaaacgagctatgctgacatgctggatctagcagtgcagcatattcgaacccttcaagatcaggttcagaatctgaatacagaacttgaaaactgcaaatgtggatgtaggaaatcaagtcaataacaaaatgggaggaagcactttagctgaagattgacttaaaaggatttttgtcaccattattttgcttcttagaaactcaaatttgtacatatggaagtaaatttcatactagttttttaaagctaaaaagtgaactctctttgtttttttttcttttcccttttccagttagaagactacgtatatgattgttttggattatttctagttttcttttttcatctaacatttacatttttaatttatttttgagtttattttgcttgaagatcattttnnan

SEQ ID NO: 11669 - DNA, 490 bp, Lycopersicon esculentum
  Predicted polypeptide sequence is orthologous to G2771
ggttatttgatatcaaagttattatccagtaataggcagtgctgctgctagcgtaagaatgaggttgtaagaagggctccgaagtccagggattgtgataaggatggactgtaatgggtaattgtgatacagagggataagggtcactatgatggctaggctttattacagtgtttcagtcatttgtttggttcatgagattaagagaacggggatcaaattatgcgttgttcatgaaaagtctatcgtttcagtcatttgtttgtttcatgagattaagagaacagggatcaaattatgcattgtttatgaaatgaagtctataagtatgaacctttctgaagagatgctgttgacctaaatgtattgcataatatgtacattcttctttaggagattttgatgccaatgtggaatatgaatttttgcattaaattgagcaaaaataaggtagtaagacattgaataagcaccagaaagggaacaaaac

SEQ ID NO: 11670 - DNA, 623 bp, Lycopersicon esculentum
  Predicted polypeptide sequence is orthologous to G2777
ggtcgtaagagaagcaggtttaaacattggaggagggaaatgtacgacatcattagaacggcaatcacaattgtcttcaaatcataatcataacactgcaaccttgagctcacactcatctcctcagcaaccatcagcaatggagaatcagagtttcatacatatgataacatcggctaagaatgcacaggaagatgatgatgacgacgaagaagaatttgttgttaagaaagagtcaccttcaccatccagaggcaatttatcagtaaaagtcgatgggaaaagcagtgatcagaagccaaatactccacgctcgaagcactcagcaacagagcaaagaagaagaagcaagatcaatgacagatttctgaagttgagagagatcatccctcacagtgaccagaagagagataaagcatcattcttgctggaggttatcgaatatattcaattcctacaagagaaagtgcacaaatatgagggatcctaccaaagtttggatagtcaaccttcaacattaccttggggcctgtcactgaacagacacaagagccaaacagaacttccagtgtgagagaaagcagttttctgtctgaattgacaaacagggccgcaacactttg

SEQ ID NO: 11671 - DNA, 515 bp, Lycopersicon esculentum
  Predicted polypeptide sequence is orthologous to G2777
tgacgatgatgatgatgatgaagattttgtgattaagaaagaaccacagtcgcaccttagaggtagtttatctgtaaaggttgatggaaaaggcaacgatcaaaagccaagcaccccacgttcaaaacattcagcaacagagcaacggagaagaagcaagatcaatgacagatttcagatgttgaggggaatcatccctaatagtgatcagaaaagagataaagcgtctttcttactggaggttattgaatatattcattttctacaagagaaagtgcacaagtatgaggaatcataccaaggctgggacaatgaacctccgaagttgccattgagcaagtgccataggacgactcatggcgttagcaatcttcctcaacgcattatcaatgcatccagtgcttcactgacgtatgctggaaagtttgatgagagcataatggggatttcttctgctaatcctatcaatgtgcaaaaactggaaccaaacataagcagcacaggtttaaaagata

SEQ ID NO: 11672 - DNA, 483 bp, Lycopersicon esculentum
  Predicted polypeptide sequence is orthologous to G2777
gcttgttctttgtcgcacaagcaagtagtaccgacagaaatgatgaaaattcaaactgtagttcttacacagggagtggtttcacactgtgggatgaatctgcagtcaataagggaaagacagggaaggagaattctgggggtgatcgacacgtcctaagagaaggaggtgtgaacactggaggtgttcatccaacgacatcattagagtggcagtcacaatcatcttcaaatcatcagcacaacactacggccttaaaattctgctctaatctgctcatcaatcatgctcccttaatagcctatgttttttgcgtctgattacatcagctaagagtgctcaagatgacgatgatgatgattattaagattttgtgattgataaagaaccacagtcgcaccttaaaggtagattatctgtaaaggttgatggaaaaggcaaccatcaatagccaagcaccccacgttcaaaacatttagcttc

SEQ ID NO: 11673 - DNA, 511 bp, Lycopersicon esculentum
  Predicted polypeptide sequence is orthologous to G2783
gattttcctctagggtttcaacacgatgcaaccggcggcaagttcaatggttccaccaccaatggcggcgcaaccacagtaccaacagcagtggatggctcagcagccgcagtaccaggttctgccaccgcaggccggttattattaccaaccaccaccgcagcagggtggcggagtacccccaccgcagcagcaacaacaacaatctcagtacacggcttcagctcagccgaccagtgctgatgaagtccggacgctttggattggagatctacagttttggatggatgagcagtacctatatagttgcttcgcgcaaactggagaggtggtttccgctaaagttatccgcaacaagcaaactcagcaatcagagggttatggctttattgagtttaatagtcatgctgctgcagaaaggaatctacaagcatacaatggcaccttgatgcctaatattgagcaaaattttaggctcaactgggcatcacttggttcgggtgaaaagcgt

SEQ ID NO: 11674 - DNA, 521 bp, Lycopersicon esculentum
  Predicted polypeptide sequence is orthologous to G2783
gtgaaaagcgttcagataacacccctgaatatacaatatttgttggagacttggcagctgatgtcacagattacatgcttcaggagacattcagacccaattatccttcaatcaagggtgctaaggttgtaacagatagggcaaccgggcacacaaagggttatgggtttgttagatttggggatgagagtgagcagttacgagctatgactgagatgaatggaaagttttgctccactaggcccatgcgcattggtcctgcagctaacaagaagaattctggtggtcagatgcaagcttcatatcaaagtactggaactcaaaatgaggatgaccctactaatacgacgattttcgttgggaacttggatgctagtgtaactgatgatcacctcaggcaggtttttgggaactatgggcaattgcttcatgtaaaaataccactaggcaaacgttgtggttttgttcaatttactgatagaagctgtgctgaggaagctctaaatgcattgagtggaact

SEQ ID NO: 11675 - DNA, 429 bp, Lycopersicon esculentum
  Predicted polypeptide sequence is orthologous to G2784
atgcaagatcaagctctcattctacatgagacttcaatcaagagtttaagcattgataataaacctggtcttcctaaaatggataagagcatgaagatggatgatgcagataattcaattccgccatggaaatccaacgatgtcaagtcgtggatatggatgcagcatgccatgcatccagaggtgaactacaacagctatttccagaaaaaatggatgccgtggaacataggaccactaaagaatgtgtcaatcaagaaatggatcaaagaaattaagcagaagaggaaagaagaaaagagactacagaaggctgaagtacatgcagcgatatcagtggcaggtgttgcagctgccttagctgccatcgctgctgaaaacatgaaccatgatcagtcagggtgtaccaaggagtcagctgtggccagc

SEQ ID NO: 11676 - DNA, 1111 bp, Lycopersicon esculentum
  Predicted polypeptide sequence is orthologous to G2789
gtcaaattttatactcgctttctcctttttgctttgccagaagtcatacagcagcggtcagtcgacttgttcagtctgcagttcacgtattcgtccttgggggctgggagattgacccacgtcgcgccctaaagacgatggaattgattccagccgttcaaccccctcccccccctttcctcttttgaagcgggttgaattctcaaagaaaaggtgttcatcctaaaatggtgaaagattttaaaattcgaaattgaaatggatcttttctcatctaatttcattcactttccccaaaaatcaactctagattttccctctctatataagcgcctgttttgctccattagaggggttggagatttttgattgaaaaaaaaggggtgttgaagaattttgtgttggtgaaaatacaggaagttagctaagtgatgaaagaaaaagatatatttaagccaaaggtttcctagaaaattttccgattcggtctttctgtcatctgttttgctttgttggttcaagtttttttggagtcgttcttcggtgtagtagttgctgtccatctcttcgctccaacccagttcgctgcccacaaaaaggtaaacacctctaaccccttttatttagatttcatgttcaatatgttggatttgaggtggcttatgttttgttttcaagtcgtttaaatgactgattagagcatgttttctctgtctctttttcactcatcctgaacttgtggtcactgtatttgcttcaagtatagtttgtttactggtttgtcatcgttttatgcttgttttttttattgtcgtaatattcgtgcttccgtcatatgttttgagagtatagggtgcattatgcagtcacacatttagttatttcagatgtacttcaaaatagcatgcctgcaaatctgtctagttttgaatggaaatttcttttgttcgtccctttgttcattcgtcacccgatatttttaaattctagttgtagtcgagaatacatttgtctcctttacttactaaagcacgggtcaatttttgttggtgttatttaaataactatcttaataactattaaagcatgttcatacctttcttcctctttg

SEQ ID NO: 11677 - DNA, 914 bp, Lycopersicon esculentum
  Predicted polypeptide sequence is orthologous to G2791
gcttttagaaccgaactttcacacactgaagaaatcggcaaaatctcagacagaagaagaagaaaatgcaagccatgaattcacttcttagtcaacaacagcagtcacagatatcacttcaagaccttcaaaatggcggaaatggcggttctaccggtggtgttggtggtttaagtcaacacagtatgggtcactctcactttgatccgacgtcgtctcatgacgattttctcgaacagattctctcttctgttccttcttcttctccttggcctgacctttccaaatcatgggatccacatcaccatctctcatctccgccgcataaccctagctccggcgaagatcaacctccttctaatccatttcactcacagttccattacgacgaccaagcttcttctctactagcttcaaagctccgtcaacatcagatcactagcggcggcggcgccgctgcagctgctaaagcacttatgctacagcaacagcttttgctctctagaacactcgccggaaacggactcaggtccccaaacggagcttccggagataacggcctcctttccctacccctaaacctcagtaatggtgaccaaaacgacggcgtcgctaatccaactaatgacaattccgttcaagctcttttcaatggattcaccggatctcttggtcaaacctccaatcaacctcaacattttcatcatcctcagggaggatcgatgcaatcgcagagtttcggagctccggcgatgaaccaaactccggcagcaagtggttcagctggtggcggtggaggttcaacgccggcagcacaaccaaaacaacaacgagttagagctcgtagaggtcaagctactgatcctcacagcatagctgaaagattacgtagagagagaattgcagagagattg

SEQ ID NO: 11678 - DNA, 585 bp, Lycopersicon esculentum
  Predicted polypeptide sequence is orthologous to G2791
atttcaaagcaccgttgaaaatggtgcttcgtccggcgagcacatgagtcattcccatttccaccccgtcgtcgtctcacgacgacttcctccaacagattctctcttccgttccttcttcttctccctggccagaaatctccggcgacggtcacccctacaatttcgacgaccatcagtcaactcttctggcttccaaactccggcagcatcagatcaacggcggtacctctgctgctgcagctgctaaagcgttgatgcttcagcagcagcttttgctttccagaggaatcgctggtaatggcggctctgggataaacggcgatcaaaacgacgacggtttgaattcggggaatgatatttcagttcaagctctttacaatggattcgctggatctcttggtcaaacctctaatcaatctcagcattttcaccattctcaggcccagagtttcggagctccggcggcgtcggtatcgatgaatcaaacgccggcggcgagtggttcagctggtggagcgcagccaaagcaacagaaagttagggctcgtagaggacaagcaactgatcctcacagcattgctg

SEQ ID NO: 11679 - DNA, 115 bp, Lycopersicon esculentum
  Predicted polypeptide sequence is orthologous to G2791
gcaccaagtagctaaattaatggaggaagatatgggatcggctatgcagaatctgcaaggaaaaggcttatgcttaatgcctatatccttaactacagccatttccacttccacc

SEQ ID NO: 11680 - DNA, 708 bp, Lycopersicon esculentum
  Predicted polypeptide sequence is orthologous to G2834
cttccattttatcatattcctacaactctctcaaaattattcacatcatgtcatttaccggcgacttacgtcatttgccgcccaacacaatcggagatgatcctatggttccactgctcaacctctccgccgttcaaacacgaatggattccctccagaaatttctctcagattcggtcaactccaatactttacttggtcaacaccagatgaacatggtttccgacgaaatcacctccgcaatccatcagattattgtcaacggcgccgctctactctcatctgcccagttgacaaatcctcctccgcctccgcctccgcctccgcggccgtcgtcgtcggctgaattgaaaataaatctaaaatcgaatcataagagatcgtttccggaatttgatcggagagatttcgagtcgaaagtagaggtattagacgaagaagaggaagacggtggcgattgggagattattgagctagatgcggttgagctactagcggagcacatccacttttgtgatttctgcggaaaaggattcaaacgagatgcgaatttacggatgcatatgagagctcatggaaatcagtacaaaacaccagaagcattagcaaaacctgaaaaatgcatcgattcatcgaattcgaataaacgaaggagattttcgtgtcctttcatcggttgtacccgcaacaaatcgcataacaaatttc

SEQ ID NO: 11681 - DNA, 504 bp, Lycopersicon esculentum
  Predicted polypeptide sequence is orthologous to G2834
ggttcccaatagtaagaaagaagaaccattggctgaccttcaatctggaagcatattcagatatggatcctgacgacagtctaagtgaagatccttggataaagtcttcttcgtctggcaacgaattgctgaaaattatgccctcagataaccattcatttaccaatttaaatctgcatgagcagaagtgggaaggttcctcttatttggatcaagaaatcaggattgagcaacagtttactggatttgctaaaccaaaacacacatctgagatggatcaacaggggaatcaaaatcatgatacgaccagaatacatgactgggatccaagagctttgctaaacaacctttcgtttctcgaacaaaagattcatcagctccaggagctggtgcatttgattgttgggcggagaggtcaagatgaggttcaaggaaatgaccttatagttcagcaacaacagctaatcacagctgatcttacttgtattatagtccaattgatat

SEQ ID NO: 11682 - DNA, 528 bp, Lycopersicon esculentum
  Predicted polypeptide sequence is orthologous to G2834
accccatgaggaagagaacctacctcctggttcctacgagattctgcagctggagaaagaggaaattcttgcacctcatactcacttttgcacaatttgtgggaagggatttaagagagatgccaatttgcggatgcacatgaggggtcatggggatgaatacaaaacttcagctgctcttataaagcctcagaaggattccagctctgggacgacgcttattaaaaggtattcatgtccttgtattggttgcaagcgcaataaagagcacaaaaagtttcagccactaaagactatcttatgtgtgaaaaaccattacagaagaactcactgtgagaaaagatatgcttgtagtaggtgcaatttgaagaaattttcagttattgcagatcttagaacacatgagaaacattgtggtaaagataaatggctttgttcttgtggaacaaccttttccaggaaagacaagcttttcgggcacatttcccttttccaaggacacacacctgcaattcctctagatgaaac

SEQ ID NO: 11683 - DNA, 546 bp, Lycopersicon esculentum
  Predicted polypeptide sequence is orthologous to G2834
tttcagtaattgctgatcttaaaacacatgaaaagcattgtggaaaggataagtggctttgttcctgtggaacaacattttcgaggaaagacaagctttttggacacatttccctttttcaaggtcatactcctgcagtttctccggatgaaactaaaggatctgctgggacatctgaccggggccaaaccggtgaagtcaccatgaaagctcgacaagaaaactataaggtaaatgcttcacttggcaatgagtttcaaaatcccggggttgtaaaagagtgtccatacaatccaagcagttatttctcacctttgaacttcgatactagcaatcttaatggatttcaagagttccctcgaccaccatttgacgagtcagatagctcattctcatttctgctgtctggatcatgtgaataccctcctcacaaggctgcaaaatttatgagttctagtgaaatggaataacatcaaccagtattcaatttgtctttggttcattgtagctatttattctattatgtcattattatattttcagagt

SEQ ID NO: 11684 - DNA, 667 bp, Lycopersicon esculentum
  Predicted polypeptide sequence is orthologous to G2834
gaaaatttagggtttcttgaaaatgattcaaggtacaagtagtagtgctaataatccacaaaacataccatcatatttattatatttattatcctaataataatattcaagaagatatattttcttcttcttcttcttcttatcaacaaaattcatttttattcaacttatctcttctcaaagagaaggttcatcaagttcaatcacttgccaccatgttcattactccggataatcaaacgattattcaccctcctcctgagtcaatatctatgatcatcgcgaatatgggaactttgatccaagaaatcatcacaacttcttcttccctcatgttttcttgccaaaagattgtcctcgactctacctcactcagtcaaaattcaagtagatatcgcgaaccatctcaaaatgatgttggtcatggtcaaggtcaaggtcaagttgatcatttgctacaagattatgattggtatgtggataattacaattctaattgtaacacacatgaagataacaaaaaccatgttactagtagtagtactattatagctagtagtactattagtcatgataattactatagtaaagaatttggaaaaaaggaattattattgagtacttcaaaaggtaaagttgtgaatgaagaaaataattatgatattgc

SEQ ID NO: 11685 - DNA, 1194 bp, Lycopersicon esculentum
  Predicted polypeptide sequence is orthologous to G2846
gattcattttcatgtaatacagaaacacacaagtactattacgactagtcgagctttattcaaggagctagaagaagtatatttttaatttatttaggagtgactaagttatggctgatgaatatcaagcaagtgtttgtggaggaaactggtggaattcaagtagaagtatatttggttcatcactatgtgcatcttcagttcctttaggaaactctaattttgcatggacaaacgatcatttgttggatatgaaatcttcctgtaggtctaacgatgaatctggtaattccgatgaatctgtcgttcttcaagaattacctaaacatgattccaccctacaaatcttgggtagtggccttaattcttcatcaacaaatgataattggagtcataccttgatgcatggaaatgataggagtgaaagtagttatccttcaatactacagcaagaagatataaattcaagcatgaattaccaacaagaaagtggtgttgattgttcaagcaactcatttaagcaagatttcactttaggaatgaatcatccaatcactagctcaactaatactcatcatgatcaaatttcttcaacctttccaatgaattcatctttctctaattatccttcagctttacttcaaactttatttgataacgatcctcctcaacaacaacaattacaacaatctttgtttgctactaataacaaccaaccaatgaatttcccaacatcatccttaaactataggcctgatttgaatgacttttcaccttctatgcctaaattccctaattccttgttgataccaaaacaaactacaacaccttcgaatcattttccaaattactctcttaatgctactgcctctctctacaatacttcatcagccacatccttaaacaatatgcgcgctactcttatgccttctatgcatccacaaattctccagtcaccaacatttaacgacaattccagagctcctaacgttactccaaagagtaaagttgaagatttaagagagtcgagggtgagtaagaaaagtgtgactaatgaagcaacattgaagagggcgagaatagagacaccattaccattgccaacttttaaggtcagaaaagagaaattgggggaccgtattactgctctccagcaattggtttcacctttcggaaagactgatacagcttcag

SEQ ID NO: 11686 - DNA, 509 bp, Lycopersicon esculentum
  Predicted polypeptide sequence is orthologous to G2847
ggagagatacaggagaagaaagattgcaaaatttgtgttgagagaagagggtgaagaataatcattagtcgagtagcaaatgatggctggaaaccctactaattggtggagcatgatcatgaatggaaacatgcatccacaattatctcatgatcatgatcaacataattcttcttcttctaattctaattctaattcttcacatttttatggagctcataatccaaatcaagattttcctcgttcattgagccaacttcttatgaatggattttgtggtgatgaagaaaagtttggtattagtccttttcatgccgccgggaattcggaagaccaaagtttgaattccgtccatccaacatcatcaacagctaattttagggttcctgttgctgatgtaaagccagaattgtatcatcatcatcatggccacaacgaatttcaaacatcttcatcgctacaagaaaaactcgaattagatactgatcattttaccaggcctttaattg

SEQ ID NO: 11687 - DNA, 278 bp, Lycopersicon esculentum
  Predicted polypeptide sequence is orthologous to G2847
gatctgcggagtagaggtttgtgtctagttccgctatcatgcacactgcaagttgggagtgacaatggagcagattactgggctcccgcattcggaggaggtttccggtgaatggtcacattaatctaacaagataaaaaaaaaaccaagttaagcgctagctagctataacatcatgatcactcaatctgcgaaaagtttaaggttgattgcttatgatgctatacattattctgctgtaatattatttagttaagctttcaatttccgtttacaac

SEQ ID NO: 11688 - DNA, 530 bp, Lycopersicon esculentum
  Predicted polypeptide sequence is orthologous to G2850
aaggaccagcaatactttggagactaataaaggtcctcaaaatgcaccaaaaaaatcaagagttgattcacgcgcatcatgtccaccctttaaggtgagaaaggagaaattaggagatagaatagcagctcttcaacaattggtagcaccttttggcaagacggacacagcatctgtactaatggaagctattggttatatcaaatttcttcaaaaccaagttgagacactaagtgtgccatacatgaaatcatcacgaagcaaagccagcagatcattgcatggaggtggtggagagatgaataatgaagaaatgaaaagagatcttagaagcagaggtttgtgtttagtgcccttaacatgtttaacttatgttactgaaggtggaggaggtgtttggccgccccctaattttactggaggcacttaaatttaggagtttcatttggccaactcattttctttatgtaatttttatcatttttgctttattaatggagcaaacttggtcattctgaaaaaaaaaaaaa

SEQ ID NO: 11689 - DNA, 609 bp, Lycopersicon esculentum
  Predicted polypeptide sequence is orthologous to G2851
aaagcaagagaaaagtaaagaaggaaagggaaaacataaaggaggaagaaaaaataataaaggaaagctactaagagtaataaagaaaaaggagggatagaaagacaaaggttctcaaaactccatcgttcaaaattctctttcttctctctttctttctctgtctctcctccaagtatagctagctacccttttatgtgtctttcctctacttaatcaagagtaagaaagacctctcaaagtttctccaaaaaaaaaaagactttatattggaaaggaaaagatatatgaaataaataagaaattgaagttagtttgggaaaagaaaatgaatagaggtgatgttatggagaaatcaccagtacaacaaattatgggtggaagccctaagtggtggaatatgatgaataatatgaggcctcccatatcatcatctcaacaagctgctgttgctgctactactactcatcatgttcctaattccttgttgcctcctaatattctttttcctcatttctcttcttcactagttcccatgtcatctactactaattcatggaatgatagtaaccaaagtcagctacctgaatcatggagtcaattacttct

SEQ ID NO: 11690 - DNA, 560 bp, Lycopersicon esculentum
  misc_feature (525)..(525): n is a, c, g, or t
  Predicted polypeptide sequence is orthologous to G2851
ggaaataaaattgcaatattggaccatatcataagagtgttatccttgttccttcctacacttaattagaaatgcaaaatataatatatagcatcagcaacagtcaaacctaactaacttatttgagagtgactgcttctgatgttatataatatatataattatcatcatcatgatcaacacatcagtatattatgcaacactaaaattgttacattaattattaattattaattataaatatcctcctcctccaagagctggggcccaataatctccaacagtattgttattgtcacttccaacatgttgtgtacaagatataggaaccaagcacaaccctctactcctcaaatcagcagattgttgttgagtgtgacccatgcttcctgctacattgcccatgtatggagagctcaatgcctgaatttgtgcttgaaggaatctgatgtatccaatggcttctgacaagacggaggctgtgtcagtctttccaaatggagaaacaagttggtggagtgctgntatcctatctcctaattactcttttctcaccttga

SEQ ID NO: 11691 - DNA, 1667 bp, Lycopersicon esculentum
  Predicted polypeptide sequence is orthologous to G2854
gcgtcaccgttccattttttttctctctctttcatacccctagggtttcatcttagctcgttcgatttcgcctgaaaaatgatgccacaaagtggagttgctcagccagcaatggcacctatgtcaatggatcagtatcagcagcaagctccgccgacgcagcagcaacaacaatggatgatgcaacctccgcaagctcaacaacctcaatttcaaccttcttggggtcagcagcaacaacagccatcgcaaactatgtctcaacagtatgttgcgactaattctagccctagctcgaatgttaatccaaatgaggttaggtctctttggattggggacttgcagtattggatggatgagagttatctctccacttgtttctatcacaccggcgagcttgtttctgctaaggtcatcaggaacaagcaaagtggccagtctgaaggttatggattcctcgaattcaggagtcatgcggctgcagaaactgttttacaaacatataatggcgccttgatgccaaatgtggaacagaatttccgtatgaactgggcatctcttggtgccggtgagaggcgagatgattcacccgagtacacaatatttgttggtgatttggctgctgatgtgacggattatgtgctacaagagacattcaaacccgtgtattcatcagtaaaaggtgcaaaagttgtaacagatagaattactggacgtaccaagggatatggatttgtcaagttctctgatgagagtgaacaattgcgtgctatgactgaaatgaatggtgtactttgttcatctaggcccatgaggattggcccggctgcaaacaagaaaccaatgggtaccccccagaaagctacctaccaaaatcctcaagctactcaaggcgaaagtgaccccaataatacaactatatttgttggtggtttggatcccagtgttgcagaagagcatttgcgacaagttttctccccatatggtgaattggttcacgtgaagatagtggctggaaagcgctgtggctttgttcagtttggtagtagagcttctgctgagcaggctttgtcaagcttgaatggcacacaattgggaggacaaagcattcggctttcttgggggcgtagcccctctaacaaacagtccgatcaggctcaatggggtggaagtgccggtgctggtgctggtgcatattatgggtatgcccaaggatatgaggcttatggatatgctcctcccgctcaggaccctaatatgtattatgggaattacccaggatatgggaattatcagcagccacagcagtgaagtttaattattttcaaggaggctaagaagtagacgacgttcaaatttccagtgcttaggctgatctttcccgtcggtgtgactggttgtacaatgaatttgataaactgagtgattgtgagtttttgtgggacattttcttttctcctgtctgtaacttgagtttgctattacactaacgtgtaccgaaacattccaaactgtaccttgacctgtgtgtagactctgttaagttttttcttaccaaaaaaaaaaaaaaaaaaattgcatttggtttgcttgtgagcagcatctagtaaatgtgatgcttataattgacgaaacaaagatggtagagaaaaaaaaaaaaaaaaaaa

SEQ ID NO: 11692 - DNA, 608 bp, Lycopersicon esculentum
  Predicted polypeptide sequence is orthologous to G2854
gccgaagccaccgttccccccctctctgaaccccatttcatcacgatgcaaccagcgaattccatggttccaccaccacagtaccagcagacacagcagtggatggctcagccgccgccgcagtatcaggttgcgcctccgcagcaatcgggatattactaccagcaacctcagcaacagggcggagttcctccaccccaacaacaacaacttcagtacaacgcctctggtttggctgctactgccggttctgttcagccgactagtgctgatgagatccgaagcctttggatcggagatctacagttttggatggatgagcaataccttctcaactgtttcgcacaaactggagaggtgacctctgctaaagttatccgtaacaagcaaagtggacaatcagagggttatggctttattgagtttattagtcatgctgctgcagaaaggaatctgcaagcatataatggtaccttgatgcctaatattgagcaaaatttcagactcaactgggcttcactcggttctggtgaaaaacgttctgataatggtcctgaatatacaatatttgttggtgacttggcagccgatgtttctgattatatgct

SEQ ID NO: 11693 - DNA, 738 bp, Lycopersicon esculentum
  Predicted polypeptide sequence is orthologous to G2854
tttttttttttttttttttttttttttttttttggagcaacgagcaaaatagggtgttcagcattgccaggatagccaaaaagcacaagtatacagttacatgcctacacttctccaaagaccttcaagtatatctagatctcatatctaagtaataaaagggcaacgcaaaaataaaaaaacaaacagcatacaatcagttgatcgaaaccataaattgtatcctcaatgaaatagcctacaaaggtttccaacaccctaagattgtgaaatacacatctggatcccaactgataacctcatgtcccgcttttgaaatcaatacacaaatcacgccgggaagcactcagtaaatcctttcaccagcatatatcactgaggatgctgcaaaacttgctgctgctgttgaggttgtgcgtaatttccatatccagcatagcccgcataatactgatttggatcctgagcagggggggcataaccataaccttcatatccagcagtatacccataataaccagcatattggtttggatcaagctgaggctgctgcttgtttgcaggacttcgaccccatgaaagacggatgctttgtccacccagctgagttccatttaatacccgtagagcttcctcagcacaacttctgtcagcaaactgaataaagccacaccgcttgcctactggtatttttacatgaagcaactgcccatagtgtccaaaaatctgccttaaatc

SEQ ID NO: 11694 - DNA, 604 bp, Lycopersicon esculentum
  Predicted polypeptide sequence is orthologous to G2854
aggccgccaccgcgtgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttggtggagacttggcagctgatgtcactgactat

SEQ ID NO: 11695 - DNA, 600 bp, Lycopersicon esculentum
  Predicted polypeptide sequence is orthologous to G2854
gcgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatg

SEQ ID NO: 11696 - DNA, 723 bp, Lycopersicon esculentum
  Predicted polypeptide sequence is orthologous to G2854
ggccgccaccgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgcagcagcaatcggcgtattattaccagcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactacccctcagtcaagggtgcaaaggttgtgactgatagggtcactgggcgcacaaagggctatggggtttgttaaatttgcagatgaaagtgagcaattgcatgctatgactgagatgaaatggcaagtctgctccactagggccatgcggataggccctgcagctaacagga

SEQ ID NO: 11697 - DNA, 364 bp, Lycopersicon esculentum
  Predicted polypeptide sequence is orthologous to G2854
tcaggatccaaatctatattatgggggttacgctgggtatggaaattaccctccacagcagcaacaaccacagtgatctctgctggttaaaggagtcgacgaaagcttcctagcacagtaatgcaacgatgtagaaagggaggggcatggattcgaagtttgcatcagatttagtataagataaactactgtaggctggttcttgaagatcagtatttatggttgtgttcaaccatcgcttactttttcattagttaccttctgttatttttcattggtttttttgttgatctttttggtttttgcgcttttatgtttacttttcatgagtcccacttggtacttggatttttgttctagttgg

SEQ ID NO: 11698 - DNA, 755 bp, Lycopersicon esculentum
  Predicted polypeptide sequence is orthologous to G2859
tttgattattcggttttgttgggggcagtagctcttgtgataagagtggttaattatcagtttaagctgtagttcatttagcatatgaatttggttgttttcaacttctacaatcagtatagctgcacaactcttgcgagtcttaaacttggatgaacttgctttgttgttttccactgtttaagggaagagcttgccatatatgttttagactgagcttaacctacaattttcctcattgttgtttcttgtttgattgaatcataagagttttgaatagattaattcattatgcttcgaatgtctgttctctcactctatttcttaatgcatcgatttttacttctatttcacattaaagtcgatgagttcttagctttgttctgagaaatattaaaatttgttaaagaatgactaaagtcccacatcgatggttaatgagatgggtggacggactccttataaaacttggacaactaaattcttgtcccttccctatatctgtgccttgtcttctcatatcatttattcccatgattttcttatcagtgttccatgttgctagtttctatcggaatttggaactaattcttatctgtttttgttttgttttcttaccaaatcccttttttgagtccaaatagattctgtctcgatatcttgcacctcccaatggttcatatttctcgagtcagccccatggcaaattgtgaaagtcggtgacaggtctttggaagctgatacagggtttcgca

SEQ ID NO: 11699 - DNA, 471 bp, Lycopersicon esculentum
  Predicted polypeptide sequence is orthologous to G2865, G2934
gcaccgaggttcaagatttcccagatcataccagtctaacaaacatatcttttttttttgtcaactaagtagtaattaatcagttcttgtatttaaggtcaaaactgattaattattggtattaatggataatttccattcaatatttcctttacaaccggatgatgatgcgaattatgattcccatcaacaacagctcatttttccacatgaaacctataccaacccttgtaatttcatataccaacaagatctggtaaatgattttgcttcttttgattcattggagttaagagacaacaatcttacatttaacaacaatactaacaacaatcagaaagggaaatcatgtggcgttgaggataagaagaaacacaagaaagtgatgcatagagaaattgaaaggcaaagaagacaagaaatgtctactctttatgcttctcttcgtcaacaacttcctcttgaaaatat

SEQ ID NO: 11700 - DNA, 572 bp, Lycopersicon esculentum
  Predicted polypeptide sequence is orthologous to G2865
ataaatgcagaaaatcctttattttcatcattgctttatatacatcgcaattttcaacaccagaccattagtgaaattaagctgtaccaacgcattctctacaaacccccaaaaaccctactgccaaattttattttatttatttttaataaaaaaagtctaattactgccaaattttatttatttattttttaaaaaaaaaataaatctaattttgacaatatcagaccatgtgcctcatggtaaaaagcttgtagaaatgcagttgcatgatatgttattaattgtaaactgagaactataagtccaggttgatcatatcaatcactttttgttgcaatgccaagtgatcaatgttgttcatatcacacgcctcagtgtgaattgagtagagtgacctttgatccgcttttgcagaaacacaactcaccacattaagcccttgtttcaaaagctcacccagaatttttgaaagaggaaaagttttcccttcacaatcgacgctgattgagatctctataccttcctgcagccaggggctaactgtgacagtacaatctgtgaatctgtta

SEQ ID NO: 11701 - DNA, 542 bp, Lycopersicon esculentum
  Predicted polypeptide sequence is orthologous to G2885
ggggattcctgcatctttggagcttgatcaactgcagcagagcaagtgtgccacacacataggagagttgaatcctttggatgagtcaggactgcatacagtggccagtacattcacgaactctagattggttggtagcgcaaacagctctatgcccaatgtatcaaataatcctattttgcttcaagtaaattcccagcaaccactgacggggatgggatttggaaatcagacttctctcaacgtagcctcttttagctctgaggccttcaatactggtgtaagtggttcttccaattttctggaccatgatagatattctaacgagaattggcaaacttctctccagcctctgaagttccagtcaacctcctttccgttaaatgaacctttcagcaacagccatttgcctcaagacagagtacgagacaatgatacttcaactggccctcatttgcagaacaatcctgttgatttttcaacctccaccatagtttccgtacctttcgaagcttcaagaggagaaacacaatgccgtgaaa

SEQ ID NO: 11702 - DNA, 229 bp, Lycopersicon esculentum
  Predicted polypeptide sequence is orthologous to G2888
ccagagccaagttgtgtgcaccatgatccatgtcatgcattaggtgatcttgttggaatcaaaaaacattttagaagaaaacgtgacaattacaaacaatggatttgtcaaaaatgcaacaaaggttatgctgttcaatcagattataaagctcacatcaaaacttgtggtactagaggccattcttgtgattgtggaagaggtttctctagaggtggaacatttattg

SEQ ID NO: 11703 - DNA, 613 bp, Lycopersicon esculentum
  Predicted polypeptide sequence is orthologous to G2893
aagatattggaggcaagtaatttcactttttcttgtaattcacctcatgttctgttttaactttgcagggtaaacacaaaagtctatgcagtctaccagataacatgaaattcttttgcagaaagctgggattgacatgcaaggtcttggtgctcctgagatacttcaaaattttcactcccaaccgagctgcatagaggttagtggcacatggagctgccgttcctgaatatttctatgcaaacctaaagcagtaaagcgaaggatgccaatctggttgaatctccatgcaaattcaatcccttaaagcatgctaatagataccaggttgattctgttccatgtgttatgcctgatgtgcaaacggtcaaatgcaagttcttagattgtagacagaagcaaaggcaaaaaaaggggttatttcctatccgcctaacccctggtgagaagaattatcgatacctttgctggtggaggtgacaggttttgtggaatagtcgaggtgtgcaagttggcctacacaccaccagtgctttcacaaaggaattcacaagagcaaatacatttgagagttgacactgtgataaggggtatgtgaacttcactacacgaa

SEQ ID NO: 11704 - DNA, 491 bp, Lycopersicon esculentum
  Predicted polypeptide sequence is orthologous to G2898
gccctaatcagcacagaaaaaataattctgaacgcctgaatatccctgaggccgacgagctcgaccccgtctcgtcgtctatcaacttacgtcaccgttcatagcttctggaaccctagtataatcgacatggtcgaggttgaggcttctacacctgatctcaacgacaaagcctcatctcctcaccacacaatgacaatggtgcctactgaaggagaattttcaataggaaagaggaaggatcaaggtattagtgaacctgaagggagtagaaaaaagaagaaaaaacaagtagccactcctcgtcctgcttgctcttgggtgcacttcagccgtgactttattaaagagtatagtgctacacatcctgaatcttcaggcctgaaagttgccacaaaggcagcatcagatgcatggaagctgatgggtcctgaggagaaggcaaagtacactactcgtgctcgtgaagtgtgggataagtacctgagctc

SEQ ID NO: 11705 - DNA, 579 bp, Lycopersicon esculentum
  Predicted polypeptide sequence is orthologous to G2898
gcaaaagctccatgacatcaaccaaaagggtaaaattagcggagaaagtaaaggcaggtggagtgaagcagagtaaacccacatcagggaagaagaagaagacagcaaaaacagatgcaaagaagcctaagaagcccccaactgccttcttctatttcttgtatgtaccacatatctttgttttttctgttctatttcaaggaacccttgctttaaactccatagcgttagttattgtcatagtagcatctaaaattttgatacaccaatctaatttgtgtttgtacttggtcaattcatgaaactccactttgggttcaggtttggtctgtcaaatcatcagcttatgagtaggtcaagggaaaagctcatgtctgttgtaaatacccccacactaggttgtcgaatttgtacttgtatttacaaattttaataagttgttttatcttcttagaataaaaatagggcttagtgtaataattagtttatgcatcttattcatatttttggactctttatttcccccatgatatcattgtttggtgaggaacaatcggaaatatagtcacagttctggtg

SEQ ID NO: 11706 - DNA, 443 bp, Lycopersicon esculentum
  misc_feature (17)..(17): n is a, c, g, or t
  Predicted polypeptide sequence is orthologous to G2907
gagaactagtctcgagntttttttttttttttttttttttttacctttaaatctcaaattcttgtcaatctgcacaatggatttttgattttcacatttacaaactaattagtgcagcctatgtatacaacaactctaacagccatggataacaaatactaatcccccaatgggatattatttaccccaaactccagggggcggaaggcttaaaagattcttctcccattaattccccaaaaccaatcaaacctcctttgaaaccaccggcttcccctaatttgaacctggcggcagaacaatggggttcttgcttgtcgaacacaaaattcaccaccctccaaaacgggcccctaccccccgggaattgaaccatcaactttaccctttccaaagccttctgcaacctttcttcagttggctttcggccttcttttaaaaaa

SEQ ID NO: 11707 - DNA, 734 bp, Lycopersicon esculentum
  Predicted polypeptide sequence is orthologous to G2933
gatcatcacaaaaatacaacgataataactacgcctcaatttcaaactgatcagaataacaagttgtttgaaggtttacgtgccgataatactattgatttaccttcatctcatcattatcaacaacaatgtttgaaaggaagtgagtttgatgttgatgagttaggggtagaaaggtcattaatggagaagaagctaaatcataatgcaagtgaacgtaatagaaggaagaagatgaattttctttattcaactcttcgttctttgcttcctcctcctactaataaacatcaaaagaaaaaattaagctttccagcaacagtatcatatgtacaagaatacatcccagagttgaagaaagaaatagagaggctaagcaaaacaaaagatttgcttttatcaaagaaatcaaattattcattactcaaaattgatgataataataagagaaaattaattattggtggaacttcttgtaattcttcaacaacatcaatttgtgcaagtcaactaagtaattcacaagttttggtacaaatttcaacaactcaagaaaataattttccaatttcacaagtatttgcaagtgtagaggaagatggattaattttgctaaatgcatcatcctttaaatcttttggagacaagatttttcacagcttgcattttcagatgcaaggaccaattgaaatggacattcaggttttgaagactaagcttttagtaatgtgtga

SEQ ID NO: 11708 - DNA, 594 bp, Lycopersicon esculentum
  Predicted polypeptide sequence is orthologous to G2964
gcatctctttcgttttgcccttcgtcttctctgagattttagggtttcgatttctgcaaattcgagttcttctgttgcttcaatggagttcgatggtggtcgaaaacgtggaaggccacaaggacctatgaatggcaatggtggattcaagaaatctaagcaagaactggagtcaattccaactggtataggaagcaaatcgaagccgtgcactaagtttttcaggttctaatcttaactcctctaaaatataagtacttgaagtgtagtttattatttatttctagtttctcaaatctaatcaagaatatttttatagttattccaattattcaaaatccatttggactaatgttttggtcatctaaagttgtgttacaggaataatagttgttaagttgaaaacagctgttgaaatgaaatgggatgattttgagaaatgttgaattaaaaacatgtgcaggttatgcaatgctaaaactgattagcggggaaaaaacttctatctcgtccgccttttcataaaccagtataatgattgggatacactcgatcatattgacaagtaaatgcagcgttaatgttgctatataa

SEQ ID NO: 11709 - DNA, 605 bp, Lycopersicon esculentum
  Predicted polypeptide sequence is orthologous to G2969
gctgttccatcttctccccttctttatcctcataccaaaatcactcttcaaaggagcgaaaacactcttccaatctcaattcttcgcctccaccgacgtctactcgtatcaaatcctcaaccaccaacgctatttactcttcatggtcttacatcaaacgtattttctcatccaataaacaaaaaatcaacaacacccaaactcacaataacccttcaattcaatctccctgttcttcaacaaggtccctgcaaaaacccatttcatcagatgacctaattaaccgctccgtttctccaatacccgaatccgaaatcacctccgatcaattattcttccctttacgaaacgatatctacccatgtactttatgtggggaagtattccaaagccccattcatctcgaacaacaccaatcgattaaacatgcaatttcggaactcacggatgaggattcgggtaacaatatagttcggatcatttttcaaacgggctgggttgataaagagaaaaacccggttatcaatcggatccttaagatccacaacagcaaacggatcctatcccggttcgaagaatacagagaatgcgtgaagctgaaagct

SEQ ID NO: 11710 - DNA, 956 bp, Lycopersicon esculentum
  Predicted polypeptide sequence is orthologous to G2979
gctctctttcttcaaagcttgagcggtttatctcgaattttccgtagggttcttctctgatcgctttcaactttcgataacagagaaacctagcaatgtcatcgtcactccatactgaagattctcaatggaaaaaccctagcatttatagccgcaaggacaaatcgctcggtcttctttgctccaagtagaaatgtgtggaggaagctgatgatatgccttaaaaacataaaaacccaatttcttgaagctatgtgatcgggaaggggtggactccaccattggtttggacaatgctgcagatcaattaggtgtcgagaggcgtcgcatttatgatattgtcaatattttggaaagtgttggggttttgtcaagaaaagctaagaatcagtatagatggaatgggtataatgcaatttctaaggctgtagatttgcttaagaaagaaggactaaaagatctgtccactgtctcctccacttgccacaatgtttcaaatgtcatagcttgtaacaattcagatgttaaggaaaaaggagaaggcaagactgctggatcacataaaattgacaaccggaaggagaagtctttgatgattctagcacaaaattttgtaaagcttttccactgttctgatgttgacttgatatctcttgacaaggctgcatcagctttgcttggtgatgtccacgatccgatggctatgaagacaaagaccagacgcttgtatgatattgcaaatgtttttgtgtccatgaatcttattgagaagatacgcagcccagataatggaaaaccagtgtttaggtggatagcctggaaagaaaatctgaggagtgggtcccttgcatctgctaaatcagatgattcaacaaggagaacttttggggcagagatcacgaatacaactcccaaacgatacagggatgattcttcatctgatgtaatgtcaaatg

SEQ ID NO: 11711 - DNA, 1153 bp, Lycopersicon esculentum
  Predicted polypeptide sequence is orthologous to G2981, G2982
ggtcatggggaactactgtttctggtcaatcggtttctactagtagcagtattgggtctccatcgagcagaagtgaagccgccatggctacccctgccagtgacaacacttttcttaggctaaacaatcttgacattcatgctgatgatgcaggatctcaagggacagctgggaaaaagaaaagagctcagcgtgctactggaggggataagagtggtagaggactcagacagtttagcatgaaagtttgtgagaaagtggaaagcaaaggaagaactacgtataatgaggttgcagatgaacttgtagctgagttttctgatgctaccaatagtgttgcaggctcagatcagaaacaatatgatgagaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcttatttagaagaacttgaagatcaatatgtagggcttcaaaacctcataaaacgcaatgatcagttgtatggctcaggcaatgctcctagtggtggtgtggctttaccgtttattttagtgcagactcgtcctcatgctacagtcgaagtggaaatatcagaagatatgcagctggtgcatttcgacttcaacagcactccgtttgagctgcatgacgataattatatcctcaaagcaatgaatttttgcggaagatcaaatgacggttctgtcccacagaatgtatctgctgatggaggtgaaggtccgagttccagtatggccaacatgtttcagcatcatatccctaatccatctgccccaaactcatctggcaggcttccgacctcacctcctctccccggaatactaaaggctcgtgtcaagcatgagcattagtcttctggcttctttcttgatcgattactgtactcattaacgcatagtatttctgtacattatgtaaagtatttttactggaagcagcctcctctgttgactaaatacttctcttgacccttgtctcaatttgagggaggttactagttgagcttttaaatttttttgct

SEQ ID NO: 11712 - DNA, 993 bp, Lycopersicon esculentum
  Predicted polypeptide sequence is orthologous to G2983
ggctccatgtacatgggatcatcatcaggaagcttaagtatgaaggtgcatcaattcacacgtggattcttagagcatgaagctgcttctccttcacttacacttggttgcaaacgtttaagaccacttgctcctaagctcaacacaaccaataatgataccacaactaccattgttactcctccttttgatcttaagagtttcattaggcctgaaagtagcaatagccctcctaaacttgcttacaatgaagacaagaaagactcctctcaggtggaatcacacccaggaggaacaagatggaatccaacacaagaacagatagggatacttgaaatgttgtatagaggtgggatgcgtacacccaacgcacaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactaggggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttgtttccttttcttttatttttttccttgttttgggaaagagaaaagagaaaagagagacatatgaatcatcaaatctatgtagtaccaattcacttctcttgaattttgggcattttagtgaaaaaaaaaaaaaaaaaaaa

SEQ ID NO: 11713 - DNA, 561 bp, Lycopersicon esculentum
  Predicted polypeptide sequence is orthologous to G2989, G2990
gcataaacaaaaacctaaaaaacatccttcatttctttttcatccttttgtcttctcacttactaaagtccccctttcattttttttttcttccttcttattaacctttttttcctatgaataaagataattctttttatttttttttggtatgaaatcatcttgaccttaaatttaatcatctactaactcttttaactcaaaaacaaaaaaaaagaagataaaaaagagtgttagatgtttcagccatggagttaaccaacaacaacaacacaactattagtactattactactactactacagtgaaaaccccagaagctgaaattgaaaccccaactcagatccagaaactgaaaccttttccttttagtaatggtgttctgaaaaggaaaagttcatttaaccataacaatcatcatcaccctgttgtggttatttacagagagtgtttgaaaaaccatgctgctagtttagggggtcatgctgttgatgggtgtggagaatttttgccgtctcctgcagcgaacccatctgacccaacttcactgaaatgtgctg

SEQ ID NO: 11714 - DNA, 639 bp, Lycopersicon esculentum
  misc_feature (591)..(591): n is a, c, g, or t
  Predicted polypeptide sequence is orthologous to G2989, G2990
caaaaaccaagatttttgttatctatagtcataaactctcatcatcatcaaaactcaaaatcccaaagaaaaacaaacccactttttttttttcttctctttcttaacatgctttttcttttcattttcttaatcatctaagttctaagagtgaggggaaaaaaagaaaaaagataagtagtagatgtgtttcaggtatggagttaaacataaacacaaacacaacagctgctattactaccgtgaaaacaccagaattagctgaaactgaaactccgagtcggatccagcaaccgaagcctttttcgttcagtaatggggttttgaaacggaaaaatcatcatcatcctgttgtggtggtgtacaaagaatgccttaaaaatcatgcggctaatttagggactcatgccgtggatggatgtggagaatttttgcctattccagctgcgaacccagctgatccaacttcactaaaatgtgctgcttgtggttgtcaccgcaattttcaccgccgtgaaccggaagaaccgccgcctatcgctaccgcggctattgagtaccaaccacatcaccgccatcatcctccgccgnctcgtggggaccacggtagcccgaattcaccatctccaccgccgattt

SEQ ID NO: 11715 - DNA, 382 bp, Lycopersicon esculentum
  Predicted polypeptide sequence is orthologous to G2993, G2994
ttttttttttttttttttttttttttttagctgaaaattttcagatgaataaaggttccaaagtacaacaattaataaaaataaaaatctaattaagtggttccatatagttacaataatactacatagacccccccaaaaaaaaaacaaaaaaaactagctacgtacgattcctagtaagattacataagcataaaccaaatcccaagaaatttaatttcattttttccctcaaaaccttaattaaacaaaattaattaaggttgatcttcttgtattatattttttttagcagaagaagggttcttattattatgcatccaaaccttaaaaacctgtctcttgactccaacttgtgagcaaaatctttgtacttcagcat

SEQ ID NO: 11716 - DNA, 749 bp, Lycopersicon esculentum
  Predicted polypeptide sequence is orthologous to G2994
gaacaaaaacactctttcccctttgtctctcttcacttcattcctttgtttatttttttgtctatctcatcttcttcttcatcatctctttcattttatattatccccaaaattaattcccataaaagaaaacaaaatcttgatcattttttatagtttttgtctcttgcttttgaaatcttaaagaatctcttcttgatcttttctagtcttttttcaagaaaacaattttgcaagtgtttgacccttttctccttcactttcaagaactcaatttttaacaatgatcttattagtgcttcaaactttaattgttctacattcccatgatgaatatgttgatgatgcatgagagggtcaataatgtattatttcctagttgtttaaaaaaaaagagtggtgaaaatcttctaggttttttttttttttggttatcctactttttcattactagttgaagtcagccactagtttcaattttaatcattttagtctacatagctcttgctacacctataccttaggttgtactaattataataagttcctatcttgtcccttttggtctccacataagtacaaaaaattttcttgaaagaggttagaaatggaacttccaagtcaagatcatgaggatatgccaataccaattaacagcacatatggacatttgatacatcatgatcctacaccacccaacaataccaatcacattataccaccttctatgaatggtcctccaattgatg

SEQ ID NO: 11717 - DNA, 672 bp, Lycopersicon esculentum
  misc_feature (672)..(672): n is a, c, g, or t
  Predicted polypeptide sequence is orthologous to G2996
tggagactgatctttttttgtttttcaacaacgaggaaaacagctccatggtctcactagatagaaataaggtcttatctgcatacattttatcatttttcatatcttatttgggagattatactgaatatattatcattgcaaccagcttatttacatacatagtgccccaaatacaaaataagtgcttaattactcaatatctaacattaatattaacaaaaatacctaaaaataatgggatctttttttttgtttgtttggttctagggttttttaccaagtgtatgcttgttgttatgcatccaaactttgaacacttgccttgtaattccagtctcattgcacaatggctgcaccaattcttcatcttccctttggatcctccaacctaatttatcacccaactcttgcattatatgcttctgaacttggctaaatttcgcccgaaaacgctatttcgaacctcccgctgaattcgggcgggaaatgagctactgaggctcacgatttcaccggaagtcgttttcacagctaccggccgttgtttggccccccgggtactgtaataccgccagtggcggtagggtctgagtacgtcgaagtgattttggggggtaacaaacgatcggttaccgccatccgctaggatgtgtaaaggcggggcatttn

SEQ ID NO: 11718 - DNA, 801 bp, Lycopersicon esculentum
  Predicted polypeptide sequence is orthologous to G2997
ttgatgtccacaccctcttctttctcttatcttctcttctgatcttcatctttctcatcactaatcattttcccctttctcttttttttttcttctctcactatcaaaattctctaaatatacaacaaccccactttagatctattttttttctttaacttgagatgatgtagatttttatttttttgaaatagtcaattttttaaaattaattcataatatatataaagtgtgaaagaaaagaaaaagtgtgtagttaggtagttgagaagtgaaaattaagatggaatttgatgatgaccaagaagagcaggaacaagaaattggcgctgtgggagcggaaaattatgtaacgacggggaacaatagtggaagagaagaagggatttccactagtagtattggtagaaaaagtaatgttaggtatagagagtgtttgaagaatcacgcggtcggcataggtggccacgccctggatgggtgtggcgaatttatgccggccggtgaagaaggtactatggatgcacttaaatgtgcggcgtgtaattgccataggaatttccaccgtaaggaagcggaaggtgaggtatttcatcataccccacctccccaccttactcatcaccaccatcaccatccccaattttcacctttttcttcttatcgaaccacccaccatccatctggttacctacatgttaacccacccccacatcagcgccctttggcgctgccatctacttctagggacgacgaagatatgtcgaaccctagtagtagtgggggtgggggtggagggag

SEQ ID NO: 11719 - DNA, 885 bp, Lycopersicon esculentum
  Predicted polypeptide sequence is orthologous to G2997
tttttttattcatatggaagaaaataatttaaataaagaaagtaccaaaggtgaccgactgactcactaacaatgtctagctagtacgtacttgtaactagcaaccctaaacaagttacttatcatcaaaatgttaataataatcataataatagtactctcttacaacaaatccttggcttaatgatgatctaattaattaaaactagcttccttgttccaatttttttttccctcctagctagctccatcaaatagatactacatatgctttgatttacttttttttaccctataaaaaggtgaaaaagcaaaattaagcaaaatttttagttttagggttttttaccaagagtgtgcttgttgttgtgcatccaaactttgaaaacatgtctcttgacatttgtctctgcacaaaactgctgcactaatgcctcatcttgcttttgcatacgccaccccaatctttctcaccttccgcttccttacggtggaaattcctatggcaattacacgccgcacatttaagtgcatccatagtaccttcttcaccggccggcataaattcgccacacccatccagggcgtggccacctatgccgaccgcgtgattcttcaaacactctctatacctaacattactttttctaccaatactactagtggaaatcccttcttctcttccactattgttccccgtcgttacataattttccgctcccacagcgccaatttcttgttcctgctcttcttggtcatcatcaaattccatcttaattttcacttctcaactacctaactacacactttttcttttctttcacactttatatatcctatgaattaattttaaaaaaaaaaaaaaaaaaactcgagactagttcc

SEQ ID NO: 11720 - DNA, 586 bp, Lycopersicon esculentum
  Predicted polypeptide sequence is orthologous to G2997
gagaagaagtgatggagtttgaggatcaacagaagcaaagagatgaagaaatcgcagctgcaccgcgtcacaacgactcactcgacaactccgacttaacaacaaaaatgccgccgagtcctcaactcgagctcgagccgttaacagccgttcagctctggacaaacaacaagccaaaatacaaagagtgcctaaaaaaccacgccgtcggtatcggcggccacgccgtagacggctgcggcgagtttctccccgctggcgaagacggctcaattgattcactcaaatgcgccgcttgtaactgtcaccgcaatttccaccggaaaattgcaccgccgcctatcgccgccgccgccgccggcgtcggcggtgaaccggttccgtttgtttaccactcacataatcaactgccgacttactacagaaccttaccgccaccttgcgggtatttacagtaccacgtggcgccaaatcagcggccgttagctttgccgtcgacttccggtggatatcgtgaggatcaggaggacatttcccacccaaattacagcggaggttcgaagaagcgttttcggacgaaatttag

SEQ ID NO: 11721 - DNA, 499 bp, Lycopersicon esculentum
  Predicted polypeptide sequence is orthologous to G2997
gtttaaggaaccatgcagccagccttggcagttatgccactgatggctgtggagaattcacacttgatgacaccaacacttcacccggaggcagcaccagtttaaactgtgctgcctgcggctgtcaccgtaacttccaccgcaagttcagttgcggtggaagttacagcaacaacagtagccgcgatgatagagaaatcatcgcggctcatgattaccgtctggcgactactgaagagtcgccagcggtgtcagagaggagcggtaagaagaggtttaggacgaagtttacgggagatcagaaggagaaaatgctggcatttgcggagaaattgggatggacgctgcaaaggaaagatgaggaaaacgagactgagagattttgcagagagataggggtaagtagaaaggtgtttaaagtatggatgcataatcataagaataattcttcctctgtatccagtactgttactggcaataatgcatcatctcttactcc

SEQ ID NO: 11722 - DNA, 1059 bp, Lycopersicon esculentum
  Predicted polypeptide sequence is orthologous to G2998
ctccgattgaacaaacatcgccattcattaatttattaaagatgatattaaaaaattcaacatactttcaatttttcttggtcatgaatcttaaaaacaatttattgacgtttatttattttcacaaaaatctcaaaacaaatggagaataacagatgataggagattaaatttgaaagggaggtttttatttttgttatggtggccggggttactgggtagaggaatggataaaggaagaagaaaggttaaaaggttaggtgggggtggggattttcttttgttaatatttttgtgattaataaataaagggaaactatttttcatttttttaaattaaaaaattatattttattgctagattgggtccatgtgccaagtgtcataattttatttgtcatttttttaagtcaaagcgcgtgaactacacacaaaatatttttaaaaaaagttttcgttttatgttcaatagacacatattctttaatattaaagtgtctaataggtaatagtcttagttgaggtgtctaagtgaattatgcgaacaactttaaggggtcgcatatgcattaagccttgaattagtgtagtactatcctatctcatcaccaacccttcagtgttcccatatttttatcatatcttgatttatatgtcatctttcaaaattacattagcacccatctttcatttaaagtgaaagattagtcatgacaagagaatgaaaatcttgcacaagatgaaggttagtgatctgaataattttgttccttgttttgattgcttaagctatttttagatgcttaaccgtattactgaatgatacagggtatacatgtcaagtgtgtgtatgtatttgactggaagaaggcccattttgtgttgatctcaaggttttgtgtcgttggtcattgagttcttgttgaatttatatgatgaatcaacatcagtagaataaattagataatagcagcaagtctgtactgaattctctggtgtatgctattaaacatgagtgaaaataacctatttgtacagtaaaaaaaaaaaaaaaaaaaa

SEQ ID NO: 11723 - DNA, 642 bp, Lycopersicon esculentum
  Predicted polypeptide sequence is orthologous to G2998, G2999
cagaggccaagaaaaggatatgggcttgcctaatcccaatcccatgagttataacccatctcaacttaaccagcaagaatcatcttcctctgcagcaaacaagttccttaccgcaccaaatagaacaacaaatgaacatgagaataccatttttagccctaaccaaaccctagatcagcataatattactcaaaattcagatccagatccagttcgacaactatctactagttcagcaagtgagaggaatattacccccgtccggtacaaagaatgtctcaaaaatcatgctgcaaatttgggaggatatgtactagacggttgcggagaattcatgccaagcggagaagaggagacactagaatacctgaaatgtgcagcttgtgattgtcaccgcaattttcataggaaagagactgaggacgaatcacaaacacctggtgtgcatagaaataaccaccgtatacccaaccaaactccgccttctcttccagctgtgcctacgcagcaacaacaccatcataaataccctcacagctatccaagaggtcacatggcaccagtaatgatgagtttcggcgggaacacgggagttgcagctgaatcatcaagtgaagatctgaatatgtttcacggaggaca

SEQ ID NO: 11724 - DNA, 584 bp, Lycopersicon esculentum
  Predicted polypeptide sequence is orthologous to G2998
gggtcgtaggcctcagaatagctagccgtatccgtaggcgaccccgtacaactgaagctcctgctctgaacactctcccgttacgctggatgaggaagccgccgatttaaaggtgataccagaagcaagccgtaagttcaagcgcgcaaggtaatcaaaggagcactaggtacgcatcaaaaggacagaaggcgacgaactagggtataaataccgtatcggatagcaccccgaccaccggtatcgtactgataaacgcgccgtcgtgaagccgcccgattactctaagcaataaggacacaagccgccgactttccgtaacccactcctcccccggccgccgaataagctaccattacaccaccttctatcgcgtcgaagatccgcaatttccctaactaatccggccgtcgtacggaaaaccccgaatcacgtatactccaaaaagcgaccaacaaactacatctgcgggccgaaccggatttccccacctgcctgaaaaaaaaaaaaaaaaaaaaaaaaatctgagggggggtttggtatttaacctgtttcacagcgagctgcaccataacctatcggtt

SEQ ID NO: 11725 - DNA, 724 bp, Lycopersicon esculentum
  Predicted polypeptide sequence is orthologous to G3032
gctcctctctctcttccctcccgtctctcctcttcccgttcctctcctctctctcttcccctcccatctctcctcttcccgttcctatcctcttccctttccttttctctttgcaggtagcagcaaccggcgacagccaccacgcagcagcagccggcgacagccaccagcagctgcaacaaacagcgcacgcagcagcgaccaccggcgaaaccaggagcagcaacagcttcttcagcagcccagcgccacccgtctctcctctcttccccgtctctgcctccctcccccttcttttaccttttctctcttctattttttttaaaggaccagcagcagcttacatcggccagcagcagcagcgacaaaaactataaagcagcgacctcctatgtcgcgatatctccggtcaacgagcaaggcgaactccggatgaacccattgaaggctccaagttggtcgaaagacggatcttttaacagattcgtcaggtacattcttacagtttgttattttatctcttgaccaattcattatttaagttgtggtataacctttggtttaacaattatttgcaccgtttagtacatataaaaatcattttagtcttcaatttgaattgctagttagaatgacaaggttttttttttcatgtttgatttttttttgatactttgattgaatatagtcattctgttggctcagtggtttagttgatgcaaaa

SEQ ID NO: 11726 - DNA, 664 bp, Lycopersicon esculentum
  Predicted polypeptide sequence is orthologous to G3044
gggaagagagagtgacattcccgcgcaagaagaagaaggagagtggcaatggcttctccttcaacttgtcaaactcaaagggttgaagagaagaaggaacccaaaagcagcaattcatcgaaatcttgttttcagccaacagtcagtttgaaagattggtggcttattagggctgaaagagattctcaaggaagaacccttgccgttgctgggcgcacttctcgagagtgaactttctcttcctattttttttttaattgctttcaaagttttgttgcaactttgaagctcccatttggccatagattttgtagttgaagcattgagaattttagtttttcaagttgtggttttttttttcctagaccccatttgtgggattttattgggtatgttcttgttgttgtaaagttgtgtttttgaatattttaagttgtgtttggatatacattttacttggaaaaatctgatgtttttggtatttaaaaagatttgaagaatttgatgaaattttgcggttacatagatatttgaagataaattttcaaaatgtactcccgaaatgtactgtcaaacgctagcttatagttgtttttacgtatttggggttctgtgatttcggatttactatgttgtcatgcaagtttcttggtcaccttggacc

SEQ ID NO: 11727 - DNA, 656 bp, Lycopersicon esculentum
  Predicted polypeptide sequence is orthologous to G3044
tttgagaaatcttgagggggggttctgttctttactgtgacttagggttttttactttaaatgagccatttatggttgctgcaagttaatgacttgttcaatttactgctcttttgagctctttgttgaaatgggtttgtgttttctgggacattaaggaggtggggtggggactttttttgtgaatttgaaagcattgattgttatttcttgttctgtatggactttttatatttggggcttttctagttttgagtgaatcttctggtagacatagtttgttcacctgaaaagtcttgcttttttggatagtttgaacacatgtttggttgtatggtctttcttgaggatagttaaatgcataaagatgaaaactttaagttcccagcatgttgaatttcaatgttttaggttgttttcttgatactcaagtgctgtggtaaaagaagtttggttaagttttttctatacttggaaaaatatggatatagaaatcaagaatgacagtgaaccagaaaagaggagtcctgtggaaagaatattggctcaaagaaaaggaaaagaagtggtcaggatactgaacctgatcaaatgaagggagcacagcagccaccatcccgaaattcagaaaaggggaacagaaacttgaatcaatt

SEQ ID NO: 11728 - DNA, 594 bp, Lycopersicon esculentum
  Predicted polypeptide sequence is orthologous to G3055
ctgaccaggcagtttgggctactgaggatgattataaagcctggaacagtggtccctattgtgaaaccccttccaattccagtcaggatggtaggcattcacaaaaccggtcaggcagtgagcctcccaacaagaagtcaaggaatgtgcaggattcagatgctcgcattatagtcaccagtagctctaaagcaatcggaaagatgttctttaaaacgaagttgtgttgtaagttccgtgccggtgtctgcccctatgttactaattgtaactttgctcatggaatagaggagcttcgcaaaccaccacctaattggcaagagatagtagctgcacatgaaaatgagcggggagtaatggtggaactgagagaagaacaccagataccaatattgagctctcctgatttacgtggagagtctcaaaggtccgctaaagggaggcactgcaagaagttctacactgaagagggatgtccttatggagatagttgcactttccttcatgatgaacaatcaaggtctagagagagtgttgcaataagtgtgactcctactgttggtggatttggaaataatgctactggagcaaccc

SEQ ID NO: 11729 - DNA, 1002 bp, Lycopersicon esculentum
  Predicted polypeptide sequence is orthologous to G3059
gaaaattactcatctcaattacaaatacgcacaaatcacacgcattagaaattcaagcaatagtcattagagtctgaaactgctcatcgcgtacagcttctgaattccaatttcctcagaaatcacgcgcatacggtgtttgcatacagagttcagagtcccgagtacttcatcggtccaactagaaagttcgaaaatttgaagaagaatttgaagaacttcatggagttttttctcggtagcagtaataatatgcaagcttccaatgttcattccttcgacggcaatgtttcgccgatcaacgctcagaacttcataggacgaggccgtttctatcctggatcaaaaactacgatcctcgatccttactcgtcttcagatagtagtggtagttcttccaataaagtctctccgctagcccgatacctttgtccaagctcgccggtgccttttattagcgattctccaaagcaccgttctctggtcagtactagcagcggaagcagaagcggctgcggcggtggagttccccgttcgcctctagcttcagtagagaactttgagattccgcttatgttcagaactccagtgaaggtcgaagaggatgtggtagtcatggacggtattctggttgaggcgaaacatggtccgagagctaataaattgtcaccgtcgacatcagattcaggtggacggttgtcttcgtcgacaccggcaaacgacaatagcgttcataaatcggaaacttgtcggtggtgggaggattcaggcacttgccgctttggttccaaatgccggtttgtacacgggaaagaagatttacgctcaactgctttcgccaacagaaatcaatctgaggcactgctctgcagatcatacacttcaggaccatcttcttatggaccacggggccgatctgttcatcagcaggtccactcagccgcgtctccagcaaaaacaacaaaaatgtccaccccaaccacgacttctactactactctt

SEQ ID NO: 11730 - DNA, 644 bp, Lycopersicon esculentum
  Predicted polypeptide sequence is orthologous to G3060
gctctcttctccttcaccgataaaccctagaagtagggttagggttttagcttactgttttttttttcattcgtctacttctactgctttgcttagggttctgcaggccgtagttatatttttcttttgttttttgttttcagagtttttttttgttcatttgttcgaatctgagtgttttaagtagctatggatttccggaagagaagcaggaatggagctggttcgaacttcaatggaggtttgaagaaatcaaagccagaaatggactccttatcgggtggtataggaagtaaaacgaagccatgcacgaagtttttcagcattgctggctgcccattcggtgagagctgtcatttccttcatcacgtccctggtggctacaatgctgtggcccagatgatgaacttaggatcagctccagcatcaagaaatgtggctgcaccacccatgtccaatggaaatgctcctgctgtgaaaaccaaactttgcaacaaattcaacacagctgagggatgcaaatttggagacgcatgcaattttgctcacggggaatggcaaattggtaagccgattgtgccatcacaggaagatccacgtgccatgggtgttggacctgctcctagtcgttttggtgggcggac

SEQ ID NO: 11731 - DNA, 355 bp, Lycopersicon esculentum
  Predicted polypeptide sequence is orthologous to G3060
agagttttttccccagctcttttctcctgctctttgttgtttgattgtttcgtaattttggatcgtctttagatctgtgagttgcttgacatggaaatccgcaagagaaacaggaatgaatctggctttaatggcaatgctggtttcaaaaaggctaagccagaaatggactcactatcaagtggtataggaagcaaatcaaagccgtgcacaaagttcttcagcactgttggctgctcttttggtgagaactgccattttcttcattatgttcctggtggctataatgttgtggccaatatgatgaatattgcaccatctccagcatcacctattcccagtgggaatactcctg

SEQ ID NO: 11732 - DNA, 400 bp, Lycopersicon esculentum
  Predicted polypeptide sequence is orthologous to G3060
agatgatgaaattgacaccagctccatctttgagaaatgctgcagcaccgccttattccaatggaaatgctccttctttgaaaaccaaactttgcaacagattcagcacggcggagggatgcaaatttggagacaaatgcaattatgctcatggggagtgggaacttggaaagcctaccattccttcacaagaggatccacgtgcaatggggtttggatctatgccaggtcgttttggtggtgggcgggtggaatctgctgctagttttggtacatcagccactgcaaagatcagtgtagatgcttccctggctggagccatcattgggaagggtggagtgaattctaaacagatttgtaggcagacaggagccaagctggcaatccgtgatcatgaaac

SEQ ID NO: 11733 - DNA, 329 bp, Lycopersicon esculentum
  Predicted polypeptide sequence is orthologous to G3060
ctgctaagattagtgtagatgcatctcttgctggacgtattattggaaaaggtggcgtcaactcaaagcatatctgtcgtgtgactggagccaaattttccattagggataatgagtcagatcctaacttgaggaacatagaacttgaaggtacaattgatcagattgaacaagccagtcgaatggttcgcgagcttattcagagcgttacaacatctgcagcacccccgatgaagaacagcagctcctccgtaacaagtaactacaaaacaaaaatttgtgagaacttcaccaagagtacatgcacttttggagaaaagtgccacttt

SEQ ID NO: 11734 - DNA, 553 bp, Lycopersicon esculentum
  Predicted polypeptide sequence is orthologous to G3060
tgccactttgctcatggcgagatggagattgggaagcaagtgcgtccagcgtacgatgatttccaagccaaaggtcctccgagtgggttctcaggttaccttgaaccgtcccaacctggtctagctgctacaaactttggagcatctgcaacaactaccattagtgtagatgcatctcttgctggaaacatcatagggaagagtggtgtgaactcaaaacacatatgtctggttactggtgtcaagctctttataagggagcacgaaacggacactaacaaaagaaatgttgaactccaaggaacctttgatcagattaaccaggcgagagccatggtgagggagctcatatcgaatatcagtacacctacaggcgggctgaagaatgctgccccattttctcgaggtcctcctggcccacttaaaacaaagatgtgtgcgaatttttcaaaaggtttgtgcacatttggagagaaatgccattttgctcatgggcccagtgagttgcagaagccattgacttgatttcatggcattcatactgtgtattagc

SEQ ID NO: 11735 - DNA, 1660 bp, Lycopersicon esculentum
  Predicted polypeptide sequence is orthologous to G3061
ccgactatagggagaaaagccgtgtgagataaggaataaaatggagagagaaaattattgtatggtagtagttttttaggtgctaaacattgaagcagaaaacctctgtaagaaagatgaagaagaaatagtctgtggatggaatcttgtagttgtaaccattgtttttgtctagtttcctgggaaataaaaccttatactgtgtaaacttgggatttagctgttttcagcaaaatctttggtttcttctgaaagctgagctgttctatttttgtttttttggtaccttattctcacttatactcatcatctaccttcttctccaaatctcacctatcaaaaatgatgtcggatgatggactttcttcattagctttcattcaagatccaaactcaaaccctactaataataatccaaaccctaactcaaatccatctgctaaacgaaaaagaaatctccccggaaagccagatccagatgcagaagtgatagcactatcaccaaagtcactgatggcgacgaatcgattcatatgtgaaatctgcaacaagggttttcagagggaccagaatttacagctccacagaagaggtcacaacttgccatggaagctaaagcaaaggaacaaaaatgaagtgatcaagaagaaagtttatatttgtcctgaaaagacgtgtatccaccatgatccatcgcgagctctgggagatttaacaggtattaaaaaacacttctcgagaaaacatggcgagaagaagtggaagtgtgagaaatgttccaagaaatatgctgttcaatctgattggaaagctcatactaagatttgtggcacaagggaatataaatgtgactgtggaactctattctccagaaaggacagctttataacacatcgagcattttgtgatgcgttagcagaagaaagtgcaagatttacatcagttccaagtacagcaaatctgaatttcataaatgaaattttgctgaatgggggatttggcaatactaatcttcagcaaagtactggaaatccccaatttggttctaatttgtttaggcctgaatttatgggacttggattggaccctgcaattagtcatcatcatcaaccacagctcaataatgtggatggacaaaaaccaaggataccactttggttggacaataatatgaacccgaatccaggtaatgatttcttagtagcatcgtcaagctctactactagcaatttgcctcatcatgaattggtccaaatcgccgcacataacaatactcaacaatggttcattaatggtactggtgttggtgatgattctggaattggctcatcctcgtctcaacttccttcacgagtattgctaaaggaggaggaagagaacaaaagaaatatgtcggagacaataagttcaatgtactacaacaatcatcacaacgaaacaacagcaccagctactcatatgtcggctactgcacttttacaaaaagcagcccaaatgggatcaacgaggagcaattcagccctctttggtactggattcgggctaatgggctcgtctttttctaaaagcaatggacaaggacaatttgctactcatgatcagaattttaacggtttaatgatgcactctccgaataataataatagtaatcaaggaaata

SEQ ID NO: 11736 - DNA, 366 bp, Lycopersicon esculentum
  Predicted polypeptide sequence is orthologous to G3061
tttttttttttttttttttaaaattaatctgattttcagataactacaacaaaaaagttactaactttatgaatgaaccttaaaaaacttcccttctccatcaaacttggaacatttttttttataaaagattcagttgcagaaaaaaaaacaagaaaactccactaaagggaacacaaattaaaatactttaacccaatgtataatataccttggaaactcaaaaataaaaccaaaaattgtgcaaatcccacaatttacatcaagaactcataaccccaattcttgttttttgctctttaatctgaaaaaaaacatctaaaaattagagggataagagatttttgttacatagttttcaatctg

SEQ ID NO: 11737 - DNA, 823 bp, Lycopersicon esculentum
  Predicted polypeptide sequence is orthologous to G3067
gctcttctttctcttttgcctcaagctttttttttcttcttcttcttcatgggtttctagttagattttctgaagtgactttaatttttttttgtaaagttttgatttttttttctctggcattttgaatgttgttttggggttgtcttcttgagagtaatgggtgttcactgttgttttctgatagctaaaaaaagggatttttactaacttttttggtgtttgtagttgggattttcttgaagtgagtttaatttgtgtaaagttttaatctttttcaaggcattttgaggaatgctgtgtggggtttgttttctgatagttaaaaaagaagcatttttcataagtagataatgtcagtcaagaatagaaagatatcttcttgactaacttttttgagtttcagggggggtggaaaaagatgatagctttaggaaagttcatttcttttagaaagttatctgagtataagtagaggaaaagttacatttttttagttatattgaagggttgttgaaaagatagaatcttgaaaatgggggagaagaagaatatgccagcagtttggtttactttaaagagatctttgcattgtaaatcagggccatcagatgttcatgacccaaaaacaagaaaagagttgagcacaattttgaccaaaaagggaggaggaaggtctggttgttcaaggtctatagcaaatcttaaagatgtaatccatggaagtaaaagacatttggataaaccacctagttgtagtcaagatctattggtagtagtgagtttattaatcaataactcatgaaagtattctgagtaattc

SEQ ID NO: 11738 - DNA, 478 bp, Lycopersicon esculentum
  misc_feature (466)..(466): n is a, c, g, or t
  Predicted polypeptide sequence is orthologous to G3067
ggaggaggagatttaaaaaaaaaatgccagcagtttggtttgctttaaagaaatcattgcagtgtagatcagagataaaagatgtgtatgatccaagaagtgaagggaaaaatttaagcaagatatcgacgaaaaaggcgacgacaggtaggtcaggttgttcaagatcaattgcaaatctgaaagatgttatacatggaagtaaaaggcatatggagaagccaccattacagagtccaagatctattggaagcagtgagcttttgaatccaattacacatgaagttgttttgagtaattcaacttgtgaactcaagattactagttgtaatttccaagatggtaatggtaatgggagtagtgggaataatgttgagagtatttctgcttttatgggtactttaaaaccagggacccctggccctggaggacaccatattggttcatcaaggaaatacagaggctntggtagtcctat

SEQ ID NO: 11739 - DNA, 1385 bp, Lycopersicon esculentum
  Predicted polypeptide sequence is orthologous to G3074
gtcaagtctaaaaaaataccttcgttttgcactttccccaaatcttctcctctctctctatctcacttcgaacaatgattgtcttcttctgattcttccaatttcagaaagaaatttgttcactagattctctaatttagtattttatatccttagattctctctatttttgaatggacagaatctgatttatcatgaggaagaaacttgatactcgctttcctgcggcccggatcaagaaaattatgcaagccgatgaggatgtcggtaagattgcaatggctgtgcctgttctagtgtcaaaagccttggagttatttttacaagacctttgtgaccggacatatgacataactcttagaagaggagcaaagactgttaattcactgcacttaaaacactgtgtacaaagctacaacgtgtttgactttcttcgggaagtggtcagcaaggttcctgattatggccattctgatgctgctggtgaaatgccaaaaagaaggaaagttgctatagaagaacatcatgacagtgaggatgaatacaaaaagagcaggacggagatgtctcctgttggcagtagtggtaggggaagaggtaggggtagaggaagaggtcgtggtcgggtaagccgtgctgataaggagctctcacgacctgatatgcaacttgaatcctgcacttctgctcagcagagtgttcaacaaaatccaaatcctggaactcagacagagaactgctcagaaccgaaagaatcacctacacaggattccactgtttgtgacaaagaaaactcagttgtaacaactcctaatctgaaggtcaatgtagatgataatactgataaaccagctgcaccggaaatagcaccctgcaatccatcaccaaggcctgtgaacgagaaagcagaggaaggccctcagtggtccctcgaaatggacagaatggtcattgaccctgctcatatgtcacaactgaatacaagtgtagcagaagaggaagaagattatgatgaagaagagtaggcagatgaaataacaaacaaatggcctatttgacatatgctatttattgattacagttgcctgtaggccttgacacaaagggcccttgtgatttattgacatattagtgtccgtctatttcttagttgtctttgtgactttaagtctttgtaatggtctctaacccttcccttttccactagtaataagtaggaagtgtgttcgttgctccaaccagcactccatgtatcaattactgtgtgaaattaggttaagtccattttgaatcttcactttttttattttataacctagaaatcgacgcggtagctgactaagtttcagtgtctattttacaaagcaaaaaaaaaaaaaaaaaaa

SEQ ID NO: 11740 - DNA, 478 bp, Lycopersicon esculentum
  Predicted polypeptide sequence is orthologous to G3074
ctttctgcaagatctttgtgaccgtacatacgagattaccctcaagaaaggagcaaaaacaatgaattctttccatttgaaacattgtatccagagctttaatgtgtttgatttcctgaaggatgtagtgagtcgggttcctgatctaggcgggtcagatgctggtgctgaatcggccaccaaaaggaggaaagttgctgaagaagatgatcatgacagtgatgatgataccaaaaggaatcatgcgaatgagactgcaaacaacagtggtactggaagaggacgaggtaggggtaggggtagaggccgtggaagaggttcacgagcagtagagaaaggtgactaccatgctcacagtgagaaactggaagacgctgctgctgatgtttcacatcaaaaggatgatgagaaccaaaaacaaaatgatgaaagaatggtagactatgtagcagaatcagcagtagattcaaagaacatt

SEQ ID NO: 11741 - DNA, 606 bp, Lycopersicon esculentum
  Predicted polypeptide sequence is orthologous to G3076
ctcatatacaactactacgattatcaaaaatgacgagccaagtagcggaaaacttcacaaaatactttgaaaattggatgatccaacttgaagagttgctgaaacaactcgttattgtacctagggagacgtcatacgtgaatgatcacgagttattggtgagtaaaatgacgacacatcacaagaactactacacagccaaatgggccgcagctcatgaagacatcttagcatttttcactccaatgtggcttagtcctttagaaatcgtctactcgtggatcacagggtggaagccttccatggcgtttcgattagtgagtggcggtggaggagcgttttcggatgaggaattgaagaatattgatggtttgagggtgaaaattcgcggagaggaagagaaagtggagagggaaatggagaggcaacaggttgcaattggggatagaaaaatggtggaattagcaaggattagaaatgataatgatgagttggtagaattggcgttgaaagggttaaggatgagtttagaaagggttatgaaaatggcagattgtgttaggcttaaaacgttgaaaggtttgttggagatattgagtcctttac

SEQ ID NO: 11742 - DNA, 473 bp, Lycopersicon esculentum
  Predicted polypeptide sequence is orthologous to G3086
aaaacattggggatttgattttaaagttggaattttgttgaaatttgagagagaaaaatctggaagagtgttgggagttagaaatttggttggacgattgagcgaaaaattgaagagagggaaagagtcgcgcaactcaagagactgaagtcacgatcctgttccctttgctcgtcgggtcgttttcaatacagctttgagctcatttggtggtggaagctcgttacctcactcgtcgttgccgtttgctgcataaaaaggggtgagaatcgacccttattttgtttatgactcgtttttttcgctcgattgttgcttgtatgtggttggctgacatttggttgtgactcgaagtctgtcattgcgtattgcctttcttctatagttttgctgttagtttggttgtagtccgagtcgacgttttccagttttgggagtatggggtgcaaattttgtatagtctgcgtctgaaa

SEQ ID NO: 11743 - DNA, 725 bp, Lycopersicon esculentum
  Predicted polypeptide sequence is orthologous to G3086
ggtttgttattggcttcactactctttcaccaccgccaccaccgtcatcttctctgccgctttccattttccgatgacactttaataactcttccttctttctctttactctcaagttgttcatgtaaattatcttttttatctacatggggttttcctgttttttcttctagtacgatctatgtgaaaatcttgaattcttgtgtttgataaagtataaaaaaagggtattttctattttggttttttttttttttgaagaaaaatggatcatagtcgtgttgagcagcaaccaattacttctggtttaactaggtatcgatctgcgccaagttcttatttctctactctgttaactactactacacctgttactggtgggggttgtggttatgcaagagatgatttttccaatttaccaaattctactgcttcttcttcatctactgatatagagcaagtttttgctagatttgtagctagtattggtaactccaactctaactctgggaattttcctacaaatcaaccaattcatgaaaaccccacgagtaatatgaatgttagatcggattttgttgtaccaaaacaagagattacaccgcgggttagtacgacatagaagtagtgatcactctcttgtttcaaattatcaaaatcagaatcaacacttcatttcacctgtgaaaaggaaccagaaactctgctacagagtactgatcatg

SEQ ID NO: 11744 - DNA, 578 bp, Lycopersicon esculentum
  Predicted polypeptide sequence is orthologous to G3091
gcccaaaccaaaaatccaacattttctcttcctttcacaccctattcattcacaaagaaaatcaaaaatctgagcgttactatttcaaactggcgatcgacaaccaagaagccccaatccgtgaaataaagcctaagaacaggcgtatcatgggacctgatgaggacgacaataggtggccgccatggttgaaaccattattgaaggagcgattctttgttcaatgcaagttacatgctgattctcacaagagtgaatgtaatatgtactgtctgcaatgtaacaatgctcctctctgctctgtttgtttagcacatcacagagatcatcctgtcattcagataaggaggtcatcttaccatgatgtgataagagtgaatgagattcagaagtatttggacatttcttcagtccaaacatacattatcaacagtgctaaagttgttttcttgaatgaaaggccacagcctaggcctggaaaaggggtcacaaatacttgtgaagtatgtgaaaggagtctccttgattccttcaaattctgctctcttggttgcaagattgttgggacctcaagtaat

SEQ ID NO: 11745 - DNA, 1299 bp, Lycopersicon esculentum
  Predicted polypeptide sequence is orthologous to G3091
ggaacagtctgagttttttttttttctcttactgtcactaatacacaaagcgttactactttcgagaaatacaaatagttttatttttttttgttttacaaagctggcgatcgataatcaagacaccacttttcgtgaattcaagcctaagaataggcgaatcatgggagctggaggacctgatgaggaagataatagatggccaccgtggttgaagccattgttgaaggaacggttcttcgttcaatgcaagttacatgttgattctcataagagcgaatgtaacatgtactgtttggattgtatggatggtgctctttgttccatttgtttatctcatcataaggaccatcgtgccattcagattcggaggtcatcgtaccatgatgtgataagggtgaatgaaatacagaaatttctggatatcacttccgttcagacctacattatcaacagtgcaaaagttgttttcttgaatgagagaccacagcctaggcctggcaaaggtgtcaccaatacctgtgaagtctgtgaaaggagtcttcttgattccttcagattctgctctcttggttgcaagattgttgggacttcaaagaacttcgttaagaggccaaaacaatcgccggagaagaagaagtcctcgccggctgctgcagccgccgtctatgactcagaggattcctacagcagcagcagccatggccggcagaacagcacaagcaacaaggtccaccaaagtttcagtccgtcaacgccccctccaacttcagttaattacagaacagccaagcgaagaaaggggattccgcatcgagccccaatgggaggactagttataggttattaagtcttagaaaaatcaaaaatcaaaatcgaagtccttcatttgctcctaattatacattagtaaaaaagatcagaatgcagaatgcagaaacttctccgtcaaaaacactagtgctttctttcttctctagagaaggccagtgtttgctttattgtgtatatactttttagctactatagtgtatgttgggataagttggaggggtggaagttgaaataagaaaatgttaagggaccaatacggaaaacttagttgggcttagaaaataagctatatattatattaaatattatatagtatgatgaaatatcaagatacagtgactcttggctttttagagtgattatacataagttttgtttgttttcttttacctcctactgtaatctaaaatgtaaatataatgttcttatagtttggaatattttagccaaaaaaaaaaaaaaaaa

SEQ ID NO: 11746 - DNA, 553 bp, Lycopersicon esculentum
  Predicted polypeptide sequence is orthologous to G3091
ccaacctgctccgactcgtgtaaacacactatagaagaatcgcattaccattaaaataaaattttctaacacgaatttaaattaattgagtcttaaaatgaatattctaatgataaaaattaacttatagtaacaattaacttaaagtggtcaaatgaattggacattttattaaatgaaagccgttacattattgtgatgtcatgagaaacaaataaggcaatatggtatagctgtaaagtgtaaacaatagaaattaaggatagagttttcattacgagcaaagaagtaacgagaaataaatgagtttgtctgcttgtcaacttgacaccacattaacgaggattgtgattgagtggcaagtacttcttcatccttaatcagaagtttcagattgagtctcgcgagtatgaaatcaccttgttacggagctctttaacccaatatttggtcacagaggcatcaatataagttcttataaagggaatcagaacaaacataaagttgtcacacaagaaatttgtactattgattatttaaaacaaaatttgca

SEQ ID NO: 11747 - DNA, 754 bp, Lycopersicon esculentum
  Predicted polypeptide sequence is orthologous to G3091
ctcctctctctaaaatagaagaaaaaacatagtttcaaatttagaagtgaaaaaagaagtatttcaaactggccattgataatcaagattctacaatcaaacacaagaacagaagaattatgggtgttggaggagctgatgaagaagaaaataattggccaccatggttaaaatcattgcttaaagaaagatttttttttcaatgcaagttacatattgattctcataagaatgaatgcaatatgtattgccttgattgtattaatggtcctctttgttctctctgtttatctcatcacaaagaccatattgtcattcagataaggaggtcatcataccatgatgtgataagggtgaatgagattcaaaagtatttggacatttctttagtccaaacatacattatcaacagtgctaagattgtctttttgaatgaaaggccacaacctaggcaaggcaaaggtgtcacaaatacatgtcaagtttgtgaaaggacccttcttgattctttcaaattttgctctcttggttgcaaggttattgggacctcaaagaacttcattaagaaaccgagggacttatcagcaaaaaggcagttaaaggcgatagcatcggactccgatgacccttacagccccaacaaccatagtcgatatagaagtaccatcatcaacaaggtgcaaagttttattccatcgacacccccctccaagtctgttaattacagaacggccaaacgaaagaaagggattcc

SEQ ID NO: 11748 - DNA, 761 bp, Lycopersicon esculentum
  misc_feature (612)..(612): n is a, c, g, or t
  Predicted polypeptide sequence is orthologous to G3091
tctggatatcacttccgttcagacctacattatcaacagtgcaaaagttgttttcttgaatgagagaccacagcctaggcctggcaaaggtgtcaccaatacctgtgaagtctgtgaaaggagtcttcttgattccttcagattctgctctcttggttgcaagattgttgggacttcaaagaacttcgttaagaggccaaaacaatcgccggagaagaagaagtcctcgccggctgctgcagccgccgtctatgactcagaagattcctacagcagcagcagccatggccggcagaacagcacaagcaacaagggccaccaaagtttcagtccgtcaacgccccctccaacttcagttaattacagaacagccaagcgaagaaaggggattccgcatcgagccccaatgggaagactagttataaggtattaagtctttgaaaaatccaaaatccaaatccaagtccttcctttgctcctaattatacctttgtaaaaaagatccgaatgccgaatgccgaaacttcttcctcaaaaacctaatgctttccttcctctctacagaaaagcaagggttggcttaatggggagaaaccttttaactactataangggaggttgggatagttgaaggggtggaaattgaaataagaaatgttaagggaccatacggaaaacttagttgggcttagaaataagctatatattatattaatattatatagtatgatgaaatatcagatacagtgactcttggcttt

SEQ ID NO: 11749 - DNA, 533 bp, Lycopersicon esculentum
  Predicted polypeptide sequence is orthologous to G3094
gcaggcgccgtcctccctttttttcctctatcccctcaaaccccataccctttttcttctctttctaccaaaacagtattttctttctttaacacaatttcaaaatccattctccatatatactcaaagcaaaacagaagagaagagaagaggaatattattattcatataacaacatgttggactacgcacaaaatcttcctcagtggcttattacacttttgacagagaaattcttcaatgcctgtataattcatgaagatgctaagaaaaatgaaaagaatgttttctgtttggactgctgtgagggtatctgccctcattgcctgtcacctcaccgttctcaccgccttttgcagattaggaggtatgtgtatcatgatgtcataaggcttggtgatgctaataaattgctagactgtgcttttgttcaatcttacactacaaatagtgcaaaagtggtatttttaaaccaaaggccacaaacaagggctagtagaggttctggtaattgttgcatcatctgtgacagg

SEQ ID NO: 11750 - DNA, 374 bp, Lycopersicon esculentum
  Predicted polypeptide sequence is orthologous to G3095
aaataatttccacatatcctggagaatgcggtgacacattttgccaaaactagatgcctttcttgccatcattttcttgtactgaaaaataattatttgtccaaagtaaatgaattgaaggaaggactagatgtcctgaaaattgtcaatatcagaaaatattattagagtgcaattattagctattcctttctggttaggcgatagaatcttgttatgaggttcattatgtgactcaataatggaaatctggcccatgatgaacgtctgaatagtttgttcttttagatgaattttttgtacttcagtgcttcctgcttgtaatgaattcttaactgatgaacattgggagattgtttgcttaaaggattgta

SEQ ID NO: 11751 - DNA, 870 bp, Lycopersicon esculentum
  misc_feature (847)..(847): n is a, c, g, or t
  Predicted polypeptide sequence is orthologous to G3111
ctcaaccacaccattgtcctctttcttctatattgttcaatttttattatgactcgtccttctagatttctgcttagcaccaactcatcttcaacgccggcggcggagccaccgtcgacggtgacagtggagtctgatttcgttgtaatactagctgcgttgctctgtgcgctgatttgtgtagtaggactcatcgccgtcgcgagatgtgcgtggctccggcgaggaatcggggccggcgggaacggtggtagtcaaccgtcggcgaataaaggattgaagaagaaagtgttgcaatcgttgcctaaattcacctacgatccaagtagtacggcgaacggtgcggcgttcacggcggagtgtgcgatttgtttggcggaatacgccgtcggagatgagatccgtgtgctgccgcagtgtggacatagttttcatcttcagtgtattgatacttggctgggctcacactcttcatgtccttcttgtcgtcaaattctcgtcgttgctcggtgccggaagtgcggtgagttcccggcagtttcctgtaaatccgacggagctccggttacaactccggccgagtctcgttcatgcggtacatctactagctcaaataatttcttggtctagcgtaacaataaaaaagaggcattagttttttaagttatatactctgacaaatcggtgtaaacgataaatgtaatttacaccgtcagtgcagttttacctgtggtaacatgtcagttactgtgttgatgcaggttagggtaaagttacatgtaattaatcttaaattacatcgttgaaatgatgtgtgcaaattttcttttaatctagtgaaagatgncataaaaaaaaaaaaaaaaaaaa

SEQ ID NO: 11752 - DNA, 633 bp, Lycopersicon esculentum
  Predicted polypeptide sequence is orthologous to G3111
gagagagagagagaactagtctcgagttttgtttctctcttttaattaagctccgacacattcctcatgagtaattctgatccatcaccgtcgcctccgtcgccgtctgcaaccaccgggatcggtaaagtcgattctgacttcgtcgtcatcctcgccgccctcctctgtgcgctcatttgcgtcctcggacttgtcgctgttgctcgctgcgcctggatccgaaggatctccgccagagcaaccggaaattccgttttttcgtcacctccagctaataaaggtttgaagaagaaggttctcaagtcgcttccgaagttcagttactcagctgaacacgccgcgaaattctctgaatgtgcaatttgtttagcggaattcgcagtcggagatgaaatccgagtgctaccgcagtgcggccatggatttcatgtaggatgcatcgatacctggttaggctcgcactcgtcctgtccttcttgccgacagattttagtagtgacgagatgtcataagtgcggcgagttgccggtagcaagctcctcctcgtcagctcccgtagctgaacccgaaagccgattaccttgaaattatcatgtaaatgcatttctacccgtaaaattaagctgggtg

SEQ ID NO: 11753 - DNA, 1449 bp, Lycopersicon esculentum
  misc_feature (1418)..(1418): n is a, c, g, or t
  Predicted polypeptide sequence is orthologous to G3967
attcttcagagaacattcccatctgagtcctctagagaggaaatcagaagaaacagatacaacatgtttggacctgcctccaaaaaccttgctgtggcagaattgcgaacaatggttcattcattgttcttggagtcgtgtgcttctgtagagcttgcttctcggcttctttttgttgtattaactgtatgtgtcacccatgaagcaaaaacaaatgggagcagaaggcctgtaggtaaagatcctcaccatgttagtgcaatgggttcagaatcgctggaagttggtggaaagcagaaagaaaaaattcccaagaaattgaaaaaacaaggacctgtttcagcatttgattcttatgttcttgctgctgtctgtgctctttcatgtgaacttcaactctttcctttgctttcaagagggagtaattattcggatccaaaatccatcctggttgctgcaaagcatgcaaatgattcgtctatggagttaaaaaatgggattcattctgctgtctgtcacactcggaggatattgacaattctggaggctcttttctctttgaaaccatcatctattggaacttcatggagctacagctcaaatgagatagttgctgcagctatggtagctgctcatatttctgatctgtttagacactccaaggcttgcatgcatgctctttcggtcttaatacggtgtaagtgggataatgaaattctctccagagcatcttcactgtataacctcattgatatccatagtaaagttgttgcatcaattgtcgacaaggccgaaccattggaagcacacctaatacctgttcctgttcttaagaaaagaagctcgggcttgaatgggaaaaaacataataaatatagcaattgcacctgcttaactgcagaacagtcatcattgctcgagtgcaaacactcaactgattgtaaaactttaactatgagtgagaaagttttacactcaagcgaggctgcacagtgcaccagtggtaaagggatcgcaagtttccctttagatgcttcagatttggcgaactttctgacaatggacaggcttataggattcaattgcaatgctgaagatcttataaagtccgtactcacggagaatgaggaattatgtttttctgttgtctcattgctgtggcacaagttaattgcatctcctgaaatacaaccaagtgcagaaagcacttccgctcagcagggatggagacaggtcattgacgcactatgcaacgtcgtatcagcattgcctgcaaaagctgcaacagccattgttcttcaggtcctgatttcgctttttggaatttgaatgatgatatgaatatggaccctcttttttcatgaaagataacatgtattcttcaccatttctctagaaaaaaaagagaattataattntttttcaagcagctgattttaagctcaattt

SEQ ID NO: 11754 - DNA, 1114 bp, Lycopersicon esculentum
  Predicted polypeptide sequence is orthologous to G3967
cttgagtatcttcctcgtgggagcccatctgaaacttgtcttatgaaaatatttgttgcgaccgtcgaagcaattcttcagagaacgttcccgcctgattcctctagagaagaaaccagaaaaaccagatatatttttggctctgccttaaaaaatcttgctgtggcagaactgcgaaccatggttcattcattgttcttggagtcgtgtgcctctgttgagcttgcatctcgactactttttgttatcttaacagtatgtgtcagtcatgaagcaaaaccaaatgggaataaaaggcctaaaggtgaagatactcactcacctagtgaaatcggggtagacactcaggcaaccattggaaaacaaagaccaatagggagtaagaaagtgaaaaaacaagggcctgttgcagcatttgattcttatgtccttgcttctgtctgtggactttcttgcgagcttcagctcttcagtatgatttcaagagggcctaattatccagatccaaaaatcatcatggatgaagccaagcctgcaagtgattcatctactgagctacgaaatgggattcattctgccgtctctcatactcggaggatgttggaaattttagaggcacttttttctcttaaaccatcttctgttggaacctcatggagcttcagctcaaatgagatagttgctgcagctatggtagctgctcatatttctgatctttttaaacgctccaaggcctgcatgcactctctttcttctttgatacggtgcaagtgggataatgaaattcattccagggcatcgtcaatttataacctaattgatattcatagcaaaactgttgcatcaattgtcaacaaggctgaaccattggaagcttatctaatacatgtaccacttctgaaggagcgacctagatgcttgaatgggaaaaagcattataaatacacaagtcgtaattgcttaacatcagaacaaccatcaggacctctgtgtaaagattcgtatgatcgtagaagttcacttgtgtgtgagaaagcttcagactcaagttcacactctagtgagcttgctgggtacacatcagcaaagtgtttgcaaatttctccttggatgc

SEQ ID NO: 11755 - DNA, 965 bp, Lycopersicon esculentum
  Predicted polypeptide sequence is orthologous to G3967
gcacggttttttttttttttttttacaaggaggtaacatagagccaccctttttgttggtcacactgaatatttaatacatcatattttcacaatcatgttcatattcaggtgtacatcaaacataaactgaaccaaaaaaaaaagaaggtaaagaaaatacaaccagagaaggactacctatatttccatgatcatggatgtgtcaaaaggacactaatctcatttcctgactgtaactaaaagctctttctcctttctccatcctcatgccaatagatggtcactttctaatcttgtgaatttcatgtggcaaaatcatgggaagaaaactaatatactgcccccattatattaagttagatcaaatggatatagtacaccctaattccttagcagccatatcaagaaactgtgtacacattccattttcaattcggctgttagcttcccaagtcaaacacttctcaatatccctttgccagttaatagtgccaatgtttaagtacttataagcaggaccatggataccatttacatcagctcgattagctctagtttttattgaaccagtctgcataatggcacggagaagtgatatgctgagagcacgtaccagagcacttggatgagaaatacaacgaactgtggccggtaagcggcacttcaacaagtttgacagaccatcaacgattactgatccagattctccccactcaagcactggttgtacagctctagctgtcacttccaggagctccagctgtggtaaggtgcatgcttctccatctacaagcatcccatctgttgcccgtaagaggaggtctggtgcgcttgcaagaataaccaaagactctggtgtatcatgattcctcattacttctgcaatcaattttacaatacgttggtttatcctccacatcttctgaccaagatcatcatctttggcaatccatggttgcaatc

SEQ ID NO: 11756 - DNA, 1901 bp, Lycopersicon esculentum
  Predicted polypeptide sequence is orthologous to G3967
gcattttggatttaattgcaatgcacaagatcttttaaaatcagtgcttgcagacaaacaagaattgtgtttttctgttgtctcattgctctggcacaagttgattgcatcacctgaaacacaacccattgcagaaagcacttccgcccagcaaggatggagacaggtggttgatgcactatgcaatgttgtatcagcggcacctggaaaagctgcaacagcaattgttcttcaggtccagatttcgctttaactgtatttggtcattatagatcatgatcattttttgttaggctgcagctagtatgcacagttcatatttatttggatccaaatggcttaacagatacacctgctatttcaaataattacattcttttctagggaaaagaaacaagtctatccttgtcctatccgaaattgagaaattttgccctccaatgaacttttggtctaatattactgatgcattaggataaaaagtcttttttttccttaactcctaacaaaacgccaagggtaattttaaactaaagttgaaagacaaggggtaagcttggaccttttttcacaaataatttggacacatggagtccacctatttcatgttggagttccgttaattaaaagaaaaaatataggatgatttgcttatggcaagggtattaataacggacccaaattgtatggagaaaaaattgagcaattccgaatagtttaggggcaatttctggaagttttcccttctctgtcatatttttggcgttatcacatggcaaatacatttatgtttatggtacagtacctttccggttccagggtttcttagacttgcatgcattaatagttatcatcgctttgcttctagctgtaagtaggtcttcatcacaatatttgtttggtcactttcttgccaaactttacttgtcaggctgagagggaattgcaaccatggattgctaaagatgatgaagttggtcagcaaatgtggagaattaaccaacgtatagtaaaattgatcgcagaactgataaggaatcatgatatagcggaatctttggtaattctggctagtaaccctgacctccttttacgggccacagatgggatgcttgtcgatggagaagcatgcaccttaccacagctagagcttttggaagtgacagctagagcaattcaaccagtacttgactggggagaatctggacaatcagttgctgatggcctcacaaacctattgaagtgtcgtttgcctgccacagttcgctgtgtttctcatccaagtgcacatgtccgtgctctcagtacatcagttcttcgtgacattatgtatgctggttcagtaaaaccaagtgccaaacaagcagcagatgttaatgccatccataatcctgcttatcagtaccttagcataagcatcattgactggaaagcggatattgagaagtgtttgatgtgtgaagctagtagccggcttgaaaatggaatgtctgctcaatttcttgatactgctgctagggaattaggctgtactatatcagtctgaaaactcacttttctggggcatatattaggtctctctgtaccataccatacctatcttgtaaaagtcagttagaaaatatattttagagtcctgtgattgttgtacaatggcatgtagatagttccacttgttttgtttttcatttggcacagattgtgtttgttgtacttccaaatacaaacatgatttgtggaaataagtagatgtagttgtttaatattttgagtgacccactaaaggctggttcagctttagaattgaatttttcctatcatgtaataaccttcttactttgtattgtacattcagcagataaaaagtcatctattcagtttaaaaaaaaaaaaaaaaaaaa

SEQ ID NO: 11757 - DNA, 566 bp, Lycopersicon esculentum
  Predicted polypeptide sequence is orthologous to G3967
gatcgcaactccaagtgccacacagaggcttcttgttggacttttagaagctccaccatcttgggctccagatgcacttgatgctgcggtacaactagtggaacttctgcgagcagctgaggattatgcatctggtctgcgtcttcctaggaattggatgcacttgcatttcttgcgtgcaattggaattgccatgtccatgagagcaggaattgctgcagattctgcagcagctttacttttccgagtactttctcaacctgctttgcttttcccccccttgaggcaaattgaagaaattgaaattctgggtggcgacacttcatgtaataaaaagcagagagaagtgactgctgcagaagccacagtagaagccactgcccaagggattgcatcaatgctttgtgctcatggtccggaggttgaatggagaatatgtaccatctgggaagctgcttatggattgattcctttaagttcatctgcagttgatctccctgagattgtagttgccacccctttacaaccacccattttgtcatggaacctgtatataccccttctta

SEQ ID NO: 11758 - DNA, 596 bp, Lycopersicon esculentum
  Predicted polypeptide sequence is orthologous to G3967
gttgcaaccatggattgctaaagatgatgaagttggtcagcaaatgtggagaattaaccaacgtatagtaaaattgatcgcagaactgataaggaatcatgatatagcggaatctttggtaattctggctagtaaccctgacctccttttacgggccacagatgggatgcttgtcgatggagaagcatgcaccttaccacagctagaggtaatgacatatttagatttctggtttagaggtaacatcttttatactacttatttctcacctgatgaatctatgattcagaaagctacgacttcctttattttcgtgagtacttgaatagatgattgattcatcatattcaatatcttctgtattttctgatatatttacatccttgccccttaaaaaaaattgagcagcttttggaagtgacagctagagcaattcaaccagtacttgactggggagaatctggacaatcagttgctgatggcctcacaaacctattgaagtgtcgtttgcctgccacagttcgctgtgtttctcatccaagtgcacatgtccgtgctctcagtacatcagttcttcgtgacattatgtatgctgg

SEQ ID NO: 11759 - DNA, 240 bp, Lycopersicon esculentum
  Predicted polypeptide sequence is orthologous to G3967
ccatgttagggcaatgggtccataatcgctggaagttggtggaaagcttaaagaaaaaattgccaagaaattgaaaaaacaatgacctgtttcaacatttgattctaatgttcttgctgctgtctagactctttcatgtgaactaaaactctttcctttgctttcaagagggagtaattattcggatccaaaatccatcctggttgctgcaaagcatgcaaatgattcgtctatggagtt

SEQ ID NO: 11760 - DNA, 419 bp, Lycopersicon esculentum
  Predicted polypeptide sequence is orthologous to G3967
gcaaatttcatcttcaaatttcaggacaaatagtcatgtgttgtagttagtatctgcttactatttaattacggaatttacatttccgtaacctgcatattatttcagagatatcttgaagctctgaggtggttttgctcgttagaagttctggaccatcctttgctaggatcctagatgttgaaattacaatctgtggatcctagattggtagtggtcatagtggtacttgatggcctaatctgtgagcatcctctcatatcgataaaattcttggattgacagcagttatatggccgctacatgcgagaggtggattgatggccttcaatactcttcaatattttggcctccccctcaagatgcacaacaacggaaggctcaaattactgcctatgttgagtactttgttcagttca

SEQ ID NO: 11761 - DNA, 561 bp, Lycopersicon esculentum
  Predicted polypeptide sequence is orthologous to G3967
gaaacaagtctatccttgtcctatccgaaattgagaaattttgccctccaatgaacttttggtctaatattactgatgcattaggataaaaagtcttttttttccttaactcctaacaaaacgccaagggtaattttaaactaaagttgaaagacaaggggtaagcttggaccttttttcacaaataatttggacacatggagtccacctatttcatgttggagttccgttaattaaaagaaaaaatataggatgatttgcttatggcaagggtattaataacggacccaaattgtatggagaaaaaattgagcaattccgaatagtttaggggcaatttctggaaagttttcccttctctgtcatatttttgggcgttatcacatggcaaatacatttatgtttatggtacagtacttgactggggagaatctggaacatcagttgctgatggcctcacaaacctattgaagtgtcgtttgcctgccacagttcggctgtgtttctcatccaagtgcacattgtccgtgctctcagtacatcagttcttcgtgacatatg

SEQ ID NO: 11762 - DNA, 551 bp, Lycopersicon esculentum
  Predicted polypeptide sequence is orthologous to G3967
ttccgttggtgtggtggtgttatggggaagtatgctgctggagaactaaagccaccatcaactgcttcttctcgtggctctggaaagcatcctcagttaatcccttcaactccgaggtgggcagttgccaatggtgctggtgttattttaagtgtttgtgatgaagaagttgctcgttatgagactgctaccttgactgcagctgccgttcctgctcttctgcttccacctcctacaacaccaatggatgagcattcttgttgcagggctaccggcacttgagccgtatgcacgattgtttcatcgatactatgccattgctactccaagtgccacccagaggcttcttcttggacttctagaagctccaccatcctgggctccagatgcacttgatgctgctgttcagctagtggaacttcttcgagcagctgaagattatgctactaacttacggcttcctaggaattggatgcatttgcattttttgcgtgcaattgggaatgccatgtccatgagagcaagcattgctgcggatgctgcagctgctt

SEQ ID NO: 11763 - DNA, 432 bp, Lycopersicon esculentum
  Predicted polypeptide sequence is orthologous to G3967
cacaaataatttggacacatggagtccacctatttcatgttggagttccgttaattaaaagaaaaaatataggatgatttgcttatggcaagggtattaataacggacccaaattgtatggagaaaaaattgagcaattccgaatagtttaggggcaatttctggaagttttcccttctctgtcatatttttggcgttatcacatggcaaatacatttatgtttatggtacagtacctttccggttccagggtttcttagacttgcatgcattaatagttatcatcgctttgcttctagctgtaagtaggtcttcatcacaatatttgtttggtcactttcttgccaaactttacttgtcaggctgagagggaattgcaaccatggattgctaaagatgatgaaagtggtcagcaaatgtggagaattaacc

SEQ ID NO: 11764 - DNA, 779 bp, Vitis vinifera
  Predicted polypeptide sequence is orthologous to G28, G22, G1006
acaaggctcagcgtcctcagagaggagaagaagaagaaggagaagaacaacaggccatggctccaccttgccagagcgagttgcctctcaatgagaatgactcacaggacatggtcatataccaagtcctaaacgaggcttttgcactcaacaactcgattatcccaccaattaagcgccaaaccactcccacgtccagcgccctggaacctgctcggacaatagccaagaagcactacaggggcgtgaggcgtcgcccctggggaaagtacgctgcggagatccgggactcagctaaacatggtgcacgtacatggctaggcaccttcgagactgccgaagaggctgccttggcttacgatagggctgctttccggatgcggggttccaaggctctgctcaattttccagtaatagctccgctgcctcttgaatcgggagtagtgcttcatcggcatcggagaccactgttgcggaatcacaagatatgggctcatccgattgcctgcaaactatgtagaactgttttttgagacgaagtgatcaaagtaagtatccatgggcctattatgcaatgggacacaagtcccacgtacgtttctactaatatgcagatgtgttaggttctttcttttttaatttccccccttttgttattttctcaatttttggtgtgagtgaggatgtggtgatcttatcatctgtatatatacgtggtctccagttagtttcctgattataattcaattcacaaaaaaaaaaaaaaaaaaaaaaaaaaa

SEQ ID NO: 11765 - DNA, 510 bp, Vitis vinifera
  Predicted polypeptide sequence is orthologous to G28, G22, G1006
tccctctcacataaacccaacaatactcgatcacaccaaacaagaagctagatttcaattcgatatgtgtgattacagtagtaatccctcttctgacttcgctctcctggagtctgttcgccgccacttgttcgacgactccgactctcgtcgcttcgacgctcccctgtattgccgtagcaatagttttagtagcttgtttgaaactgggggtgaattgcctttgaaggaggatgattccgacgacatggtgatctatgggtttctccgcgacgccgccagcggaggctggacacccacgctcgctccactcttttcagagactgcctcccacggtttctctaccgcccccgcggtggccgtgaaatcggagccggaagtttttccggcggaggttattggagtgcccgagaagacggtggacccaccggcgaaattaccggctccggcggtggtgccggcgaaggggaagcattacaggggcgtgcggcagaggccgtgggggaagtt

SEQ ID NO: 11766 - DNA, 888 bp, Vitis vinifera
  Predicted polypeptide sequence is orthologous to G481, G482, G485, G1364, G2345
tttttttttttttttttaatcctccaaaacaaaacataataacaagtcctcttctgacatacatggcaccagatgacaatctgaggtataatattagctgttgcttaatcatccaaaacgagcaaaatataattccaggcgtcacccgccttacatggcagaagatgaaagtctaaggtatcatatgcaaacccttctccagatattgcagtctgccctcaaatatgcctagataattaaacggcaaagatccagttctacaatatcgggctatcccagctgttctgcagtcaaaattctgaatcattgaattggtaaaagagaagctagagtctcctactcgctactctgcacgggagatacaattagatgctgcccctgtgcctgggaattcatatagttcattgcttgcgtaaaggacccctgatgagcaaactgtgcatttggaccaggttgacttcctattgcatcccttctagcagatccatctccacctctagcagatcccctggtatcaccctccagctctctatatctctgcaggtacacctttagtggttcaatataatcttcaaatcctagggtcgccatcgcccaaagcagatcatcaccattaatcgtctttcgcttctctttctgacacttatcactagcctcgctggtgatgaaactgatgaactcggagacgcactcttggacagtgtccttcgcatccttggcgatcttaccattagccggcaacgccttcttcatgatgcggctgatgttggcgatcggaaggtaccggtcctgctcacgaacgttgtggcgggggctctggtccccgccgctttcgtggctgcctccggggggactcgccggacatctgcatggtcgccggaacctctc

SEQ ID NO: 11767 - DNA, 589 bp, Vitis vinifera
  Predicted polypeptide sequence is orthologous to G481, G482, G485, G1364, G2345
ggttgaaggtgtacctccagaagttccgggaggtggagggcgagaagaccgctgtgggcagacaggtcgagaaggacggcggcggctccagcggggacggaggtaatggcggcgtagtaaacactggaaacttcggaagtgggtacggtgcgatgcagcagacaatgatgatgatgggccaccaccagcatcatcaaggacacgtctacggatcagggtcgtatcatcagatgggtagcggcagtagacctacctccggtggttctagcagtggtggcggagccgccaccggaagacccaggtagatttatctgttgtaacttctaagtgatatatatgagtttttctttaccagattgatgtggattatgaagatgaagatgaagaagtagatgaagacgatgatgggttctgtatgtgaggatcacaggctatgttcgaatacattcttttctggagctactgcagctagctggagaaggggatggatgaagaaaacactagctacagcccttgctcttggtttttcttcttctttttgtttttttctttcctttccagtttatttcatatataaattgtaaatccc

SEQ ID NO: 11768 - DNA, 682 bp, Vitis vinifera
  Predicted polypeptide sequence is orthologous to G1073, G1067, G2156
gaggtcgtcctcctggctccaagaacaagcccaagccacccataatcgtaacgcgcgatagcccaaatgccctccggtcgcatgtacttgaagttgccgctggcgctgacgtcatggagagtgtgttgaattacgcccggcgccgtgggagaggcgtatgtgttctcagcggcggcggcacagtcatgaacgtgacgctgcgtcagcctgcgtctcctgcagggagcatagtgacgctgcacggcaggttcgagatactctcattgtcaggaaccgtgcttcctccaccggcgccgccgagtgctggaggcctttctatatttttgtccggtggtcagggtcaggtagttggaggaagcgtggtgggtcccttgatggcttcaggtccagttgttttgatggctgcgtcgtttgccaacgctgtctttgacgtttaccactggaggaggaagagggagctgtgcaagtccagcccaccgcgtcccagtcttcaggtgtgactggaggcggtgctggtgggcagctcggtgatggcggaggcagtggcggcggtgctggtgttccaatctataacatgggagcaagcatggggaattttccctttccaggtgatctattaagatggggtggaagtgctcccagacctccattttaaggctattgtgttgaattcccatatatt

SEQ ID NO: 11769 - DNA, 790 bp, Vitis vinifera
  Predicted polypeptide sequence is orthologous to G1760, G152, G153
ttttttttttttttttgcatagtattgcctgacattatgtttcaaatttctgtatgaaatgcccaaaaacagtttacagaacatatttgagatctcacacaatttcattctgctattccagcattaaatcaataactgagcgctacatcaaagcaaaagaggaacaccaacaactggttaacccaacttcagaagtcaaggtatcttcagtaaccaccactccatcttcttctgtaaatttatccatgtttaaagaagcatatatagttgattttgtatgcaagcacagcattgcagcattatatatagaatgctttatctaattgtttgtgtatgtatttatcaacctatccataaggtataaaaaaatttaagacatgttcaaacaacaatgcagttaatagacaataggcaaaccttctctgtacttgcactggtgtcgctcatgttggcataggaattaattgggaaggaggaattacagttcaaattcctgaaaatttttactttcttgcaagctttcccaacacgaattataccttccacaaatccttagcttcctggcaacgaaacctccatccacctagattgcacacaaaaaatccccaagaagtgatgcagtaatggttttgttggtttacttaaacattacaaccccttctgatgacccacagccatagtcatggaatccagttgttccatccacttccaggtttaaatatatatatttctcacaggcctacgcgtctccagattgaatcaaatctgttctttatccaactcatatcta

SEQ ID NO: 11770 - DNA, 683 bp, Vitis vinifera
  Predicted polypeptide sequence is orthologous to G1945, G2155
ttttttttttttttttcgctaaaaaaacctacactgtttgtctttcattttccttaaaaaaagtgaatctaaaactaacccaagaacattaaaattaaacaaagtaatcgaaggcagtacaaagaagaagtttctaagattcacagtactcaagaaaaagaagctgtagaaataggccaaactcagtacggtggtggtggtggttgtctcgctgtgggtgcccatattacatctgatggtaggtggcagctgtaaatggacatttctgccggcgggtggccgctgtcgcccgaacccgtcggaggagactggccatcgttgcctccggagcctgaattgggcacttcgtcctctcccggtaaccggtgataggagggattgttgaaggacgcagcaatgacatacaccgtcccagcggccagcagggttccggctacggaccccccgacgatctggccctgcggacccgcgagggagatggtgaacccgttggcagatgacggaatcggagaggaggccgattgggggataatggtagcagagattgagagaatatcaaaacgcccatggaaggtaactgtagcacctggggtggtggagggctgccgagggtgacggtggcgacggtgccggagccttaagcacacaaggccaatatgcggggcgagagagcgagcatagct

SEQ ID NO: 11771 - DNA, 356 bp, Vitis vinifera
  Predicted polypeptide sequence is orthologous to G1988
acatgttttttttttttttttttttttttttttttaaaaaagaaaatgttctaatataataatttttgccttttaaaaaaaaaaaaaaattattacaaaatcgatcgtaaatcttgacatgatcatctaaattcttccccaaagcactctgcccagccttcctctcgatcgcgcacgtgccggggtctccgtctctccatcttcagcacacgtgcgagctttgactcggctgccaagatcagcttcgccggcactccgctgatctccacaagcctcttcaaattctgaggcgtgtatgccgacctgtccccgcttagcttcgcggcgcacgaaatcgccgccacgagcgaaacccc

SEQ ID NO: 11772 - DNA, 633 bp, Vitis vinifera
  Predicted polypeptide sequence is orthologous to G2
ggtcatttgaagctgattggcggagtcggggcttcagacctaagttcaacctgcagcaggaggcgtgtaaaagcgatggggatgccctccggagaaatggatataatgaaatggaaaccatgcagcttctgagccacacccacctacaatcgccagcggcattaaagccaggtgaaatgtacagatatgggcaattcagaagagctggagaaacccagatgcttcatatacttccgccacagctcagctcaccaaattatcagattcagtttccaagcagcagtaacggaggccgaattgctgtcaacggaggagatctctctctggccacaaaccatcaacaatggcaatccggtcccccacaattgtttgcaactgctgcagcatcatcaggattcccaccgcagatgattagacccaaccaacaatggccgcagaaaaatgggttccactctctcatcagaccctcctgacccatacaaacaattcttcttttttttttttctttccaatcttttttctcttttctgcctcagccatcacctcccattttccattctttttcaagccccaccataccatgtaaaaagaaaggaaatcagtgttgtgtacgtggctgtctgtcttctacct

SEQ ID NO: 11773 - DNA, 619 bp, Vitis vinifera
  Predicted polypeptide sequence is orthologous to G2
ggttgattgctattttcatttttctgcctgggtttattacagtatttccaatgcacatatcggtaaggaatagataagagttcagtgggatttgaatgatgtattgttaatttttgtagggcctatgacaaagctgcaattaaatgtaatggcaaagaggctgtcaccaacttcgatcccagtatttatgaaaatgagctcaactcatccggtgagtaatggaaagatgaatcgtttcacttctctagtgatcaacagtctctttatgcattggtgtgtattcaattagatcatgtctggcacaattctcaggtaatgctgcagatcacaatctcgatttgagcttgggtggctccgcatccaagcagaacaatctggaattgggggatgacagccaagttgttacaatggatcagcattcggtggggatgtcatttgaagctgattggcggagtcggggcttcagacctaaggtactaaacagatttgattctttcagctggataattaggtgttataagctgtgcatattcagtcctagatggtgatgttctctacttgtccatgaaacctagttcaacctgcagcaggaggcgtgtaaaagcgatggggatgccct

SEQ ID NO: 11774 - DNA, 910 bp, Vitis vinifera
  Predicted polypeptide sequence is orthologous to G4
catcaagccttccgctttctccgctgcgaagccacatggctatacaggtataaaatctgtggaatttaatgggcaagctgaaaaatctgcaaagagaaagaggaagaatcagtatagaggaatccgacaacgcccttggggaaaatgggctgcagagatccgtgatccaagaaagggggttcgagtttggcttgggactttcaacactgctgaagaagctgcaagagcttatgatgctgaggctcggaggatccgaggcaagaaagcaaaagttaattttcctgatgaaactcctttgactgctccaaagcgcaccatcaaggcaaatgctcaaaagctaattccaaagggtagccctaactcttcccattcgaatctgaaccagagttttaatttcatgaacaactctgatcaggaatactatagtagtttaatggatgagaaaccatcaaccaatcaatatgggtatccagattccttccctgccaatggcgaagttggactaaaatcacttgccccatctgagaatggtcgcatgtattttaattcagaccaaggaagtaactcttttgattgttctgaccttggatggggagagcagggagcaaagaccccagaaatctcatcggttctttcagctacccttgaaggtgatgaatcccaatttattgaagatgctaacccaaagaagaaactgaagtctaactctcagaatgcagtgtctgttgaagaaaatactccaaatgggctttctgaggatctctcagcttttgagtcccagatgaagtactttcagatcccttatcttgacggaaactgggaagcttcaatggatgccttactcagcggggatgctgctcaggatggtgatcgaccaatggacctttggagctttgatgatctgcctact

SEQ ID NO: 11775 - DNA, 872 bp, Vitis vinifera
  Predicted polypeptide sequence is orthologous to G5, G974
tttttttttttttttttttttttttttttaataaaagtagaaatcaattacaactcaaataaagaacatacatgataccatggatcagcaagaaaaaaacaccagctgaccaatggccatgaccaacacacatcatattaacacagcagaacttgctaagttctaacctaccaccaggttccctagacataaacacagatagctactgcaactgccaaaaatttcattgcagtagctatactcctactgtagacgccaatttctaaactcaagtacagtacatcgccctaaaataagactgaaaatgaaaaaccaaaagaggagacacattatataacatcatggccattgggatgaaatagctgcccaatcgatctcgttagagggatatttctgcaaattgaaattctcccaagcaccgtagaacggtgcttcttcgcaatcatctgggaaagtaagatccgagaggggcgaggatcctccggacccatcactctcagtaaacatggacgatgaagttggctccaccttacaatcttccgatccctgttcagacaacgtcgaactctccgaaaccgtcaccggctgtgacgcagagggcgccaccgcccgcgacctggatttcttgccctgggtaggcttcccctgtttctgggtttcagccaagctctggcaaatggcttgaagctttgcgtcaactgaggaatggagaggcttgtagtccccaattcgcctccgatatgggatccttggtggcggagatttgggaaattaagcctcgcgaagtcacctctaagtttgtacgcggccttgtcgtaagccaagcggcttcttcggcggtgtcgaagtgccagccagagcctggttcggtt

SEQ ID NO: 11776 - DNA, 970 bp, Vitis vinifera
  Predicted polypeptide sequence is orthologous to G5, G974
ttttttttttttttttttttttttttttttacaaaaccgaaacataactaggaattctccacggtcggccaagaaaaaataccagcagaccaagatggagatatcttacatgtacattaacaacacctgactgactcaacagctcctctgtcaatgtcaaaaaacccattgcagaggctacaacttgggccaccaactgaaacctaaactaaataaccgaggaactaccctggaaaaggccaaattaaaaaaaggactaaaaacagagattacaatgtgatttaagtctaaatggatgcccaatcaatctccacaaaaggaaacttctccaacgtcaagcactccgagtcattccactgtgaatcagtgaaatccaagaaggaaatatctgattcaggcgatgatgaacccgcaaatgattcgtcggatggagaaggggatgacgatgatgatgaaatctccaccttacaatcctccaaacccaaaaaccccgattcgggatccgatgaattatccaggaccatttccgcctgatgggtggaactttcaatcttcgcatcggcgactaggccaggcttccctgaattcccctgtttctgcgaaatagccaagttttggcaaatggcttgaagcttcgcatccactgaggagtggagaggcttgtagtccccgaattcgcctgcaacaagtgacccttggtgccggagatttgggaaattgagcctggcgaactctcccctgagcttaaaagcggccttatcataggccaaagccgcttcttctgcagtatcgaaagtgccaagccacaggcgggtacggttcttaggaagtctgatctccgcaacccattttccccaatgccgctgtctcactcctcgatagagcttagctggtttcgggggagttccaacctgcttcatggggatggctttggggccgaggaagtttagggtatgttgctgctgccatt

SEQ ID NO: 11777 - DNA, 822 bp, Vitis vinifera
  Predicted polypeptide sequence is orthologous to G8
tttttttttttttttttttttttttttggaatgaaacgaaatggagtgcttcaagtagaagtaccaggtacactgttatgatcagtttacatggcttcatattaaacagaaaacaagcacagaaacgactctctaattggttttgctttccagcagggtcacttcctaagcagaaagaggggaaaaaaattatcaaaactgcatctgttgacttgagctcccaaaattgtagaagcaacttgtactgttggtggtggatgtggttggtggggagatttgtggaggaggctgcagggcaggattaatgttcctgggatttaatagtggaagagttgcagagggaccaatggtggagcaagaagggaatcctgatgatgctgcagtagacaacagtgggattgggatattgacaccatggccatacacttgccttgcccagtttgagaatcttggtgaagaaaccccttccaaccttttctccagggctgtttcctcgtgaattggtaagaaactagtgcatatgccggatatcatgggaaggtgcttggatactgtggttagactatggcggggttgtccaccaactagtgtgtaagtggagccctcaaccatggatctcctcccaactgcgtcatttcccctaggaccatcgggagggaaagaaagcccaaggttcaaatcaagattgtgcccactgcttctgtcattggcctctaagattgccccttctccataggaacttgatacaaagatcgggaccgcttcccttccatcgtatcgatcagcagctttgtcatatgcccttgcggcttctatttcgct

SEQ ID NO: 11778 - DNA, 745 bp, Vitis vinifera
  Predicted polypeptide sequence is orthologous to G8
ttttttttttttttttttgaagttcaaacaaggcaaaaatatctaaattggctcatcccactcaggctaaagcaccctggtttaacaggcttcataaaagagaaggatcaatctaatgtctcatatctacaaccacacttcaaaattagaatatatgaattcatttaccaatcttagtttgctttgcttgcctacccacctgctttcaatgcaaatgagaagatattgaattgtggctgtttctgctggtagcttgtttcagctcctgcagtagtagtaaggggatatactggtggtgttggggagtgatggagagtaatagtgctggagaactgttgtactctgtaagctgccttgagtgggattagctggtgaagcagttgtaaccgaagacaagaatcctgatgatgctgcagtagagaagagaggtggagtagccccaccataagggccatgaatttgccatgcccagtttggcaagtgatcaacttcaatcctcttctctattgctctttccttatagataggaaagacacgagaattttcaccactccagataggagggtgatcagatgccattaccaggccatatgatggatgaacccccagtgttgctgaagtagagttctcaatcctttctcccctgtcatcaggcatggcatcgtggccctgctgggaaggagaaccatttgctttgctgttcctcactggatcatcagacattggttcatcagaaaaatatgga

SEQ ID NO: 11779 - DNA, 846 bp, Vitis vinifera
  Predicted polypeptide sequence is orthologous to G12, G24, G1277
acatgttttttttttttttttttttttttttctaacataaaaaaaaaccaagtccatcatcaaataactaactatagccgttaaacatccctttgttgggttgggttgttacatctgacaaagtgatgaaaaccaaagagtaagcagctttgcccgtttgacataatcctttggattatagttccagtttcggattacccagcaacaattcctttgtttttctcttcttccatggttgcagaagaaagagatgggtaatagaggggaacacaagatcataagttcatgatctgtgggtttgagatagctgtcaatcatcatctgaactttctgggctagggtactcgttcaagtcgggtttgtcggagactctgctagaattgggttctgatgcgtggagggcggtctccatggcgtcaaccctagctccgacttcggtggctttctttcgtatggatgcggcggataagtcctgaacctcatcttcttccgctatatactccgggaagttgaggcgagcagagcggccccggagacagaagacggcggtgtcataggcacgggcagcggctttcggtgtggagtatgaaccaagccatatcctggacctcttgttgggttctctaatctcagccacccacttaccccacttcctcatccttatacctctgtaaggcttctcttgttgctgcctctgcttccgcttctctgtggtcgcacaacacttgccttccatcatcacaaccgacctttgttctgtgccccaaacagccccaagctaaaaaccaaaaccagaaaaaattctatctcccccggccgtatggccgaattcccggtaccacacat

SEQ ID NO: 11780 - DNA, 790 bp, Vitis vinifera
  Predicted polypeptide sequence is orthologous to G15
ttccgtggggtaaatgccgtaaccaactttgatataacaaggtacgatgtggagcggatcatggcgagcaggaaccttcttgctggagaacttgctaagcgaaacaaggacatggaatccaccagtgaggctaagaatctcaacccttctgttcataccagcagtggggaagccattctctcccaggataacaatcaaagtgaatcaggatggaaaatggtgctctatcagtcttctcaacaatcgaactcctgtttgaaacagcttgatcagaagccactgagttttgatcattacagagccccatcttttccggtggccccacacaatctgatggggacggacgctatgggtccagctcagcaagaggctgaagactcggccaagatggggacccacttgtcaaatgcttcctcattggtgactagcttgagcagctcaagagaaggtagccctgataaaaccagccttcctatgctctttgcaattcccccatcagcacccaagttcttcgccactccagcaaatactgtgaattcctggatcccatcagcccagctgaggcctgcaatccccatgcctcacatgcctgtctttgcggcttggactgatggctaagaaacttgtgttttggcaaaactggtaaaagtttttgcattaacaaaacatgggtggaaagggaaagggaaagagaatggtttcatgttggttttttctgaattactggtggaaattggggggttaatgggggtcaagggtgggacctattgtgaacatggttcaaaatttt

SEQ ID NO: 11781 - DNA, 648 bp, Vitis vinifera
  Predicted polypeptide sequence is orthologous to G15
ttttttttttttttttttttttttttttgcaaaatcttcattccaatatgagccaaaaggttgagtctgaaaaagttgccaacactttggttacagacagattactggcccctacccttgtctttttcattcactaataccataggaaaagagaaaactaaagtaaatttctttttaccaatcccccccttccacccctcaacaccacgattttctttcccccttgtccatgcaaaactttacatgtttattacaatgaagctttaggtgtcattccaagcagcaaaaaggggcaagtgagccatggaaactgcagcagtcctcagctgggatgttgggatccatgaactgagtgcgcttgcaggccccatcaattttgatgctaatggaggctttgcaaacagcattgcagggccagttttatctgggctagcttctcttgagctgctcaagctggtcaccaaggacgatggattggaaaagtgcgtccctagtttggtcgattcatccccaatgggctggcttgtgttcactgaatcaatcccaataagatcttgcaatgccattgaaaaagaggtggtcctgtaccctccaatgctcattggtttctgttcaagtgattccacacaactacttggctgctgcccc

SEQ ID NO: 11782 - DNA, 774 bp, Vitis vinifera
  Predicted polypeptide sequence is orthologous to G15
tttttttttttttttttttttttttttttggtaattttctaacgggaagttgatatgagtagaaggtccccagtatttgagggccgccagatcgtaagctcttgcagctttctcttccatatcatacccccccagataaacttgtcttcctttcctagtctgcccctccttcttgcaactattatcccaaagatgggcttcatatctaccagtccatctatgccttgtaactcctctatattgtgaagtcctctgcccaaatgtgtcaatggacttcctatgaactggttgcttttgtgcaacctttccggacccccttttctttgtttccatggccacacactcagctccggtaggcgagatctgtcttggagctgtcacacagcttgactgagaaccggggctcatggacaagctgagagactgtaaatccccacaacccatagctccaatagacccaggagctcctccgtcatcaacgatgctgttgttcatctgctgctctagtgcatggtgagtcgagtagtgccttgcaacccagtttttcaggcaaggcattccatcctcccccataggagggatctgggtatggcaatctgcaagttgggtttcctttgtttcttcttctaatgggttctggtaaatcccattgcaggcaagtccagtgaaatatgggtggtgttgaactggaatttgttgctgaccttgttgcctaaaggattcctgaagaaggtttagagaatgttgcctactggtttcaggttccgcattttg

SEQ ID NO: 11783 - DNA, 559 bp, Vitis vinifera
  Predicted polypeptide sequence is orthologous to G19
tttttttttttttttgtaaagacgtttttacattattacccatataatataatgagcagtctaattatagcagaagaagaaggaaggactaggaaggaaattaacagaaaaagagcagtagatacatgcaccgacaaacgccgtaaaatccaagggtcttaaagcaaacgcagatgacgacaaccgacggcgatgcatgtaaccacatgcatttattactgtatctgcgatgcactggaaccattacagagtggtgcatcaaaacgcagcgctgcatacatgcagacgatggtggtgagggtgagtggaagcaaggtcctccagcatccagaggtcgaccgagtctgactcggtgatttcgttcaactgagtggcggcctgttccggctccaaacccaggagcgattccaagctcgagatttgctccttaaactccaactcgctcgctgcttcgttctcgtacggagcaggataggtcattaatggtggtggtggtacggtcggctgataacttgactgtgctgtggggtctggaacacgcatcgtcttttggtggcgg

SEQ ID NO: 11784 - DNA, 805 bp, Vitis vinifera
  Predicted polypeptide sequence is orthologous to G20
atgcagcagcggaaagtgaattttttggtggtttttgcatggaaagaaaaattgatctaacgggttatattaagtggtgggggcccaacaaaactcgccaatcagattccctcgcaaaatcatcagaggaaacaaagcaaggcagtggggaagatattggcagtaaacttaaaacattggaatgggcaatccagcctactgagccatatcagatgccccgtttgggccttccccatgaagggaaaaagcaaaaaagttccactgcatcggccttgagcattttgtcacggtctgctgcctacaagagtttggaagagaaagcatccaaaaagcaagaaaataacactgataatgacgagaatgagaataaaaataaaatcaacaagatggatcatggaaaagcagttgagaaatcaacaagccatgatagtggaagtgagagacttggagtagcattaggattgggtggggaattctctattcaaagaagtgtgtatccattgactcctttgttatccgcaccacttcttaccaactacagtagtgttgatcccttggcggaccctattttatggacgtctcttgttcctgctctgccgactggacttccacgtactgctgaggaggaacaatgacacttccacaatctcctacaatttggtggaaaagcagacgtttgcttgagttccatttgagtgttctagcgatgcagtattttgaaaagaaggtggaaaggtatgaacacctcagtttgtctttagacatcagaagctttcagttattcttcaatgcttgttttacacag

SEQ ID NO: 11785 - DNA, 712 bp, Vitis vinifera
  Predicted polypeptide sequence is orthologous to G25
ttttttttttttttttttccaaaaacgcggaattaggccgctgaattttattcgacaatttcgatattaagaagtcactggaatacaggatcaaaagtttattcaacttctatccgacaaaatttagcagcaaatcatcctaattaatggggaataggaaatctaacaatttcctcccatgacccaatttacaaacgacctaaaagatgcaaaaataattaaccaaatgcttatagagcagctgaggtgggttgaggagcaactgcaaattcatcaaagctccaaagagcttccatggcagcaccaccgcaagcaccagcattttcctgagcagcgttgggaaccgcggctgagttgccgtcgagataggggatctgatagaacttcatgaccgactcatacgccattagctcctccgacagcttctgcacttccatttcctccttctcagcttccgtcacagtctctgtttggttctctttctgatttttcactttcccaacacaggctttctgattgcaattcaacaatccagaggaagggtacacagactccgaatcagagccgtatttcacttcggttgtgacagcaaccgggttagcgttcatagcaccaacggtgttgaacccattggaggggaatgctccaatctggttcaagtgatcagcaaaacccaaactttttgagaaatttggggtatagggctgacaaa

SEQ ID NO: 11786 - DNA, 618 bp, Vitis vinifera
  Predicted polypeptide sequence is orthologous to G27
tttttttttttttttttgatagaaaataaaaccattccatttctcactcttccatttacatatatatacacattaaccaccacaagctcagcttcatccactcgattgtgaaaattaccaggggtagttagtaaacgtaacttcatcgccaaacgacgtcgttacatcatcaaacaagcactcaaacgactcaaaactgagaggactgtgtaccggccctccaaatggcgtcgtttcatcaccaacctcaaacccacaccagtcctccaagctcaggtcccgaaccccagcgctggtatccgttccagcagcagagttttccgctgccgcctttgcagcagccacctggatgtcccttctagaagacgactctgggcggggcagcgactcggccgattcggggaagttgaggcaggccgagtcgcccctgaggaagaacgcagcggcgtcgtaggcccgagcggccatctccggcgacccgaaagatcccagccagacccgggtcttcttacccggaaggcgaatttctgaaacgtaccggccccagctgcgtttccggacacctcgaaagggagaatcggattggcgtttgggtttgagctgagaagaagcctcgtg

SEQ ID NO: 11787 - DNA, 793 bp, Vitis vinifera
  Predicted polypeptide sequence is orthologous to G43, G46, G1419
tcactctctctacctgtttgcagtgccaatactccactacctcccagtgctcatctccattgatatggcagaagaagcttcatcgcttcacttcattcaccaacaacttctcttcgactttgaagctttcgaaagcttcgtctctcatgtaaatgatccatcccaaacttcaacctctgattcaagtccttccacctcagatattgttccgctctctaattactcgaatctccatgaacatgaaaacaacccttttctcctcgactgttctacttcggctccatcagggtttttccagtttgaaaccaaatcccccaaaacttccacattaagtcatcggcgacctccactcagcatctcagtccctcagccagtcgtttctcagtcgcaggcggagtccgattcaggcgatatcaggcattacagaggcgtgaggagacggccatgggggaaatttgcggcggagattcgagacccgaatcggagaggatcgagggtatggctggggacattcgagactgccattgaagccgccagagcttatgatcgagctgctttcgagatgcgtggctcaaaagccattctcaatttccctcttgaagctgataattggtcgggttctgatccaccagcgatatctggccggaaaagggagagagacagtgagactgaagagagaaaacaagtggagattaaggtttaaagcaagaggagcacttgcccgaatccgacagcacgctgatcgcagccagtcatgttttaggggttagtccattaactccgtcaaacttta

SEQ ID NO: 11788 - DNA, 801 bp, Vitis vinifera
  misc_feature (679)..(679): n is a, c, g, or t
  Predicted polypeptide sequence is orthologous to G43, G46, G1419
tcactctcactctcactctctttaagtgctcgtctccattattgatatggccgaagaagcttcatcactgcacctcatccaccaacaactcctctccgactttgaatctttcgaaaaattaaacaatccatcccaaacttcaacctctgattcgagtgtttccacctcagatattaatccgctctctaattacttgaatatccctgaagatgaaaacaacccctttctcctccactgttctacttctgctccgtctgggtttttccaatttgaaactaaatccaccaaagcttccagattaagtcgtcggcgacctccactcagcatctcagttctcagccaaccattcctcagtcaccggaggattccgattcaggcgacgtcaagcattagaggggcgtacggcgtcggccgtgggggaaatttgcggcggagatccgagacccgaatcggagaggatcgagggtatggctggggacattcgagactgccattgaagcagccagagcttatgatcgagctgctttcaagatgcgtggttccaaagctattctcaatttcccccttgaagctgggaattggtcgggttctgacccaccagcgatatctggcccgaaaagggagcgagagagtgagagtgaagagagagaacaagtggagacgaaggttttaaagcagnaggagcagtcgccggaatctgagagcacggtggcgggggcaaccagtaatgttttggggattggtccgttgactccgtcaaattggagggcagtgtgggaggagagagagatggagggaata

SEQ ID NO: 11789 - DNA, 763 bp, Vitis vinifera
  Predicted polypeptide sequence is orthologous to G43, G46, G1419
tcactctcactctctctacctgtttgcggtgccaatactacactatctcccagtgctcatctccattgatatggcagaagaagcttcctcgcttcacctcattccccaacagccccttttcgactttgaatctttcgaaggcttcgtctctcatgtaaatgttccatcccaaacttcaacctctgattcaagtccttccacctcggatattgttccgctctctaattactccaatctccatgaagatgaaaacaacccttttctcctccactgttctacttcggctccatcagggtttttccaatttgaaaccaaatcccccaaaacttccacattaagtcatcggcgacgtccactcagcatctcagtccctcagcccaccgtttctcagtcgccggtggagtccgattcaggcgatatcaggcattatagaggcgtgcgccgacgaccatgggggaaattcgcggcggagattcgagacccgaatcggggaggatcaagggtatggctggggacattcgagactgccattgaagccgccagagcttatgatcgagctgctttcaagatgcgtggttccaaagctattctcaatttccctcttgaagctgataatcggtcgggttctgacccaccagcgacatctggtcggaaaagggagagagacagtgagactgaagagagacaacaagtggagattaaggttttaaagcaagaagagcacttgccggaatctgactgcacactggcggcagccagtaat

SEQ ID NO: 11790 - DNA, 691 bp, Vitis vinifera
  Predicted polypeptide sequence is orthologous to G43, G46, G1419
acgccgccgcccctgggggaaattcgcagctgagatccgcgacccccaccgccgagggtctagggtttggcttggcaccttcgacaccgccgtcgaggccgccagggcctacgaccgagcggccttcaggatgcgcggcagcaaagcgatcctcaacttccctctcgaagccggagcaccaccagaggcttcgcagcggaaccccagcgttcggaaaaggctgagagagactgagaagaacgactgagagaccgtggaggtcaaagtaataaagaaggaagagatagttgagtcgccggtttcggacgtcacgttggctaatacttcgacggcagtcgcttgtcctttaacgccgtcatcctggacggccgtttgggatggtgcagatgggaatggtatttttaacgtgccgcctttgtcgccgttatcaccccttgtgatgacatgagatgaaacgttataacggcgttcaagaaagcgaaaaccatctgacggcgctacagtcttggatgatgcgtaaattagaaatagaagatttattcaaattatttaaaaaaccaaaaatataaaaaataaaataaataaataaattggggaaaaaaacagtaaagttagtagagatacacgtggaaaccacacgtggaacatggttgtgtatccccaatataatatgcttgatgatgcttgttgt

SEQ ID NO: 11791 - DNA, 609 bp, Vitis vinifera
  Predicted polypeptide sequence is orthologous to G43, G46, G1419
gatctcggtcccacggccgaccaaggaaattgaatggttggagttcgctgagccgaaacaggcggccacagtagaaccggcgcagaatatttcccatcctgaggagaagaagcactacagaggagtccgacagaggccgtggggaaaattcgccgcggagatccgagatcctaagcgtcgcgggtctagggtttggcttggcacctacgaaactgccatcgaagcggccaaagcgtacgacagagccgcgtttcagatgcgtggaagcaaagcgatcctcaactttcctcttgaagccggaaaatctgccgagaccagcgccgattacggccggaaaaggtgcagagaagccgaaacggaggaaacggaagtggaagcgaacccgccggcgaagaaggagaagttgccggaagctgacaccatcacacatgtgcaaaatgatactccgttaacgccgtcattttgggacttcgacctggattccgtaggctgtttatttaacgtccctcccatgtcgccgttatctccccatccgaagttcggttttcctcagcttatggtcatataattacaatattttccaatgcatttagtgactttcaagtgtat

SEQ ID NO: 11792 - DNA, 688 bp, Vitis vinifera
  Predicted polypeptide sequence is orthologous to G43
gtattcaatcctttcattcaattcttctgtgtttcaacaactcagcttctgtgtctctagaagttgtttgaatttgaagtttgagcttgctgatcatggcaacagcagttgaagtctcagcactccaactcatcaggcaacacctcctaggggagttgtctccaaagaacatcgtcgtcactgaccttacagtcggtgaagaatggagcaatggattaaattctgaggtttcgacctctcaatctgattccttctgttctcaggctgctagttgtgactctcctgtcacaatctccgagttgttcggcagcacggatctcagcgctgatttcttcggcttcgtccccagctccacctctgagcagtctcaaagtaatttcttcgagttcgaaactaaacctcaaatcatcgatctaacatcgccgaaagggctgaactcgagtcatttttttgaatttgaaacaaaacctcaaataaaagatacgacgaaaacaaaatcgctagattcgagctctcaatcgactggtaaagatcgaaaaccgtcgttgaagatctcggtcccacggccgaccaaggaaattgaatggttggagttcgctgagccgaaacaggcggccacagtagaaccggcgcagaatatttcccatcctgaggagaagaagcactacagaggagtccgacagaggcc

SEQ ID NO: 11793 - DNA, 334 bp, Vitis vinifera
  Predicted polypeptide sequence is orthologous to G44
gttttttttttttttttttttttttttttttggagtattttgtgatactttatttggaggacaacaaaaaggaaccctgtgggatataaacaaattcaatgttgttcatagaatatataagaattctactaacatttaaatgtctttggtaaggtagagaccctctaattcagactatgacctgagaataggctatccaaggatggggtgataacggcgttaacggtggcagatggaatattccctccatgtctctctcctcccacacggccctccaatttgacggagttaacggactaactcccaaaacattactggctgccgccactgcccc

SEQ ID NO: 11794 - DNA, 903 bp, Vitis vinifera
  Predicted polypeptide sequence is orthologous to G44
tcactcacttctcttccccctactctctctctctttctcaccttgtttcgactttcaaccctaggctattcctcactgctcatctccaatcatgggagaagaagcttcatcactgcaactcatccaccaactcctcctctccgactttgattctatggaaaccttcgtccctcatgtaagtcattcgttaagatcttcggcctctgattcaagtgcttctacggatgatattattcaagtttccgagtacccgaaactccatgaagatgaaagcaacgcttttctcttcgactgctctacctcttctccatctgccgtcttccagtttcaaaccgaatccccaaaaccttccagattaagtcatcggcgacccccactcagcatctcctttcctccgccacccatttctgacacttcgtcctcgttagactccggcgagagaaggcactatcggggagtgcgccgccggccttggggaaaattcgcggcggagattcgagacccgaatcggagaggatctagggtttggcttggaaccttcgagacagccattgaagccgccagagcttatgatcgagctgctttcaaaatgcgtggctgcaaagctgttcttaattttcctcttgaagcggggaattggtcggattcagacccaccggcgacttccatccggaaaagggagagagaaagcgaaagtgaagagagggaacaaccagagataaaggttttaaagcaagaagaagcctcaccggattctgacagccccgtggtggcagaggcggctaatgttttggaggcgagtccgctaacgccgtcaagttggaggaccgtttgggaggagagagacatggaaagggcattccatttgcctccgttaaccccgttgtcaccccatccttggat

SEQ ID NO: 11795 - DNA, 714 bp, Vitis vinifera
  Predicted polypeptide sequence is orthologous to G44
gctctcatgtaaatgatccatcccaaacttcaacctctgattcgagtgcttccacctcagatattaatccgctctctaattacttcaatccccatgaagatgaaaacaacccctctctcctccactgttctacctctgctccgtctggctttttccagcttcaaaccaaatcccccaaaacttccacattaagtcatcggcgacctccactcagcatctcagtccctcagcccaccgtttctcagtcaccggcggagtccgattcaggcgatatcaggcattacagaggcgtgaggagacggccatgggggaaatttgcggcggagattcgagacccgaatcggagaggatcgagggtatggctggggacattcgagactgccattgaagccgccagagcttatgatcgagctgcttttgagatgcgtggctccaaagctattctcaatttcccccttgaagctgataattggtcgggatctgatccaccagcgatatctggccggaaaagggagagagacagtgagactgaagagagacaacaagtggagattaaggttttaaagcaagaggagtacttgcccgaatccgacagcacgctggcggcagccagtcatgttttaggggttagtccgttaactccgtcaaactttagggccggctgggaggagagagagatggagggaatattccatctgccaccgttaacgccgt

SEQ ID NO: 11796 - DNA, 846 bp, Vitis vinifera
  Predicted polypeptide sequence is orthologous to G129, G136, G140, G146
tttttttttttttttttttttttttttgacgaaaaacaggcatgctagcaaatataacaaggagaaagaagcacacaaaggatcagtatagctacatcgatcagtagaatctttcatggagtcatagtgtgaaacatgtagagaagtagcactctaacaacatacttgggtgacctatgcccatcaacaaagatactaacttgtcagagtattaagttcctccacttgagaaaagttgatccctgctttttagtgtttctcaagataatctgtagcttgcatccgctaggcactagatcatccccacagaaactaaaaacagcagaaattactggtccttgaagcatattaaactaattgaagagctggttggtcttggcgagagtatgattgatttggttgcagtccatttagttggaaatagtttctagagtcgaactgctgagatggcatgagttcatagttagctccttctggcatcaagctcatctgctgttggtttctctcattctcggctatccttgctcggagatactggttatcattatgcaagtctatttccctcttttgcatatactcgatctcagcaaacaacagctcattctttttggatctgattctacttatgcctttctctaaccgaatctccaggctcttgaggtccttgaaattcaaggagcccagagactcacccagcatgtgcctgttcgaattctgcaaattacgaatctgctgatgcagtttggaggattcttgctggtagaactgagcattggcttcagaaacggacccggtgttggaggatctgcgcttgccttcttatacctctcattgttgatttacact

SEQ ID NO: 11797 - DNA, 942 bp, Vitis vinifera
  Predicted polypeptide sequence is orthologous to G129, G136, G140, G146
cgcgtttttgcacagtttgaaattttccgaaagctgaggtcgccggattttggaaacaagtgtagtgaacatggggagaggaaagatcgagatcaagaggatcgaaaacacgaccaaccgtcaggtcacattctgcaagcgaaggaatgggcttttgaagaaggcttatgaattatcagtgctatgtgatgcagaagttgccctcatcgtcttctccagccgcggtcgagtctatgagtactcaaacaacaacataaaatcaaccatagataggtacaagaaggccagctcagatagtacaaatggaggctttaccatggagatcaatgcccaatattaccagcaagaatcagcaaagctgcgccagcaaatacagatgctgcagaattctaacaggcacttaatgggtgattccttggcttccttgactgtgaaggagctaaagcagctcgagaacaggcttgaacgaggcatcacaagaatcaggtcgaagaagcatgagttgctgttggctgagattgaatacttgcagaaaagggaaattgagctggaaaatgaaagcgtatatctccgaaccaagattgcagaagtggagaggcttcagcaagcaaacatggtatcaacacatgagttcaatgccatccaggcattagtttctcgcaatttctttcagcccaatatgattgagggtggatccacaggctacccacttcatgataagaaggtcctccatctcgggtaaatgatgggagaaaatatccgccaacttcatctccttaagatgtttaaataaatcttttcccatgctatccaaactgttatgtaacggagaattaatgtcattgttgtatttggggtttctatgacttggtatttatcagctagctaccagttctgttttgtataacattagtacgatatataataatagcctattaaaat

SEQ ID NO: 11798 - DNA, 1160 bp, Vitis vinifera
  Predicted polypeptide sequence is orthologous to G129, G136, G140, G146
gcaaaatactgaaagatacactataattcttgttttgcttcttttggatgtattggattctcttgctttgtttcaagttccaattcaggcttaaatgtaacaaaatttgcttatagaagcatcaatttggtttagctcatttcagctttcaaccacggagtttccgaatcaagcctcggaggggtcttcccaaagaaaaatgggaagagggaagatcgaaattaagcggatcgagaacaccactaatcgacaagtcaccttctgtaagcgccgcaacggcttgctcaaaaaggcctatgaattatcggtcttatgtgatgcagaagttgctctcatcgtcttctccagccgtggccgcctctatgaatatgctaacaacagtgtgagaacgacaatcgaaaggtacaaaaaagtgtgttctgattcctccaataccggatctgtttctgaagctaatgctcagttttaccagcaagaagcctccaaattgcgccgtcaaatcagggatatacagaatttgaacaggcatattctgggtgaggctcttagctctctgaactttaaggaactcaagaatctggagaccaggctggagaaaggtatcagcagaatcagatccaaaaagaatgaattgctgtttgctgaaatcgagtacatgcaaaagagggagattgagctccaaaacagtaacttatttctgcgagcacagatagctgagaatgagagagcccaacagcaaatgaacctgatgccagggtctcagtacgagagcgtgccgcagcagccatacgactctcaaaacttgctccctgttaacctcctggaccctaatcaccattactctcgccacgaccaaacagctctccaactagtgtgagaagtggtgctgtatttgtgggtctcttcgtggagtagaatgggaatgaagagatatgttttcctgcagattgtaagcgtagttaactttatgtgaagtgatggtgagaagcagtgtgtccaagtagagaaacaagtgagagagccctttcccattttctcataaaactctctttttaaataactctgttgcctgccacaaattaagaagatgtattaattcatcttgtatgactgaaacactgaaactgaagatgaaactggaaactacctacattgcttca

SEQ ID NO: 11799 - DNA, 791 bp, Vitis vinifera
  Predicted polypeptide sequence is orthologous to G129, G136, G140, G146
ttttttttttttttttttttttttttttttgcttggataagtaatccatttcgacgcatgtatgtatatatatatgtgtgcgcgtacagataacacagaagatgaatagtctacatccaaagacggttattcacaaaatatctaagtaaaaaagcagaagcacccagattaagataagggataaagccatggacagcaacttgttgacaccaactactatacaatccaaaacactgcaagcaactggtggccatttggagcctgcggtttaggggtcacctccatcctgatcagcaagcattcttgcagtctgatgatggctcttgctgcccatttgcccgtctttctcatatcccagccccgtcatgtggaccgccaaaaccactgctgccactgctcctcccaaatgcatcacattcttctgctccaaaggctctggtgtttaagttggcctcgtgcagcttaactttcttttggaggcgggtgttgtcctcttgcagggccctttgacgttttttaagcaggctgatgtgctccgaaatgattcgcctcttcttagcacgaattcgttcaaccccgtttttcagccgcctctccagctgttttagctctttcatgcccagcgtcgacaaatcttctccggccaaatgcttatgttttgcttccaaggtgtctattgttctcctcaagttatcgatttcagacatccaaaactgctcaattgttctagagcgttggtaattattgaattccatcaacccaacttcattcctatacctggctatgctcct

SEQ ID NO: 11800 - DNA, 615 bp, Vitis vinifera
  Predicted polypeptide sequence is orthologous to G129, G136, G140, G146
atcatcaaatcccttttttatctctatctttctcgatctctccctctccctcttcatcttcttcttcttcttcttcttcttcaaaacaaattgcataggaagagggacacactagtggtggtagatctctagggagaataatagcgtgagttggatgattgttggatggtctattttgtgtccataaatacccatctgatagaacaaaccatttccattttctgcaactctcctgtgcagagctataccaaagaatcgtgtgaattcaaccagaggaggaaaaaaaaagaaaaaattgttgtttccacccttgtttatctacttctcctaagtttccttaccagctcatttcagctttcaaccacggagtttccgaatcaagcatcggaggggtcttcccaaagaaaaatgggaagagggaagatcgaaattaagcggatcgagaacaccactaatcgacaagtcaccttctgtaagcgccgcaacggcttgctcaaaaaggcctatgaattatcggtcttatgtgatgcagaagttgctctcatcgtcttctccagccgtggccgcctctatgaatatgctaacaacagtgtgagaacgacaatcgaaaggtac

SEQ ID NO: 11801 - DNA, 1029 bp, Vitis vinifera
  Predicted polypeptide sequence is orthologous to G131, G135, G155
gggaaagaatacttaagcaaaccactcttcccacacatatttatttttgatcttctgaccagggaaaaaagaaaggagcgcaaatggggagaggaagggttcagttgaagcggatcgagaacaagatcagtcggcaagtaactttctccaagagaagatctgggctgctgaagaaagctcatgagatttctgtgctgtgcgatgctgaggtagctttgatcgtcttctctactaaagggaagctcttcgagtactccactgattccagcatggaaaggatccttgaacgatatgaaagatactcactttcggagagacagcttctctcaacagatcctgacccacagggaaactggtcgatggattaccctaaactcactgctaggattgaagttttacaaaggaacctgaggcactttgtgggagaagatctggatcccttaagtctgagagagctacaaaatttggagcaacagcttgatactgctcttaagcgcatcagaacaagaaagaaccagcttatgcatgaatcgatttcggagcttcagaagaaggagaaatcactggtggagcaaaacaacgcattagcaaagaaggtgaaggagaaggagaaggtcgaacagaataatcgtgcacaatgggagcagcaaaacaacataggccaaaactcatctgcctatgtggtgccaccacccccactacagctcccttcactcaccattggtggtagttttgtggggagagctgtagaggaagacggagctgaagctcgacctagtcccaataccctcatgccaccatggatgctgcgccacgtcaatgaataaagggtggagatcatttccaggtgagaattttttacgcgacggagttacacatgtgagacatgtcagccaagtctttaatgccccagataaatccaattgtaaaatcctgaattatggtgataaatcactgcaccaccattagttaatgatttcaatgtattttggcacatgtgccttcttcaagatggcctttgcctctgtt

SEQ ID NO: 11802 - DNA, 1075 bp, Vitis vinifera
  Predicted polypeptide sequence is orthologous to G131, G135, G155
atctacttcaactgctctttgcttttgtttttgttttcttttttggaattctctttccctttcttttgggtttaattttctccgctgttttctgtttgggttctaagaaaaaaaatacataaaaataacaaaacaatcgaaaaaaaaaaaaacgcaaaaccaaaagatgggaagaggtagagttcagctgaagcgcatagagaacaagatcaatcgccaagtcaccttctccaagaggaggactgggttgctgaagaaagctcatgagatctcggtcttgtgtgatgcagaggttgctttgattgtcttctccactaaaggaaagctgtttgagtactcaactgattcttgcatggagaagatccttgatcgctatgaaagatattcttatgcagagaggcagctgactgcaactgatcctgaatcacagggaaactggtcccttgagtactccaaacttaaggcaaagattgagcttttacaaagaagccaaaggcactttttgggggaagatctggattcactgagtctgaaagagctccaaaatttggaacagcagcttgataccgctcttaaacacattcgatcaagaaaaaaccagctaatgtatgagtcaatttctgaacttcagaggaaggaaaaggcaatgcaggagcaaaataacatgctagctaaggagatcaaggagaaggagaagactgtggcacagcagacacattgggagcagcaaaaccatggtcttaatacatcatccttcctactgccacagcagcttccctgtctaaacatgggtgggacttaccagggagaagcacatggagcaaggaggaatgagctggaccttacgcttgaaccaatatatccctcccaccttggatgcttcacgacgtgaattggtttgagtcttctatatggttataatttttagttccatgtgaatatggacttatagttaagctgagagaccttttatgtatctgatttgatatctacttgggtgaggagtatatactcaacaatacatttaaatgcttttggaatctgaattattttaagatgtttccccttatatttc

SEQ ID NO: 11803 - DNA, 684 bp, Vitis vinifera
  misc_feature (459)..(459): n is a, c, g, or t
  Predicted polypeptide sequence is orthologous to G131, G135, G155
tttttttttttttttcatgaaggtgaggatatatatgtattcacttacagttgtttacatatatccagtatatgtacatattagtattggagttggttttgatgcccttctagttactctgcatttgcatttgggccttctgactatatagaatattacatacaaagagtagtagtttgaaactactggatttgcaaaataagtacaaaccttaattttgggaatgttctatagatataccagacattttcacaatgtctcctaaccactagatgcatatatagacatcaaaatggcatagtagaaagagtatcatcttgtctatttattaacatggcgcagcatccaagcaggaaggggtgtattggttcgattttgaggtggaattccttgatcatctccactatcccttgccaagcaattaccactaatatttagtgcatgcaatggctgttgtanaagaaaggatggtgagtccaggtcctggttttgctgattccattgtgcctgttcagcctgttccttctccttctcctgcacctttgcagtaagcaagtcatgttcctcctgcaacgccttaccctttttatgaagctcagaaagggattcatacatgagttggttctttcttattcttgtgcttttaagagattatcaagctgttgctcaaattctgagctcttg

SEQ ID NO: 11804 - DNA, 808 bp, Vitis vinifera
  misc_feature (753)..(753): n is a, c, g, or t
  Predicted polypeptide sequence is orthologous to G133
ttttttttttttttttttttttttttttacacagaaggcaccaaagcttttcagtgtcattatgatgatgcttgtaagttcataaaaacagaatacagacacccaagtcttagattatagtttgcttaattagatatcattctaattgaagagtttgataattagatgtccaaagaggaaatgtaccatggtccattgctactgatcaagcaaggcgcagatcatgtgatccatatcccccatcatggtgaagattagggtgggcttgatgcaggcgaaaagcatagaggttggaagccccgttcgcgaatgccaccgctgattcataatctccatcattttccactaatccgtaatgtggatcatcgcattttgcttcaaagttgagaaggagatttccgtgttgttcttccaagttcctgacctttttcctgtaggtctcggtctgagttttgatcacgtggtacttccgttcgcgtactaatcctaaagaagcgtccatcttctgctcaaggccgcgcaggtcctcaatgctcagatcgcccaaatcttcacccattctttgcctgatctctctccttaatttgttgttgatctctttcagttttcgcaagttttcttgcattcgctcgtagtgagagctccaaagatcaatccctaaagtcttctgatactgatcgtagacctttttcgtcgttatagtaggactggtatattcgtggaattttccagtattggagaacatgatgagtnaaacccccggccggatcgggcgaattcccgggcatatgtccggtaccgtcgactg

SEQ ID NO: 11805 - DNA, 792 bp, Vitis vinifera
  misc_feature (733)..(733): n is a, c, g, or t
  Predicted polypeptide sequence is orthologous to G133
ttttttttttttttttttttttttttttttgcgaaattctcacatcattacaccgacgacgaaaagaacataagttcaatgaaacctcccgctgtcaaggtacagctagaagagcgacgataataatggtgacgaagaggtaaaaactcaacagggccattagatgacaccggtttgattaatcagttctatcgttcctaataaaatctcgatgattgtttgcctgggaacgatgtgtggattcagttgctactcgagcaaagtaaaggtcaaatcagagcccacacccgagtgaagatcattaggcgggttaggctgcaagcttagggcaaataccggagagcttccatttgagaatccaagaacagattcgtaatcccctccattgtccactagcccatagaattgatctctgtcccttgcatcaaattcatgtaggagatttttgtgtatttgttccacattccttaccgttttcttgaaagtttcaatctgattattgatcacctggtacttcctatcacgaaccatcttcaaagaactctccatctcttgttcaagatctcgcagttcctcaacgctcaaatcgctcaaatgttcacccatcctctgcctaatctccttcctgagattcttgttcacatctttcagtttcttcagggtttcttgcattctctcatagtgatagctccatagatccactcctagagtgttctggtactgatcaaatatntggatcgttgtagtggaagggctgatgtattcatggagctttccagtactggagagcat

SEQ ID NO: 11806 - DNA, 754 bp, Vitis vinifera
  misc_feature (693)..(693): n is a, c, g, or t
  misc_feature (728)..(729): n is a, c, g, or t
  Predicted polypeptide sequence is orthologous to G134
ggaagagggtttggtttggagagagatggggagagggaagattgagatcaagaggatcgagaactcaagcaacaggcaggtgacctactcaaagaggagaaatgggatcatgaagaaggccaaggagatcactgttctctgcgatgctcatgtctctcttgttatctttgctagctctggaaagatgcacgagtactgtagcccttctacaacgttgattgatatcttggataggtatcacaagcagtctgggaagaggctctgggatgcaaaacatgaaaatctcagcaatgaattggataggatcaaaaaggagaatgatagcatgcagattgaactcaggcacctgaagggggaggatatctcatctctgcaccacaaagaactcatggccattgaggatgcccttgagattggccttgcaagtgttcgcaacaaacagatggaattctacaagatggtcaagaaaaatcaacgaatcctggaggaggagaacaagcacctcaattacatcgtgcaccaccagggtatgcccatggaggcgggcaatgtgagagaggtggaaagtggatatcatcagagagctgtgagggactacaatccccagatgcctttcgccttccgggtgcagccaattcagccaaacttacaggagaggatataactctcttagctatatatatagtttgtgcntttattaagaaggatacattccagactttgcatannggttgttgtagaggtgatcttattc

SEQ ID NO: 11807 - DNA, 1091 bp, Vitis vinifera
  Predicted polypeptide sequence is orthologous to G137, G145
gtgagaaaaaatctgtttgcattttgtgtttgttgttgtttggtcggagagaaagctaaaggctttccctttgttcttttcttcatttttcctgagaaatggggagaggtagggttgagttgaagaggattgagaacaagatcaacaggcaagtgaccttcgctaagagaagaaatggccttctcaagaaggcgtacgaactttcggtgctctgcgacgccgaggttgctctcatcatcttctccaatagaggaaaactctacgagttctgcagtagctcgagcatgctcaaaacccttgagaggtatcagaagtgcaattatggagcaccggagacaaatgtatccacaagggaggccctggagttaagtagtcagcaggaatatttgaaacttaaagcacgttatgaagccctacaactatcccagaggaatcttcttggggaggatcttggccctttgagcacgaaggaacttgagtcactggaaaggcagcttgatgtatcactgaagcagatcaggtcaacgcgaacacagtacatgctggatcaactcaccgatcttcagagaaaggaacacatgctcaatgaagcaaacaagaccctgaagcaaaggttgttggaaggaacacaggtaaaccagctccagtggaatccaaatgcacaagacgtgggctatggtcggcaacaagctcagcctcagggcgatggcttcttccatcccttagagtgtgagcccacgttacaaatcggataccagcccgatccaataacggttgcagcagcaggccccagtgtgaataactacatgccgggatggttgccatgaccataataagaggaaggccaaccctcacggtatgcatgcattcctttgacaaatgggtataatttctgtgttgtaagttacatgacagaaactgaagaacatgtgtaatattatgggtatccacgtttcccctaatacaccataaaaacagattctattattataactctccatccttagggagaactgtaaggtaatgtttgttgtgtgctccaagcattctgcttctttctttaattcccgcttttctccagtttgaaaata

SEQ ID NO: 11808 - DNA, 1053 bp, Vitis vinifera
  misc_feature (971)..(971): n is a, c, g, or t
  Predicted polypeptide sequence is orthologous to G137, G145
ggagaagcctaaggttatatagccaactgaaagaaacaaagattaatatatatatacgaaagaggttgatataaaggagaggaagaaggattgagagaggaaatggggaggggaagagtggagctgaagaggatagagaacaaaataaacagacaggtgacatttgcaaagagaagaaatggacttctcaagaaagcttatgagctctcagtcctttgtgatgctgaggtcgctctcatcatcttctccacccgtggaaagctctatgagttctgcagcagctcaagcatgctcaagacactcgaaagataccaaaaatgcagttatggtgcagtggaagtcagccgaccctccaaggagcttgagcagagcagctatagggagtacttgaaactgaaatctaagtttgaggcccttcaacgaactcagagaaaccttcttggggaagacttgggtccattgaacacaaaagagcttgagcagcttgaacgtcaacttgagacatccttgaagcaagtcaggtctactaagacccaattcatgcttgatcagctttctgatcttcagaacaaggaacaagttttggttgaatctaacaaggctttgacgaggaagctggatgaaattagtgtcaaaaatcaccttcaattatcatgggaaagtggtgagcagagtatgccatacggccaccagcaagctcagtctcaggggttcttccagcctttagaatgcaatcccacattgcaaataggatataatcctgcaggctcaagccagctatctgctccgagtaatgcccaaaatgtcaatggatttatccctgggtggatgctttgagttttcacatttgtttgcttgactgattgctcttggaaaaatgtttaccaggtaaatgcccttgtatggtgatgatatgtatgtggtttcattagtaatatatgtaacctttaatggcaaaataacagctatgnctgaatctccaagggctggaacacttagccaaggcatgtaagaaattcattgtattctggaaacctatgatacttgctttca

SEQ ID NO: 11809 - DNA, 667 bp, Vitis vinifera
  Predicted polypeptide sequence is orthologous to G137, G145
tttttttttttttttattgcaaaaggatttattacatagtatttgttccaaggattgtggtttctacaattgccgacaattcaattggactttattaacaactttgacttagattagagatatactcaaatcagtagctctattattgtcctctgtcatatgacagaaaaggggttggataggcatgattttagtgaaggttagaaaacaattgcgctgttggcatttctatggccaattacagatcatgagtttgggtttcaaaccatccacccagggatgaatccattgacattttgtgttgtgctggctccgttcatctcaacccgcagcacaggattgtaaccaatctgcaaagtgctatcgcattgcagaggctcgaaaaagtcctctgactgaacaggctcgcgattatatggtagattatgtgcggcagcttcccatgttgatcccaggccactttctgcactgctttcacccaacttcctccttaaggcgttgttggcttccattaggatttgctcctttctttgaagatcagacagttgatcaagcataaattgggtctttgttgatctgatttgcttcaatgacttgtccagctgatgctcaagctgctcaagctcctttgtaccaaatgccccaatcttccccagaaaattctctg

SEQ ID NO: 11810 - DNA, 840 bp, Vitis vinifera
  Predicted polypeptide sequence is orthologous to G142, G148
tggggtttgttgtagtggttgacgaataagaggaagaagaagaggaagagaggatggggagagggagagtggtgttgcagaggatggagaacaagatcaaccgccaagtcaccttctccaaacggagaaatggactgctgaagaaagcctacgagctttctgtgctctgcgatgctgaggtctgtctcatcatcttctctagccgtgggaagcttttcgagttcggaagctctggcatgaccaaaaccattgagcgataccgaagatgttgttacgcctcaagagataacaatgacgctgagcatgatcttgaagagatgaataaacagctcacatcgaagcttgaggaacttgaagaatgtgttcgagttattgaagcttcatgggattctggcacagtagctggcaacgacaacctcaacatgcacatctctcaacccaaccaaattcaacctcaaccccaaccccaacccagcctaccaatggggttccacgaatttgttccaccggaaggagcagctatagcaaggaatgtaggcaatgcccggaatggcctcgcccaaggatggcttgtttgaccttcaaaccatcataaaaaataccaataaatgcgtgatgttgcgacttatattttgtttggaattgacttcttgagtgatctttgctttttcaaaattattatatatgtatatatggtttgttttttttatgcaattgaatatgattttgataataaacatagatatgtacgagacattctcttagacttgtgtgttcgagtttcttaatttgagaataagaatggacataaaaaagaaaaaaaaaaaaaaaaaaaaaaaa

SEQ ID NO: 11811 - DNA, 1008 bp, Vitis vinifera
  Predicted polypeptide sequence is orthologous to G142, G148
ctcgcgtgcccattgaagtcacgataggagagcccaagaaaaattatagaggagcatctgggttttcactcagagtggtgtaaggagagagagagagaatggggagaggaagagtggagctgaagaggatagagaacaagatcaaccgtcaagttaccttctccaaacgcagaaatggtctgctcaagaaggcctatgaactttctgtgctttgtgatgctgaggttgctctcatcatcttctctagccgcggcaagctctatgagtttggcagtgctggtactaccaaaaccctagagcggtatcaacgtgtctgctacactcctcaagacaacaatatggaatgtgaaacacagagttggtaccaagaggtgtcaaagttaaaggcaaaatatgaatctctccagcgcacccaaaggcatttgcttggagaagatcttggaccgctgagtgtcaaagaactgcaaaatcttgagaaacagcttgaaggagctctagcacaagctaggcaaaggaagacccaaatgatgatagaacaaatggaagaccttcgcaggaaggagcgacagcttggggatctaaacaaacagctcaaacttaagcttgaggccgagggacaaagtcttaaagccattcaaggttcatggaaccccagtactgcaactgctggaaacagcagcttccctgtgcatccttcccaatctaacccaatggactgcgaacccgaacccatcttgcaaattgggtaccatcactatgttccagcagaagggccgtctgtttcaaagagcatggctggtgagagcaacttcatccaagggtgggttctttgaagtagtgtttgatcaaaagagaagaagaagaagaaaaaaacataagtatgacttctatatatatttgtgtaatgtgtgtattgtgttgacatactgatcaccacatgaattgcttgtatacttatatagcttctctttcatggggacaatatatatatatcaccatttctagctg

SEQ ID NO: 11812 - DNA, 937 bp, Vitis vinifera
  Predicted polypeptide sequence is orthologous to G154, G627, G1011, G1797, G1798
acatgttttttttttttttttttttttttttttttgcaggagaaaagcacattgtgaaatttaatgcagggcaatttacatcataatacaattttctgagaaagtattcttctgatcataccgaccattgagtgtattcaatagacaaaacattactcttactatacgactgatactagaatcattgctcgcgctggtgcaactcatagtatatagcagtgttgctgagcatggaccccttcatcagtttcccaataggaggcgcttggctctcccctcaggcagtccaatgaacaagtcagtggagacatctgaattttggcttctctctgcactaggcaaagtttcattctcttgattcggagcttgatacggttgcaccccacacttttcacacagcattgcattttcagctgctagggctttctccttttctttcagttgctcgatttgttccttgaaaacctgattctttcttgctcggatgctgcttacgctgcgctccaactgttgttctatctgttgtagttcttcaatggagcatgaccccaaaccttctcctaagagtttccgtttggaaatttcaagaagctctatcttctttgccatatttgctgcttcatgcttcaaatgctgcatgttatgttcggtagtcttgtagttgttggtatgaacatcttttgtgtgccgttgatatcgttctattgtctcctgcatactggaactggaaaattcatagagcttccctcttggagagaaaatgatgagcgcaacctcagcatcacagagcacggagagctcgaaggccttcttgaagaggcccattcctccgcttaaaaaaggtgacttgccgacttgtggcgttttctatacgcctcatttgagtctttcctctcaccatcctccagaaaaccccgttgaaaactctccaaaaaaa

SEQ ID NO: 11813 - DNA, 851 bp, Vitis vinifera
  Predicted polypeptide sequence is orthologous to G154, G627, G1011, G1797, G1798
ttttttttttttttttttttttttttttttggtgctaaatttagattagatcgattataatttgttgcctaatctaacattaggcaccaactccctgtagtgaaaacaaaaactagagcaaggaaaactaattaagagtacaattaatggcgatgaaaccgggtttccacaaaccagcaacttcacactacattttttttttctttcaggcaggcataaactcacactacattaactttaatgctatatatatttgaaatttattctataggcacaatcttaacactacattattcttgtttattgaatgctgccactcagatgattagcgagtgcaattatttgatgttgaaattgaaaatagacactgcaaatcacgatctggaaatgtggccaagaacatcagcaagtccccacttggtcatgagcagcgcatttctggcaggccgatgaacaactcggtctccacttcagaacttggactgctttggctgtaggttacaccttcacttggttgtgctgagagttgccactgccttgtgtccttttgacttaaccttgcattttcttctagcagttgtttctccctttcttttagctcctcaatctgctcctggaatatctgagcctttcttgccctgatgctctttaagctcttctccagttggctgtcaatctctaggatttcgtccagagaacatgagctcaagccttgtcccaaaagcttccgttgagaaacttcaaggagctctatcttctttgccatgctttctgcatcctgcttcaaattctgcatatattgctccaattctggattgttggtttcaacttgttttgcatgttcacggtat

SEQ ID NO: 11814 - DNA, 678 bp, Vitis vinifera
  Predicted polypeptide sequence is orthologous to G157, G859, G1759, G1843
gattctgtagtggcaatagcttgagaaacattatcgagtcttacctacagataagtcgtgatgcagaagcaaatgttggcagcagctctcatgaagccaagcagaagcgttatccagttccatgggcaggtgctgacctacttaaaatagttgaaagtcaggttgaagggccacgcatcgagcaactaaggttgtcagagctcagccaactagagcaaaaactggatggcatgctgagacaaactaggcgacggaagacacagctgatgatggaagccatagcatgcctcaaagaaaaggtaaaggagctgaacgaacaaaaacagcaaatggagaagatgattgcagcagcagagagtaaagacgccctccagcatgaggacctggtgatggaacaagccggtaacaacagcaagccccctccccagaatgttgtgctgcagttgctttgattcaatgctagtgacaagcttgacacgtggcaattgataataaaccgttctacacaagtgccagctgtggtatgtctcagctatctagttctaatcttgaagtggacttctctgtaagcttaggttggggagatattctatagtatttgtttggtggctggaggatagtacagaaagtaatgggacatccaccgcctaattgtatctttggtcttatgactccttg

SEQ ID NO: 11815 - DNA, 851 bp, Vitis vinifera
  Predicted polypeptide sequence is orthologous to G157, G859, G1759, G1842, G1843, G1844
ggggggcttgaagtagagatatgggtaggaagaaggtcgaactgaagcgaatcgaagacaagagcagtcgccaggtgaccttctcaaagaggcgaaatggcttgatcaagaaagctcgcgagctctctgttctctgcgatgtcgatgttgccgtcctcgtcttctccagccgtggaaagctctacgagtacgctaatggaaacagtttggctaggatccttgaacgttatcagagtcattttgaagcagaaggcaatgcctctacaggtgctaatgaatcagagaattgtcactacgagtatacaagagactggactgagctactgcagacagtgcaaagccaacttgaagggcaaaatgatgagcagatgagcgtgactgaccttgtgcaactagagagagaacttgatgctgccctgcttcaaaccaaatctagaaagaatcaactaatgatggagtccataaggcatctccatgaaaaggaaaggatgctgaggcaagaaaaggagcttctagagaaagagatggaagcaatgaggaaggagaaggaagaaggctggaaggagtgtgcgattgggaacaacctcgatccctttaacccggaagagccctgtcctcatcaaaggacaaccctttccttgcttagagggtaggcaccgctcatacccaccgccattgccaccgcttaaaaaggtgtgctaggcttcagtggaaggccaagtgtttggtgtctcaacggctgattgcaatgacgttttattacgtgtgtatgaactatagctgccaagtggccgttcttgtatccgctcagtctctttattagtaataagtttagtttcaaaaaacctatt

SEQ ID NO: 11816 - DNA, 605 bp, Vitis vinifera
  Predicted polypeptide sequence is orthologous to G168
ttttttttttttttttttttttttttttttgtttacaagctttggtgggaaatttgagaagaattcttccttggcagaacacaacatgggtcgatcgaggttgccattggagctcattcctaaagaaaagtctcgaaaaattaccttccaaaagcgaacgatgggattgaagaagaaaacatatgaaatatcaacactttgggggggtgatgcatgtgtgagatctatagttggacgtcaaatgatcgccctatggaaccaatattttggccttcaaatcctaaggaggtgaaatccattatcaataggtacaaagaacatagcaaggaggaaagagggttgaaaaccctagatttatcaggctttttcgaggaaaggactaagaagatccaaaaagagatttcaaaattaggtcaccaaggtgtagaccagactaaataccccacatgggacggacgatcgactgaatgatctatcagtggatcaacttagggaactcgtgaatgcattgggcaccaagcttgaagtcatcaagtctagggttgagttgttgaagaagggcctgcattggtaaaccctagttatcctaacaatacaatgccccc

SEQ ID NO: 11817 - DNA, 563 bp, Vitis vinifera
  Predicted polypeptide sequence is orthologous to G183
ttttttttttttttttttttttttttttaaaagctagaagaagcaaagttgcacaagactaagatccattggtcagcaggtgataaaaagcgaacgaacggaaagatcaaacagaccctgcactttttgcaaaatgacaataaaaaaaaattatatcagacatacctcgctgcgccccgctggcgatcaattcgacggggcccaccctcagcttctgcttttccctctgcgatctgcctctactccagttgttccggccaaattaagcgccgacgttcaatctcttttatccgtagccagcttctaatacatgcgctcattagtaggtcccggttcatgactgggccgcccgacttttctgccctttttctgtcacacccccaaattttgaattctcagccgattcttaaagccataaccctaaccctaatctttactttttccaagattattctggttctgatctccaaatcttttcatgtgtagatccaaaatggcgaccgatgtggtccaatccagtgggaagcagcgaacaagtaccacaaaatcgcgaggtcatccac

SEQ ID NO: 11818 - DNA, 635 bp, Vitis vinifera
  Predicted polypeptide sequence is orthologous to G184, G186, G916
ttttttttttttttgcttatatagagagagagaattctgatatctacttctattattcatttagagacagcatatcctctccaatgaataaagtatgcccaaccaaagagccagagaaaaagaaagaacaaagaaacacctgaggattttttttttaaagatcatcattattaatattatgtaaagggagagagaaaaaaaaaattctaacacaattcttaattgcctaccaaatttgagttcccaatattattgtcgacattggtgcttcttgtgttggtactactgttactattattgtttggatgaacattgccaataatggaagtgatggctgccactagagctgcagtgaagttcgggtctgcggtgatggcagccgttgctgcagttactgtgtctgaggatgatgatggtggcttcagcacttgctcggttcctacttgaggaggctgcatttctggggagctttgaagggcggagaatttggattggctgtgaagcactggattgaaagcgtgcgacccaggagcaaaattctggggatggttttggaaagggacatggaattgggcattcggcctctggtgctgtaagaggttcgggctgtgtgtaagatctaatgtaatagtggg

SEQ ID NO: 11819 - DNA, 734 bp, Vitis vinifera
  Predicted polypeptide sequence is orthologous to G189
tttttttttttttttttttttttttttttttttttttttttttttttttttttttatgattcaaacccccaccaaatccacaatcttctctcttttctatttctattctttttttcgtaaacacaactaaaagattttcaagaaaaaaaaaaaaaaagataaggaatttatgtacgggataggggggtaacataaacactcatcctcttgggatatttggactattgagcatcacgggttcttgatcctctgtttcttgtttcttcacgggacgatattcaccatggggtgatagccactagggattaggatgattcgagaacgagagctgcagtagcgtccgtaattgattgagaggggttgggatcgccttcataggtgaaagtcagcaccgtcggatcgtcgagagcccgttccacgtgttggggtggggggcaccctctcacgctactgggcttgtaatatccccttggatgcggagaaccttggataggtttctgaccatactttctccaagaaaaatcatccgggggaatatcagccatctggggtgttatggggaggactcttgacccttttttactctcaatttccttttttaaaacaaggacccggccaaaaatgttccgatttggccctgggttggccatgggaaggggtttttttttcatggaagacaggaaagggagggcggcccgtaaataacctgggttattttgatttgaaacccgggc

SEQ ID NO: 11820 - DNA, 547 bp, Vitis vinifera
  Predicted polypeptide sequence is orthologous to G189
gttttttttttttttttttttttttttttttggaaacccaacaccaactccaccatttccttctctctctccttttctttttttttttttttttttttttttggatttttgattctaaatggaaacgcagcggtttacagggagagcatggagttgaccccggacttttttacagggaaccataaactaacccccaatctctttgattgagctggtatcctactcctggtgctctaccattttcttgatctaaaaaaattctaggatgagaccagcggcttctgcgacggaaaaaaagggggtgggctcgccttcgtaggtgacaatcagcatctttgggtcgtccagagctctctctacctggttgcgggctgggcaacctctcacgctactggacttggaggaaccccttggatggggagatccttttattggtttctgtccggacttcctccaagaaaaatcatctgggggaatatcggccattttcgggcttattgcccgaactctaaccaccctcttcaatttcatctttcttctcttcgaa

SEQ ID NO: 11821 - DNA, 674 bp, Vitis vinifera
  Predicted polypeptide sequence is orthologous to G189
ttttttttttttttttttgcgaaaagagaaaagaggtcacgcactacttttatgattcaaacccccaccaaatccacaatcttctctcttttctatttctattctttttttcgtaaacacaactaaaagattttcaagaaaaaaaaaaaaaaaaagataaggaatttatgtactggatagggggctaacatagacactcatcctctttggatattttgactattgagcatcactgcttcttgatcctctgtttcttgtctcttcactggacgatattcaccattggatggtagccactagggattaggatgattcgagaacgagagctgcagtagcgtccgtaattgattgagagtggttgtgatcgccttcataggtgacaatcagcaccgtcggatcgtcgagagcccgttccacgtgtttgcgtgcggggcaccctctcacgctactgcacttgtaatatccccttggatgcggagaacctttgataggtttctgaccatactttctccaagaaaaatcatccggtggaatatcagccatcttggtgcttattgcaggaactctgaccactctcttcactctcaatttccttttcttagaacaatgacaccgcccaaaagatgatccgcacttggcacctgcgtcatccattgactgcactttctcttcat

SEQ ID NO: 11822 - DNA, 465 bp, Vitis vinifera
  Predicted polypeptide sequence is orthologous to G189
tttttttttttttttgggatttttgattctcaatggaaacgcaacggtgtacagggagagcatggagttgatcccgtacttttttacagggaaccataaactagcccctaatctctttgattgatctgctattcgactcctgttgctcgaccattttcttgatctaagaacattctaggatgacaccatcggcttctgcgaccgatagagagtggttgtgctcgccttcataagtgacaatcgtcatctgtgggtcgtccagagctctctctacatgtttgcgtgctgggcaacctctcacgctactggacttgtagtagccccttggatgtggagatccttttattggtttcggcccgtacttcctccaagagaaatcatcggggggaatatcggccattttgatgcttattgacggaactctaagcaccctcatgaatttcatcgttcatctcttcgaacaat

SEQ ID NO: 11823 - DNA, 680 bp, Vitis vinifera
  Predicted polypeptide sequence is orthologous to G194
gaggaagagaagaagactaagaaagagttgaagcccaagaagacaacaagtcaaaagaggcagagagaaccgagattcgccttcatgacaaagagcgaggttgatcatctggaagatgggtacagatggagaaagtacggccaaaaagctgtgaaaaacagcccctttcctaggagttactatcgttgcaccagtgcatcatgtaatgtgaagaaacgagtggagaggtgtttcaaggatccggccattgtcgtaaccacctacgaaggtcaacacacccacccaagcccaatcatgcctcgagcaaacccatcctccattgccaccacctttgctggcccgaggcttcaaacgacgccgtttcaacacctacacctcctccaccaccaccagcaacagcaacatccctctttcaacgatgttccactcttgaattatggccatggcagcagctttgggagcgccgcaaggtctgttcaagagaggcgttcttgcgcaccaacttctgctttgcatagagaccatggccttcttcaagatattgtgccctcccatatgagaaaggaagaggagatatgacgaaacgcgactccattactgttttgagagaggaggtgcggactgcggtgtagacggaaaaacccagttctggcatgtaattcgcttgctgactagtactg

SEQ ID NO: 11824 - DNA, 859 bp, Vitis vinifera
  Predicted polypeptide sequence is orthologous to G197, G255, G664
ttttttttttttttttttaagttcaaatattctcggtcacaaatttattgactaatacatgtgtactgacccaaagtactgtccacaatgccataagcttcgcaaaggaagaaagcaattggtagtctctttttcggatctacctccagtgcgattccacatgcctttctttgtaaactttagtcatagtgagcaatataattcatcaattggaagaatgactaaaaattcatgaataggtgttggctgctaggagatctctcagcctttcaaatgcatcgatcagaacttgcttttctcctgctcttgttcactttatgcaaattaattcctcttctaaatgttaagtggtggtttaagatcaaggaaatgaaaaaccaaattttccaccaaattaaaattttcgtccatgttcacctaacaatcatccaaagaggagcagcgtggaagagggaccaggttcaagctccctcgatactttgggctcattatgtttcttcgcctcttcggtagtatctactgaaggttgaggaatggtgattgcgacatcaaggttcaaatcaggtaaggcacgccggttatcatctaaacagcttccggcatcagatgtctgatcattatcaccaaccgattttaccggcggacttgcatggttgttcaaaccagatgatgttgcggtcgcagcggtacatgggtcccgagggcgagggaacttgtggctcagacgatgattatttgggtcaatacccatgtttattagctttctccttaatgagaattccagtagttctttacttcattgtctgtccttccaggcagtctccagctatcagtgaccagcggttgcctaggatgcatg

SEQ ID NO: 11825 - DNA, 891 bp, Vitis vinifera
  Predicted polypeptide sequence is orthologous to G197, G255, G664
cggggggccttgatgcttttttgacaacaataccaaaaacaaaaggcctccgtctccctacccaccacccccaccatcaccaccaccaccatcactactgctaaaactgtacacaattctatagcttttatagctgccagtttttccttctgcttgtgattcagctcaatggggaggtctccttgctgtgagaaagctcatacaaacaaaggggcatggaccaaggaggaagatgatcgcctcatcgcttatatccgggcacgcggcgagggctgctggaggtctctccccaaggccgcaggccttctccgatgtgggaaaagttgccgcctccgatggataaactacctgaggcctgacctcaagcggggaaacttcaccgaggaagaagatgaactcatcatcaaactgcatagtctccttggcaacaaatggtctcttatagctgggagattaccaggaagaacagataatgaaataaagaattactggaacacccacatacggagaaagcttctgaaccgaggcatcgatccgtctactcatcgccccatcaacgagccctcaccggacgttacaaccatatctttcgcagccgcagttaaggaagaggagaagatcaatatcagcagtactggtggatttgggtgcaaaactgagaaaaacccagttacggaaaagtgtccagacctcaaccttgagctcagaatcagcccaccataccaaccccaagctgagacgccattgaagactggtgggaggagtagcagcactactctttgctttgcatgcagtttgggaataccaaatagtgaggagtgcagttgcagtattggtactagtagtggaagcagcagctctgggtatgacttcttagggttgacatctggg

SEQ ID NO: 11826 - DNA, 757 bp, Vitis vinifera
  Predicted polypeptide sequence is orthologous to G201, G202
gcatataattttgtgggagttggggttgggcctggggaatggaagggtttgttggtagtggctacaactccagtgaacaaaacaagcggtggaactttgaaaatgcatcagattgaattgggaaatgtaaaggatgggaggctccacgaatgaagttttgcgagatactgtaagtccatacctacaaagcaattgagccaaactaagacaaatctgctagaaccaccagtccaagtcaaccctaaatcctttaggaggacgagacttctatatagtacgcccattgcttatgggattccctctcttcctcctgctctctctctctctccccctctccctctctctccctctctatctctctcagtcatatctctggagttggatgtttgtatttatatagagaatttcaatgaggaaaccttgctgtgagaagaaagatacaaataaaggagcttggtcgaaggaggaagaccagaagcttattgattacatccaaaagcatggtgaaggtagctggcgctcacttccacaagcggcagatggtccctgatagcgggtagattgccaggaaggactgacaatgaggtgaagaattactggaattctcatctaaagagaaagctcataaggatgggtatcaatcctgataagcatcatgtaagacagtccatttctcgtcaacacccggaaacacctcatggcaaaaaggatcagttatccaacgatgcaactttcctagtcaagaaaacaaaaagaa

SEQ ID NO: 11827 - DNA, 652 bp, Vitis vinifera
  Predicted polypeptide sequence is orthologous to G201, G202
tttttttttttttttgtttcctggttgtatatttcatggaagtagctttatttcatttcttccatctttgcagggaaacccgtaatggcaagaccacggccgaagagattggtatggacccaagaagaagacaaaaaactcaaacacttgaagacagaataccccaatctatcttggagaaagatcgtacagctagggaagctggacagggatgaaaaaagttgctcacataggtggaggaactacctgcaccctgatatcaacaaaggggaattctcccaagaggaagatgagctcatcatctttctaaagggcgctgatgtgaggtaattaataatgatatgatatgatatttgtgtggtgatcagcttgaatctgaggtaggagttcctgtggtaatttgcagatgggcatctatgccgaaatatgttcctaggcgatctgctaacgctatcaagaaccgctggaacaatcacttgaagaagaagaatgcaactatagatgaccttgcttatttgattcccaaccttgatccaaatgcaattcgtttgattgctggacccaacagctgaagaaatcgccaagttaagggtaatgagagtcctaagtacatgtctttgaagctagggaaacaagagtccaactacaacct

SEQ ID NO: 11828 - DNA, 679 bp, Vitis vinifera
  Predicted polypeptide sequence is orthologous to G206
tttttttttttttttagttgccgacaatcatttggctgagtctgttcgatacatgaataattctaaccggtatgacagctcctgtcccaccgataattgttgtccaatctttcaacagtcaaaagaggccacccaaagaatttcattttcccatttcccacatcggacaacttgaaaattacaagccccttccctcatatttctgataattcatgcaactccccggaccttgtgaaaatattgtaccaaaattccatgtccatgtcatacgtgctatatggactactgccaatgacagcacgcggagagaatggaaactgaagctgtggaccactggccgcccctggcaaatcacccgccgcgccggatttgttggatgacagtacttccgaccagaaattctcgtccatttctgggaaatcctccggtgaatcgaccttaatgcagggtgtagtaatgtcggacatggtggcggtggtcgtggtggtcgtggtggtggcggctgaggagatatcgctaaaggacggctgtggggacagtactggtccatacccaaggctctccgatctcgaattggttgcagaattaatggggttttgttgtttttcgacttgggacgcatcaagagagtgtcttttagggggtggcgtggcgtggttgtgcttgagctcttcttcaa

SEQ ID NO: 11829 - DNA, 759 bp, Vitis vinifera
  Predicted polypeptide sequence is orthologous to G207, G227, G230, G242
ttttttttttttttttttctgtttttgttttttgggttgcttctgaattcgttgctgcatgttctttgacaaaggccgagagatgataatggatcaaagcctcgaatttgtgcaatctctctttctttcccccaactaggatttgatttggatgggtgattcatagcctctctcttgttcttcttctctctgtacaatgaccaaaattatttcctctgtatatagaaaccgaaaccatggtctgaagaaaaaacaaagatggggttttttctccattgttttctctctcaaactctctgttcaaacttctactcgatcttgctgatgccgatgcgcttcactgccgcgttcctaatcccatctgcttgcaagcataccccattctgttcaagccctgccatgtagtttctcacttcctttcttatcatctcttgcatcacagctaacagctctgcactgaaggggataaatggcttctccccctgggagaggactgtagccggcaccgtcgctggctggttgtgttggtgcatcggaatctgctgcaaaggagccatcgcaggtatcatctgaatagggtttgcaggcggtgcatggttgggttccggtgcacggttggaaacctcgcacgaatcgacccccggaagagagagggagagagaagttggagggtcgtttgaggacgacgtcgtttcgggaggtatgatcccgccggttctcgccacggggcggtacacatgtgatgagctcaccacggga

SEQ ID NO: 11830 - DNA, 789 bp, Vitis vinifera
  Predicted polypeptide sequence is orthologous to G207, G227, G230, G242
gtttttttttttttttttttttttttttttgcccgggaaaaaaagtccccattgaatttcatttttccccattttttcgattttctattgcttaggcggttgcttctcagattctaccaccaaccaccgaccaccatagctcattcctctcgttaacaaaccctctagattttcttccttccccgtcttttccactggaaactaccaaaattatttgtatttaagaaggaaaaaaaaaaaaaaggaacaagatttcaaaaaaacacagcttgttttttaaatatcccgattccctccgagtcgactcatcgctgcaaccataggtaggttgttccttcctctactcgattttgccaattccgatacgcttcatcactgcgttccaaatagcttcagtctgcaaacacagaccattttgctccatgcccgacatggagttcctcacttcctttctgatcatttcttgcatcacagccaagaattcgggggtgaagaaaggtttctccgacatacctaaacccaactcacagttctggacgtttcgtggggatccagggttttgttgcagctgtacaggcggtatcgccggtgattggagaatctggttttggattttaacatgatcggatcctgataaatgatttgacacttcgcaagaatcggatccagggagagagagactgagggatgttgggggatcgttcgtcgatgaggaggcctcgattttctgagtaggtaaaactatggaccggttcccggcactggtctataaacaagcgatgaagccat

SEQ ID NO: 11831 - DNA, 800 bp, Vitis vinifera
  misc_feature (800)..(800): n is a, c, g, or t
  Predicted polypeptide sequence is orthologous to G211
ctgcattcacttttgggaaatcggtggtctctcatcgcaggtaggcttccaggtcgaaccgataatgagatcaagaactactggaacacccatctgagtaagaagctaagaagtcaaggaactgaccccaatacccacaagaaaatgacagagcctcctgagcccaagaggaggaagaacacaagaacaagaaccaacaatggcggaggcagcaagagggtcaagatcagcaaggacgaagaaaattccaatcacaaagtccatctccccaaaccggttagagtcacctccttaatctccatgtcgaggaacaacagctttgaatctaatacagtcagcgggggctcgggctcgagttcaggaggaaatggggaatcgcttccatggcctagtttcagagacatccgggacgacaaggttattggggttgacggggttgacttcttcatcggagatgatcaaggtcaagacctggtcgccagctccgatccagaatcacaatcccacatgccaccaactgacaactctctggacaaactgtatgaagagtatctgcaactgcttgagcgagaagacactcaagttcagcttgactccttcgccgaatcactactcatttaattcaaatttcaaaaggagttgcagagagaccaaaagatcaactggttatgcttgcttgcttgctttgaatcttagcttccatgcacgtgctcaccttcttcaaaccctagcttggttatgaacttcattgatctattaattaattacttagcaaaaaaaagatcgaaaaaaaaaaagan

SEQ ID NO: 11832 - DNA, 1212 bp, Vitis vinifera
  Predicted polypeptide sequence is orthologous to G211
agaaaccaattgatccacgcagagaagcaagccagagggatgagaaatccggcatctgcgtctacgagtaagactccgtgctgtaccaaggttgggttgaaaagaggaccatggacgcctgaggaagatgagcttctagctaattatgtgaagagagaaggtgaagggaggtggaggacgctgccgaagcgagctgggttgctgcggtgcggcaagagctgtcgcctccggtggatgaattatcttcggccgtcagtgaagcgcggccagatagctcccgatgaggaagatctcattcttcgcctccatcgcctgctcggtaacaggtggtctctgattgccggaaggatcccggggcgtacagacaatgagatcaagaactactggaacacccatctcagcaagaaactcatcagccaaggaatagatcccagaacccacaagccactaaaccctaaacctaatccatcaccagatgttaatgctcctgtctcaaaatcaattccaaatgcaaaccctaaccctagttcttcccgggtgggagaaattggaagcaaccatgaggtcaaggagattgaaagtaatgaaaatcacaaggagccgcctaacctggatcagtatcacagtccacttgcggccgatagcaatgagaattggcaaagcgcagatgggttggtaacgggactacaaagcacccatggtaccagcaacgatgacgaagacgatatcgggttctgcaacgacgatacattcccttcatttttgaattctttgattaacgaggatgtgtttggaaatcataatcatcatcagcagcagcagcagcaacagcagctgcagcaggtgcagcagccatctaatgtgattgcaccattgccccacccagcaatttctgtgcaggccaccttcagtagtagccctagaactgtctgggaacctgctgcactaacatctacatcggctcctttagtccacgatcaaaaacactccatgtctccctgaaaatgatgaatcaagcttatatgagtttgattaaaatctgtgtgatgtaatttgttgtttccctttttgtgttttgatgttgtattagcttccactcttggttatttaattaggatgttaattaaagctttatgtgtgaatatcgtatgtgaaatggatccttgcaactaagttgtttttcccaaaaaaaaaaaaaaaaaaaaaaaaaaa

SEQ ID NO: 11833 - DNA, 1103 bp, Vitis vinifera
  Predicted polypeptide sequence is orthologous to G211
cgggggacgagagagaaagaagaaagaaagatgaggaatgcatcctcagcatcagctccaccttcatcttcttcaaaaacaccatgctgcatcaaggttggattgaagagggggccatggacgccggaggaagacgaggttctggccaattacatcaagaaagaaggagaaggccggtggcgcaccctcccgaagcgcgccggtctcctccgctgcggcaagagctgtcgcctccgctggatgaactacctccgcccttccgtcaagcgcggccagatcgcccccgatgaagaggatctcattctccgcctccaccgacttctcggcaacaggtgggctttgattgccggaagaattccgggccggacggataatgagataaaaaactactggaacacacacctgagcaagaagctgatcagccagggaatagatccgagaacccataagccattgaaccctaattcatcatctgttgatgtgaaagcttcttcttcaaaggcaaaagctgttatgaaccctaaccctaaccctaatccttctccttcagaaaaagcagcagccaacaaggaagctgggaacttcaagagtgacaatcagtatcagattggggcagctggcaatgatggcagtgccaatatccagaattcggatggttccgggaccggattgaggagcagcaacaacgaagaagacgatgaccttaactgtggcaccgatgatgtcttctcttcatttttgaactcattgatcaatgaggatgtgtttcctggacagcaccatctccaacaacagcaccatggtggtctcattgcaccgggctccgatgctttgatctctacttcttcagtccagtcgttcgggttcggtaccagctgggaggctgcagccatgacttccacgtctgtttttagccaaatcgatcactccaagaggtttaacgatcaacctgataagcggttctgatgacagccggtgttctttaatttggcttcaacaccctgcaatgagatatatagttaataagaattctagggtttgggttgttaatttatgtatgtggttgtgttgttgtgttagtatgctttatttgtattgtgaac

SEQ ID NO: 11834 - DNA, 512 bp, Vitis vinifera
  Predicted polypeptide sequence is orthologous to G212, G247, G676
ttttttttttttttttggaacagaagcgtgttaattcaatgaggaactaagaaaatataactagaaggaagtacaattcaagatttggccccaaatgagaaaaggtgaatcagaaaccatgccgaccaagatcaagagaacaaccatttagaaactccattatactgttggtagtgagctctaaatcatcattaatagcccaaaaggagtccaagtaaccctccccaataaccagttgatcatgccagtctggggcctcaaggctctgctgcagagtgccttcatttgctttggcttccgcagctcctctgctgcttccacaagaaggggatgaacttgaattcatgagtggctcggatcctttctgcatttcccttgtgtctgttagagttgaagatacattagctctgttgtttttctttttgatgcccagctttttgctcaaatgagtgttccagtagttcttcacttgattgtctgttcgtcctggtactcgtccagcaattaaagac

SEQ ID NO: 11835 - DNA, 802 bp, Vitis vinifera
  Predicted polypeptide sequence is orthologous to G214, G680
tttttttttttttttttttttttttttgcagattagaatgaacctcattttgttttattatatagaaatattaccaagcaataagaaacaaagatatatttatacaataagcataaagttagaaggtatcgattgacctttgaaaagaatttttgtgcgtgacttctgatttgcacagcagtctttgttcctatatgttcttctatacgttgccaagctcgcccataaagcttcaaggcctccagaaacctattatgctcctcctctgtccatcgctcccgctgcttggtaatagtatacggtttccttgtctgatgttgaccaagattcataactcacattttcatcgtcaaaacaatagtttcaagtcattgtacagactgattcaagaattcagcataaaagaaaaataaataaaaaaatttcctatgtaaaatcaccttgataatcaagtcctctccagaggaatatatgtccattaccgaacctaggcagcttccgctgcttcagattaccgaacctaggcagcttccgctgcttcagattatggagcctgacgaacgaggaatatgacaacctcctttcatctcttgatgtcttgaatactacaaatagcctagccgtctttgtcaatgaaacctgataaagtaatgctacaaaacgaatcgtaggacgccaaaaccttctataaaacccggtatcctccgtttggttgccgagaaaacttccgcaaaaggcatggcggacgaaaattctgtctggtcggatctcttccccgatcctgcatggactcaattcatcg

SEQ ID NO: 11836 - DNA, 874 bp, Vitis vinifera
  Predicted polypeptide sequence is orthologous to G214, G680
atcacaactggacctagaatgctctgaagctttgcaagcacaacattcagcatctaaatcaccagccatatcatcttcagactctgaggagagtggaggtgcaaagccaaatactgagtcaactgctcctgataatgagaaaaacactacagcagtaactgagctcaatgatccgaccaagatgaagagtagaaaacaggtggaccgttcctcgtgtggttccaacactccttctagcagtgaagtagagacagatgcattagagaagcatgagaatggcgaggaagagtgcaaagaagctgatgtaaatcaggcagctggtgaggctaacaatcgccgttgtagaagcaccagcatccttaatgaatcctggaaggaggtctctgaagagggtcggctggccttccgagcactcttcagccgagaagtattgccacagagcttttctcctccacatgatttgaagaataaggggctccagaataaggatttcatagagaatgagcagggtggagatgagaaacatgaaaatgccttgcagttagacctcaacagcaaggcatggggaccttgttccagtcaccaagatgtggagaaaaatggattgatggaaaatgacaacagagaagaagggctgctcacaatagggcttgggtatggaaagattaaaggtcgtagaacaggatttaaaccctacaaaaggtgttcagtagaggccattgatagcagggtcacaaactgctgcagccaaggtgaggaaaaaggccccaagaggatacgcctggaaggggacgtttcaacctgatatttcataatgcatgcaaatttaaacggaggaaaccttcgtagctgcattcaatttctaatttttccc

SEQ ID NO: 11837 - DNA, 793 bp, Vitis vinifera
  Predicted polypeptide sequence is orthologous to G217
gagagagagagagagagttgcagttttcatatagaagctcacacccaagcaagcagtctgtgaaaccctaaactctgaatctctcattctctctgctcttttttcgtttttggtgataggtatgaatctgccattctctcaatctcttgcaaaggagcttcactgaatataggtgtttcttcttcttcttcttcttctgattcactaattcaaattcaaatccaaatcgtagaaccctaatcatcgaaaaccctagagcggaggaggtcttcaaagagagaggggcaagatgaggataatgataaagggaggcgtgtggaagaacacagaagatgaaattctgaaagcggcggtgatgaagtatgggaagaaccagtgggccaggatctcttctcttctcgttcgcaaatcggccaagcagtgcaaggctcgctggtacgagtggcttgacccttctatcaagaagactgaatggaccagagaagaagatgagaaactacttcatcttgccaagctcatgccaacacaatggagaacaattgctcccattgttggacgtactccttctcagtgccttgagcgttatgagaagctccttgatgcagcctgtgtcaaggatgagaactacgaacccggagatgacccgcgtaaactgcgtcctggagagattgacccaaacccagaatcaaagccctgcccgtccagatcctgttgatatggatgaggatgagaaggaaaatgctttcagaagctccgagctcggttagcccaacacgagaggtaagaaggccaa

SEQ ID NO: 11838 - DNA, 672 bp, Vitis vinifera
  misc_feature (563)..(563): n is a, c, g, or t
  Predicted polypeptide sequence is orthologous to G217
gctccatcaagggatgcccattcttttggtataaccccaaaaggaactcccattagagatgagctccacattaatgaagatatggatatgcatgatagtgcaaaacttgagctccggaggcaggctgatctaagaaggaacttacgttctggtttaggcagtcttccacagcccaagaatgagtaccaagtagttatccaacctattccagaagataatgaagaaccagaggagaagatagaagaagatatgtctgataggctagctagagaaagggctgaggaggaagccaggcagcaggcattacttaggaagagatcaaaagtactgcagagagagctccctagacctcctgttgcttcattagacctcattagaaattctctgatgagggctgatgaagacaagagttcctttgttcctcctacgttgattgagcaggctgatgaaatgataagaaaggagctgcttggcttacttgagcatgataatgcaaagtatccacttgatgaaaaaacagagaaggagaaaaagaaaggaggcaagcgctctgcaaatggaanatctgctggttctgtccctgacatagaagattttgaagaagctgaactaaaagaggtatatgctatgttgcaactctatttaaattaagtcttttttgtagttctttac

SEQ ID NO: 11839 - DNA, 520 bp, Vitis vinifera
  Predicted polypeptide sequence is orthologous to G225, G226, G682, G1816, G2718, G3930
gtaaaaattcattcccttccctttcctcttcattcaatttctttcttcttttcttctcctccctctccttcattaaaaccatggaccgccgccgccggaaactccccaaaatcgccgccccctcgcagtctgaagaggtgagtagtattgaatgggaattcataaacatgagcgaacaagaagaagatctcatttacagaatgtacagactcgtcggagataggtgggatttgatagcaggtcgaattccggggcgaaaacctgaagaaatagagaggttttggataatgagaaatcgccaagggtatgctgagagaggaaaagaggctagtcaaaagaagcaatagacctcatacttacttggccatgcccaatgattctttttttgtcttcttcttcctcttggctcctttagaaaggttgttctttcagtggtagcttcttggctttcatattggtgtaaagcgtgttttgaatactcaaaaatttgtgttaaggtagccattactcaccatttctc

SEQ ID NO: 11840 - DNA, 647 bp, Vitis vinifera
  Predicted polypeptide sequence is orthologous to G225, G226, G682, G1816, G2718, G3930
ggttcttctctgtgttgtcttctgtgttttcaacctaatggctgacttggatcactcctctgatggcagctctctggattctagaggtacccatctgaaggatttaatggctcttctgctcttctccatttgcatgtcaccttctggttttctgaatgttttctactaaagatgtgttttttgccttctgggtcttcatgttttggtattggggttcctgtttcataaatacccaaatcatttttgtgatgttagctctctggattcatgtgtttttatgggtattttctatcaaaaatgtggttttgccttctgggtctctctgtttttctattgggtgccctgcttcataaattcccacatcatagctctctgaattctagaggtacccgtttggaattagtggctcttttgctggtaacctttgtgttttatgggtatttttgggctggtaacccatatgaaattttgcttcttttgctattatccccacaagatactagccagtttttttctctttccttggtggttgttgctgcagagggaagcagtcaagattccaagcttgaattctctgaagatgaggaaaccctgatcactaggatgttcaatctggttggagagaggtggtctctgattgctgggag

SEQ ID NO: 11841 - DNA, 650 bp, Vitis vinifera
  Predicted polypeptide sequence is orthologous to G233, G241
aatggaagaatacattttattacaggcactgaatcttattcaatatctagacatacaactgataaggcccaatgagatcatgttacaacaatgaagaaatcaagtaataagaaattttctgggaaatatgggtttcttttccatccttttctcggacttttctgtggattaatttttacatactcctactttacatttctataaagcaacttttcctaagtcaatttcttgtacttctatctttttgacccgtcaatcactatgaaagtgatcatcaaaggagaattccgctttttgctttcttggtcaatgaccctttgccccactggaatttgccgcatccccatcttctcactaaccgtcgaaaactatgcatcactatgttcagatcctccaaaacaggaatcaaagctcctgtaggccgccagatctaatgaaaacgtcataccagaactccatgccatcatccatcatgtttgaaatttgtccataggcgagttccggtgtctgaagctgtaattcgtctgcgactgctgggaaatctgacgccatgcttgaattatcagaggacagcgcgtctgaccaaaaactttcatcgatatttcaggaaatgattccgttgagtactcctccatctgttcattcttgac

SEQ ID NO: 11842 - DNA, 242 bp, Vitis vinifera
  Predicted polypeptide sequence is orthologous to G242
ccgggcaggtacttaggtgagtctaggagtgcggccaaacggagggctaaccgttacggccgatgttactgttgtggtagaatggagtgcaatggaggaaagagaacaaccatttcacaagacgaggtgaaagcatgtattaggactccggcgaataggtttctaaccgaaaacggtggtcgacacatatcgaatgcaatcgatctcgctctcagtgacatggaaagaatcgggaagtctga

SEQ ID NO: 11843 - DNA, 634 bp, Vitis vinifera
  Predicted polypeptide sequence is orthologous to G249, G1322
gggaactctctagcaaaatctgctggactgaaacgtactggaaaaagttgccgcctccgatggctgaactacctgaggcctgatgtccgcagaggtaatatcacagatgaagaacaacagttgatcatggaactgcatgctaagtgggggaacaggtggtccaaaatcgcaaagcatctgccaggaagaaccgataacgagattaagaatttctggaggaccagaatccaaaagcacataaagaatgcagaaacattcactgcgcagagttctgatcagacacatgatcaagcaactacaagccaagtcatgggtgctgcacatgttgctgattcttattctccaccatcctaccctgccaatctcgaggcttttccgggtccttcatcggctgaatccaatgataatttctggaccatggaagacatctggtctatgcagctacttaatggagattaagtacaaaaccatatatatacatatactctagtttgccctaaatattaggtttgtctatagtttaagccttagtattttctatatgataaggtcgaaccatatattcactgctgtaatataatgtttctacctctatatctatatatatacatacataagtatctatacctataaa

SEQ ID NO: 11844 - DNA, 850 bp, Vitis vinifera
  misc_feature (799)..(799): n is a, c, g, or t
  Predicted polypeptide sequence is orthologous to G256, G666, G668, G932
ggacgcttgtctcccattaccaaagttgaaacgctaaggaaaagacctttgtctggaaacccttccacaactcagagagaaagaccgaagagccatggggaggccaccttgctgtgacaagatcggggtgaagaaagggccatggactcctgaagaggacatcatcttggtctcttacattcaagaacatggtccagggaattggagagcagttcctactagcacaggtctgcttagatgcagtaagagttgcaggcttagatggactaattatctccgcccgggtatcaaacgcggtaactttactgatcaggaggagaagacgataatccacctccaggctcttttgggcaatagatgggctgccatagcttcttatcttcctcaaagaacggacaatgatataaaaaattattggaacacccatttgaaaaagaagctgaagaagtttcccacaggtgtagatgaccataatcaagatgggttttcaatctccaaaggtcagtgggagagaaggcttcaaacagacatccacatggctaaacaagcgctatgtgaggctttgtccatagatacgtcaagctcgctgcctgacttgaagagctctaacggctacaaccctaacaccagacctgtccaagcatctacatatgcatccagtgctgaaaacatagccaaattgctggaaggttggatgagaaattcaccaaaatcaactcgaacgaattctgaagctactcagaactccaaaaaactccagtgaaggggcaactacaccagatgctcttgactcggattntagcttcaactcttccaactctgatctttctctgtctaatgatgggacagc

SEQ ID NO: 11845 - DNA, 581 bp, Vitis vinifera
  Predicted polypeptide sequence is orthologous to G261
acatgttttttttttttttttttttttttttttttcgttgaaatcatgaaagagccaaaaagttgataaatgatggagacaccatcctacataagatcatgtgtacagaaaagataactcaaataatatgtctattcactgccagatcaaaaatcaaacgtgcctaaatttattacaccaaactattgatgcatcaaaacttgaaaaagaattgactaacatcaagttctctctgctggagtaagctgtcccatttgatctgcaagcttatttgcactccttgcattccaccaaaacctgccatgatcaccaggcttcccttcattcttcctgctttcatcatcctttctttctaactgaacttcctctgctgatgaaccaggattctcagtgaagaactgttcccagaatacgtcgttgaccccagttggaacaggagatgcagctccaactacttgttcttttaaggtagtaacctcaggagcagtagcagcgggcttgcaattcatgtcaatcccagtagatttagacctagtatcaatattaagttgaatgtaagatatacctggactttctgcccc

SEQ ID NO: 11846 - DNA, 372 bp, Vitis vinifera
  Predicted polypeptide sequence is orthologous to G261
ggcgacatgtttttttttttttttttttttttttttttcgtcaagaacctggcatgcaccacaacagtgagggctaaaacttgtagtctgtaactataggaccaaggtaatcatacctcttagttaagttaatatacaaccagccactgagacctagtgttaaatgaatggaccaacattaagttctttcagatgaagtaagatgacccatttttttagtaagatgatctagattatttgtatcccaccaatatttcctgtggtcatctggcttactgtcacccttgccgccatatgcttccctccgttctgactggacctcctgtgcatccgatgaaccaggtgtctctgttaggaattgtgcgcggaaga

SEQ ID NO: 11847 - DNA, 637 bp, Vitis vinifera
  Predicted polypeptide sequence is orthologous to G263
gtttttttttttttttttttttttttttttggagcagaaggcatccaaaagtaaatatagaaagcttccaacattatgatatatgttctaaatggattgtgcaaattttacacagatttatgaacttacttggagatggggaaaggaaggtggagacccatttgcctttgatctccgacgccaccttttctcctcatcatcatcatcaacggtggacctgtcttagtcctacgttataaataaataaccacccccgtcttcgttacattatttcacaaactaagaaataaccctagggttgcagagagtctcttctttctcattgctaaccgtaaactagaactaaagaacatttttaacatacatatataaatatcaaaagaaacaagcccatgtgcatggcctttttctttcttttttggtttgggtgtctgcgtgtgtcacatgctgttgaggttgttcagttgcagaccttgctggtcatccacggcgcctcaaagtccacagtcttcatctccttctggtgtggcccaccgtaccccattttctcctcacgtccccttttcttctttcccttcagccaaaccccaaacagtatcaaactctcctcattgaggtcctcgtctttttcatcccc

SEQ ID NO: 11848 - DNA, 685 bp, Vitis vinifera
  Predicted polypeptide sequence is orthologous to G264
ttttttttttttttttttttttttttttttgcgaatcaaatgcagtgcatatggtttatttagaattcagatattaaacacttattttttggtaaacataaacaatatgttcaagaacttaaactgatgtaacatcaagataacactttactgctatcttcttgatttataactttagcaaccacctgtgcaaaattattaacccaaaaaaggacattatatggtttatcctatccaaaactcacaaatcaaagcaagaattgagactaccctttgaaaatatgacccggcttttgatgcaaacttccagtgctcaaagagtgagatgctccatgctttttgagttacccaacattccttggcctgctcttctatcttcttgctcatcatatgggtttgacctaaaatttgaacttgcctcttcagtgtctgaagagcctggtctttcagtcaggaactgttcccagaacacatcattcacccggaccggagcagttggaggtgcttcatttgcaactgaggccccttgtgaggaagacaaaatagtgtcatcatcagcaaaatttctgctcttgtggatagctctaaaatcagcttctttagcatcggcaatagacctagatgctgaggatttgccaatatcctgacctatttggggcatcctagttgaactacttttgtcaac

SEQ ID NO: 11849 - DNA, 710 bp, Vitis vinifera
  Predicted polypeptide sequence is orthologous to G268
ttttttttttttttttttttttttttttttgcccaatgtacaggaacaaatttcattgacatctccccctatatgtagaactcgacgaaggggttgctgtaattttcaacaaaggggacaaaaaagaaatgcttacatgtcatacaccctatcaagcatgtcaaaatcgcttgtcacacctcaaaagtctccgacttgcatggggaccttcacttgtgtcatgtacagcagacgcccatcccatggcaaccgcaattgcatgtagttcattcacaacagatactgtatcacggatataaacacgcccaccaggtcttagcattcgatctatctcaagcatgatgtttgagatattacatcttttttgctctatggagaagagacccgctgcatgcaataggtcatatgttcttgggtaggtgtcaaatggctcacaccagtcatgcctaactcctatgagtccacgatcatagattacaggcagggtgttgaatccactaactggaacaacattcataacccagcaatcaacttggaaatcaattagtgctgctgcaaaccctccaaatcctgctctcatgtccatcacatttctcaattttgaatcattccagtggtaagcatgaacataaccatatattacttcatgccaaaattttgtgtctgccttgaggatttcctttctggatatgtaggcatccatttctatg

SEQ ID NO: 11850 - DNA, 731 bp, Vitis vinifera
  Predicted polypeptide sequence is orthologous to G270
ataagtcaggaggattactcatcgtatagagagactaagttggcccagttgaagccccttgttcttgataaacccacaagttttcctgtgaaagaggaggcggcggaggcggcgcctgtggaggggaaccccaatgaacctactagtagtcgagtggtgccaaggaaccctcggcgagcagtttatggcggcactttggaggatatttccgagttctttaacagtgggacctatcaaccaggtggtaatgctgcaactcaaggaccccgtaaattgttcacaaaggaggaaaaacttctgctgaataagcggatacctgatctggcagctgctacccctggcaaatggctccctctgcacactcttgctgcatcaggggaattttacctcatggatgctttgttgaaacacaacgttgatatcaatgctgtggacaaggatggtttaactgcactgcacaaggcaattattggcaaaaagcaggccattacaaactatcttttgagagaatctgcaaatccttatgttcgtgataaagagggcgctacattaatgcattatgctgtccaaacagcatcaagtcatgcaattaagattcttctgttgtataacgttgatataaacctgcaggataatgatgggtggacaccgctacatcttgctgttcaacccgaagaacggatttagtgaggcttttattaattaaaggagctgataggacattaaagaac

SEQ ID NO: 11851 - DNA, 777 bp, Vitis vinifera
  Predicted polypeptide sequence is orthologous to G274
tttttttttttttttttttttttttttttgattagcacatcaacttcatcgcggaatatgacggcaccttctggtctcaaaatccgatccatctccagaagaatgtcctccgcatcacatttgtccttgtataaactgaaaacaccatgggcgtgaataaggtcgtatgtccttgggtatgtagagaaggcttcacaccagtcatggtagatgccaatcagtcctcgttcgtatacagcaccaagagtacttttctcagctatggtgggtacaacattcataacccacaatttaggagattcaagtgcagcagcaaaacctcccaacccagcattcatatccatgatgtttcggtaccttcctgagtcaataattttattaatttttttataagcatttaagtgcttcttccatagtttattgtcctccaggtatgtctcaacagagactccaggaatagatccactagctactctaggagggacagcataaagcctcttgggaaatggctgcagttctccaccagaaacttctcctggactattaacatcaggatatggacttatgcatggctccatattcttgtgaccaagtatcatctgtttcttcagctttgcaaaatgtagttcgagcatcatcttgtctgccactgcatgcaccagcattcactctcttctgccaaattgcaatttcaccttgctcatatttcttctcccagcaaagaagtctggatatgtcttcaatctttctctgctcctcctggagttcctctttagg

SEQ ID NO: 11852 - DNA, 826 bp, Vitis vinifera
  Predicted polypeptide sequence is orthologous to G274
ctctgtcagaacagcattggatactggttgtggggttgcaagctggggtgcatacccgctaaagcgaaatgttttgcctatgtcatttgcaccacgggacaatcatgaagcgcaagtacagtttgcattggagcgaggtgtacctgccataattggtgttcttggaagtatacgcctgccttacccagcaagagcctttgatatggctcagtgctctcgatgtttgataccatggacatcaaatgatgggatgtacctaatggaagttgatagagttctgagacctggtggatactggattttatctggccctccaattaattggaagacttactacaaaacatggaaacggagtaaggaagaactgcaggctgagcaaaggaccattgaagagatggctgaacaactttgctggaagaaggtatatgagaagggagatcttgccatctttagaaagaaaataaatgccaaatcctgccgaaggaagtctgccaatgtatgtgaatccaaagatgctgatgatgtctggtataagaaaatggaaacatgtgtaaccccttaccctgaggttaccagtgcaaatgaagtggctggtggggaactgaagaagtttccagcaaggctttttgccatccctcctcgcatagctgccggacttgttgaaggggtcacagttgaatcttacgaagaggacaacaaactatggaaaaaagcatgtaaatacttacaagaggatcaataaattacttggcacaacaagatacaggaacataatggatatgaatgcaggccttggtggatctgctgcagctcttgaatgatcaaa

SEQ ID NO: 11853 - DNA, 759 bp, Vitis vinifera
  Predicted polypeptide sequence is orthologous to G274
tgtcaaagcttataaaagaaccaataagatcattgactcaggaaggtatcgcaacatcatggatatgaatgctggtctgggcagttttgctgcagcacttgaatcacccaaattgtgggtgatgaatgttgtgcctacgatagctgaaaaagacactctgggtgtcatttatgaacgaggattgatcggcatataccatgattggtgtgaagctttctcaacttacccaaggacatatgacctaattcatgcaaatggtgttttcagcttgtacaagaacagttgtagtgcggaagacattcttctggagatggatcgcatcctacggcctgaaggagcagtcatattccgtgatcaaatagacgtgctcatcaaggtgaaaaagatcgtaggaggaatgaggtggaacactaaattagtggatcatgaagatggcccccttgtctctgaaaagatattgtttgctgtcaaacagtactgggttgtaggtgaaaacaactccacagcagctccacagtgaattcaaaagagggaactttcagtgtgattttatcaagcaatgttgctacctctgattcaagtccatcaatttcatttatctcactcatgattatctggccgagtaacaaacataggggatatgattcttacattatcacatgttgattaattcattgattgccccatgttctaccattgccattgttgatggtactagttcgcaaggttctatgatcttagatggccttctatttttat

SEQ ID NO: 11854 - DNA, 792 bp, Vitis vinifera
  misc_feature (769)..(769): n is a, c, g, or t
  Predicted polypeptide sequence is orthologous to G275, G837
gactgtctacagttgaaagtttgcaatgtcactgctggaccagattacatcccatgccttgacaatttgcaagcaattaagagcctcccaagtaccaagcattatgaacaccgagagaggcactgccctaatgaaccacccacctgtcttgtttcacttcctgaaggatacaaacgtccaattgagtggccgacaagcagggataagatatggtactataacgttccccacaccaagcttgcagaaattaaagggcatcagaattgggtgaaggtttccggcgagttccttacttttcctggtggtggaacacagtttaagaatggtgctcttcattacattgaattcatagaggagtctatgcctgatattgcatggggaaaacgcagccgtgtggtattggatgttggatgtggtgttgctagctttggaggctatctttttgataaagatgtgctcactatgtcatttgccccaaaagacgagcatgaagcccaagtacaatttgcacttgaaaggggaattccgggtatatctgctgttatgggcacaaagagacttcccttcccagccatggtctttgatgttgtccactgtgcacgttgtagagttccctggcatatagaaggtggtaaacttctcttggagctgaaccgtgtgttgcggcctggtggtttctttgtgtggtcggcaactccggtttaccagaagcttgctgatgatgttgcgatatggaatgccatgactgaactgatgaagtcgatgtgcngggagcttgtggtgattaaaagg

SEQ ID NO: 11855 - DNA, 907 bp, Vitis vinifera
  Predicted polypeptide sequence is orthologous to G275, G837
tcgcaaaatgaacctccaatctgtgccgattcagaagatgcaaatgctgcctggaatgtcccattgcaagcatgtatgcacaaagtgccagttgatgcatcgaaacgcggctctcaatggccagagctatggcctgcaaggttggataaaagtccatactggttgacaagttcccaggttggggtttatggcagggcagcaccggaggatttcactgcagactatgaacactggaaacgagtggttgctcagtcatatctaaatgggataggaatcagctggtcttctgtgagaaatgtcatggacatgagagctgtctacggaggatttgctgcagctttgagagatttgaatgtttgggtcatgaatgtggtctcaatagactctccagatacacttcctataatttatgaacgaggtctatttgggatttatcacaattggtgtgaatcattcaacacctaccctagatcatacgatctgttacatgcagaccatatcttctccaagaccaaaaagaagtgcaacctggtggctgtgattgcagaggctgatcggattctaaggcctgaaggaaagcttattgtccgtgatgatgtggagacacttggtcaggtggagaacatgcttaggtccatgcactgggaaatccggatgacttactccaaggagaaggagggattgctatgtgcccagaaaaccatgtggaggcctaaagagatggagataataaagtcggctattgcttaagcgcatacacatactctcctcaccattcgctgcttcttcatttttgaggctaccatggcctctcagattaggtattcttttggtttttagtccaatacttacattaatgataacagaatttcttggttagtccatgtaccatgtcagttagctcctc

SEQ ID NO: 11856 - DNA, 703 bp, Vitis vinifera
  Predicted polypeptide sequence is orthologous to G275, G837
ggcggcctggtggttactttgtgtggtctgctactccagtttaccggaaagttcctgaagatgttggcatttggaacgccatgtctgaaataacaaagaaaatttgctgggatctggtggcaatgagcaaggatagtttgaatggaataggtgcagcaatatacagaaagccaacttccaatgagtgctatgagaaaaggctgcgaaatgagcctccactgtgtgaagaatctgacaatgcagatgcagcctggaatataccccttcaagcatgcatgcataaggtgccggtacttacctcagaacgtgggtctcagtggccagagcaatggccactcagagtggagaaagcgcctaactggttgaagagttctcaggttggagtctacggcaaggctgctccagaggactttacttctgactatgagcactggaaaactgttgtctcctcatcatatttgaaagggatgggaatcaaatggtcttctgttaggaatgtcatggacatgaaagctgtatatgggggatttgctgccgcactgaaagacttgaaagtgtgggtcatgaacgtagtcccaattaactccccagacacactcccaattatctttgaacgggggttatttggaatatatcatgattggtgtgaatcgtttagcacctatcccagatcttatgatcttgttcatgctgatcatctctt

SEQ ID NO: 11857 - DNA, 516 bp, Vitis vinifera
  Predicted polypeptide sequence is orthologous to G275, G837
tttttttttttttttttttttttttttttttaatgagtttctcttctggcttctcctgtttttcctccagatcattttccgatggtttctcaggaacagctgaattatcttggggattagggtttttttcatcctgagtgaaactcacaccatccccattctttgcatcatctgttagatcaccagaactatcctcaaattgcctagtatcactatcattactttcaaccacttgttgcttcatctcatctttggtctcctgagttgagacatctgaattttgaaccggaacgacagatgaggatgtcatcatccaaaccccaaccaagcaaagagccacaaaagcaaccagagttgctgtagaacaataattggtggtcgatctcctaccatcgactctactatattttcctaaagccattttttacctcaattatctcctcaaagttcaaaccgtgtgaagaattgtggcggatctgagagcgaaatgctagggagtggacattgttgttcccc

SEQ ID NO: 11858 - DNA, 614 bp, Vitis vinifera
  Predicted polypeptide sequence is orthologous to G280
ttttttttttttttttctttttttttttcccatccaaagctacttcattttttctaggggtgaaacagggaaggaaaaaagcaaaagcacaaagcgattagcaaggaaaatgtaatcagaatcagtctctttaaatcctttttaaagagaagggggtggaggagagagagggacagagagagagagataggccaaagccttaaacagccgctgcacaatttacatgcaattacagacacccactagcttacaacactcaacactgaaacaaagaaaaaaaaagattgaaaagctaatgaagagaaaccataaattagagctaatatacctaaaaaccctactctcagtttcaaatcaacacccaacaggaaccaccgccggcttcacctttggcggccgtcccctgggcctcggtgccccagtcgccggcgctggggctgacgaagttcccaccttgggcttctttggagggcgtccgcgtggctttccacttcctgaggaagccttcttcggcggagagaccggagcaaatggatctctgggctttggcggacggcccctgggcctcggcggcgcgagaacggttcctggaggaagaggaaccttgggcttgg

SEQ ID NO: 11859 - DNA, 524 bp, Vitis vinifera
  Predicted polypeptide sequence is orthologous to G291
tttttttttttttttttttttttttttttcgctttttttcaccctagcgaaaatctctcacctaaagccaagaatgatcattgcagggcttgcttctaggttcccaaacgattgaaaattcaacatctaaaactttgttttcatctttttcagaagccaaagaaagccttaaacacctaacttagggttttggtaatttggaagttaaatctgaacactgatagcacgttatatcaacacggcgctccgatcccaaacaactaacacaaaacctaatccttatacagtcaccaaacacgttatatagaatcgtgctcctccccctccctctgatgaaccaaacaaaaaagcagcaaaaaaaaggccactaacctgcttgttggtctgggaataatcaaccatatactcataagcatcggcctgagcattaaccctagtttcggtgccttcaacgggcaaagcgaaggcgtccatgacaataatggcgtcgccgtcggtctcttgccctgcataaggcccatgac

SEQ ID NO: 11860 - DNA, 814 bp, Vitis vinifera
  Predicted polypeptide sequence is orthologous to G291
tttttttttttttttttttttttttttttgataaagctactctcggttgtcattcaatttcagacgatgaaaagcctgatctcaatacagtggttgttttggccaaaatcttcttttaacatatcttctacgtttcatccaaatttttaaccacttggagggactccgtaagggtttggtccatagccaggcagaattgagcagtaggatcaaaataatgtacaaagggcaaatacacatctgacttgcactgaattggattctgaatgaaaatgacggtgtaaatgtgtaacacggtcttcgattaccattactcgtcaaggcgtccaaaacgctgactaaatacaaatatgcaaaccctaaaattccaaaataaattggcaaatgatcaagcaagggatttacgtcaccataaatgatatcaaaactttcatagccccttcgcttggtgttggttaaccactcgtgcaagggaaaatctggagatgtagaggcatttttagggtactgctgttgaagaaggtacccaaatcaagtttcaatcatgggttctgggccagatggctcagtgcgagatctgttagactggcgcacagagttgaaaagaatgtccttgataacctgcgacattagcccatgcacttgctcaacagtaatctttgcactatctcgagttatcttagcaagttgagactcctcctctttctttctttgggaaggtgctattaggggtccaaagcgcgaatgagccaattgattctctgcctgctccagcttttccgctagatctgaaatttgtcctgcaacatagccc

SEQ ID NO: 11861 - DNA, 853 bp, Vitis vinifera
  Predicted polypeptide sequence is orthologous to G307, G308, G309
tttttttttttttttttttgtttatgaaataattgatttcattgaaggaatagactatgcaaccaaaatccaattacaagttttagaggagattattatgatttataactgtgtctaggaggggttgccaagccgaagccgctatgagagggcggctgtgccagcctagcgtcaaacacccgtcatgctcctcaacacagtacccctcagccgagaacagcgtcagcagcatactggcttgtttgaacgcattggatcccaggttcaacggcctgaaccctgctgctccaagccgattcctccacttagccaacggctcgtgcctttccactcgagccgacccttcgcaacacaacacgttgcatatctctttctggatgtaaatctcggctacggctttctccggctggagagagcaagcctctagggaatcgaacattgtggagtagtagtacagggcctcggtgaaccgatccaagaactctgattggttatgattcgcttcctgttcaaccactgtcacgattttcgggttcaagcttcggatccacccaagcaccgtttctatggcagacacccgggtcggaccggatccgagaagccggtgaagctgcatgattgagtttatagctacggcttcctttgggctcacctgtagcatccacggcttcacatcttccagccgcgaagctgccacaccacgaaaagcgaagcggacgttgacggaccgggctaactcagcgagccggagaccgatttctcggagcgagtcgcggccgtcaggcgatgggggaccatgcctgtcaacggagtaaggaggccaccgggacgcaggctaggcttgaatagagcc

SEQ ID NO: 11862 - DNA, 639 bp, Vitis vinifera
  Predicted polypeptide sequence is orthologous to G307, G308, G309
gcatcgatttcagcatgaaacaagggatgcagtggcctgcgctgatgcaagccctagccctccgtcccggcgggccgccctcgttccgtctaaccggaattgggcctccttccacggacaacaccgatcatctgcatgaagtgggttggaaattggcccagctggcggagacgattcatgtggagttcgaatacagaggtttcgtggccaacagtttggcagatctcgacgcatccatgcttgaactgcgagatggggagtccgtggcagtgaactcggtgttcgagttgcatagtttgctggctcgccctgggggtattgagagggtgctgtcggcggtgaaagatatgaaaccagacatagtgacgatagtagagcaggaagccaaccacaacggccccgttttcctagaccggttcaccgagtcgcttcactactactccactctgtttgactcattggaagggtgtggtgtgtcgccggtgaacacccaggacaagctgatgtcggaggtatacttggggcaacagatctgtaacgtggtggcctgcgaggggcctgagcgagtggagcggcacgaaacgctggctcagtggagagcccggttgggatcggcggggttcgacccagtgaacctag

SEQ ID NO: 11863 - DNA, 746 bp, Vitis vinifera
  Predicted polypeptide sequence is orthologous to G312
atagttgactttggaatcgttcaaggggttcagtgggccgctcttctgcaagctttggcgacacgatccgccggtaaacccgctaggattcggatctccggcattcctgcccctgcacttggaaaatcaccagcgtcgtctctgttcgctaccggaaaccgtcttcgtgatttcgcgaggcttcttgatctaaactttgagtttgagcctattctgaccccgattcaggagctcaacgaatcaacctttcgggttgatccggatgaggttttggctgtgaacttcatgcttcagttgtacaacctcctcgacgaaaccccggtgtctgtcaatgccgctctccgcttggccaaatccctcaatccgaaaatcatgactttgggcgagtacgaagcctgcttgaacgaggtagattttatcaaccggttcaagaacgcattgagatactacagggccatatttgattcactggagcctaacttggccagagactcgtcggacagacttcaagtggagagattattgctcggccggcgaatagcaggcgttatcgggccagaggaaccaggaactagacgagagcgaatggaagacaaggagaaatggaagtttttggtgggaagttgcggttttgagtcagtacccctcagccattacgcggtgagtcaagctaagattcttctggatcactacaactacagttctttgtatgctatcatagattcagcacctgggtttctctctct

SEQ ID NO: 11864 - DNA, 782 bp, Vitis vinifera
  Predicted polypeptide sequence is orthologous to G324
ggggttgctggaacacgaaatccgagttccccaagttccttcgcaaactttcatgtccatcttgccctcacaaaaccaaggatccacatcgtcttcttcggcagctccttctcaaaaccctaatctcgatcatggaatcctctttcaaccacacccttcacctctctctcgatctccgccctctctccccagtcacgtgcaaaaccttgcatcgcttcacatctccgactccgaatcttcagtcgcttcatccgacgacgtttcaggtggtcttagttgaaaattttcacttgatctttgttttctagggtgataggaatcctagaattttgacattaattcttagtagttacaattctgccattgtagttacctgctgcaatggcggggttttttgaggactctcgtacctgccgattggtttccacagaagtggataaaatagaaagaaaagtagtcatttcctattatattgcccgttgtttttttccaaaaaattgagaaacttgatttggatttgctaatagttgtattaggctgaattaatcaagctttgttctctcgaattcccagttaatgaagaattgaaacttctgatttttttttttacagttctctaaacagaaaaatgtagcatcagtttcttgctaaatttccttgattttagcttctgtaattggtttcaaagtatatatagtttctttttatatgcaatcatgtttctttattcgttttaggtaagaatcattttggtcaataggattttattgtttgtaaggttg

SEQ ID NO: 11865 - DNA, 609 bp, Vitis vinifera
  Predicted polypeptide sequence is orthologous to G328, G2436, G2443
ttttttttttttttttttttaagtaaaatgacatgcacattaaatgattccaaaagcaaaagtgggaccaaaggggaacctccgtgtctccgggcggaccacggttgggccccaccagaaacgcagctagccacaagataacttaacaacttttcggagccactaaaaaggtgacgcgtgtcactcaaaaggattctctacaacccccacttgcctcttccgtcttcctacagttacctcttcaccacccttcgttcactgtgcacccgaaacacaaacctacgctcactctcacagtctcacacacatgttgaaggacgaaggttgtaacgctgatgccgccgccggtggaggcggtggctgggctcgtgtttgcgacacgtgtaggtcggcggcatgcactatttactgcagagcggactccgcctacctgtgcgctggctgcgacgcccgcatacacgccgccaacagggtggcgtcgcagcacgagcgggtctgggtgtgcgagtcgtgcgagcgcgatccggcggcgttcgtctgcaaggcggacgcggcgtcgctctgcgccacctgcgacgctgacatccactccgctaatcctctggcccg

SEQ ID NO: 11866 - DNA, 767 bp, Vitis vinifera
  Predicted polypeptide sequence is orthologous to G328, G2436, G2443
ttttttttttttttttttttttttttttttatacaaaattactaggcacatttctcattaattcaaacccattacatcgagaaagatacagtattagtggttgagtctttagtaacaaactcatacaattctttctctccttgatactggatttagaatgacgggacaatgccatatccgctttccgccattaatgtcgtagagaacatctgatccacttcaacttctacatctgtcctcttggcaaacctgcccttgatccggggtcttgtctctgcatatgctttccttgatgcatacctgattgtcttctcaaacttccttgtcttctttttctctctgtacctcaggacccttgcctccctatccattggagtcagctgggttggcatctgaattggagggcctgagaaaaggtcgattgttcccttgggaggtctcggatgcgagattgagattgagatatcactcatagttgttgcttctggcacgacgccaacatccattgatgacacagagacgctgtggctaattgaagggttgtagctgtaggcagctttcgaggactcatactccatccccagatgaaaaccctgctgctgatgctgctggtgtagctgcccctttgcttccccgcactgaactggcacgacactgtctcccccataattcttgtgcggaacgctgtaatgcggcggcggctgctgctgattatactgatcactgaactgattctcagggcatgaattgtactccactaggtcccc

SEQ ID NO: 11867 - DNA, 929 bp, Vitis vinifera
  Predicted polypeptide sequence is orthologous to G343
tgcatgctcacactcgctgcgcgttcctctgcccctacccccaccccctctctccagtcctctctctatcactcctcagctatacaggctgagctcagactctagagagagggagcccccgcctacttccactgctactattactacccactactattactttgctactttctctgcttcttcttcttgttcttattctaggggagagaacttgctggggatggacttgtacggtctacagacgtccgacttttttcgtatcgatgacctacttgactttactaatgacgaactcttctcctccactaccactgattccggtaatctccctccgccggagatagcctccggcaaccgctctttggcggcctccggcaaccgcgaccagcctaatacttttcattctgctgatttcactgacgacctctgtgttcctagtgatgatgttgctgagctcgagtggctttcgaacttcgtggacgactcatttgcggattttccggagaatgaactcgccggaaccgtaatggcccggcctgactcatcatttccagggcggacacgtagtaagcggtccagagcatcgtcgacgaacaaagtatggacttcgctgccggaatctgagattccgatgatcgggaaatcaaagacgaatagcaacaaaaacagtattgtaaagaaagaaagctcatcgtcatcatttgtgattagcggagagagatcctcgtcctcgtcgccggcatcgtcgcccacgggagcgcgtaagtgcacgcactgcgcttcggagaaaacgccacagtggcgcacgggtcctctaggtccaaaaacactatgcaacgcgtgcggcgtgcgttacaagtcagatcgactggttccggagtaccgacctgcagcgagtccaacgtttgtgctgactcagcactcgaact

SEQ ID NO: 11868 - DNA, 677 bp, Vitis vinifera
  Predicted polypeptide sequence is orthologous to G346
ttttttttttttttttttttttttgaacaaaaccgaaacactttcttcttttttttggttctaattctaaaacataaccaaacacactaatgtcaaaattcctcctttggatttttcggaatccaaacagagattttgcactatcccattacaacaaaccctaatctctaactaagctaaaagaggaaaacaaaaacaaaaaccaaaaaaaaaaaaaaatctgaaacctacccatcactcccctaaccaccaaattatccacaaggcctcaccaccatatccctctgcttcagcttcctcatttccataatcttcctgtgcgaattagaatgcaccttgcttgagaaagtcgggctgctcgccggccgatactcagccacgaggcggccagacttgtaccgcaccccgcaagcattgcagagagttttggggccgagggggcctgcccgccattggggggttttctccgcttggcaatgctggcacttcctcccaattgtagagcttgtaattgtttgtttgctattggtagggctgctgttgttggcgttggtgttaccctggctactccaccaccaccacggctggcccgggatgtccgagaagtccttgtggcgcctgcggcggcgcttgctccttgcccggctgggcactcggaaattctcgcagcagctcat

SEQ ID NO: 11869 - DNA, 799 bp, Vitis vinifera
  misc_feature (710)..(710): n is a, c, g, or t
  misc_feature (766)..(766): n is a, c, g, or t
  Predicted polypeptide sequence is orthologous to G347
cgggggtgggtggaggatctgaccctccaggcaacgaaaaggaatttcaacgcgcaataccctttcttaaatcttcaattctcaaaatctgattccaccaaatctacaaccttttcacaccgtattttcgcattcaattcatcgccttttccgttcaattgttcgaggtcggagaggaaattcagttatcaatcagctatgcagagccatctcatgtgtaatgggtgtaggagcattcttgtttatcccagaggagctacaaatgtctgttgcgcattatgcaattcagttacctcagtcccacctcctgggttggaaatggctcaacttatatgtggaggatgtcggaccttgctaatgtacactcgtggtgcaacaagtgtgagatgctcctgctgtcatacggtgaaccttgcaccagcgccatccaaccaggttgcccatgtcaactgcgggaactgccgaacaacacttatgtatccatatggagctccatcagtcaaatgtgcagtttgccactatgttacaagtgttggtatggttaatgttagggttccaattcctgtgcacagacctactgctgcagcaatctctgcatcaacaccctctacttcatcaagccaaactgtggtcgtcgagaaccctatgtctgttgatgaaagtggcaaattggttagcaatgttgttgttggagtcaccacagagaaaanaatgatgctgagaccaagagcggttagcttacatagaagagaaccaagttcgatcnacgcataagatggaaaggtggatttagagattg

SEQ ID NO: 11870 - DNA, 717 bp, Vitis vinifera
  Predicted polypeptide sequence is orthologous to G351, G545
attcggcaccaggcagagttcctcaacccgcataccttttctctcagtgtttctctctgcctacttcatctccctctttcatggctctcgaagctctcaactcaccaaccacacccacgccttcctttcactacgaacaacccagcctccactctctggagtcatgggccaagcgcaagcgttccaagcgtcctcgcttcgacaaccaacctacagaggaagagtatctggctctctgcctcatcatgttggctcgaggaggcgccgccgcctccaccgtctcacaccgccgccatctctctccccctcctgccctgcaggtggaagctcctaaactcacatacaaatgttcagtttgtaacaaggccttcgcatcctaccaggcactagggggacacaaggccagccaccgtaagcagtccggatccgatgacctgtcggcctccatcaccaccacaagcaccgcggccgctgccagcggtggtaggactcatgagtgttccatctgtcacaagactttccccactggacaggctttgggtggacacaagcgatgccactacgaaggcggcgccagcgtcagcagtggcgttacctcgtccgaaggtgtggggtcaacccacagccaccgtgacttcgacctcaacctgccggcttttcccgaattatggtccgcacgtcgattcccagtcgatgacgaggtcgagagtcctctgc

SEQ ID NO: 11871 - DNA, 731 bp, Vitis vinifera
  Predicted polypeptide sequence is orthologous to G351, G545
gctccctacaatctcatcgcaaactctctctctctctctttctgaaactctcaattctctttctctcttacagtcagtgatggctttggaagcgctgaattctccgacgacgatgtctcctactttcaaatttgaggaggcggagctgcactctcttgagccatggacgaagaggaagcgatcgagacgaccccgttttgagaacccctctactgaggaagagtacttggctctgtgtctcatcatgttggcccgtgggggcgccaccacccgggaagagtcaccgatgccgctgcgggcagtgcctcctcctcccccgttgaatctctcttacaagtgtaacgtctgcaacaaggccttctcttcgtaccaagctctcggaggccacaaggccagccaccggaagtcctccaccgacgacgcgtccacctccgccaacaccaccactacggcggggagttccgcgctgaatcctagcgggaagacccacgagtgctccatctgccaccgcacgttccccaccgggcaggccttgggcggccacaagcgttgtcactacgatggtggcagcagcggcgtcacgtcttcagaaggcgctgtttctagtcacagccaccgggactttgacctgaacttgccggccttgccggatttctggccgaggtttcgcgttgacggagggcggaaaagtcaaactggggttgagcaagaggtggagagtccactgccgg

SEQ ID NO: 11872 - DNA, 714 bp, Vitis vinifera
  Predicted polypeptide sequence is orthologous to G355
cgttccattaaccattcagcattggtttgctttcatactataatatgaagagaagcagagttgatggagtcgatgaggttgaggccttagccatggccaactgcttgatgctcctgtctagggtgggaaaatccgaatccaccaaccagctcccgggtcgtgtgttcgagtgcaagacatgtaacagaaaattcccttcatttcaagcgctgggcggtcacagagccagccacaagaagcccaggctcatgggcgacgaactgctgcttcccacctcgcctgcgaagcccaagactcatgagtgctccatttgtgggttggagttcgcgattgggcaagcgctgggcggccacatgaggaggcacaggtctgagatccataaccctacgccggtgtcggttgtgaagaagacgagtgacgagagagttttgtccttggatttggacttgaatttaactccctgggaaaatgatttggagattcagttccggaaggtgcctcatatggtggattgtattttgtaatttttgggccatgacttatatttattcgtttgtatttatggagactggtagattcatgattctttatagagatcttgatcttttgtagatatagattttcgtattagagtggttctttatccacatatatatatatatatacatggattactgccaaaaaaaaaaaaaaaaaaaaaaaaaaaaaacatgt

SEQ ID NO: 11873 - DNA, 727 bp, Vitis vinifera
  misc_feature (697)..(697): n is a, c, g, or t
  Predicted polypeptide sequence is orthologous to G361, G362, G370, G1995, G2826, G2838
gcgtcctgcacctgttaaagagaaaggtattcgcctgtttggtaaagaatttggaggtcaccatgacccagaagagcagtcagagtccgtggagactaacatgtgtgaggatgtcaaggacagtgaaaatggcgaaagtggtagaagatttgaatgccattactgctgcagaaacttccctacttctcaagcgttgggaggtcaccagaacgcccacaagagagagcgccaacacgccaaacgtgcccatcttcagtctgccatggtccatagtggcctctcagatgcacacatgtacggcctggtcaattacaggctcggctccgcccccacgccgcccatcacctacccgtcatggggtagccaagccatttctagtaacggcaggttttatggaagtcatggatccttctcgcagccaccaattaacggaaaccctttggccttatggcgaatcccggcctccgtacaaactactcccactttcagtcgcgaccgttcatcacaccatccactgccattattcgccggtgatgacttgaagccctcgtcgcatgtcggtggctctacctcccaaagcagatacgtctacgaatcaacaaagcccggcgtgcaagaccatgtgagtttggatctccatctgtaataatctgaaacattccattttagaagaagaaaaaaaaactgagattttctncatgcagccatcttttgttatgctaatatg

SEQ ID NO: 11874 - DNA, 529 bp, Vitis vinifera
  Predicted polypeptide sequence is orthologous to G361, G2826
ttttttttttttttgaaggaagaaaaaaaaaattaataaatagatttgaaaatttacatgatctggctggggaaataaacatcagcttttgagttaagtccagtggagccaggagaacaaagcagagccatataactaaagaagccaagccaaaagtcaaggcgcagctggggcgaggctaagatgcaaatccaagccgaatgcatcatcaaaagtggggccaccgtcgcctctagagaacctgctcaatgaaggcgcatccactcttccatgagctctagactgtggagccgacgtcgttagtgttgactccccgacaccgccggcatacgatagcgtagcggcacctctcccactagatgaagggaatacacacccgtgagacacgtggaacggcggcggcccacgtggaacgtacacccaggaagccgactgcggcgccgcccccgccggaaccaccacaggccccgccggagccaggagatgggggggcggcgcgaacgcagatatcatggggtttcggatgtag

SEQ ID NO: 11875 - DNA, 665 bp, Vitis vinifera
  Predicted polypeptide sequence is orthologous to G361, G362, G370, G1995, G2826, G2838
gtacatcaccactgcaaaatataattgttttctcatttcaacaaggatggagaaagatggttctagcctcctttctcccatatcagatggagaacatggggattctgccggaaccagcgttgagaagaagcttaggttatttgggtttgagcttgatccatataagaaaggtgagagctgcctgaaggagtctgtggaaagagatgaaagtgtaaattcctcaaacacagattcatctgggagggaaaaaccctctatagagaagaactcaacagtagagccagaggacaagaagtttgagtgccaatattgtttcaaggaatttgcaaactcgcaggcattggggggtcatcaaaacgcccacaagaaggagagaatggagaagaagaggttgcagctccaagcaaggaaggctagtatcaaccattatcttcagcccttgcagaacaaccatagtttcacttaccatggctcagccctatggttctatgatccctcctgccaatctcccgacgatgaatctcagattagtttcactccatttgatcaagatgcccatctcaagaagtcccagttttccaagtggtatgccccccctgctaacctcccacttcaacaggatacctgtatgttcactctcacacatgctgatggatccggacaga

SEQ ID NO: 11876 - DNA, 910 bp, Vitis vinifera
  Predicted polypeptide sequence is orthologous to G363
tcccttctcctctcctctccatttatttactatattttcctcttgcatccaaactctattcccagttggtagtatccgtccacaacgcccttccatccaaactttatttccaatttaggggttgtggagaaatgattttccatggggaaggagctgaaacatcagtcaacaaacagcaaggtggactgaggataagtgagaacggagatgaaggagctgaagaagataatccaggtgagtggctgaatttaagcctgggtaggaatttgccgtctacagctctagactcagacccgcaatcaagaccaacttcttccaaggttttctcatgtaacttctgtatgaggaagttctacagttcacaagcattagggggtcaccaaaatgctcacaagcgggagagaggtgcagctagaagatatcagtctcataggatgatggccatgatgggtttgcccatgaatacacctatcaggtcacttggcgtccgcccccattcactagtgcagaaaccaaacagagatggaactgcaattgtggcgagatttgatgattccaacacgggctttggaatgacatggacacccttcacactagaggaaacgatggacgtgatgtggcccggaagctaccgcttggaacaacaaccatcagagcaaacatcagagccacttaagctcgacttaaatctccggctctaacagacccttcatcagcccttgtccagaattgtccatctcggttcatttctgtaataacagttcttgttttgttcttccatcaaaaaacatgtactgtgtactaacttaggtatgagccaaacaactttgaagagtcaaaaatccatgcctggatttctgcctaatatctctagaaaaaacactaggaatatactactgtttatgcatat

SEQ ID NO: 11877 - DNA, 907 bp, Vitis vinifera
  Predicted polypeptide sequence is orthologous to G363
tctgaagtcagtagccaagtagcgtccaatgtatccatccaagagacttcctctgatccctccaaggacagcactacgacatcatcttgcctcacaaatcttataaagcttcagccagaccaagggtctgtttctctagacttaacactatgtttcaaccccaacgacaccaagttgaagggcatgggtgagagtagcagtgatgcagtggctcaggctccagtggcaacggccccaaaggttttctcttgcaattattgccggcgcaagttcttcagctcacaggcattgggtggccaccagaatgcacataagagagaaaggacactggcaaaacgggccatgcggatgggaatgttcgcagatagatacactagtttatcatctctgccccttcacggttctgcattccggtcccttgggattgaagctcattcctcactgcaccaaagaatggtaccgctggaaaggcctgatacaaggggcggagcaaggtttgagcaaggctattacgggctgccagtgttcatagaagatgaagaagcagagctgttttggcctgggagttttaggcagatcggtgaaagagttggaggcagtgcaattcctgaattggctcaaggtcccaatataaattttgtaccaatggctcccccaccaaccacagattcgtcttcacctgatctcactttaaaactataagattctttccccccttttttccttcatttcctctggactcattactcctcacagggttcactttgtacagcgagatatgctcgaggcatggcggctaccctcggattttccactctcttttgtttctttaacttgttttcttttccaatgatgtgctgcggttgagctagtaagttgtatgagaagtatctgaagatgaatttta

SEQ ID NO: 11878 - DNA, 806 bp, Vitis vinifera
  Predicted polypeptide sequence is orthologous to G374
ttttttttttttttttttttttttttttttggtaagattaatagtacattgattgctaagattttactttttgaaatcaaaaccataacacaaacaatttgaaatgctgcatggggttaaactagaagatacatttcccttccagaagaaaaggaaaaagaaaaagagattagccatttgtcttctcctattacactcagtacccatcagttgtatccggcatctgctgaagaagtgtccatatcgttaagacccagctcctcattctgctcccacgacctctcgtattcctcaactggagatggtgacaatacagtatcatcacaacaaaggaagagattagccatttgtcttctcctataacactcaatacccatcagttgtatgcggcatctgctgaagaagtgtccatatcattaagacccagctcctcattctgctcccatgacctctcgtattcctcaaacgttaactgatggtcatctttgatatcatcagtggttggtgcaacaaaagaatttgctagtgcgtcatcaatgattaaagtccaaggctcttccagactcagaagcttgcttagcctcattctgaaatcttgccatttgcttcttttagaatcatcgagactgtccccaaaagtaaatccgtgtactctctcaaggttttcacaaatttttgtaatcaagccttcaacagttgtaacaactccacccaaagtgccactagccagctccaagtcaagctctgggacactcacacctgcagtatctgactttattacatcacggcttagatcattaacattc

SEQ ID NO: 11879 - DNA, 647 bp, Vitis vinifera
  Predicted polypeptide sequence is orthologous to G378
aaaactaaaagaagatggtgaatcctttgattgaaaccatccctagctagggcaatatgtaacatagtgatcccacaaaatcattcacttcattgtgattttgtggcttaatcaagtgtccatacaaacatcttttctacacatggggcaagacccatgtagggttagccattgatctacacattccatatgaaagtagtgcctgcaacttggaagccctcttgtcatctctccatccttgaaatcctgcaagcaaatggtacaactgatttcattatacatttctgcattgctagggcaaaagtttgatttgggaagcttttcaatgaaattatgaggcagccctttggctccactgatgttgtaaaagtcctcagtctctccataatttgtttccaatgtactaatctaagttcaaatgaatcattagggtcttatgttactagataaaaccattccatcttttcgaaaactattttatattcttaaaaataaaaaataattttcaaaattgtttttaaaaatattttcaagtatttttaacctttctgacaccgaaaaacttttaacatttaagatttaaaaacgttttctaaaaccatgaaaattgtttttaaaatattttcaagtatttttaacctttctga

SEQ ID NO: 11880 - DNA, 780 bp, Vitis vinifera
  Predicted polypeptide sequence is orthologous to G378
tttttttttttttttttttttttttttttttcggaataagcaacaaaagctattataactcaaaatttttgtacatatcgctaatcaagtacaatgaacaaactcgtcatattacatacctgacctactagagaaatggtatagacggagattaaatgaacaaagtagaaaaatcctaaggaaaaaagttaatactgatgaagaatcaaagaactcttctcgtgttgtaatttacagaaaataaattacagatcccttctgcatagagggcaagaaccgtgtccaaggagccacttatcaatgcatggcaggtgaaacatatggtgacaatggggcaaacttcggactgtctctccaagctgaaagtcctgaaggcacactgagcaagagaccttctctccagaagcatccccattattatcactggtgattgtgatctttgggatcttttccactgaatctccaggcaaacccttggccccaccagtgtcaaagatgttgggagcctcatcatagctaacttcaacagcacccatctgactttgcactgcacttagcatggcaggaccgatcctctcacgaacgagtctaccacttagcaggcttacaataacatcaatcaggtagagcagacatccaatccctgactcatcagattgccagagaacaagagaagattcaaagacctcaatagagaaaacagctcctgatattgctccaacagcagcccctctaacaaacccgctctctgtctcttggcctatcaaagctccagtcccc

SEQ ID NO: 11881 - DNA, 671 bp, Vitis vinifera
  Predicted polypeptide sequence is orthologous to G384, G385
ctgctagtgggtgttagctcttcacccactactttaaaaaaaaacacacacacacaaacaacaggagatttaagtaggaaaaaaggttggacagaaatgaagtattaaaaccctaataaaaccctaaccctaaccctaattgacaaagttagaaaggtgaggggaagctcaaacctatgtgacttacatgaaactcattgtactttgttttgggaagtcaatacccgaacctcgaatccttgcaaattcttaatgaaataagctaattatcttttccatcttgggaaaataggatggtgtaaggtgcgctcttgacttctccccatcttttataagctgaaaatcctcctcaccttcgtttcttttcctgcttttcttttccccttcttgagttcataacaatatttcaagctttgcagttcatgcgttctcacacgagactgcagccttaatcctgtcgacagtgcaagcgatgagattgtttacagtcgcaaccgaccctagagagagttttgccgttggaaccgaatcaaccaatatctgaaatgccacggttagaagagatcctccagacccaacttcacctatgactcctccatgagctgtggttccatctggaagaattgcaaatcctgagggaagaagagcaacatagtctggatcccctccat

SEQ ID NO: 11882 - DNA, 661 bp, Vitis vinifera
  misc_feature (635)..(635): n is a, c, g, or t
  Predicted polypeptide sequence is orthologous to G386, G707
cttctgcgccggtgtctgcgcttcaacagtccacaaatggaacaagctgtgcgccggcaacgtggacgaagacgtgcgagtaatgaccagaaagagcgtggacgatcccggggagccaccgggcattgtgctgagtgcagcaacctcggtctggctgccggtgtctcctcagaggctcttcgacttcctccgcgatgaacggctgaggagcgagtgggacatcctatccaacggcggacccatgcaggagatggcccatatagctaagggccaagatcatggcaactgcgtctccctactcagagccagtgcaatgaacgcgaaccagagcagtatgctgattctgcaggagacttgcatcgacgcggctgggtcgcttgtggtgtacgcgcccgttgacatccccgccatgcacgttgtgatgaacggaggagattccgcctacgtggctctcctcccatctgggttcgccatcgtccctgatgggcctggctctcgcgggcccaactctggggcccacaccaacagcggaggcccaaacagagtcagtgggtcccttctcaccgtggctttccagatccttgtgaacagtttgcctacggccaagctcacggtagagtcggtggagactgtcnacaatctcatctcctgcaccgttcag

SEQ ID NO: 11883 - DNA, 825 bp, Vitis vinifera
  Predicted polypeptide sequence is orthologous to G388
tttttttttttttttttttttttttttttgcttggaatcggaagttctcactagctctaacttccatatcataggaggaatgagaaacgactagaatcagcaagccttatctccacgatttaagattggggaagaaaaaaatgaaagaagaaacacattaaaagtagccgatttggccttggaaccaaaaaccgaaaaaagccaaaacctataagttttacaattaatcagagtatctatctaattaacataggcacactgatcacccatcctcacattgcaaacttgtttttatattttgcaatggacatgatacaagagtggtcacagactccacagactccatagttagtttggctggtggggaggggtttgttaagacttgaaatgctatggtgaacaaagatcctccttcagggctcttctcctccggcctaaaagtgatgacgagaggccttgactcaaccccatctggaagaattgagaaacccgatggcagtatagcaatgctgctggagtcgcaccctgtcatcacagactgcatgccggcaatgtctacaggagcataaaccaccatggattcatatgcatttgtgcaggtatcttgtaccacccacatactggcgtctttggatttcattgtctgaatagtgactgcattgccccgatcctgccctttggccaagtttgcaattgactgtactggccctccactcaacatgatgtcccactcgctccggcgagcttcatctcttaagaaatcgaatatgacgtggggagccactggcagccatacagatgaaactgcacacaggatcacccctt

SEQ ID NO: 11884 - DNA, 862 bp, Vitis vinifera
  Predicted polypeptide sequence is orthologous to G390, G391, G438
gaatcctatgttaaggtttcaaacgaaagaccagttgatgaacatgaagcatatgcaatgagcattgtcctcttcggtcaacaccttccaagccactgctctctcgtaggagaccggcctccccatgctagacaagcaaacaccaccttgaaggcacacaaaaccctgctgcattatctgtgggaactcagagcagagggtctttcttccattgtcatcaaaggtcttctccagagttatatcctgaagggctactaaggttgtctcaagcatgtcaagccctgcctgatttgcaaatgtaaaaactggcagtgcctttaacgagcagcacatgacagcatcagagtgatgccagagagttttgagaatggattcatttccttcattactgggtttgagcagctccactcccaaatagcacctatagctctgacagatccaccgagcaagtgtgtgcgcctcaggagtgcctggcagtgggcgaaaacccatttgagggccaaatcgagaaggagagagtgctaatgccactctctgaacagatgatatgatactgcggacatactgccgagccatggatgccacattttcttgaaggtgcatttcaaacgcaaattgaaatgatattgtcatcacagattttgcgctcccagtgtgcccagagttgtcactagatgccttgtttccagctggcccgacttcaagagaagaagcaaggtcgagggtacgatttggactagagccatccaccccagaatcaaggggaataattcgaaaaccagaaggaagaagaggtgcatcatcagagaaagaggcatcattggagcaagatgagttcagaacaggtgccacagcatatcgt

SEQ ID NO: 11885 - DNA, 774 bp, Vitis vinifera
  misc_feature (744)..(744): n is a, c, g, or t
  Predicted polypeptide sequence is orthologous to G390, G391, G438
ttttttttttttttttttttttttttttttcgggtgtttatgagatcctgatatacttcattcatgtcataatgtaatattgtaccaacttttttctaaagccacatactatataacttaagatatagcaaagcctatgtgcatcacacaaaggaccagtttataaacatgaaagccaggcagggattggagtcctcatcgttcaggactttccatgcaatggcctgctcataagacacaggcctgcccatgctggatgtgcatatccctgctggcagatacgcaaagccctgttgcatgatcttagagaactccgagcagagaatcttcctcccagcttcatcaagaatcttgtctagcattatatcttgaagggccaccagagtagtttcaagcatatcaagcccagcctggttagcaaatgtgaaaactggagatgcatttgttttcagggagcagcacatgattgcatcagaatggttccaaagtagcttcaagacagcatcaccaccttgggagtcaacccgaaggagctctcccccagtgtgaatcctgtagctacgacaaatccaccgtgccaaagtaagagcctcaggagaaccaggaagtggttttaggcccatatgggagctgagccgggaaggggcaatagccatggcaaccctctgaacagaggccataacactacgtacatattggcgagccatagcagccacattgtctcgaacatggttctcaaaaganaattggaatgcaatagtcagaacagatctg

SEQ ID NO: 11886 - DNA, 867 bp, Vitis vinifera
  Predicted polypeptide sequence is orthologous to G390, G391, G438
tgtagtggagttgacgagaatgcagtgggagcctgttccgaacttgtttttgctccaattgatgaaatgtttccagatgatgctccactgttaccctctggttttcggatcatcccactggattcaaaatcaggtgatacacaggagacattgactactcatcggaccttggatctgacatccagtcttgaagtgggcccagcaacaaatcaggctgcaggggattcatcatcatgctataacacacgatcagtcttgacaattgccttccagtttccatttgagagcaatctacaggataatgttgcaacaatggctcgtcagtatgttcggagcgtgatttcctctgtgcagagggttgccatggtcatatctccttcaggattgggcccagctgtgggacccaagctgtcagcagggtctccagaagctcttacattagcccactggatctgccagagctatagttaccatgttggggcggagttgctgagatctgattctgtgggtggcgattcggtgttaaaaaatttgtggcatcaccaggatgctattttgtgctgctcattaaagtcattgccagttttgatctttgcaaaccaggcaggacttgacatgctggagacaactttagttgctctacaagacatctcattggataagatatttgatgagtctggacgcaagggattgtgtgcagattttgccaagataatgcaacagggttttgcttacttgccggctggaatctgcatgtcaacaatggggcgccatgtttcatatgaacaggccatcgcatgggaagtccttgccgcggaagagaacactgtccattgccttgctttctctttcatcaactggtctttt

SEQ ID NO: 11887 - DNA, 520 bp, Vitis vinifera
  Predicted polypeptide sequence is orthologous to G390, G391, G438
cgatgatcatggacgcaagactctctgctcagagttccctcagataatgcaacagggttttgcttgccttcaaggtggtatctgtttgtcaagcatgggccgtcctgtctcatatgaaagagctgtggcatggaaggtgctgaatgaggaagagaacgcccattgtgtctgttttatgtttatgaactggtcttttgtctgaccttctgaccagaactaaaagtacagtgtatgaagagtactagaacactcttaagaccattattctcgtcttctcttttttcttttttgttccttgttggtctttttgttgtggaaaccctggagtactgattaggaccaatgttcccatgtttttaggcctgctgttgagatatttaccctgaaactaccttgtgttccattttgggtaatttcatgatctcttcagttcctgaatagaaaaaaaaaaaaaaaaaaaaaaaaaaaaaaaaaaaaaaaaaaaaaaaattaaaaaaaaaaaaaaaaaaaaaaaaaaaaa

SEQ ID NO: 11888 - DNA, 385 bp, Vitis vinifera
  Predicted polypeptide sequence is orthologous to G394
atccgttcatagatatctatactgtttattgatttacaaacatatatatatatgatatataaaaagagaacgagattgattagtaaattctattttctacaaattaattacattaatcttctactagaagcccttaaccaaaaaaaagaggggttgtgggagtctcctttttctaatcctaacaacttagcaggcagcagaaggattggtgaagggattgtagaagtggggcttaggagccattgtaaatgggcttttggaagcgccgtcggtgacgcccccgatcctctcacacgaggggcacatggtgagggtggccgccggcagctgcatgtacaagggctgcgctatagtttcagtgctttcagttcttgtagctccttct

SEQ ID NO: 11889 - DNA, 826 bp, Vitis vinifera
  Predicted polypeptide sequence is orthologous to G409
gcaacgcatctctcttcctcagtctctccctctccctttcactttcacaaacacccaaacattagccgtcggcgctgccggagatttctctttcaacccttccaagaatcgacacccttcccttctacgtcttctgagtgatgggggtgagctgttctcgctgttcccacacttcccacatcactgagatcatcatcaccagtttcttccgtcacaagctctagatcctggttgattcagaagcctccgttcgtcggaattcggaagctatgggagcttgagaattagtctggagagttgtaagtatggcgagtgggagggtcaatctcgcagcgatgcttcagaaccaaagggtcccttgttcttctcagcctcttgatgctctcttcctttctgcctcttctccttcttttcttggttcgagatccatgttgagctttgaagatgttcgtgcgggaaagagacccgataatcccttcttctgccagtttgatcatgatgaaaatggagacgaggacttggatgagtatttccaccaacccgaaaagaaaaggcgacttacagccgaccaagtccagtttctcgagaggaattttgaggtggagaacaagcttgaaccagaaagggaagtccagcttgcaaaggaccttggcttacagcctcggcaagttgccatatggtttcagaaccgcagagcgcggtggaagaccaaacagctggagaaggactttggcgccttgcaagctagctataacagccttaaggctgagtatggatacctcctaaaggagaaggatgaactaaaaactggatctattctcctcac

SEQ ID NO: 11890 - DNA, 919 bp, Vitis vinifera
  misc_feature (812)..(812): n is a, c, g, or t
  Predicted polypeptide sequence is orthologous to G409
tctctcaatctctctctcataagagaatttccattcaaagtttgagcagtcgttgttgttgcgcgtgatgggtgtgaggtctccctactctcaaacttaccacattaccataattctcatcacaagcttctttcgtcacaagccatagatcaaaattcaacacaccgcccttgcttattctcccaataaattaacatgaccccttagctcatcttaaattcatattcagtaatctatggacggtaggaaactgtatggtggcggttcaaacatggccgttttacttagtaaggaaacacttccctctccttcagagcttcttgaatctttctggattcccgattcttccactactttccatggttctaaatccgtcgtaaactttgaaggtgttggtggagacgacacaaaagataggccattcttccaaacactccatgaggaagaaaatggcgatgaggattttgaggggtgctttcatcgacccgagaagaaaaggcggcccacagccggtcaagttcagtttcttgagaggaattttgaggtggagaataagcttgaaccagagaggaagaaccagcttgcaaaggagcttgggctgcagccacggcaggttgcaatatggtttcaaaacagacgagcccggttcaagaccaaacagctggagaaggactatgattctttgaaagctagctatgatagcctcaaggctgaccatgattgcatcctgaaagagaaggaaaaacttaaaactgagctcctgttgctgacggacaaagcgctgatcggggagaaagaaggggagaaaaganaagcattggagaacatcagtccatcacatgcagaatctcagaaagcaatgatcgatagagtttctgaacacgtaccacccaatgcaccaatcctcttctgtaaacag

SEQ ID NO: 11891 - DNA, 413 bp, Vitis vinifera
  Predicted polypeptide sequence is orthologous to G416
tttttttttttttttttttttttttttttattttttttttttttttttaaaaacacaaaatgtctgcacaaagaacaacttcaatatatgtgtatatatatatgtcaaaaaagacgggttttccgtttctttaccatatgcagaaatgcaagaataaaaataaaaatgctttgcaataatcaagatgtgatgcaaaatcgacctttctcccttagctctgccacaggaacatagatcactgactggtcttgccattgattagttttgtcacattgaagtctcagtattacctgcttcaacttctctatcttatccttaatttggcagagtctctccatctccttctctgcatcttgtacaccagttccctccttgaagtcgaccctttgcttgtccctcttacttttttcccc

SEQ ID NO: 11892 - DNA, 481 bp, Vitis vinifera
  Predicted polypeptide sequence is orthologous to G416
ttttttttttttttttttttttttttttttaaaagcttcagttgtttcttcaagctcacatcatcgtcaaactccatagtaaccttgccatttgtaggagactcaagtaaagcccttctatgatgctttttctttacagggctggccattattggctttggattttttctcctccgcacctttttcaaattctttagggcacggaccagtgatgctgatgagttatcccttgatgccactaaatcaacagttttgtccttcacgatttctgatctggattcctcggagattctgggagaagtctgaagttgttttgctctttctgcctttctggtttttagcgctatatatcgcgcatttttgaaccatttgttcaccttctcataatcaagacccaactgctttgcaagattctccctcacatctctagaggaaagttcattctccccaaatgcttggcgaagcttctcaaccgcatcaa

SEQ ID NO: 11893 - DNA, 405 bp, Vitis vinifera
  Predicted polypeptide sequence is orthologous to G418
ttttttttttttttttttttttttcggttttttgttttccttttaaattttaaatttttatttatttatttatttttaatttttacaacaccaaacaccaaacaccaaacacaatgaagaagaaaagaaccatttcaatcttcatttgatgccccatattgattagtataatgacatcaaatcttgggctacatcaaaagctggtttgctttcattgatggttgagctaaaatagaacttggcttcaaagtaaatgtgctttgagattaaaagtgcttttcacagaatgcccagatcatcaatccagttttaacaataccccatttcaaatcttctcttgatctataaaagagaaaaggaaaatagatcaagaggtttacagattaagaaaccttatccccccct

SEQ ID NO: 11894 - DNA, 724 bp, Vitis vinifera
  misc_feature (683)..(683): n is a, c, g, or t
  Predicted polypeptide sequence is orthologous to G418, G965
tatccagaaatcaggtctcgaactggttcattaatgcaagggttcgattatggaaacccatggtggaggagatgtaccaacaagatgccaaggaagaagaagccgctgcatcatctgaggatagagaagccaacccacaaaatcaccagaaaaacagcatctccgcacagacaccaaggtcttccactccaccagcgtccgatagatcccaaatcaatgctcaagaaaacgacccttcacccgacaccatcaattacaggaattgcttctcgggaacccaagcaattactcaagctactaccaccacccccaccaccaccaccaccatatctcaacgttttccgaccacccatgaagccggcatgcatcaacggacggtggccgctgatgacacgtggtgtcgaggaagcgtgtttggcggtgaatatgggaccactgatgccgcatctctagggacacccgctggtgatgtctcccttaccttgggccttcgacacgccgggaacttgccggacaagggccggctgtcgttacgggacttcggggcctgctgagtggccatgattttattcatatatcattttcaagttgagaaatatatgaataaccatcttagggtgctatgccagatctacagtattaattgtatagtacaatcatttagcatcctgcaatttagatcntgatcttagaccctccaaacttattatcgttctaaatattt

SEQ ID NO: 11895 - DNA, 787 bp, Vitis vinifera
  Predicted polypeptide sequence is orthologous to G419
acatgttttttttttttttttttttttttttttttatgaagaaagacctgtatatccttgcatcaatcaatggcaattccaatctactctaacagtagtaaacatattctttccatcgaaaaggccaaggtgcaaaactaccagccatggaactaatgttcagtagtatgtctagctaagcaagtataagtttatgtatgtatgaagtatttatctatgtctctcatgtaattatctaccatcaatgatcactttccttcaatcacaaggctctggaccggggaagctcatcgcctatctgtttatccggccaagtcgtggagcaactgcgctcccatcaagtttctgtaaggcaagttctgtccttctccatctaaaagagagtactgaactggttggcaatcttcaatggggtctctagggtagaagagagagctctgtgatgcaggtgagaatgcaaagctcaccccgcttccaccatgctgttgtaagcccagcgtcaaggacacgccgctgccaccgaaattctgatgggcactgtcgttagtgaaagaaacagcgccggccgtgtggtgattgtaagaggagaagtccaactccacggctccaaaggcctcggcaactcgcccgaagttgggctggtggtggtggaggtggtgggggtgggggttttgaaggcttttgccatttttagagtcgttcttctctgggttgctgatgatggaagagaggcactcggagtcttattcgaacaagttgctcggcttgttgccttttgatcttcaaa

SEQ ID NO: 11896 - DNA, 667 bp, Vitis vinifera
  Predicted polypeptide sequence is orthologous to G427
ttttttttttttttttttgagttaaaaagtatcagtataatcattaatcatgatcaacatcactgttacaactgttctatcatattatttatattacattacaaatgagaaggaaaacgactaaacatacaaaatgtctgaagagtgctgttagtttgtgtttctgcgtgagaggaaaatattgcactattcatactaagccctaacaaaacatttccatctgctacccatttttcaggtcaagaagtccttcaaaaacagccttcgtttatgggtcagtcctgctatgcgttcttgcttccaattcaaaacccaaaatttttctacaatttgatttatcaattattctgtttagtacacaacccccactagcgatgcctccaggagaatgggaggtgcctcgggggaacaatccttgcaaagcttaacaggagtttcaccaggtgaaggcacaggtgcaacaatgtctgacgacgaggaagaccagatagatagtgatgccaacttgtttgatggaagtctggagggtgcagacagcatgggatttggtcctcttgtccctacagagagtgaaaggtccttgatggaacgagtaaggcaagagctgaagcatgaactgaaacaggggtacaaggagaaaattgtggacataagggaagaaattttg

SEQ ID NO: 11897 - DNA, 828 bp, Vitis vinifera
  Predicted polypeptide sequence is orthologous to G427
ttttttttttttttttttttttttttttttatggaaagcatcttacatttgttaaaaagttagaaatctacaaccttatatgtatgcccatatattaattacattctgtacctgatctctaacttccaggggttgtttcaaactcccagcttcaggtgtttttggtttttttgtttttggtctaaagagttatctgcatgcccaggaggttacataagcagctgctatattgacacacaagtatgttcttcatcttgccgttttgagtatgaaattagatgatgatgacgatgatgatgctgatctctctacctcttgcgcttcgactttaagggggtcaccgactgaaaattactatgccagttgcgcttcctttggttgatgaaccaattgttgatttgctttagctgcaaccccgtctcctccactagttttgccttgtcgtcttcagttgggtatggccactttgagtgttgctgccaccagtttttcaacacggaggttgtgtctcctggtagtttccctgcccttctttttctgagaatttcctctctcacatcctcgattcttgatttgaatccctgcagaacatttgaggaattattgtattatgacttgagttacccagtaaccaggagaagagcaagatgagggaagatgaatattgaagaaagaacatcacctgcttgagttcaatcttcagttcttgccgtactctctccatgaaagtcctttcagattcagttggaagcagtggaccaaaccccatcatgtcatgcccgtcaccccctccttgatctaatgaagaaatctgcatctcctcctcat

SEQ ID NO: 11898 - DNA, 860 bp, Vitis vinifera
  Predicted polypeptide sequence is orthologous to G427
tctctctccctctatttatatttgaaaattgtgcaagctttctctttctctctctctctctctctctcatctggatgctgcttgcttctttctctttctctgtgtatgtaaaatctgtgtgtctacagaagtggtgcagaaagttgtgcgtctcagatcccgatatacggcctctcttcttacaccaataacgagaaaactgtctgcttttttatcttctttctctctccaccaccatcaccaccccctccccctactataagggagagacacacccccttctcctctttggtggtcctcaacctctcaaccctacacccctccccctctcttttcctttcttcctctaattgttttttcctttttcactagttctcagctttctccacccaccagcaacactttactttgattcaaaaatacaagaaccaatatgcaggaaccgggtttgggaatgatgggtggtggcggaattggtggtttgagcgacggtgatcagcagcagtgccagctcaagggggagatcgtcacacacccactatatgagcagctacttgcagctcatgtagcgtgtctccgtgtggccacaccgatcgatcagttgccgctgatcgacgcgcagctgacgcagtcccatcacctcctccgctcctacgcatcgcagcagcaccaccacggcaactccctctcaccccatgagaggcaagagctcgacaacttcttgtcgcaatatttattagttttgtgtactttcaaagaacagcttcaacaacatgccagagtccatgctgttgaagctgtcatggcctgccgtgagatagaacaaaccttacaagccctcactggggtgagtctgggtg

SEQ ID NO: 11899 - DNA, 681 bp, Vitis vinifera
  misc_feature (639)..(639): n is a, c, g, or t
  Predicted polypeptide sequence is orthologous to G427
gccttgatggaacgagtgaggcaagagctgaagcatgaactgaaacaggggtacaaggagaaaattgtggacataagggaagaaattttgcgcaaaagaagagcaggaaaacttcctggtgacactacttctgtcttaaaagcttggtggcaatcacattctaagtggccataccctacagaggaggacaaggcaaagttggtacaagaaacaggcttgcaactaaagcagataaacaattggttcatcaatcagaggaagagaaactggcacagtaacccttctacttccactgttttgaagagcaaacgcaaaaggtgaaaacagcggtggtgatcggttcatgtaaatgaagagggaagtcctagaatcaaactccccattgatctatcagctcatgctccacgtgggttatataaatccaacatcatactacatagaaatgtaacgctataaggatgcatgaaaacaatatgatgatcaagtgaagaaccattcttttgcttctacaatttcaagctaacgcagtggatgaggtaaggtggtgatgacgatataggtatatgctcttcaaggcatgcagatggtgtattaatccttgtgattaggaagctaagattttaagaaaatatcactcanaccaatttcatttatgatttttgtttcctctattcatagttg

SEQ ID NO: 11900 - DNA, 673 bp, Vitis vinifera
  misc_feature (652)..(652): n is a, c, g, or t
  Predicted polypeptide sequence is orthologous to G427
gggaacaatcagaaccggggcgataacaatggtgaggacatgctggattgtgattctggagggaattgggaaaatgcgaggtacaaagccgatatcttggcccatcctttgtatgaacagttgctttccgctcacgtttcatgcctccgaatcgcgacgcctgtcgaccagttgccgaggatcgatgcgcagctggcgcaatctcagggcgttgtaaccaagtattcggtccttgcaaatcagcctttggatgataaggagctcgatcagttcatgacacattatgttctattgctgtgttcatttaaagaacaattgcaacaacacgtccgtgttcatgctatggaagccgtaatggcttgttgggagcttgagcaatctctacaaagtttaacaggtgtatcaccaggtgaaggcactggtgcaacaatgtctgatgatgaagatgaccaggcagatagtgagatcaacttgtttgatggaagtctggatgggccagacagcatggggtttggccctcttgttccaactgaaaccgaaaggtccttgatggagcgtgtcaggcaagagttgaagcatgagctcaaacagggatacaaggaaaagattgtggacattagagaggaaattcttcgtaagagaagagctgganaactacctggtgacactacct

SEQ ID NO: 11901 - DNA, 673 bp, Vitis vinifera
  Predicted polypeptide sequence is orthologous to G428, G1594
ttttttttttttttttcacttcggctacacaaccaatattttcagctctaagtttagcagtgggagcccattagtttcatccctaccataaaatatgccagcaactagaacttacgaaataaattaggacattgtcagaaaaataaggtgggtaaacatttcatttggtatcagcaaattaaagaccaaattgaagaatatacaccggaaatacgggagagagagaagagagggttgtcactgcatcactcattcatgaaaaatggtccataaatactgtccataacagcaaattgcatgttctccgatggcttccagtgccgtttacgttggtttatgaaccagttgtttatctgcttctggtccaggcctgttgattcagccagtgcgatcttgtcttcctccgttggatatggccatttatagtgaatattccaccaatcaagaagggcttgtcttgcttcctttggtagctttcccttcttctttgtctttgaaaattcatgcttcagggtactgatatagccactatatttccgcaatagcttatccttaagctcctgattttcagtagtttgaagacattcttgtacctccacctctcctccacttaagtcctcctctgatgacccagctgcttcgtcggaaacgtagcttctggaagcaccattgc

SEQ ID NO: 11902 - DNA, 808 bp, Vitis vinifera
  misc_feature (764)..(764): n is a, c, g, or t
  Predicted polypeptide sequence is orthologous to G431
ttcaagccctcacagtttcttcttctgattctgctggtggcgagggccttgatagaaatggatcatctgaagaagaagttgatgtaaataacttcattgatcctcaagcagaggacagggaactgaaaggccagcttctgcgcaagtacggtggatatctaagcagtctcaagcaggagttcatgaagaagagaaagaaaggaaagctacctaaagaagcccggcagcagttgctggattggtggagcagacactacaaatggccatacccatcggagtcgcagaagttggctcttgcagaatccacaggcctggatcagaagcaaataaacaactggttcattaaccaaaggaagcggcactggaagccctcagaagatatgcagtttgtggttatggatgccacacatccaggccactattacatggacaatgtcttgggcaatccccttcccatggatctctccccaactctcctctgaagatggaagatggccggcttaaactattgaaaatgcaactgcatttctgaacctgtagctttatatgttattggatggtgttatatattttactgtactcttaccacttgtatctatgttttgcctatttaatactaaatcagactgctaaatgcagctcgtcctcccttaaaaatgtttttctagtgatgggtttgtgttgtggttcttgtacttggggtgaatccactttggaaatggctgagatttcatagccaagaagtttgaaatgtacatgggtcntggggtttaactcaaaaaaaaaaaagataaaaaaaaaaaaaaaa

SEQ ID NO: 11903 - DNA, 652 bp, Vitis vinifera
  misc_feature (627)..(627): n is a, c, g, or t
  Predicted polypeptide sequence is orthologous to G440, G864, G1421, G1750
gctgatttcagccgcccatttcccccaaggacgttgccgaacgccgcgaaactttttacccgtcgacggcttcgccagctgccggacagcctgagcttcaccttttccggtgggcttcttccggccatttctcgccgatctgcttctccaaacagtggtgccgtcgctgttatctcctgaacatgactgaatagtgatctcgttaacgaacttcttcacacgctgacgcgcgaaaagctcaccctcttcgtcgctggaagagtccgtcgcgtcaccgtcagtgacggaaatccgtacaattctgggcccatcagcattcatactcctgccggtgaatttctccgacgaggttgtcagcagcttagtacgcttgcggtgctcactgtacttgattggggacaacatgtttcgggagatttctcagattccctccgttagcattgaaagcagaggatgaaagggaaagggagagagaaggagggtgtaaaaatagagaacggagaaaaagcagagattcctctgagaatagagaggcacggagaataaagagataaagaaagctgaggaaagaacacacgttaaagggaagcttgaaacgcagataaacctgccattaatggattgaanacccacaaaaagccattaaagcacc

SEQ ID NO: 11904 - DNA, 883 bp, Vitis vinifera
  misc_feature (849)..(849): n is a, c, g, or t
  Predicted polypeptide sequence is orthologous to G447
agttctctatttccttagttaatagagctcatttttattcgtggattgtaatctctacatgcttgtatacctatggatgccaaacaagacaatatgggtgatattctccagggcaaaaaattccagcataagtttttgcattgcaattgcccacccctaaaataatgggaaaaagacctatctgtgctttcgtaaaccttagggtctattgattgttgatgttaggaagctcatgattgaattgatcagcctttcctagaaggcaaaaatttgagtgagtttcttgccccacttatcaacctggtaacttgagattgattcctggtctcaaaattattcctaattccactattcaaaaaatgattaaatatggttaatttatgcctgcttatgctgtctggtttggggtatttcagggagtttgtgaactgtgtacgctgcatcaagatcctttctcctcaagaagtccagcagatgagcttggatggagatattggtaacagtgtacttcagaatcaagcctgtagtagttctgatggtggcaatgcttaaataaatctctgccaaaatcgttgccatttttcagctgcatttttaggaatctacccatcatcagctctctgcataacagagatgttttgcaacagtgccatggtagggttttccttcatcagcttgaagagaagggcaaagtaaattaggaagactatcctttggcagcaagagcttgcttcttaaattttgtaccggttcagaaataggaaacattggtggaaatttgaagaaatacaaaagctgggcagtacctgattgactgattatgaaacagcttggaagggatggtgatcnttgtgtccaagggagaagtatatttttaaagttg

SEQ ID NO: 11905 - DNA, 685 bp, Vitis vinifera
  Predicted polypeptide sequence is orthologous to G450, G456
ttttttttttttttttttttttttttttttgacttactgggacattattataattgtcattaagcaagccataatgctaattaaacaaaggcatagagacccagtcttgcaacacaaaataaaaatagttttttttttttttgggtttttttcttagtcctggccataattaatactcaaatatctcacaagtttatatgatcaaaccacaattaataatattacacacccccaaacatcctgctcaatccatcttggccctttcggtcgttgaagatcaaaggagcaggctgggggggccactgccttagctcctattcttgcatttctccatggctctaggggcgagccctatcgcctcttttcctttcattatgcgcaagcgtttgcatgaatccacaaacatctcccatgggacatctccaacgagcatccaatccccatctttgtcttcgtatgttggaacatgatcaaaaccattcaaaagatccatcaacttgctctcatttatgaaatccttcattccttgtgatccataattcccaatagtgaaggagctgaacatgttgcccaaggcattggacagctcctgataactagtgtacatcttcaagtcaaccttacgcagatacggcgctccgtccatgctaaccttcacaaaggctgcgttgcagctcaccttccc

SEQ ID NO: 11906 - DNA, 358 bp, Vitis vinifera
  misc_feature (139)..(139): n is a, c, g, or t
  Predicted polypeptide sequence is orthologous to G450, G456
ttttttttttttttttttttttttttttttattttactaataaacaaccgatacgaaaggtacgattattgcttcttggccattacaaatgccccgatctttgataattatataccgtcaaataaaaatacggacacancgatccaacatcctcatcaatcgaagcttgaacaccgggctgctagctttatcttctaagcttcatggatgctggacttgtacggggctgtgctggatcagcatctattcttacacttctccattgctcttgggatcgaaccaattgcttctgatcctttcattatacgcaagcgcttgcatgaatccacaaaccccggccgtagtgggcgaattcccg

SEQ ID NO: 11907 - DNA, 780 bp, Vitis vinifera
  Predicted polypeptide sequence is orthologous to G450, G456
atgtcaccgcagctccctaaaccctcgccggaatcttcctccgccggcctctatttcaatgataccgagctcaccttatgcctccccggcgctaccaagtccggcaccaagcgcgggttctccgacaccgtcggcttgaacctccgtggcccctgcaatacggatcacgctagcaatccatctgaaaacgatgtttccggcgactccaagcctccgccggcaaagacacaaattgtggggtggccgccggtgaaagcgagtcggaagaatgttgcgaagatcagcaaatatgtgaaggtggcggtggacggagctccgtatttaagaaaagttgatctggagatgtacggaagctatcagcagctgttgggatctctcgaggacatgttctcctgcttccctattcggaattatcttaatgagaggaagcttatggatcctgtgaagggatccgactacatgcctacctatgaggacagggatggagattggatgctggtcggcgacgtaccatggaaaatgtttgtggaatcatgcaagcgactacggctgatgaaaagcattgaagcaattggactagctccaagggaatctcaaaaatgcacaagcacaagtggatcaaaaagcctatagtttgatagcatccttggatgataatttgatgtaaaaaggcttcttcttctatttttttcccctaattttgattggttttaggtgaccaaaaaaaagagaaaatatatgtaaaagagacttttagagtagagaaatagacgttagtta

SEQ ID NO: 11908 - DNA, 715 bp, Vitis vinifera
  misc_feature (568)..(568): n is a, c, g, or t
  Predicted polypeptide sequence is orthologous to G450, G456
tttttttttttttttttttttaatttaaaatttaaaaattatataaaaaaaaatgtatacatttggggacagagaatctctcatctcttacaaataaaatacatggcactgaaaatttctagggaaccaaaaaacactcacaacaacaagaaaggacgatgcatgagggttgttattagactaacaagaagccattgataatagacaaagctacacaattttgagcaacagtcttatgaacaagtagtactgttattgtttcttgctcctaatacaatttcccagcttcttttctctctcatatttatatatcatgccaccatacaagcacatccatccatgatcctcagctgcttctggctttcctttgatgggcagactgtggatgggtgcctctagcttctgttcttgcacttctccactgctcttggggcaagtccgatggcctcggatcctttcattatgcgcaagcgcttgcaagattcgacgaacatctcccatggcacgtctccaacaagcatccagtctccatctttgtcttcataagtaggcacgtaatcggaaccgntcaaaagatcgatcaatttgctctcattcatgaaatccttcattcttgtgatccacagttgccaatagtaaaggagctgaacattttgcctagggcatcagagagttcttgatagctcttgtacatctttagtccaccttacgtagt

SEQ ID NO: 11909 - DNA, 988 bp, Vitis vinifera
  Predicted polypeptide sequence is orthologous to G450, G456
gaggaagaaggagaagcaaagagagaagatagccatcatcatcaacgactagaatagagcaaggtttccccggagattccatggaagttggccggaaaatgtcgagcatgctcggggctgagcgtggttttgatttcaaagagactgaactctgtctggggctgcctggtggaggtggaggtgaagccgagacgcttaaggcttctggcaagagggggttctccgagactgttgatctcaaactcaaccttcagtccaaggaatcagtagtggatctgaacgagaatgtcaagtgtccacccaaggagaagaacctccttccttgcaccaaggatccggccaaaccacctgccaaggcacaggtggtgggttggccaccagttcgatcatttaggaagaacataatggctcagaagaacagcagcgaggagggtgagaagggaagcagcggtgctgcattcgtgaaggtttgcatggatggcgcgccatatcttcgcaaggtggacttaaagatgtacaagagctaccaagaactctctgatgcattaggcaagatgttcagttcctccaccatgggcaactatggggcccagggaatgatagattttatgaatgagagcaagttgatggatcttttgaacagctctgaatatgttccaacctatgaagataaggatggagactggatgctcgtgggtgatgttccatgggagatgtttgttgattcatgcaagcgcttgcgtataatgaaaggatcagaagcaattggtcttgcaccaagagcaatggagaagtgtaagaatagatgctgaaccagcacagcctcgtacaagttcagcatccatgaagcctagaagataaagctagcagcactgtgttcaagctttgattgatgaggatgttgtttggatgtgtctgtatttttatttgatggtatataattatcaaagatctgggcatttgtaatggacaagaagcaataaacgta

SEQ ID NO: 11910 - DNA, 585 bp, Vitis vinifera
  misc_feature (61)..(61): n is a, c, g, or t
  misc_feature (451)..(451): n is a, c, g, or t
  misc_feature (477)..(477): n is a, c, g, or t
  misc_feature (526)..(526): n is a, c, g, or t
  misc_feature (528)..(528): n is a, c, g, or t
  misc_feature (545)..(545): n is a, c, g, or t
  Predicted polypeptide sequence is orthologous to G451
tttttttttttttttttttttttttttttgaacactgatatctaatggagtatcgggatcngtttgaagggttgatccaaaactcgacagcaagaacgaattatccacatttggcatatatagatctatcttgtgctgcgtaggggaaaaccgagagcccaagccacaagaccatgtgatctgatcatcagaccctccccatcggaaaggaattctaaatttcggggtccgttccgatgccttcatgaaacttagcctcttacaggatgagaagaccatctcccatggaacatctccaaccagaatccagtcgccgtctttatcttcataagccggggtatagacagaaccattgcagccttccctctctgagaactcacctatgctgaacttgaacatattctccagatcgatcaggagctccgggtagctcttgcaaaccttgagatcnatctttctgagggaaggagctccctncatgctcactttcacgtacattccggccccctcggcttcccctttcctntnctggaagctgtttttcnggatcgatcggaccggcgaccaccccaccacttgtgcttt

SEQ ID NO: 11911 - DNA, 738 bp, Vitis vinifera
  Predicted polypeptide sequence is orthologous to G451
ttcatcattacaactcctgatcggaattcaaaaacgatctaacgggataatcatcgggaaaaatggagaagccagagccctacaataacggacttaatcttgaggcgaccgagctaagactaggggtaccggggaccaatgagcctgagaaacaatcatctactagtgttaggagcaaaaagagagcatcgccggagatggccgaggagactaggactaagagcagctcttgtatatccgatgccgacgacgacgcccctccaccaaaagcacaagtggtggggtggccgccggaccgatcataccggaaaaacagcttccaacagaggaaaggggaagccgagggggccggaatgtacgtgaaagcgagcatggatggagctccttacctcagaaagatcgatctcaaggtttacaagagctacccggagctcctcaacgccttggagaatatgttcaagttcagaataggtgagtactcagagagggaaggctacaatggatctgactatacccctgcttatgaagatagagatggtgactggatgctggttggagatgctccatggaagatgttcatctcatcctgtaagaggctaagaatcatgaaggcatcggaatgacacccgaatattagaattacttaacgatgatgaggctctgatgatcagatcacataatcttttggcttgagctctcggttttcacctacacagcacaagatagatctatatatgt

SEQ ID NO: 11912 - DNA, 845 bp, Vitis vinifera
  Predicted polypeptide sequence is orthologous to G451
ttttttttttttttttttttttttttttttcgggaaaaccatacttttgtgtatctatattttcataagattgagacagaaccaaaacttggataaccatgtcatgttcctttgttctttacaattgcatttgaagcataaatgtatatctcttcatatgcaggtttagcttgatgcgattattacaaacaaggctacgaataacatcgagatgcttaaaaccaccatggatcttggtgccacaactttgggaaagaaactttaattctgctttgttttctctgtttgctgtcttgacttgccgtttcagttccagagaaaactgttgatagagaaaacgacattcaaatccaaatttcttcctggagaacccaagccgaaagagttgccctgggtgagagacacgtcctttcttcttttatgggctgccatgacttctaggattccttatgcaccacaacccaagcctctagcgtctgatcctttcatgattctcagtcttttgcaggatgacatgaacatgtcccatggaacatcgccaaccagcatccagtcaccgtctttgtcttcataagtgggtacatattctgatcccttgtagccctctctctctgagtaatcacctatagtgaatttgaacatattctgtagagcctgaaggagctccggatagcctttgtaaaccttcagatcaatctttctgaggtaaggagctccatccatgcttactttcacgaacattccagcagcctccgcctcagtcttcttcagttggaagctatttttccgaaaggatcggattggtggccaccctacaacttgtgccttcgtggcaggtgcatttt

SEQ ID NO: 11913 - DNA, 733 bp, Vitis vinifera
  Predicted polypeptide sequence is orthologous to G451
tttttttttttttttttttttttttttttaagtaaatttgtacacttccatttcaagaaaatatgcataaactatacataaaagtttgtttctccgactcatcatcttgatttcgttttgtttctgtgttggaattcagactcagatttctccatggacagcccaatctacaaggagttttcctttttcatagaccaatcaatggatcttcttttggatgtccccaattcccatttttgagcagcttggattgtgcaggtgttttctatagaaagcagcccaagcctctagcttctgatcctttcatgattcttagcctcttgcaggaagagatgaacatattccagggaacatctcccaccagcatccaatccccatctttgtcttcataggtaggtgcgtattctgaaccattgtagccttccctctccgagtactggccaacactgaacttgaacatctcttccaatgccttaaggagctctggatagcctttgtacacctttaggtcaatctttctgagataaggagctccatccatgctcactttcaaataggttctcccctcctcagcctccgttttcttcggctggaaacagcttttccggtatgatcggaccggtggccaccctactacttgtgccttgggggccggagcagtttcacggtgggattttccatcatccgagacactagagttgttcccagatcccgactcctcgttcatgtcccc

SEQ ID NO: 11914 - DNA, 275 bp, Vitis vinifera
  Predicted polypeptide sequence is orthologous to G451
tttctttttttttttttttttttttttttttttttttaaaaaaaaaacatcataattagggtaaacttaaaatttgttcagggaaaaaaacaataaaattattttttgcattacaatcacaaacttctaatcatttattttctggagttccttcaaaaaatttaactgccggccgaaatttttggtttcggatttttttttgatcctcacccttttgcaaaattcaatgaacatttcccaaggaacatttcttacaagcatccagcccccatttt

SEQ ID NO: 11915 - DNA, 771 bp, Vitis vinifera
  misc_feature (696)..(696): n is a, c, g, or t
  Predicted polypeptide sequence is orthologous to G461, G462
tttttttttttttttttttttttttttttgacaaaaattaaaattggataaagtattatcttaattaaacaaatacaaaatttttaattaaagtataaagaaacacaactagattatcttgtctgtctaggatcctagatccaacttaacattaattaagtcttacatgcataatttaaataaaaattgtcttctaaattaaaaaagaacatcataattagggtaaacttaaaatttgttcaaggaaaaagacaataagattaatttctgcattacaatcacaaacttctaatcatttatcttctggagttccttcagagaatttaactgcaggccgaaattcttggtttcggattttttcttgatcctcagcctcttgcaagattcaatgaacatctcccaaggaacatctcctacaagcatccagtccccatctttgtcctcatatatgggaatatactctgaactatctgcatctttcaatgcttcaccgatgccgaaacacccgaaaagctcctcaaaagcggtgacaagattgaagtagccttggtgggaactcaaatcgatcttacgaagaaaaggtgcgccgtccatgctcactttcacgtacattttggtagcttctgttcgatccttgtcattaaaactgtttttcctccgatatgagcagactggcggccaccccacaacttggtncttgttctgggctttccgttcacacgtgggggcgctgctatccccggacatctcagaaaacaccctcttcttctc

SEQ ID NO: 11916 - DNA, 694 bp, Vitis vinifera
  misc_feature (335)..(335): n is a, c, g, or t
  misc_feature (338)..(338): n is a, c, g, or t
  misc_feature (376)..(376): n is a, c, g, or t
  misc_feature (452)..(452): n is a, c, g, or t
  misc_feature (652)..(652): n is a, c, g, or t
  Predicted polypeptide sequence is orthologous to G468, G2866
ttttttttttttttttaaaataaaactatatatactcatttggtgtgtatgcatgtacatctataactcagtaacaaattcatatactgtgagtttgatttccaccccacaagacaaaatgtggagagatcggaaaagacaactatcaaggatgtactgggattgggctctttagtatttgtctaccctagtgatcttcaatctctttacagtggtcaagaacagctcccaaggaacatccccaaccatcatccagtctccttccttgtcttcatatgttagcacatggcatttctcagaatgcagaactccatccacctcagcccagagaatgntgntgctgaacatatggtcaagagtccttatcaaggcatgntaaccgtcgtgcgcaaatagatcgagctttcttccaattggaatgccttccatgtataccttcacaaagaaggtgncatcattgcacttgtttccttctcctgccagggccttcctgaggagagtctttatgggtggccaatctgattgttgctcccttggagtggaagggcagtaatggtgatcagaggttgaaatgctgagcccaaggctaagatctgtgctgaagtctctcttgagccgggggaaagaagatgcagatgaaacagttgaatgnctgctgctgtcaatagatgatgatgaagagtttgtagctcta

SEQ ID NO: 11917 - DNA, 875 bp, Vitis vinifera
  Predicted polypeptide sequence is orthologous to G470
ttttttttttttttttttattacaaaatacatgctcatatataagtaaatatatatatatatccacagcctactctctagttggaaatgagagagaaatcaaggagaaaagagctgtacaaaaagagtctcagaaacctaaggctgcccctaatttacccaaagaatgtaaaagtatattatatatgaaattcatgaaagacaatgaaagcataatataacatataaaacaccagacttcaaacttcttaacaaccaggtggtttgggggttggaaatgaaccaaaaatataaaaaagggagaaattatatttttttaaaaccaaaaaacaaagaaactgcaaactagtgacctgtggtaaacccggattaaaatgccatggcgaaggggctttacaactgcctcaactgccttcacaacccatggtcaattcaggcagacttgccctgccccagagactcactgctgagggatgtctccaactctttagcttcttttgcaccacccttcttctccagaactgttgggttttcccttaccttaggattcaggggtcttgggtccatcctctgaatctcctctcgggtgtagacaaagattttgcgcaccatgctgcaaaactccggccagggatcatctccaacaagcatcatgtcaccctcgtcatcagtaaaaacaatcaaccaatctttgttgagagatattaattcaccattgaattcaaaaatctgatccaattcagatattagttcagtgtaaccattaacttggtgacgtccacggatctccctacggcaattctctgcttgtgaaccttgatgcaactcctattgaaccgaatgagtttgctttgatcatctcttgaagctgctgtt

SEQ ID NO: 11918 - DNA, 873 bp, Vitis vinifera
  Predicted polypeptide sequence is orthologous to G470
cgggcagagagctaatgccgaaacctattttggttcagaagcaagaggctgtgaaacccaaggatggaaactgcaagctctttggcattcctctaattggtaatcctgttatatcagaaccagcaatgtcatacagaagcatgacaaatgagccagcaggtcatttacatcttgcgcctagtgcatttgattctgatcaaaagtctgaacagtcaaaaggtgctaaatcaaccgataatcctctggctgttagtgagcaggagaaaccatgccaaacttctctccctctttcaagagatgttcagggaaaagttcagagtgtttcaacaaggagttgcaccaaggttcacaagcagggaattgctcttggtagatctgtggaccttactaaattcaacaactatgatgaattgattgctgaattggatcagttgttcgaattcgggggcgagttaatggctcccaagaagaattggctgattgtgtatactgatgatgagggtgatatgatgcttgttggagatgatccatggcaggaattttgtggcatggttcggaagatctacatttacaccagagaggaggtgcaaaggatgaatccagggaccttaaattcaaagaatgacgataatccatcagttgcagaaggcatggatgcaaaagaagtgaaacgtcagccggttcctttgacatcaaacctagagaattgctagatttaactcccatggttctaggtttttgtgcattgatcagagaagcttgctatggttgttttagtaggaagggcaattgaactaattgagatgcacaagagtctcttacctcttttagacaggtttgtctatccgaatagggatcatttttatattccca

SEQ ID NO: 11919 - DNA, 699 bp, Vitis vinifera
  Predicted polypeptide sequence is orthologous to G478
ggacagggtgactgtacacgccattgcagctacagtggaacgctgcgttttggagattaggtttttgaattactcggcagtcaacaagtactcctcgttcgtctttgtcttttcactcggtttcatgctgccatagatcgagttgagggcctttggaacaacgtcgtcaaacctgagcttcagtgggaaatgctggagtacgaatgggggaacccatctccgatcatgctctccggagacgagcctcctcaggattcggaccagacccgccagatattcgaccactaccaccaaaccttcaccgacggactcgtcgctccggcgaccgccttcttccaccaccagagccagcctcagcccgctcatattcactccctctacgacccacgcgcctaccacacgtaccaggcccccccgccggcgatgctgtcgcttgagccggtggccgggacgtccgccggcggggggaccgggtttatggtggtgccgaagagcgaggagatggtgccggcggcggatttcacggcgagaattgggctgaatttggggggcagaacgtatttctcctccgaggacgacttcgtgaaccggctgtaccagaggcggtcgagaccggcggaacccggtttgacgaactcgccgaggtgtcaagccgagggctgtaatgccgatctcacccacgcaagcattaccaccgcc

SEQ ID NO: 11920 - DNA, 657 bp, Vitis vinifera
  Predicted polypeptide sequence is orthologous to G484, G2631
tttttttttttttttttttttttttacacaaactcaaactaattacattgagttacaagcataatccatagagagaataaaaataaactgcgagtccatataggtgccactactcttgcaagagcttttgtacataacataagggggattagaagaatatatgggatactcaaggatgcttgcctatggtccaaaagaaaattgaagtcctaaaattagctctccaaacttgggtcaagttctgattgtttttggatagaggccccaccattcattcttgcgcgtgcctcagcaaacatcctctgctgctctgccaatgcttcttcctcggtcatttccgctccattgctccacttcccaccttttatggtgtccatagtttcaagcttgtgttgttcatatgcagcatacacctcctcaatgtactccccaaatccaagaacctctaaagccttgagaacatgctcaggtgcaatggttcttttttcttctctgctacaacgtcattggactctgaggagatgagattaataaactctacacaacattcaatcagaaggtcgtgagcatctcttgcaacacgtacatctgggggcaacatctccttgataatttttgtcatagtagctttgggcagagaagcatcctcttgggact

SEQ ID NO: 11921 - DNA, 699 bp, Vitis vinifera
  Predicted polypeptide sequence is orthologous to G489
gacatgttttttttttttttttttttttttttttttgcgtcataaggtcaaattcagctactttgatttgcatgacctgaaaatcatagtatagcaaatacattacaagtagaccctgcactagtaacttgataataagccgtccatattaactaagttttaagcactaaatctttcaacaaaataaaacattcattctatagataaagctaatcctcactatccagaggtaataatattttctttatcaatattaatttgtgcagcccacatattccgtctttgcaatcactttggtgcttctcttgttcatgtatttctcctgttcatttcgatactagtaaggcatcttcttccctgacacttattgttcttgcttctgctctagcaaatctcctctttgctcaagaatctgcaggtggctgctgttgctgctgctgtggccacatctgctgagcaacataagggcgaggctgttggccataaagaccttgatccatcacagtcttacccataaccattcctggagctccaacctgtggaccatgctgaggttgcatataaaagtaagggagaccctcagcaggacctccaactggaagtggcccccctcttggcattgatgctagcacctcctcttttaaatcctcaccgtgggacaatatccactaagaaaatcaaatatatccagcccctgtg

SEQ ID NO: 11922 - DNA, 826 bp, Vitis vinifera
  Predicted polypeptide sequence is orthologous to G489, G714
ataaaaatcgagtaccataaagccaaaccctaaccaaccaaccccatcattcactgtacggactttccctccacaacgcccgaaacccaggatagcaatggatcatcaagggcatggacaaaccccagtaatgggaatggctggtagtgcagctcagttgccatatgggacaaacccttatcaacataaccaaatgggtggaacccctacttccggatcagtagtgacatcagttgggaccattcagtctccagggcatccagcaggggctcagcttgcacaacaccagcttgcttatcagcatatgcaccaccagcagcaacagcagctacagcaacaactccagtctttctgggcaaatcagcatcaagaaatcgagaaggctactgattttaagaaccatagccttcccttggcaagaatcaagaagatcatgaaggcagacgaggatgtaaggatgatatcagccgaggcaccagtggtatttgctagggcatgtgaaatgttcattttggagttaactttgcgctcttggaatcacacagaagaaaacaaaaggaggactctgcaaaagaacgatattgctgcagctatcacaaggactgatatctttgactttttggttgacattgtgccaagagaggatctcaaagatgaagtactcacgtcaatcccaagaggaaccatgccagttgggggggcctctgacacagtcccttactactatatgcctgctcaacactcgcctcaggttggcacgcctgggatgatcatgggcaagcctgttatggatcctgctttatatgcccaacagcctcacccctac

SEQ ID NO: 11923 - DNA, 337 bp, Vitis vinifera
  Predicted polypeptide sequence is orthologous to G489, G714
tttttttttttttttgggcgataagctggcagccactaagaatctgatggtgattgccattgctgcttttcctgcaacagccacatcaattgacccatgtagagatgaggttaatgggcatacaaagctgggtccatcgcaagcatccccatgatcattcctggaatttcaacatgagatgaatgctgagcagcataagtaataagagggtgcatcagcaggggccccaataggcatggttcctttcaggattgatgcaagcacttcaatcctgtcttggcagaatgtcgatcaaatgtcaaagatattgtcctcatgattgctgctgcaatgacct

SEQ ID NO: 11924 - DNA, 687 bp, Vitis vinifera
  Predicted polypeptide sequence is orthologous to G502, G519
gccgaaattgatctctacaaattcgatccctggcagcttcctgagatggccttgtacggagagaaagagtggtacttcttttcgccgagagatcggaaatatccgaacggttcaaggccgaaccgggcagcgggaacagggtactggaaggccaccggagcggataagcctattgggcatccgaagccggttgggattaagaaggctttggttttttatgccggaaaagcccccaggggagagaagacaaattggattatgcatgaataccggctggcagacgtggaccggtcggctcgcaggaagaataatagcttaaggttggacgattgggttctgtgccgcatatacaacaagaagggcattgtcgagaaacaacacaccgctgcccggaaatcagattgctccgatgttgaggatcaaaagcctggacctcttgctctaagcaggaaggtaggtgcgatgcctccacctccgccgccgtcgtcctctacggcaccaactgcgacagcggcactggacgatttggtgtacttcgactcatcggattcggtgccgcgcctccacaccgactcgagctgttcggagcacgtggtgtcgccggagttcacgtgcgagagggaggtgcagagcgagcccaagtggaaggagtgggaaaatcccatggacttttcgtacaattacatg

SEQ ID NO: 11925 - DNA, 684 bp, Vitis vinifera
  Predicted polypeptide sequence is orthologous to G502, G519
gcaggaaaagggggagagaaaagagaaaagagaaagagaaaaagggaaagtaaattttaagaattttcaagaggaagaagtgaatgatgagcggagatcagttgcagttgccggctggtttcagatttcatccgacggacgaggagctcgtggtgcattatctggttcgtaaatgcgcatcacagagcatctccgttccgattattgccgaggttgatctctacaagtacgatccatggcagcttccaggaatggctctgtacggtgaaaaggagtggtacttcttctctccaagggaccgcaaatatcccaacggttcaaggcctaaccgggcggccggatccggctactggaaggccaccggcgccgataagcccatcggccgacccaagacggtcggaattaaaaaggcactcgtattttatgccggcaaagctcccagaggtgtcaaaaccaattggatcatgcacgagtatcgcctcgccaatgttgatcgatccgccggcaagaaaaacaacttaaggcttgacgattgggtcttatgtcgaatatacaacaagaaaggcagcgccgagaaacagcacacctttgatcaaaagtcaatgaaatatccagaacttgaagaccagaagccaaaaataatatcaacggttcaaaataaagtagtaccctcttcattgccgt

SEQ ID NO: 11926 - DNA, 648 bp, Vitis vinifera
  Predicted polypeptide sequence is orthologous to G502, G519
tttttttttttttttgaaaaaaaaagaatattttactattattctatattctacaaaggtgagaatttcctacaatggtacatattaacaacgaccaatccaacacattctcatcccatcatccccatatcttccatgaatgaaactcatgttagcaacttcatgaatcatgagaccaatatagctaccatcttcatattctaggtttgacgtacgatgatcaaattttcctaatcggaatatttatcaaaatgacttgttcgagaacatcaacatgtcctgccacgacgatgttaataagtctcccgaaaactgtgcttgagaggcaaaagggtcgttggcaaaaccatccatatagaggctaaaatcaaagtcattccacttaggctcgctttgaacctccttctccggtgacattacttgttcggatccactagaatctgtgtgagtgtgtaacctcggcactgaatcagatgtctcgaagtataggtagtcattggttgttggcggcgcaggcattggaggtagggacggcaatgaagagggtactactttattttgaaccgttgatattatttttggcttctggtcttcaagttctggatatttcattgacttttgatcaaggtgtgctgtttctcggcgctg

SEQ ID NO: 11927 - DNA, 821 bp, Vitis vinifera
  Predicted polypeptide sequence is orthologous to G504
gtttttttttttttttttttttttttttttttgcgaatactgctaaccagactatatatccaaggatgtctatggcctcacccgaaaatattagcagctaactgttacagtactgagaagaaacttgaggccatttatggagtccctagcgctcttccctgacaatcaaaaactcaaaatacacaaaccaactacactctatatctaaccaactgtatcgatgacaatcggagtatatatatatagaacattggctagctggtgatagtctacctgggataatctctgattttgattcaaatattatgtatagttatgctcacaatccgtaaccgcaaccgagctaagcataccaattcatgccagggagttgaaagggttgccggaaaacgccttcgccaagagaccccagcattgactgttggtgcaatgaaggagtctgcggaagctggctgagcagagtggcgatggaattgttcccatcagttgttctaccaatgtttccatctgtgttttcggcttggaacctctttgtcgtggaaggaccggcagtatcatcgtcgttccagtatagagaagggagcgttcgcttcagagggaggatgcttgatgttgtggctgcaaccaaggagaggtgatccggctttgagcttgagcaggccagctgagaaatagtgccggaactgttgataccatcgctgtttatcatcccttcaaacaggctctgctcattttctagcaatgcactgtagtttgggacctttgggaaactgcagtttcaggctttgttgccccatcgagatcgaggtcggcaccggccc

SEQ ID NO: 11928 - DNA, 459 bp, Vitis vinifera
  Predicted polypeptide sequence is orthologous to G522, G1453
ttttttttttttttttttttttttttttttagtctggttttaaccctttatcaaataccttatttttctggttccaaaaacaatggttttaacaattagaaattctttcatagtttttttccaatcaaaaccgaaaagagtcccaagttttacactcttgccaagattaaatttcttattgcaattaaagcaataaatccatttgttacatttgtctcgtataattcttattgaatcatccatgtttattgcttctagttgagacactgttatttgctccatagaggttggttaacctaacaacaacagtaagattgtatggtcaagaggcctgtatatcaactcagaatgctcttcttagggatacccatgaaaacaacacaaatgttgttaaatatgatacttaacctgtaaaattttgtgttgcttggttgaattttcgcctcagtttaccacaaa

SEQ ID NO: 11929 - DNA, 672 bp, Vitis vinifera
  Predicted polypeptide sequence is orthologous to G525
gctggaaggcaaattctcatattacaacctccccaaagccgcaaaggatgaatgggtcgtctgtagggtattccacaagagcgcggggatcaaacgaagtcttattcctgcgccgataaggatgaactcttttggggatgatctcttggactgttcttctctaccacctcttattgaccctccttattccaaccccaacaaaaatgattcctgctttacaaatggtgaagatgaattcaagggatcatcaaccagattttcagatggaaaccaccactacccttacttctcccccaccataaacggtcatcaactgcaaaagcaacaagatcagaagagctttcttctatcccccaataacgtgcacaccacctccaactaccaagccaccctaagcaaccctacaccaaactccattttctacccccaagtttctccctcgaatcctcttttccccttccaagcatccccaactcctagttattcacactggcagatgggtagttcatttccaagctttccgggctctggcttcaaaggtagtgatccgaccagtaccgtaagagcccagacatctggcgtacagaggcaatgcaaggtggagcagttctcatccaaccagtctatggtcagcctctcgcaggacaccggactcagcactgacatgaacac

SEQ ID NO: 11930 - DNA, 763 bp, Vitis vinifera
  misc_feature (762)..(762): n is a, c, g, or t
  Predicted polypeptide sequence is orthologous to G525
ttccatgtacaatctccctaaaacaaccaagaatgagtgggtgatctgcagggtcttccagaagagctcaggtgggaagaaaacacatatttcagggctggtgagaatggacccttacggcgatgaattacgctcttcttcacagctgcctccattgacagactcttctccgttcagcagcgaaacgagaacagtcggtgactcgtctcacgtgacctgcttctccaaccaaatggaggacagaaagccccaggaggacatgattgacagcttcaacaaccctctcttagctgcctcttcttcctcctcaaacccctctgatatctccccggcttcactgcttttctccaaattccccttcccaaactcattccacactccccaaaatccactaaaccttggaaactgtcaattcccagactcctttctcatccctgaccagtccatactgaggattctccttgaaaaccagggatccgacatgaaaccatcctcgaaaacagagttctcacaggaaacagggctgagtactgatatcaacactgatatctcttcagttgtatcaacccatgaaatggttcaaaggtctttcgaagatcaaaatgatccatccacttcagctgggcctgtagacattgattgcctctggaattactgaagctgaatgataagaattatggaatcaagaagaagaagaagaagaagaagaagcagaagaagcagaacagcatggtctatagaattatagaagccaaaaaagana

SEQ ID NO: 11931 - DNA, 796 bp, Vitis vinifera
  misc_feature (756)..(756): n is a, c, g, or t
  Predicted polypeptide sequence is orthologous to G536
ctttccttttctctctcctccttcgcatttctccctagatcgaagcttcatccatggcggctacttcagctcgcgaagagaatgtttacatggcgaagctggccgagcaagccgagcgctacgaggagatggttcaattcatggaaaaagtgaccgccgaagccgaggagctgaccgtggaggagcgcaatctcctctctgttgcctacaagaacgtgatcggcgcgcgccgagcctcttggcgcatcatctcctccattgagcagaaggaggagagccgtggcaacgaggaccacgtcgctaccatccgtggctacagatccaagatcgagtccgagctgtcctccatctgcgacggtattcttcgcctgctggattcgcggcttatcccttcggctacgtccggtgactcgaaggtgttttacttgaagatgaagggcgattatcatcgctatctggctgagttcaagaccggagccgagaggaaagaggcggcggagagcactctcgcagcttataaatcggcgcaggatattgcaacagtggaattggctccaacccatcctattcgcctgggacttgcacttaacttctctgtcttttactatgagattctgaattccccggatcgtgcttgtaatcttgctaaacaggcttttgatgaagccattgctgagttggataccctgggagaggagtcttacaaggacagcactttgataatgcagcttcttcgtgataacctgactttgtgancttcagatatgcaggatgatggtggtgatgagatcaaaga

SEQ ID NO: 11932 - DNA, 880 bp, Vitis vinifera
  Predicted polypeptide sequence is orthologous to G536
gaggggagcagaaaagctaatctctgagagatcggtgatggcatcctccaaagaccgcgacaccttcgtctacgtcgccaagctcgccgagcaagccgagcgctatgacgaaatggtggattccatgaagaaagtggcgaagctggacgtggaattgaccgtggaggagcggaacctgctctcggttggctttaagaacgtgatcggcgctcggagggcttcctggaggattctttcatcgatcgagcagaaggaggaagctaaagggaacgatcagaatgcgaagcggatcaaggagtacaggcaaaaggtagaatcggagctttccggaatttgcagtgaaattatgactgttattgatgagcatctcattccatcttcttcggccggtgaatctaccgttttttactacaaaatgaaaggcgactattatcggtatttggcggagtttaagtctgggaacgagaagaaagaggctgctgatcagtcactgaaagcttatcagacagcttctacgacagcagaggctgatttatctcccacacatcccattcgactgggtttggccttgaacttctctgttttttactatgaaattatgaactcccctgaaagggcctgccacctcgcaaagcaagcttttgatgaagctatctcagagttggatactctgaatgaggagtcttacaaggatagcacattgattatgcaacttctgagggataacctcaccttgtggactactgacatcccaggggatgatgaagagagctggaagctggaaacctctgctagggctggtgggaatgaaaacgcagagtgaagcagacgataacctgggatatattgcatgtaatggggagagtatttgatgcctgaa

SEQ ID NO: 11933 - DNA, 899 bp, Vitis vinifera
  Predicted polypeptide sequence is orthologous to G536
tttttttttttttttttttttttttttgcttaagagtctcatttgaacccttttgcattttaagtttgaaaaaaagggggcagaaaaagagaaaaaagaaatataaaaaagggggaaaagaaaaagaaatgaaatgaaagcaacctaaaagcaaccacgccaatccttctaaattccgtccgagagtggcggagaggagaaaagctagggggatgcaaatgaaaaactctgataattgtcccgacatctacagaatattaagaacaataccagacaacaataagggacaacaaaggagagaattttgaaatcctctgtaatccggaaaacaccagagagcctaggaatcatcctttatccctgttcacacaataaagggctgtgaggctctcctctcttcagcttcactcatcgtctccaccagctttggcagagctttccatcttctggtcttctccatcctcagggatgtcagaagcccacaaagtaagggtatcccttaaaagctgcataattaaagtgctgtctttgtaagattcctcgctaagggtgtccaactctgaaatagcttcatcaaaagcttggattgcaagggggcaagccctttcaggtgaattcataatctcataatggaagacagaaaaatttaaagccaaacccaatcggatgggatgagtgggggataaatcgctctctgcagtagtagaagccgtctggtatgccttaagagactgatcagccgcctctttcctctcattgccggtcttgaactccgccaggtaccgataatgatcccctttcattttatagtaaaaaacagtggattcaccagccgtagaagccggaatcagatgctcatcaatcacagtcataatatcgctacaaatacccgacagctc

SEQ ID NO: 11934 - DNA, 837 bp, Vitis vinifera
  Predicted polypeptide sequence is orthologous to G536
tctatccctctcaaaaccaaaccacaccaaaaccaacagatctagaaatcgcaggctctctcttcccccaacagaaaaaaaaatcatcagaatcaatggcggcagctccatccgcacgcgaagagaacgtttacatggcgaaactagccgagcaagccgagcgctacgaagagatggtggagttcatggagaaggtctcggccgccgtggattccgaggaactcactgtcgaggaacggaacctcctctccgtcgcctacaagaacgtgatcggtgctcgtcgagcctcctggcgcattatttcatccatcgagcagaaggaggagagccgcggcaacgaggaccacgttgccatgatccgcgactacagatctaagatcgagtccgagctctcctcgatctgcgatggtattctcaagcttcttgattcccggctgattccctcggcttcctccggagactccaaggtcttttatctgaagatgaagggcgattatcatcgctatctggccgagtttaaaactggagccgagcgcaaggaggcggctgagagtaccctcactgcctataaatctgctcaggatattgcaaacgcagaactggctccaactcatccaatccggctcggactggctctcaacttctctgtgttttactacgagattctgaattctcccgatcgagcttgtaaccttgcgaaacaggcatttgatgaagccattgctgaattggataccttgggtgaggagtcatacaaggatagcactttgataatgcaacttcttcgtgatcgactcactctgtggacctcagatatgcaggatgatggggcagatg

SEQ ID NO: 11935 - DNA, 902 bp, Vitis vinifera
  Predicted polypeptide sequence is orthologous to G536
ggtggtctgcaactcggactttactgtgatggcgtccacactgccggagaatctcaccagagagcagtacgtgtacctggccaaactcgccgagcaggccgagcgatatgaggagatggtcaaattcatggaaaagcttgtaatcgggtggacctccatgtcggagctcaccgtcgaggagaggaacctcctctccgtggcctacaagaacgtgatcggctcgctccgagccgcgtggaggattgtgtcgtcgatagagcagaaggaggagagtcgcaagaacgaggagcatgtggctcttgtcaaagactacagatccacggtggagacggagctctccgaggtctgtgctggtattttgaagctcttggactcgcatctgataccttcggcttccacaagcgagtccaaggtgttttacatgaagatgaagggggactaccacaggtatttagctgagttcaaggttgggaatgagaagaaggatgccgccgaggagactatgttagcatacaagtctgctcaggatattgctctagctgatctggccccgactcatccgataaggttgggcttggcgctcaatttctctgtgttttactatgagattctcaattcatcggataaggcttgtagcatggccaaacaggcatttgaggaagccattgctgagttggacactctgggagaagaatcatacaaggacagcactcttatcatgcaactgctgagggacaatcttactctttggacttcagatgctcaggaccagttggatgagccataggggatgtttaaattggccagtcatattcctctccaggaggaggtgggctttgaatgtcattttgttgtgctggtgaaactatgtttctagaaacatcaacctgggtcatgatgtt

SEQ ID NO: 11936 - DNA, 962 bp, Vitis vinifera
  Predicted polypeptide sequence is orthologous to G536
gggttgcatcctattcactccccgtgctttcctttcccactcacatttgaattaggtcttaatttgtcataacaaagatgttgttgaccgaatcatctcgggaggaaaatgtttacatggccaagttggctgaacaggctgaacgatatgaggaaatggtagagttcatggaaaaagttgcaaagacagttgaagtcgaggagctgacagtggaggaaaggaacctcctctctgttgcttacaaaaatgtgattggggctaggagggcttcatggagaattatctcgtccattgagcagaaggaagagagcaggggaaatgaagatcatgtagcgattattaaggattatagggcaacaattgaagcagagctcagcaagatttgtgatgggattctaagccttctagaatcacatcttattccctcagccgtaattgccgagtctaaggtgttttacctcaagatgaaaggtgattaccacaggtacctagctgaatttaagactggacctggtaggaaagaggctgcagagagcactttgttggcttacaaatctgctcaggacattgctcttgctgaactagctcctactcacccaataaggctggggcttgctcttaacttctctgtcttctattatgaaatccttaactcaccagaccgtgcttgcaatcttgcaaagcaggcttttgatgaggctatctctgagctggatacgttaggtgaagagtcatacaaggacagtacattgatcatgcaacttctccgagacaacttgactctgtggacttctgatatcacggatgatgctggagatgacatcaaggaagcatcaaagcgtgaatcgatcgaagggcagccgtgatgaattcatcatagaagatgtgctctgtactattcagtctgtgaccctaatatagatgccatttgggttgttgtataagtatttgcttaatgaagt

SEQ ID NO: 11937 - DNA, 860 bp, Vitis vinifera
  Predicted polypeptide sequence is orthologous to G536
gagagagagagacggcgatggaggaaagagagcaacaggtttacttggctaggcttgctgagcaagctgagagatatgatgagatggttgaagcaatgaagaaagttgctaaattggatgtggaattgacagtggaggagaggaatctggtatctgttggatataaaaatgttattggggcaagaagggcatcatggaggatattgtcttccattgaacagaaggaggagaccaggggaaatgagcaaaatgcaaaaaggataaaggattacagacaaagggttgaagatgagttgtcaaagatctgcaatgacatattgtccgtcattgataatcatctcatcccatcatcctcaacaggggaatcaactgttttctactataagatgaaaggagattactaccgatatttagctgaattcaaagcagggaatgaccgtaaagaagctgctgatcagtcacttaaggcctatgaggctgccaccagtacagctgcctcagatctgccgcctactcatccaatcagacttgggctggctttgaacttttctgtcttctactatgaaattttgaactccccagggagggcttgccaccttgcaaaacaagcttttgatgaggctattgcagaacttgatagcctgaatgaagaatcatacaaggatagtacccttattatgcagcttcttcgggataatctcacattatggacctcagatctgccagaggagggaggtgagacatctaaagctgatgaacctcaagcagagagttaggtatgggacaaaagaggtgattctttggatgggtgagctcgtagaaggattgagaaatggagcttgatagacttttcatcttat

SEQ ID NO: 11938 - DNA, 727 bp, Vitis vinifera
  Predicted polypeptide sequence is orthologous to G557
tcttttctccccttgtttggttgccgagaaaatgcaggaacaagctacgagttctcttgtggccagctctttaccttctagtagcgagagatcttctagttctgctcttcaagccgaagtaaaggaaggaatggagagtgacgaggagatcagaagagtgccagagatcggcagtggggacccggcgggcccatcagcctccggacgagaggcagctttagtggccggtcccgaccgggttcaggcctcaggcgatggtcagagaaaaagaggaagaagcccggctgacaaagagaacaagcggttaaagaggttgttgaggaacagagtgtcagcacagcaagcaagggaaaggaagaaagcatacttgaatgagctagaggtgagggtcaaagacttggagaggaagaactctgagcttgaagagaggctctccaccttgcaaaatgagaatcagatgctcagacatatattgaagaacaccacagcaagcaggagaggaggaagtagtaataattcaaacgcagatgggtctttgtgagagaaagagagagagagagagagagagagagagagagagagagagagagagagagaagggtgggagattgtgcattttctagtttataaatttaaacatgaaatggcaccaaaagtagaaccttgagaaacgcttaaatcttgaataattattttccaaaaaaaaaaaaaaaaaaaaaaaaaaaaa

SEQ ID NO: 11939 - DNA, 841 bp, Vitis vinifera
  Predicted polypeptide sequence is orthologous to G558, G578, G629, G1198, G1806
tgagcatccattgggtttcatttagaggatgctgtggacctgagtggaagcactgcattcaattcgacaaaaccaagtggtcgagcagttacttctgatcccctccatactgtcacttttgataagtcacaaaattcatttgatataaatccaactgctgcccgggtggagtctcagaggttgccattgcaaaagggtcaacaatcaaatctggtttctatatctagtggtagtgtagagaactggggagagtctgcaatggcagatgccagtcctaggactgatatctcgacagacgtggatacagatgataaagttcagaggtttgaaaggggtcaacctgcttccaatatggcttctgattccagcgacggatcaaaggataaaatgatcagaagactcttcgtaggcttgctcaaaatcgtgaagctgcacgaaaaaaccgattgagaaagaaagcatatgtccaacagctagaaagtagccggatgaagctgacccaactagagcaggagctccagcgagcgcgacagcagggtatttttatttcaagctcaggagatcaagcccattcaatgagtggaaatggggccatggcatttgatgtagaatatgctaggtggctggaagagcagaaccgacaaatcaacgaactgagatcagcagtcaattctcatgcaagcgatgctgaacttcgtgttattgttgataatatcatggcacactatgatgacatattcaggctgaagggcgttgcagccaaggctgatgttttccatttattatcaggcatgtggaaaacacctgcagatcgatgttttttgtggcttggtggtttccg

SEQ ID NO: 11940 - DNA, 819 bp, Vitis vinifera
  Predicted polypeptide sequence is orthologous to G558, G578, G629, G1198, G1806
aacttcggatattgtggacaatgttacagcacattttgacgacattttcaggttgaaaggcattgcagccaaggctgatgtcttccacatcccgtcaggaatgtggaagacacctgcagaacggtgttttatgtggattggcggtttccgttcatctgaagtcctcaagcttcttgtaaaccaattggagcctctaacggagcaacagttgatgagcatctacaacttgcagcagtcatcccaacaggcggaggatgctctctcccaagggatggaggccttgcaacaatctctggctgagacgttaaccagtggctcacctggcccatctggatcatcagggaatgtggcaaactatatgggccagatggccatggcaatgggtaagctagggactcttgagggatttcttcgtcaggctgataatctgcgccagcagacgctacagcagatgcaccgtatattgacaacccggcagtctgcacgtgctcttcttgcaataaatgactacttctcccgacttcgagccctcagctctctgtggcttgcgcggccacgggaatgatgttgtatgagtatcaggatcgtctttagaaatatggtctcctgctagggaatcaaaaggctcacttccaacttcggagtacttttgggacctatacatggtgcagggaggctgtagtggtggtttcagctccatctacacatgtaacatgagatatgttcactgggtagttgtatgcttgtttcatatgttcagttaggtgatgtatttttatttcttatgtctcagacaacagtgccaataatgtgatcatg

SEQ ID NO: 11941 - DNA, 672 bp, Vitis vinifera
  Predicted polypeptide sequence is orthologous to G559
tttttttttttttttttttttaacgagccatataactatatatcatatataatatataacccacagttcaatattcaactaaaattaaatataaatgaaattaaatacctaagaaagaaggtcatatagatgtctagaagggataaacaaaaaaccaaagatgtcctatctgacaacagactgaaacaaggattttgaacccatactgaccctttaatacctagctgctgactggcacgttcctcatctttcgtttgaagcggggctatgatgacacatgcactttcctttgttctcagagaaagatcaaaaaaggacaaacaaaaaaccaaaggtgtccaatctccggagagattgaaacaaaattttgaacaaacactgacccttgagtgcccagccagctggtgcattcctcttctcatcattctttcacagcagaagagttggtgtctgatgcattttccttctggctcggagaagccatagatcctcggattttcagatctccagcttgttgaggctgttcctgctgcatttgttgctgctgaatctgctgttgaatctgctgctgctgctgctgcagctggtgcagttgatgctgctgaagctgatgctgcttatgagatgaatctggagctgctgaactgctgtgcagttaaagagtggcatggc

SEQ ID NO: 11942 - DNA, 902 bp, Vitis vinifera
  Predicted polypeptide sequence is orthologous to G561, G562
ggcatctatacaggcatactatggatctggagtccctcttctggcaccacatttcaactctgcagtcccgggcagtcattttccttatccatatgtatgggctccatctcagccactgattccaccttatggggtgccctacacagcaatctactcacatggaggtgttcatgcacatcctgcagttcctcttgttgcaactccattaagcaaaaaagttccttctagatcatcagtggatatggatcaaggtgttagaaagaagtttaaaagattggatgggctggcagtacctgtaggcaatgttagcactgaggacaatgccggaggctcagtctatgaggtgtcacagagtgtgaaacatggtattgatggttctactgatggaagtgatggaaacactggagcattcctaccccagaggaatagcggttctgagggcatcctttctactgacaatgatgggaacttccataggtttgctggttccttatctgaaggagaagcatatgcagcttcccacaaggtttctgtgaactctgtggcccctacaaatgttgcaggaaaatctgtcagaccccttcatagaaatgaagaaattcatgcagcttgtgttgcttctagcactagtgcagggtctccttttgaagtctgtcaacaggatgaacggcagctgaagcgagagaggaggaaacaggctaatagagaatctgctaagaagtccaggttgaggaagcaggctgaaaatgaggaactgagaatgagatacgaaaccctgaatgaggagaataaggcactgaagtttgaaataagcaagctaacagagcatttggacaaagtgaggctagaaaatactgcattacgggagaagctgaaaaataaacagcagcttgaactgcaag

SEQ ID NO: 11943 - DNA, 744 bp, Vitis vinifera
  Predicted polypeptide sequence is orthologous to G561, G562
cacatgggcatggggttcaatcatcacctgttgtaagcgaagcattggtacttaaattttcccttaactcttgaaatattctcttgccctgtactgcaaatatggacagaataatgtgactaagaatgcatcagtgatggacaaagcaaagttgtgtcttttagctgtgcaggtagtcacagatacatctaattaggtgctatgatgcaggctgcacctcctttgagcatagaaacacctgcaaagtcatcaggaaatacagaccgtggtttaatgaagaagttgaaagggtttgatgggcttgcaatgtccatagggaatggcagtggtgagagcaccgagggtgggtctgatcatggattatctcagagtggagaaactgaaggttccagtgatggaagtgatgggaatacagcaggggcagatcaaactagaaggaaaagaagccgggagggaacaccacctataggtggagatgggaaaactgagacacaggccacttcagctccttctgcagaggtaaatgcaggttctgataaggtgttgggtgttgctgtccctcccactagtgtcacaggaaaattggcaggagctgtactttctcctagaatgagcacagcattggagctcagaaatcctcctagtgtgaatgcaaaaactagtccgagtagcatccctcaacctggtgctatggtgatttctgacacatggatactgaatgaaagggagataaaacgtgagagg

SEQ ID NO: 11944 - DNA, 333 bp, Vitis vinifera
  Predicted polypeptide sequence is orthologous to G583
acatgttttttttttttttttttttttttttttactctgcaactacctgtgaatgacctgaaaacatattcccattcgcactacaagaactcctcttactgtctccaaaattcaaaatttccccagactcgggcttcagggaatgcaagttaccatttctcccattatttccatcaaatccaaattctgagaaattcaactccctagtgaaaaaaccctgcgtgtgaatctgctgttgctgctgaggattatgcataatactagggttttcagttaaactacttgagctagggttctcaaattgaattgacttggaattctgctgattacccc

SEQ ID NO: 11945 - DNA, 722 bp, Vitis vinifera
  Predicted polypeptide sequence is orthologous to G584, G1136
ttttttttttttttttttttttttttttttcggtgacccaacttccaactgaacaagattgaatttgtctgactttattaccttcatcagagttgaactcaatcaacaaagaatcctagagaggatacaagagattatagtagatttcaatattgcaaacagaaaagcgggctagtacactaataaaaaccctgaaacttcatcagggaaacacctatatacattgacaacaaaagatgaacaccaaaaaaggggctagggctgttcttaatcaacagatgccggtgccggatccttcatcctaaaagacaaactcgcctcaactgcaattatatactaaagactactaaagaccagctaagagtggtgtattttacagagctcgccttctgggagccttaaaatgtcccagagccctaaacctttttgacactgaaaccccaggccgggtcgggtaataagctatacgcaacgcctacctgctgtctgcaaatttggatgacagggctagcctcagctgatcttgagtgtaaaacctacttcccatcttcacggttgcctgttggatcatcaaatcattcaccaccgacacactcgcgtggttcacatctaggtccagctccttgagagcccccataagctttgcagcaggatggttctttttactacactgaattcgaatcatggcatcccacccgattatcttcacatcaatatccccc

SEQ ID NO: 11946 - DNA, 701 bp, Vitis vinifera
  Predicted polypeptide sequence is orthologous to G585
tacatcagtacaaactaaccgaaaatgaagactaagaaggcttattgaaatgggattcagacatgagaggacagtagataaatttacacaacatattcaagaagctaaagttaacaacatacccagagaaattctacaatggaagtggataataggactccatcttgtgatcagcatttgcttgttatcctccatagtgcctgtttgatcatccctgctgatgccactgctcgtcctcgaaacttggatttaagtgttaaagtgagaaaaccgtcatggtttgatgattgaactgagtgacaatccaagtggaggttgtttatggcatccatgatatcaagcaataagtattctctccaagggcatctcatctcaatgagtacctcctgctcatttatgcggactttcatgtctgatgatggcaggctgtctttaggaatgatttcattgatttccaggtcagtttcatcaatgtcacaagccttcctcttgtttatccacagcttctttccatcatcaatcattttgtcatcataattgtctgatgtctgttctaccatatccaggtatttctgtctagctcttgcttccagctctgtctgcaagtccatactagtttccaactcttctactcttgcctcaagctttttcaggtactctattgtgtcaccgagaattgatacttcatcgatcttgttgat

SEQ ID NO: 11947 - DNA, 774 bp, Vitis vinifera
  Predicted polypeptide sequence is orthologous to G591, G793
tcttccttctcacggaagctgagaggccgagagctgagacttcactccaatcaaggccatctcttccatctccgaaaccctaacccaccttccgtacggttccgactcgtccgagtttgagtgatggcgagcaatccctcggaagctccagcggacgattttctcgagcaaatcctcggaattcccacctaccccgcagctgaccctaatttggctgctaatgacgtgaatttggccgctcctatggtgcttcagctcggctccggcgaaggctctggccacatcgccggcgggtaccagggaaccatgtttccgttagggttgaggttggagcagggaaagagcagctttctgaagcccgaagacgcgtctggcagtggcaagcgctttcgtgaggaggttattgatggtagagcttctaccgtgaaaaatgctttccatggtcaaccaatgcaggctaccgttgctgcagcaccacatcctcctgcaattcgcccaagggtgcgggcgagacgtggacaggccacagatccacacagcattgctgagcggttacgcagagaaagaatagcagagagaattagagcactgcaggaactagttcctagtgtcaacaagacggatagagctgcaatgcttgatgaaattgtggattatgtgaaattcctaaggctccaagtaaggtcttgagcatgagtagattgggcggagctggtgcagttgcaccacttgtaacagacattccattagcatcagtcgaggaagaagcaagtg

SEQ ID NO: 11948 - DNA, 654 bp, Vitis vinifera
  Predicted polypeptide sequence is orthologous to G591, G793
gatttcatcttgcattaaaatttcttcaaatacatcatacacatacccatccaacccttttaaattgccccacaacccactatcccaaaaagagagaaagtgtgcacccatcaatgttctggtcatccaccactaaccccaccactgatattaggagaacacatcaatttagcttttgacaaactaatcccttagaattgaccatggcaaaaacccaaaaaaaaaaaaaaaaaaatcaagtgcctgtagttttctttcctgggcatcatcataatcactcctcctttgacaaaactggaaaaaagaatagaacagtgtcaccatcgcatcttccatgattgttcttccaataaggagttagaaactagatttggagtaagatattcccaggatgggggaccaagagaagcaccataatagggttgtatgtcgatgagcatatgcatatgtgatcacatactctttgttctgatctatgagggagcatcggattcaggcttgactagtgttgatggttcaggttggtgtgtccggaagattgccgaggccagtgagataggcatgatgcaaagtgccttggactgaaggaactgcatggcagctcccacatctacttccatcagcttagctacttgttgttctgttccatctgtt

SEQ ID NO: 11949 - DNA, 844 bp, Vitis vinifera
  misc_feature (772)..(772): n is a, c, g, or t
  Predicted polypeptide sequence is orthologous to G592
ggggcggtttcttcatgggggatggatcagtcgcagcagatgaagattggtggaggcaacaattcgaatcttattcgacatagtagctcacctgcaggactgttctcccacctaaatgttgaaaatggctatgctataatgagaggcatgggaaatttcgggtctggaagtgggactaatggagaaccatctttttcttctgcaagcagattgaagggtcaaataaacttctcgtcagggccaccttcttcctcaggcctaatgactcccatctctgaaatggggaacaaaagcatgggaacaggtagtccagacaatggaagttttggtgaaggtcatagtaacagtggaggtttcatcacaggcttcccaataggctcttgggatgattctgcaatcatgtctgaaagttttagtagcttgaaaagtgttagagatgatgaggcaaatactttttctggtttgaatgcatctgaagctcagaagggcgagcctgcaaaccgccctcctgttttggctcatcacttgagtttgccaacaaagacttctgcagatttgacgaccattgaaaagtatttgcagttccaagattctgtaccttgtaagattcgagccaaacggggatgtgccactcatccacgaagcatcgctgagagggtgagaagaacccgaatcagcgaaaggatgaggaaactacaagagcttgtccctaacatggacaagcaaacaaacacatcagacatgttagatttggctgttgactatattaaanaccttcagaaacaggtcaagaccctctcagataatcgggcaaagtgtacgtgttcaaacaagcagaagccat

SEQ ID NO: 11950 - DNA, 627 bp, Vitis vinifera
  misc_feature (530)..(530): n is a, c, g, or t
  misc_feature (555)..(555): n is a, c, g, or t
  Predicted polypeptide sequence is orthologous to G597
ggacatatgagggccggtttgagatattatctttgtctgggtcattcacggtctctgattctggtggtgcaagaagcaggacaggtggattaagtgtctcattggctggtcctgatggtcgcgtgataggtggtggaattgctggcatattgactgctgctggtccaatccagattgttgtcggcagcttcatgcccaatggttacaagacacacaaaaggaagcaccatcgtgaacctacgactacctccattatcccacctgccccagatacagttacagctgcaagaccaatctcacaagcagcacctgaagttggcccctgtctgaactcaacatccccatcacatggacaaagccatggagaagcagatgacagtgtgaacaataaacagatttcaaatgtaatatctttgcagagcgctgcttggaatgggtctgagcacaaatctgaacagagaccctctcctgacatcaatttgacggtgcccagtgaataggtaatttgcattttccgttttttatttcanatctaatgcttgtaacttgaaaggntattttggtttttaggtcaactttagagaccgagtctgatggcacaattgaatgaggctaatttaacttgca

SEQ ID NO: 11951 - DNA, 710 bp, Vitis vinifera
  Predicted polypeptide sequence is orthologous to G597
ttttttttttttttttgcaagtaacagacaacaataaaacggaggttaggattaaaagtgaactacaacaccttccacgaggttaacaataagcaccaacaacaacaacaacaaaccgactgcaaaagccagaatacaaagaaaactacaatcaacatctccatctaaaacctactaaaagaaagcacaacctctcctctctaatttcttctacctgacacggccaagatcacctgtcacactacttggttggaactttacagccagcagtagggtcaagctggaaagtcacctgtggtccttattatgcacaactaacttacacaaggcttaaattacaaatgggtctctttttttaagggaatcaccaacacagcaatagagcccgggtcctacatagagattggttaggtagctgacctgcggagtgttcagtctacttccatgggatgctcgtcattcctggtggattactgttattgcaggctcccgtgctctggttaagggggctcccaggtccgccagatgactcactcagtgtcccacgagacggggggctacttgttcctgttaccccacccccaccaccaactggggcaatctttggtggggctgatgaaggttccacttggcttgctgactttgattccttgcggccatctgcaataaaactacccacaactacctgaacaggggatgcagctgttaaa

SEQ ID NO: 11952 - DNA, 689 bp, Vitis vinifera
  Predicted polypeptide sequence is orthologous to G597
ggaaaagcctctgagctgctcttcccatctgaaaccctaaaaatttattctcttctctcgtttggatcgctgtatttttcctcatttatcgggttgtatagaaatttagtaccactttccatatatgaaagatgtcaggatctgaaactggaatcatgactaccagagagcccttcagcatgggtctccagaaaaatgcggtaccgtcacagccggtgatacaaaacatgcgcttagccttcagtccagacggagcagctgtgtacaagcccgtttccgggacctccccgccgtaccagtcttccggcggtaccggtggagatggttccaccggcggcgccatcatacctcacgggcttaacatgaatatggggagcgagcccttgaagaggaagagagggaggccaaggaaatacggcccagatgggaccatggcactggcgttgtcacctgctccttctggtgtgaacgtatctcagtccggtggggcattttcttctccacctgcttcggccggatcagcctcaccttcttccttgaagaaagcaagaggccgaccacccggttccagcaagaaacagcaaatggaagctcttggatctgcgggagttggatttacacctcatgttatcacagtgaaagctggagaggatgtatcatcaaaaatatgtcattttctcagcatggtc

SEQ ID NO: 11953 - DNA, 810 bp, Vitis vinifera
  Predicted polypeptide sequence is orthologous to G598
ctttcgactacgagtagtcacagcgaggtgtctgtgcagagggtgaagaaggaggaggtggatgcaaagatttcagcatggcagactgcgaagatcgccaagattaataatcggtttaagagggaggacgccataatcaacggctgggagagtgaagaggttcagaaaaccacatcatggatgaagaaagtcgagaggaagctggaggagaaaagagcaagagccttagagaagatgcagaatgacgtggcaaaagcacacagaaaagcagaggaaaggagggcatcagctgaggctaagaggggaaccaaagtggctagggttcttgaactagccaacttgatgagagccgttggaagggctccagtcaagcggtccatcttttgagtcctaccatgctatatgatacttgatttctacaacatttataaatgcttcaatacaaggacacataataattgcccctaatatataagggtcccttcgtattttgaactataagggtaccctacatatatgtatatgggattggggcaatgggaactgcaggttgagtgttttgtttcttcaatggttcagttttcctcttgatgcatcatcatcgaccttgcttctcaagaccagtcacagacacactgtgattggtcacaggcggagccgggattcgcaaaccaagggcaaaagtgaaccaacttcgatgactgtgtgatgattttgaaaagggtttggtcttgtacagttgcttgtaattttgcaatggaattgtattattagcaaaaaaaaaaaaaaaaaaaaaaaaaaaaaacatgt

SEQ ID NO: 11954 - DNA, 702 bp, Vitis vinifera
  Predicted polypeptide sequence is orthologous to G600, G2768
agggaggaggtcgggcggatgagtcagaggggcggtggtggtgatgctctgattttctcttggaggggcgcggtgcctctacatctctggtggggcgctccggcgatgacctctccggtcgagggcggcggtggtggtggtcggcgctcgatgattggggagccaatttgggttttggtttcattgtagaaacgtcaccgcccatgctcccttctctagcatattctcgatctttagggaactctttgctttcacctcgtcgctcactttcacgacgccttctcagatcagctttcctagcctcaaattcctccctactcataataggaggtgcagcatttaaacccattccaaaatcagccagatccctctgaggtggaacaacaggcagcatataacccggtgccccaaaaggcccctgaggtagaacacccccaaaaggcatatctaatgtattgtaaccataccccatatatggcatggcaccagcataagggttcataaagccatccattcctggctgcatgccattccagtaaggagcatatgtgggatccataggcatcatatagttctcagctgcaagatcttgagtggacttccactgaatgtctgctgcatttacaggcacacgagctttcttctttttctttttctttcctgcctcaacagaagcaagcttctgctgcacttcttcctcag

SEQ ID NO: 11955 - DNA, 789 bp, Vitis vinifera
  Predicted polypeptide sequence is orthologous to G602
cttttttttttttttttaatatcaagcttttactcattaattaaatatgctttatactttacaaacacactaatgaacctttatggtccaaccagatcaacacacaaaacaaaaataaccaaaaaaaaaaggggtagacagattgaacaaaattgagttcttttagtactttcatatcatgcccaagaattttaacctccaaagcatccaaggaccttctttggtgtctgcccagttgcacggaatttcgcagccatctcctccgccttaagaaattcttccccgcgtctggcttcaatcattgccttcttttcttctgcttgcttgtgaatcaatgctactttgtttttcattttctctgcatattctgccttcttcttctccaattcttcctcgatcttcttcagtttagcttcaacagctgctttcttgctgttttcccatgcacaaacatcagaaagctttttctgggccttgttatctactttcgatttttcactttcttcccatgccctgataaaagacaactgcttttctttttccaaatttgcgagagcaacatctctctcaaaagatcctcctgaagtttttttggctgcagaatctggagtcttctcaactacagcgagagctttggattcgtcggccttcacttcaggtggtggaaccacagatttctctagagcgacgtcatttttaacgtctgccggagttgtcgccggcgtaaattcgggtcccgacgccagaagcgggttcgggtctgattctacgttcttctccattactcta

SEQ ID NO: 11956 - DNA, 417 bp, Vitis vinifera
  Predicted polypeptide sequence is orthologous to G611
tttttttttttttttttttttttttttttgccagcagattcttcatgatatctgtgagctttgacaccttctgtcatcacactatttgtagatatagttggtctgatacaatcaccaacctctgatgaagggaaaacttcattacttggtctcaattcgagcccaccctcaagagcagtattactagctctggaaggagtagcattaagtcctgacgtattttccatgttggttcttccatgactctgctctgctccactagcaagggaggcatttgaattggtcacccgctcattacaagtagcttgtttgctgaccccagacatttcatcagccatagcagcactggtctgcattttcccttgttgagtactagcacaaaaagtatcagccttacgtgtggcgtacggtctgcat

SEQ ID NO: 11957 - DNA, 688 bp, Vitis vinifera
  Predicted polypeptide sequence is orthologous to G616
gccgcaatcgccgttcaatgtggctggcgatcatcatccggagctgcagcatttttcttttgttcccgaccatcttatcccggtggcgacttcgcaacccggtggtagtgacaacaacctcaactttacaatctcttccggccttgctggtttcaatagggggacccttcagtccaattctccgtctctgttgcctcaccttcagaggttttctcctatagacggatcaaatctacctttcttcatgggcgctgctcctgtggagaatcatcaccaccatcatcaatttccacctggatttgatggctgcttgcaactctactatggcgacggaagcaggcattcagaccagaagggaaaaggaaagaactaagttgctggaagagcacattcctctcggttcaacatcgtttctggaaaaatgaagatggagaagtagagagggaagccgtgagtgaatgcatgccttcccctgaaattgttattatttatgctttatgcgttttgaaatggttgagctttccatcccacacattggggatatatttgctttgcttgtgcatgggaagcattgtgtgttttgatgagatgatttgatttgaagttattcatcaatttgccttttggaatttgtcgatacttattatttaagaatcaatctacttaatgaagcggaattgcattttga

SEQ ID NO: 11958 - DNA, 712 bp, Vitis vinifera
  Predicted polypeptide sequence is orthologous to G618, G2057
gcattgcaccacctctggactctgattccattgctgacactatgaaatctttctttcccactagttcagggacttcctcaatcaattatcagaactacccgcctgatagcaaccatcataacgaagatctttgtctatctcttcattctttccaagacccagatgcggagtccaaccacaagaacctttttgccagtgcagcacaagttgggtatgagactaatttccagagaatggtgagttggggaggaggtggtggagattcagagagtcgcggtggatttgggtttatgtttaactcacctccaatgccaatgccacagccacagccaccaacattgctgagccaaggctcagaattttcacagaggggaccccttcagtccagttttgctcctgctgttcgtgcttggaatgagcttcctattgcttctggggcaatgcatcaatcttcactctctgatggcaggtttgtgccaaatggagtcccaggttttcgaattccagcacgaattcagggtgaggaggagcatagcgtggtctcagataggccatcctcttcctcccccaactctcatcactgaatacactttttcatccaacaggattttctctaggctttcatggtgaccaatgaccaaattcaatgcgaccaagaagatgagcttcagtcaattcattggtctaccaaggaagaagatatctagttgaa

SEQ ID NO: 11959 - DNA, 636 bp, Vitis vinifera
  Predicted polypeptide sequence is orthologous to G618, G2057
gccgccgcgttcgcctctccgcccacactgccatccaattctacgacgtccaggaccgcctcggctacgaccgccccagcaaggccgtcgattggctcatcaagaaggccaaagccgccatcgacgagctcgctcaactcccagcttggcatcccactgccatcaccgtcaccgcggccgccgctgctgctaccaccgcaaccaccacccaccaccaggaagacgaagaaaatcccaaccaggtcgccattgatggcgacgatgatcgtgtgcaaatgcatcacggcaacaatccggaccccaaccccaatcctaaccctaaccaaaaccctagttttcttccgccatcgttagactctgataccattgcggacacaatcaagagcttttttcccatgggtgcttctggggaatcctcgtcttcgtccgtacagtttcagagctacccgcccgatttgctctcgagaaccagtagtcagaatcaagatcttcgcctttcgcttcagagcttccaagaccctatgcttcttcatcatcaccacacccagagccactctcatcatcaacaacaagcccttttttcgccgttaggcttcgacgccccctccgccgcttggtccgagcaccacgcagcgg

SEQ ID NO: 11960 - DNA, 606 bp, Vitis vinifera
  Predicted polypeptide sequence is orthologous to G618, G2057
agcaaaacccaaacacataacaatccaacaaagatttcaacaaagttgagctctgaaagcccgctcaaaacaggaaagcaaatctaagaacataaatcaactgatagaagctaagcaaaccggggatcgaaaaacctgaaatcccaactcagatttcttcttcccgcggattaggccattggatagaagtcaccgaaatccctcttcagattgctttgaatttgctcaaaagaccacacacaacagctagttctttggcctccctttgtggatgatggattagccctgttagagaagatttcggggttttagtgctacactcaatggcgagaatcggaggaagcagaggacggcttgtcggagatgccatcgtgctcctcctcaccctgaattcgtgctggaatccgaaatccggaaaacccgccagggacgaaaccaatgccggaaatcatggatggttgaatgggagttgtttgatggtggtggtggtggtggtcgatggtggcggcaattggcgggtctatccaagcgcgaatcgaaggcgtgttgctggactgaaggggtcccctctgagaatacatctggctttggcaaaacaatggctga

SEQ ID NO: 11961 - DNA, 752 bp, Vitis vinifera
  misc_feature (539)..(539): n is a, c, g, or t
  misc_feature (541)..(541): n is a, c, g, or t
  misc_feature (727)..(727): n is a, c, g, or t
  Predicted polypeptide sequence is orthologous to G620, G1821
agaccaaatttgagagtgaagagagatagggagatggagactggaggcttccatggctacagaaagctctccaagacgacctctggaatgaagctgacagaacccaatgagaagcagcctgagagcaatcagatgtccaacaattcagccatggaagacactgaatgcactgtgagggaacaagacaggttcatgccaatagcgaatgtgatcaggatcatgcgcaaaatcctacccccacatgccaaaatctcggatgatgccaaggaaacaatccaggagtgcgtgtctgagtacatcagcttcatcacaggtgaagccaatgagcggtgccagcgcgagcagcgcaagaccatcactgcagaggacgtgctgtgggcaatgagcaaacttggttttgatgactacatggagccactcaccatgtacctccaccgctaccgcgagcttgaaggcgaccgtgccaccatcaggagtgagccagtggtgaagaggaatgtggagtttgggggtctgagcgtggcggcatttgcggatcngnttcatatgggtcatcaccaggggttcttcggagcagcagccatgggtggatacttgaaggaagctcccaatgcaggcacatcccaggctgcagtggctagcttggaaccatatgcccagtacaaatgagctgatcacaaaatactagctagagagagtagtagtttctagtgaggtgaaggtaaanaaaaaaaaaaaaaaaaaaaaaaaaa

SEQ ID NO: 11962 - DNA, 896 bp, Vitis vinifera
  misc_feature (48)..(48): n is a, c, g, or t
  Predicted polypeptide sequence is orthologous to G622
atagatgtttttctccctctcaagtggacatgtgcagacaacattganggatttgagcaggtgttcatgttctgcaccagatgagtggaatccaaaggaatcagaaagtctttccagacttggaaaggattacaagaggcaaaaatccatggagagccataaactagcccaagaaggtgagcctactggcttagatgctctggccaatgctgcagttctagaagaaaatggaggtgactctggtgagccatcagctgaagccaccaccagacaccctcggcaccgccctggctgctcgtgtattgtatgtattcagcccccaagtggaaagggcaagcacaagtccacatgcatatgcaatgtgtgcatgactgtgaagcgccgattcagaaccctaatgctgcgcaaaaagaaacgccaatcagagcatgaagcagaatcttcacagattaagcaccagattcaccccatcaatgaatcagaaataagcggcatggtaagaaatgtgtcattgcagagaaaccattcagacggtgaaaacaaccagagcaaaatccaagaagaggtagttgctgaaactggtacaggacaaatagacttgaactgccgtcctgacaatgaagaagacctgcttccaggtgtaacaggagtgagcatgacaagccttgttcaagcagcaagccatccattggatttctacttgaagcagactgggctcacaagtttgatatctgaccaaccgatgagctcaaactcccgtcccctcccccaggttactggaggggaagatggacacctaactgatgaacggtccctttcacctctaatctgggagcatgggagtggagctggtgaaggctaccacaaacctgatttggactgaaaatcacccgtct

SEQ ID NO: 11963 - DNA, 675 bp, Vitis vinifera
  misc_feature (624)..(624): n is a, c, g, or t
  misc_feature (628)..(628): n is a, c, g, or t
  misc_feature (666)..(666): n is a, c, g, or t
  Predicted polypeptide sequence is orthologous to G636
agagaggaagcttggaagctgcaagaattggatagaattaaaagagagcatgagattcttgttcaagaacggtccattgcagcagcaaaggatgcggctgtgctcgcattcttgcagaagatcgccgagcaagcgggtccggtgcaattgcctgaaaacccttcttcagaaaaagtatttgagaagcaagataataggaatggtgagaattctattcaaatgagctcctcccggtggccgaaagcagaagttgaagcactgattagacttagaactaatttcgagatgcagtatcaagaaagtggacctaaagggcccttatgggaggagatttcactagccatgagaaaaattggttatgagaggagtgccaagaggtgtaaagagaaatgggaaaacatcaataagtacttcaagagggtaagggacagcaacaagagaaggcctgaagattcaaagacatgtccatactttcatcagctcgatgccctctacaaggagaagactaagaaggtagagaatccagataacaattcaggctataacttgaagcctgaagacattttaatgcaaatgatgggacagtcagaacaacggccacagtcagaatcagtaacagaagangggnggaagcgagaatgtcaatacaaaaaaaaaaaaaaaaanaaaaaaaaa

SEQ ID NO: 11964 - DNA, 866 bp, Vitis vinifera
  Predicted polypeptide sequence is orthologous to G651
gttttttttttttttttttttttttttttttgatgaagcaaattgaaataaatttcaccattaatggatggcctaagaatcagttgttacagtaacagaggcttgagaaaattcaaagcaatgaattacagtcagaatagatgatggagattgatgaagaagaagaagaatgatagtctatgaacccaattgccaaaaaccaaactggaaacagtttcagatccatggatatgccaaagcagccaaaaatcattacctctcatgaatgattccatcttttttttttcttagccattcatcgtctgatggggttcacgaactctgcatcagacactgctgagtgctcgatttggctaatgtcgtcgtcttcaattggagcgggaaggttaagatctatcatgctgtcgcccaccttgcttgaagcttttcttggtggaggaggtggtgccggagctgctgcagcagctgctgagcctgagatgtgggatctcttgtgcccaccaagtgcttgtccggaggtgaatttccggaagcagactgggcattcgtgaattttcgcatcagccaaacagggattgctagagttttcaggctcaaactccacttccttaattggagcacaggctttgatcttcttgtggctggctcggtgaccacccaatgcttgataagatctgaacactttgttgcatgtctcgcatttgtacttgcctcgagctctggtcttgaacaatttgagctcgtcggagtcatcggtctcgtcaacaaacctctcttcttcttctgcttctgcttctgcttcttcttcatcctcttcatcatgccgccgttcttggttttcctgctcctctatccatttgtctcta

SEQ ID NO: 11965 - DNA, 497 bp, Vitis vinifera
  Predicted polypeptide sequence is orthologous to G652, G1335
ttttttttttttttttttttttttttttttcgattaatatgatagccgtttcactaaatatcacaaggaacatgtaaagatgatcaatggatggaaaacaaagaacaaggaagagaaaaaactatatatcatgcaaacaattacccacattacaaacaaatttaccaaaaatatggaagaccgaaactcaacaaggagaaacagttgttgatgacaagcgctgctgatccgtttgtcttctctggtttcatccccgaaataatcaccacaaaccacataaaaattacattagagaggtaaacccacattgtcacttctgaccattagggcagtccctcgcaaaatgcccttcctctccacagttatagcatgcaccaccgccagcaccaaaagagtatccaccaccgccagcaccagcagagtatccaccaccgccagcaccagcagagtatccaccaccgccaccgtatcctcgtctcccccaccactgccctccc

SEQ ID NO: 11966 - DNA, 457 bp, Vitis vinifera
  Predicted polypeptide sequence is orthologous to G652, G1335
cccgcgtccggggccatctcgcaagggactgcagtcagagtagcggcggcggaggaggcggtggccgatacagtagcggaggcggaggcggtggaggcggcggtggcggtggctgctacaggtgcggagaagcaggccatttcgctcgcgagtgccctaacaatgcccgttaaagtgcgagcaaaaaggcgatgattggtggggggtaaacgtgtattttcacatgtttttttccttcctctcatcatacctgtcgttcttctttttcagttactgtcatggtttgtttcttagtgggtcatcttcgtatagcccacctttctcatttcaagttatgttttgcaactgtttgggcctatctttcatagggtttttcttggatcggatatggtgatttgctctctcttttcccctctctcccccctctttttcttgaattgacattggggttggttgt

SEQ ID NO: 11967 - DNA, 926 bp, Vitis vinifera
  Predicted polypeptide sequence is orthologous to G653
cggggctctctctatctctctctctctttctttctctatcatcatccactacttcgcagcatccgctccctgcaaaaagcgtccaatcctctttctcccgctctcttttacgtcagcttggattttgattctccaaactgcctctgaatctttaatttctggctgttgattaagaccttcatttctgaagacctcacggatcaacgatttctggcttgtttagttttctgagcagctgagggaaaggcaaatctaagcatatatttccgaagccaatctcgcatttccgaatcggataaaaagtcggatctaaggcacgcacaattatgtctttcattggcacacaacagaaatgcaaggcgtgcctgaagactgtttatccggttgagcagttgtctgctgatggagtggtttaccataaatcgtgcttcaagtgctctcactgcaatgggacacttaagctgagcaattattcctcaatggagggtgttctttactgtaagcctcactttgagcagctctttaaggagtctggaaatttcaacaagaattttcagtcacctgcgaagtcagctgagaagttaactccagagctgacaaggtcacccagcaaagctgccagcatgttttctgggacacaagagaaatgtgcaacttgtggtaaaacagcttatccacttgagaaggtaaccgtggagagccaggcttatcacaaatcatgtttcaagtgctcccatggtggctgcccaatatccccatcaaattatgcagcccttgagggcattttgtattgcaaacaccattttgcccagcttttcaaggagaaaggaagctacaaccatctaattaagtccgcatcaatgaagcgctcagcagcctctgttcctgatgcttgaactccataacaatattttatcctctattac

SEQ ID NO: 11968 - DNA, 1106 bp, Vitis vinifera
  Predicted polypeptide sequence is orthologous to G663
ctcgatgaagagcttaggagttagaaagggtgcatggacccaagaagaggatgttctcctgaggaaatgcattgagaaatatggagaaggaaagtggcatctggttcccctccgagcagggttgaatagatgcctaaagagctgcagattgagatggctcaattatttgaagccagatatcaagagaggagagtttgcattagacgaggttgatctcatgattaggcttcacaatttgttggggaacagatggtccttgattgcgggtaggcttccagggaggactgctaatgatgtcaagaactattggcatggtcaccacctgaaaaagaaggttcagttccaggaagaagggagaaaaaaaccccaaacacattctaaaaccaaagctataaagcctcaccctcacaagttctccaaagccttgccaaggtttgaactaaaaactacagctgtggatacttttgacacacaagtaagtacttccagtaagccatcatccacgtcaccacaaccgaatgatgacatcatatggtgggaaagcctgttagctgagcatgctcaaatggatcaagaaactgacttttcggcttctggagagatgcttatcgcaagcctctggacagaagaaactgcaacacagaaaaagggaacacattctaaaaccaaagctataaaacctcaccctcacaagttctccaaagccttgccaaggtttgaactaaaaactacagctgtggatacttttgacacacaagtaagtacttccagtaagctgatccacgtcaccacaaccgaatgatgacatcatatggtgggaaagcctgttagctgagcatgctcaaatggatcaagaaactgacttttcggcttctggagagatgcttatcgcaagcctcaggacagaagaaactgcagcacagaaaaagggacccatggatggtatgattgaacaaatccagggaggtgagggtgattttccatttgatgtgggcttctgggatacacccaacacacaagtaaatcatttgatctgatttagaccattgttatcttaatgtttaagttcaaaagttgttcttgcattcaaaaaaaaaaaaaaaaaa

SEQ ID NO: 11969 - DNA, 661 bp, Vitis vinifera
  Predicted polypeptide sequence is orthologous to G669
gcaacatctcttcggaagaagaagaactcattatcagactgcataagctccttggcaacaggcaacttctattattttcattattagtatttattatatcaatgttttcaacaatgggtacaattttgagctcctttttaagtcttctgcattcagggtcagaaaatttgtatccacttctcagcttcatttattactgactgttattatagtttgtcagaagttccttggtttaattatcattcagggatgtccatgcttttttctgtaattaaagtcatttatgttttatgttggtaaagaaatatatatatatatatatacatatatatatatataatatgaatgtttttgatattggggaaactttctctgggttggaactgtttggatattcaactttccctgccatcaaaagtcattattttttcaagttcaactgctaccctttaaagcctatcaagtcttaataagaaaaagtccagacacagtgattttactttcaactaacaaagtacaagttgaattcattactcaacttgtaacgccatggctggtgcaggtggtcattgatcgccggtaggttgccggggcgtacggacaatgaaatcaagaactactggaacacaaatttgagcaagagattgcaagcatccaaggg

SEQ ID NO: 11970 - DNA, 835 bp, Vitis vinifera
  Predicted polypeptide sequence is orthologous to G670
gcacagcaatttgatgtcgcccacacccaacaaggacttcttcctagatagattcatgatctctcaccaggaaaactccacaggctgccaaccatcagatgtggtggggtatttggcccctcagcaattgaattacccatccaatgctagactctcaattaacccaacccaacctctctggttctctcaatccagcaaaacattagacatgaattctgagttcagttccaatgctgtatcctccgttctttcatctgtcaccagctcacttctcccttcacctatgccctacaagccctccattccttttcactctgataatccttcaattccctctttcactctgagtggatcccgtttctgggatgcaggtgcctccaccaacagtagcaatagtagctctggcagcagtagcagcgccgagttgcagagtaacagctccttctttgagaacagcatcttcccatggggattggcagattgtagcacgtcagacaaaggagcccaaatccatatcatagaaagcgaaccggaggatatcaagtggcctgaatatctccaaaatccatttttaatggcagcagctttacaaaatcaaaccccacaacctttatacaatgagataaaatcagaaacgcacttcataaccgagacgtctagtgctatgtgggctcacagccagcagcagcaagaacatctgcaagctccggatatccagagactccccgcaacctttggacatatttagcttatatcttgacatatggatgtgaagcctctggtcacttttggggggagggggaggaatgtattgcagaattttcatatgggagag

SEQ ID NO: 11971 - DNA, 682 bp, Vitis vinifera
  misc_feature (580)..(580): n is a, c, g, or t
  misc_feature (599)..(599): n is a, c, g, or t
  misc_feature (617)..(617): n is a, c, g, or t
  misc_feature (658)..(658): n is a, c, g, or t
  Predicted polypeptide sequence is orthologous to G671
gctcaaatttctgtctctctcttcaattttaactaagcttgggaggtgcatattaaacttctgtgtttttgctttctctcactcttcttggatgaaaacatttgttatttttttcttcctttcattgttttaattcttttcaagatggggttatgttgattctgtccttgactgggaggcgtctaatctgttctgtttgtcttctttcatttcagttggtttaggcagcagcaggttatacttgggtcacggatacaaatttagcttctgaaatcaaaaggtttgctggcttgctgtctgacatctacattccccaagtttcatagtttagtaggccagaaaaaagttaacgatcttggaagttccatttctgcagtctagctttctttaagtttctgaaagcatgaaaagattgaagtttcttctttcctcctggaatggtatatatatctctttaccatttgtatgatgtactgttacctaatccatttcccttacccttatcatgccataatctcaaaactttacttgttctgtggaaccaatatgatagagactgttccatcgatactaacaaganataagaggatgatccttgngttggattgtgttgaatngtgtatattcacaggattaggatagctaatccaagtctgtntatagatttcgcctataaacctgc

SEQ ID NO: 11972 - DNA, 542 bp, Vitis vinifera
  Predicted polypeptide sequence is orthologous to G715, G1646
tttttttttttttttttttttttttttttggaaaaagctcttgtttatttcataataaaatagcttccgcaatgtctccaacaaaaaaaaaaaaaaaaaaggcactactaacacataggtatagatgcatgttattccacaaaacataagatgacgctttttccaaaccatcaagagctttcacatgcctccatcacattttcctcgcttgggagcatttttgttcaccatttcagaagaagcaatagggggcagctgaacagaacaagggatttcatgattccacattattaattcatggtttgctgcaggaaaatgtacttcgtcatttgccacaacaaatcctgctcctcctgaaatattttcactgtgctcttccttatgcacatcgggagcaatgtttgtcaagaaatgcagagttgggtaacatcgtatggctctccctatatcacatggctgcagagttcggcgtttgttggcttccgcatgaagccatgctcgaagtgtgagctctaggatgaacaattcacttgctttggcaa

SEQ ID NO: 11973 - DNA, 692 bp, Vitis vinifera
  Predicted polypeptide sequence is orthologous to G715, G1646
tttttttttttttttatgacaagtaatatgagaatatattcagataactagaatcattcagttaaaatgaaaaacatggaccttacatttagaactgcacataggattagttgagtcatcactgcactggtccaaatcacggtttttaacaagtttctaattgaagccattacattaaaaaccaaccagttttcacaaataataacagagcaagtgctcctatgattcatagccaaggaaaatccaagttctgtccacgagctcgatagtttccatcatgctgggaagcaccacaacatccacaatgggcgtttgcttaaccttggccatcaagattcccctgtccactgctccctccgctcccgtacgacccatcctctgccgtctgccacaccgactgccacgcctgcgacggcggctgcacgtacacccccggatccacccccggaaccgccggccttcccatcattacccccggcgcgggctgccccatcggtggataatagtacggcaccccactggccgtcgaccctaccatccccaaccccccctcgtccttgatctcatccctcggcacaatatccaccaaaaaatcaaatatatccgtcctagtaatcgccgcggcgatatcattcttctgcagcgtcctcctcttgttctcctccgcgtgcaccacgacctatcgtcagctc

SEQ ID NO: 11974 - DNA, 833 bp, Vitis vinifera
  misc_feature (18)..(18): n is a, c, g, or t
  misc_feature (50)..(50): n is a, c, g, or t
  misc_feature (790)..(790): n is a, c, g, or t
  Predicted polypeptide sequence is orthologous to G718
tctgatggctctggtgancaatgattggtttaaaactggggaagcgatcntactttgaagatgtttgtgctgctagcaccgctaaaactacaacttcttctgtcaatcctgcatcatctgtttctgcaacaaagcgatttagaacatcttatcagagttcgcaaacccctcgttgccaagttgaaggatgcaaccttgacctcaagtcagctaaggattaccatcgcaggcatagaatctgtgaaaaccattccaaaagccccaaggtcattgtagctggtttggagcgccggttttgtcaacagtgcagcaggttccatgagttgacagagtttgatgacaagaagcgaagttgtcgtaggcgcctcaatgaccacaatgcacggcgccgcaggccacatccagagtcaatccaatttagctctggaaggctgccttcatcactatatgatggcagacagcagattaatcttgcatgcaacaggttaccaatccctgttgcaactcctatgtggcaaaatccatgcagctttaaggacacccagactggaggttctttgattaggcctgtaaaagcagtaggcattgataagcagctgcatttgcccactgatgagatgccggatgctatttctatgctacatgttaactcagagaggatgttgtcttttgatggcagtacacctcgggtccttaaccaaggtttagaggcatctgcaattgcttctaattcaaatgtagcaccagatttccggcgtgctctctctcttctgtcaactaattcttgggntttgaatgatcctggacctacttctttggaccagctcatgcat

SEQ ID NO: 11975 - DNA, 690 bp, Vitis vinifera
  Predicted polypeptide sequence is orthologous to G718
agtacttgttagcgtcccttccccctttctatgtacccagtctacgaacctggcctaatctaataggccttccaggccctgaaaacaccgatgcagcatggtttcatagtgtaggatggctcttaccggaacttcttcactcaattatcaagattcaagctactttctgcttttgctcgcctcaaaaaaagctgcgccttttctctttctacgtccccgagaccaggactattctgatcgaagctataggcatcttacctctttctttaggcgagcttattcaccataaagtctgcatactcaatgactcatagcgagtcgctccgtcctcctgtgtagatgtagatatagaggcacctttttcattctgtctggtctgtctatcaccacaaacctagtgatctcacttccaagaagacgcagagctaagagtcaagatgcgggttcatctgacgagctggattttgaaagagtcgggcacttatgtttactaaacgaacaggctcggtagtaccttaactaagttcttcgaatggaggacaagggacggatgaaattcccaatggtatcgaactggcttctatgattgccttcacataacttgagtagacgacagctggaagtcccttttggttaatatagccgcttgattgcttatttactatgaaccagaatgactttctttcctat

SEQ ID NO: 11976 - DNA, 790 bp, Vitis vinifera
  Predicted polypeptide sequence is orthologous to G720
ttttttttttttttttttttttttttttttcctgaagttgattagatgtgggatttgggggaagcgaggaaaagcaacatctagattctcaaaatagacatgtaaaccaaaaaaaaaagtcccatcttcatatcatcagacgagacccctcatcttatctaaaacagccaccttccaccataacaccaccgcctccattttctctctattatttgcacaccaaccccacccccacccaccaattaaaaaacaagaaaagcctcaactagtctctatttacaaccacacatctcatttggggcgtccaattcacatgcgcggcccccttgtcaaccgtcccaccctccacctcagagatgcctttggggtcccacttttcgtctgcagccgatgcgggatatgtgtggcatggggctgattcagtagggacggggggtgttgatgtgaggggggatggtggaaatgccctggcgggagagctccgccagcacgctctcgggggccggcggtttcaggcccaatggcaggggcatccacggcttgcttattgcctccttcactaccctgtcaattacctcctctgccggataaaggtcaatagggctctggggtatgccagggttgtatattccacttccattattatgatcaaacccagatggattttgaggaaaggaagagcatggagtatgtgttggtgtcatcacagggcagccccatgcatcggcattcatccctggataaggcttccaaatccaactttctgcgggctgccatgtatgatagccag

SEQ ID NO: 11977 - DNA, 873 bp, Vitis vinifera
  Predicted polypeptide sequence is orthologous to G732
tttttttttttttttttttaagacaggaattcaactgatattattatatataaagcagagagaccaagtacatttatagttcttaagtccatattttatatggcaaccctatttttacagaccatgaactgattacccatatgcttattccttaccatcctttgatggagatttgccttttttttttttccttttttttttatatctctctctctcttgaaaacccagacgctcataaagatcagtactgaaagatatcagaagccatgatgggttgactcaaatatagcaaactcaaagggttcatgaggctgtcaggagtggtaggctcaggaagggtccagggctccccactttcaaagccaccattgcttgtattcaagaaacttatgatctcaaccagatactgcagtctgttgctgagctcagagaattgagctctgagtactgaattttcagcctcaatgttaaagtaatgctgggtggtgacattcatgcttgtgataatctggctgttctccttcctcagctgagcagcctgagccattaaatcatccaagtgcttctgcttcctcatccttgaccttcttgcagattctctattggatatcattcttttccgctttctctgatccatcaaagcctgcaaatcttcttcagaaccagagttctgaagcaaagttgaccctgaagatgtgccactggaggaagccatgaaaactcaaaaattatgcagtttgggattaattttaggttcaagcctcaagagagagatttagcaggacccagacactgattaactctagtacttaaaagataacagtatatatagctatatattaatacctaattatcagagccatttgagagcaa

SEQ ID NO: 11978 - DNA, 942 bp, Vitis vinifera
  misc_feature (866)..(866): n is a, c, g, or t
  Predicted polypeptide sequence is orthologous to G732
cggggcttctcttttcttctcttcctcccctatagatcttgggtgttctgccttaggacatctcctttatagatctgaggttctgccggttttctttcagggtgtccagcctctgttttccaaggtttgatcttggggttctggtttctagacccgaagctgggggaacctctgctgaaatcaactcttgctctgattttgatttccgggggggtttttgttcatgaatctgggtctttgatttctccatcaaaaccccatttttccatttgtttagatctggggtggtttctttctcccgatcttgatgctgaatgttttattcttaacgtttgagactcatgtctccagttgtcagtgaaatcctccgctccgggtttatgataaattcctcactcaaacgcaggacccacttagttcaatctttctctgttgtgttcctctactggttctatgttttttcatgaactgtctctgattttggcttgattttaaaatagatattagtactgtataaaaataactagtgtttgggtcctgtgtcctgtgtcttctcgatctcttagcaaagtttatagtactgctgagattgttagtgtctgtggtataaatatagtatgatggcttcttcaagtggaaactcttcaggatcaactcagcttcagaactctggttctgaagaggatctgcagcatgtgatggatcaaagaaaaaggaagagaatgctatcaaatcgggaatccgcaaggcgttcccggatgagaaaacagaagcacctggatgatctgatggcccaagttgctcagctcaggaaggaaaataacgaaatcctttcaagcatcaacatcaccaaccagcgctacttnagatttgaggctgataattcaattttgagggctcgatctatggaactgagccacagatatcagtctctcaatgaca

SEQ ID NO: 11979 - DNA, 780 bp, Vitis vinifera
  Predicted polypeptide sequence is orthologous to G735
gccgacatgttttttttttttttttttttttttttttttcgcataattcacaatatatttaaacacaaagaataggagttgtttcatacatcatgcaatgacaatatactttgcaagaaatattgcaacacaatcaattgttcataaagacatcttcaacaaaaagcttcatccttgggatgctctgcttgttattgctggtttccactgccctgaggcccattgacagccccacggatccgcttttgcagatgctccaagctagccactcgctgcaatgatgcagttcggcccatcttgttccctcctgctcctgcagctgcaggattctgcggcacgctttcaactgaagaaacatctgccaaaccgttattgattcttgggtcatgggtggatataaggttattaaaaggagatggataaaagtgctgctttgggtcatcttgcacaggaacagcagcatctgctgatgtgtcaaatgggcttccatcaaatgaatgcatgcccgccataaatatctcaaacatggtttggaacaatgggtccaatccagtaactcttttaaccgtctcttcagccatcttcacctttgctctcaatgtttccacatcagcttttaaaaccctattgtcaacagctgcttcattgtactttttggcttatatcagaaagacgcttcaacaaagaaaaattttcaagtcttaattgggcaacctgtgtctcgagctcagccaaatgagcctgttttcttcttcttgagcgtctagctgattctctatt

SEQ ID NO: 11980 - DNA, 756 bp, Vitis vinifera
  Predicted polypeptide sequence is orthologous to G744
gaaaagaaaatataagattgacggcattcgaaattggaatatcaaaaagcaaactagggtttcccctcgtgtagatgcccgcggtccgttcctccgaggcttgtggttggagcccggcctagcgggttcgatcgtgtttggcgggtatggaacatgggggttttgaagaaggaggtgagattagggtttatcattatattcccagattgatcgctggcgccctttccggcgctctcaccggtgttttgctctcgctggtgctttcacgggggctatcactggtgctatagcaggtagagcttctgacagtggtgtcctccgtggagctggacttggtgccattgctggggctgttttgtctgttgaggttttggaggcttcccgtgcttactggtgttcagaccgatccaactcacagaactccttatctattacagatttcatagaggagcttctccgtgggagaattgtagaggaatcgttcacaccagcagtgttaactacttaccgatggcaggttagcattggtaacttaagctatgatgacatgtatgatgtctatggtgaagttgcatccagaggtctgtcaggggactcactgaagaaactaccatgccatgtaatcttggatgaaattaaggcagcacagagcaactgctgcacaatatgtttgcaggatattgaagttggggagactgcaaggagcttgccttggtgccatcacacatttcacttggcatgtgtggacaagtggct

SEQ ID NO: 11981 - DNA, 801 bp, Vitis vinifera
  Predicted polypeptide sequence is orthologous to G748, G1900
tttttttttttttttttttttttttttttactaaagattgacataaccattactacttcaaaggcacctggaaaaatggaaaaggttcctggtttagatgtacaaatttattctacaacacttggagtggttcttcctagaatctctccttcctctgcctctctgtcacatatagttatgtacataaacatttactgatcagaaaacaatctaagctacaaggcaaaacacctattcatgctgttacaggaaagataaaagttaccatgcaaactcatcaaagacggcttcactctcctacaaaagtaaatatggatgaactcttctctggtcttcctctgacttggggctactacattgaagctgctaagtcatctggaaactatgggaaaagggcagtgcaaatttgttatcagggagagtttgcagcaaggtaaactccatcacatcaaatcacatcccactgccactgtagtagataatttacaatgcaatttaggctctctcatggaagttgagtgatctggacaaggctgcagggttggcttgcaacaccggagacatttcagctatgcgctttttctcgtcaccctttgattgaaaggccttcaagagacttcccccattactcccatcattcttaatcccaagtgttgtccatatagagctcttagcagcttcattgggatcgtcaatcctcagtgtctttggaatccaaacacctctttctggattgttctctttctggtgatcttctttccctgggttggctggattaaggacctctccatccctggcccc

SEQ ID NO: 11982 - DNA, 949 bp, Vitis vinifera
  misc_feature (894)..(894): n is a, c, g, or t
  misc_feature (896)..(896): n is a, c, g, or t
  Predicted polypeptide sequence is orthologous to G748, G1900
cttagtatcagggaacagaagagatgtgctgagatgcgaactgtcaattgcggaggaaatggggaggagccatcctcatgtgcatcttcagtgtcggctcctagtttcccagaaaatgagtttcctgaaaatgttgggcataaggaccaacctagtttgcctgcatctcgtagtgagattcatccacaacttcatcagccctgttaccctgttcctccatgggctttcccttggaatccaggttggaccaatgtagctcctgtagcaccacctcagtgctcgtctgacactgtttatgctccgaacaacagtaatccaaattcagttcagtggtgctccagaccaatgctggcagttcctggcttttgtgcaccaaccatacctctacagcttgtgcctccctcatattggggttgcatgcccatctggggtgcaggagcagggaacatctccttggctggatccaatgactgcctgtctccctcatcctccacgagcaacagttgttcaggcaacgcctcaccaacactaggcaagcattccagagatgcacaaccagcagaggaacagaagctagagaagtgtgttttggttccaaagactctcagaattattgacccagatgaggcttcaaagagttctatctgggctacattaggcattaagcctgaccagaaagcacccatatcaaaaggcggtattttcaaagcatttgaacccaagtctggagccaagaccgatctatcagatgccactcaggtactagaagcaaaccctgcagctctgtctcgctcccaaacattcaaagaaagtacgtaaagccgatgttgaatacagtcgttgcttgaagaacttgtctctctgcaatctttccatgcatatttgctatctagngnatattgcttcagctttgagttgctggatcagtcatggaacccatttgtataat

SEQ ID NO: 11983 - DNA, 700 bp, Vitis vinifera
  Predicted polypeptide sequence is orthologous to G752
tttttttttttttttccaaaagaacggcaccattctgtgagtacttttcatttcaaagttcatagaaggtaaatgagaagctcccagctgttcagccaagagccttggatttattagttggttgaaagaaaggggatttggtatgtacataaagaagtgaaaataaaaaatgttgggagtaggaggatccacataatatctgtacaaatctcccccatccaatctggtttcctgaattatgaggaagatgattaaagtgcagctgaagccttgcagacagggcaccaattcttcagccgtagccactggtgtatacaggccacatgatacccatgctcgcattgcaatttccccacttcatccccaaccatgtactcttcctgacaaatactgcatttgacatcatcaccatccccagcacaatccatggtccctggttctgtaggcagtgtgtgatagatgcttctctcaaggcattttgacaatgcttcttctgtaagtgctgtgctcacagtacccatcttctcctctagagccaataattcctcatatgacatgttatctatatctagtctcatctctctgtgctgatcatggaagcttaagccaccaaggaacaatttgtctccagaacaagtattgctcatatgttagttctcatctgctcatcctctcagagccatatactctgcatccatca

SEQ ID NO: 11984 - DNA, 632 bp, Vitis vinifera
  misc_feature (537)..(537): n is a, c, g, or t
  Predicted polypeptide sequence is orthologous to G760
gccaagctgaagagtagggacctggaatggtatttcttcagtgtgctggacaagaagtatgggaacgggtcgaggacgaatcgcgccacggacagagggtactggaagaccacgggcaaggaccgggaggttcgtcacagagcccgaaccgttgggatgaagaaaacccttgtgtatcacagtgggcgagctcctcgtggggagcggactaattgggtgatgcatgagtacaggcttatggatgaagaattgaagaaaacaggcgtggcgcaggatgcatttgtattgtgtcgaatctttcaaaagagtggctcaggtccaaagaatggtgagcagtatggggcgccgttcgttgaggaggagtgggatgaggatgaggatgtggtggtttttgttccaggtgagttggctgcagaagaagttgtagctggtcatgaaccctctgatgaagctgttgatcttgagaagtgtcttgacataggtcttcctcctgaaaatgatcctcttccattgaatttctattatggagattgcagncagtatgctgaggattccagggtatttaatgaaaatgaacaaaagcccttcataggtatggaggaaaatcattgtggttcggagctgcctaatga

SEQ ID NO: 11985 - DNA, 831 bp, Vitis vinifera
  Predicted polypeptide sequence is orthologous to G760
tttttttttttttttttttttttttttttcgccaaaaaaagtaaaaaaaaatgacattacatcatgacaggttacaggaatgtttgagctttccacaggatgtagggatctcaaactccgatgaaagtagagggactgtgagtgtgtttgctatgtttcaataaaaaggtgaccatatagaatgtaagaagttaggctgcgattacaagtccaacaaaaccaaagagtcgagagaacaccaaagtatcagtttggtaggtaacatatataaaaaataaactaataacagtgccacagcagcgtgctgttatgtagaagggaccataaggggttattatccctcaactacctgcctgtatttctttttaacccagaatactgtttgtgggtatgttatgggcaaccaaccatcctatggattaagggtcttacctgctacaaatgcaggtcccaattttataactcaccgaaaggatcagcacccaaatgaatataaggtagaacccagcccgggatattactggtcctgccttgcctgacatcaagctagctattggttccaaacttgcagaattcatctcaccctgtggcaagccaaaagaaagcatgaaatttatattccccgatttaccatatgaccagtctaccccattgccactcaaagtcgtgtctcttatttggatcattccagcagtgagatgaactgaactagaagattgcatggctgagttcaaccgaagagctacatcttttgtaggggcatccgaagcagatgcaaaaggagcagggataccacccaacaactgatagcttgcctgtttgatgaatgga

SEQ ID NO: 11986 - DNA, 890 bp, Vitis vinifera
  Predicted polypeptide sequence is orthologous to G778
cgatagtgcaccaagccacgtgccacaaccaaaactcaaacttcatccatcatgcccagaacctggccaatatgaagtctacagtcgggtcctccgcccatgtacagaccggaaatcaagggttggtgaagaagaggactcgttcggattccgctcattgtggaagaaattttagtactaatgttcatgaagctgagcgcgcagaccgcagtgcatgtgctagtgctagtgccacattttgcagggacaatgaaacaaccatgatgacatggccctcctctgaatctcctcgcagcttgaaggccaaaactacagatgaagactcggcttgtcatggtggatcggaaaaccaggatgaagatagggagactaaaactcagacaggccgctctcactcaacaagaagaagccgagctgctgctattcataatcagtcggagcggagacgtcgagataggattaatcagaagatgaaaactctgcagaagctagtacccaactcaagcaagactgataaggcatcaatgcttgatgaggtgattgagtacttgaaacaacttcaagcacaggttcagatgatgagtgtaagaaatatgcctcaaatgatgatgcctatgggaatgcagcaacaacttcaaatgtctctcctagcgcgtatgggcatgggcgttggccttggcatgggcatgggaatgcttgatatgagtgccgtccctcgtgctgcacctcaaacactcccttctctcctccatgccaacccagttgttgctgccactccaacatttgtccctcctccctttgtagtgccacccatgatgccatcctcatcacaaccaaagtctgatgcgggcgcccacgcagcagtccctttgcaggatcaatactgcgct

SEQ ID NO: 11987 - DNA, 860 bp, Vitis vinifera
  Predicted polypeptide sequence is orthologous to G783
cccctcgagttttttttttttttttttttttagacaactaggatttaagcttcatttttcactagattgatacaacaacgaggctctgaagacaatgctgtcttgatcatcatgcaatatgttgaatgaagagaggcacttttaaggttcattgacaaagggggcctagcacattattgaacatttacataaatgaatgtctattctgaatctatgaagtaaagcagggtaatatccagtggtgttgcggtaaccttacacatagacagcctttagtctcccctgctgctggttccagagctagtgccactaccaacctcatgttgctcgggtgtcttcagctgactatctagaatttgtgatggccaacagtctgatggggatggatagcgagcatggggtctgctcacatttgaggctgcagcattgggttgcgggaatgtttgaaggtcctgatgtaagggaacaacaaagacgggacccacaacaggtgctgtttgcgatgcatgatcagttacaggaaacatgagatggtcttctggtagctgtggggcagtgctgttgtgatccaactgagaaggatctgaattccatgctggtttggaccgaatcctttcttctagctcgctctgcagcttcttgatctgagcttctagagctgaattgtcctctctcagctcgttcttctccatactcacatagtgagattcagataaaagagctgcattatcccttttgagacagtcaacctgagcaagcaggtctcttagaagacgagtggcatcagtcaatacacaggcctttccattgttctgctgagctgagtcaagaatgttgcccagctcaggaataggacattc

SEQ ID NO: 11988 - DNA, 847 bp, Vitis vinifera
  Predicted polypeptide sequence is orthologous to G789, G1494
tgagtgccaaagcgaggctgctgaacatgaatcagctgcaggaaacaaggcatcacaaagatccgggtcaactaggaggagccgtgctgctgaagtccataatctctcagagaggagacggagagatcgaatcaatgagaaaatgaaggcattacaggagcttatacctcacagcaacaagtcagataaagcatcgatgctagatgaggcaattgagtacttgaagtcccttcagttacaacttcagttgatgtggatgggaggtggtgtcgcgcctatgatgtttccaggagtccagcactatatggccagaatgggaatgggaatgtgtccacctccactgccttctattcacaacccaatgcatttaccaagggttcaactagttgatcagtccacatctgcagttccaccaccaaaccagcctccaatttgccaaaccccagtcttgaatccggttaattatcaaaatcagatgcaaaatcccaacttttcggagcagtttgcacattacatgggcttccaccctatgcaaactccctctcagcccatgaatgtgttcagctttggatcccagagtcaccccatggcatcgcctgccaccactggtggcacctccactgcagctgctgcagttgatggtgctccaggcagcaagttgggttaataccagtgggtacgcatgctgctcgaatgcttttggttccattacacatcaagtgcgtccattgcaagatgatgataaaagccatccattaatttcgtcctggtggatggcctaggccagctcttcctacatagactaaggatccatcaagttatgtgtttacccatatggatgaaatta

SEQ ID NO: 11989 - DNA, 738 bp, Vitis vinifera
  Predicted polypeptide sequence is orthologous to G791
cgcaagtgtttgttccaaagatgtacttggcttacttcaacagttgatttaaaaacatacaacaatcatatttgcttattgtattttacatgcaatcagcagaaatccaagggagtcattggtttctgataacaatgacaaagtaaaatagacgaggaactctttgggcactgagaatgtagaccaaccattgatgtcctccaacttaagccactgggggacggagaacatgatcctgtgatgtgtcaactgcagcaggtggcatgaattgccacatggcaacactagggtaaccaatgaaaggcatcagcttgttgccaggagctcggccttgggcagcaaatgcagctggcattgcagaaggatgaggcagaaagcctggctgtgcactaatggctttgacttgctgctccagcttctccttttcggcttttaacctttgcttctcatcccgaagctcatttttctcagccttcaactccttaatcttctcttgcaaatccccatttgactccttcagcttctgtgcttcacttcgtaattgagtcaccattcgaacagcatcactcagaatagcagccttgtccgttttgggtggccttccaggctccaagatagaacccaattccaagaacctctcattcagcctatccctccgcaatttttcccggcaagctttggtgccagttgcaccacatgagattcatgcttcaaccgttttcggggtccaagttcttt

SEQ ID NO: 11990 - DNA, 917 bp, Vitis vinifera
  Predicted polypeptide sequence is orthologous to G791
ttttttttttttttttttttttttttttttccagattaaacttattgagatttacatgcaaataccatcactaattcaggtaagttcttaaattgcaaacatcttccatcacccacgaaatccagttagaaccaggaacactaatagtctaatacagtccagaaacgacaaaatgaaagtaaacttctttggggcaaaatgcaaacccaaatcattagaggttgagttgctgatttaagcaactgggggacggagcacatgatcttgtgaggtatcaactgcagcagggggcatgaattgccacatagcaactcctgggtagccgatgaatggaaccaacttgttgccgccagcttggccttgagctgcaaatgcagcagggattgaaggaacgggaggcaggaaactaggttgagcattcattgctttcagttgctgctccagtttctctttctcggcctttagcctttgcttctcatcacgaagctcattcttctcagccttcaattctttaatcttctcctggagactagaatttgagtccttcaacttctgcgactcacctcgtaactgagttaccattcgaactgcatcaatcaaaatagaagacttgtctgtttttggaggccttccaggctccaggatagaacccaattccataaacttgtcatttagcctgtccctccgcaacttctccctacatgccttcgagctagatgcaccacatgattcagatctcaccctcttctttgatccagtttccttaatgccgtcagagtccccaaatgaaccatcaatttccccactgacattagcagaagtgttcaaggcctgcacaggagtccaggcgaaccctgaattcgtattagcgaagtttgaatcagggacagggatgtcctcgatgagcccgtactcgt

SEQ ID NO: 11991 - DNA, 911 bp, Vitis vinifera
  Predicted polypeptide sequence is orthologous to G791
atgtgaacggtggtgtgtgatggtgaatggtgccaccgatccctaaaaccagaaaaaaaaagaagaaaaaaacccaaattcatttctcttctcaccaccgactttaatttcgccggagaaaactccggtatggtatctccagaagaagatccaaattggatcttcgactacggcttgatcgacgacgttcctgtcccctccctccaagcaacctttaattggccttctcatgatttcactgcttccgtcgccctcggtgtggaatttgatgactcacctgtgaatttggatgatgtgaaggaaaatcactcccggaaaaggatgaggtctggactgtgcagcgcgtctggctccaaagcatgtcgggagaaagtacggagggataggctgaatgacaggttcctagaattgggttctatcctggagcctggaagaccccctaaaatggacaaggctgttatattaagtgatgctcttagaatgatgactcagctgcgtagtgaaggacagaagctgaagaaatcatgtgaggatctgcaagagaagatcaatgaattgaaggctgagaagaatgagcttcgtgatgagaagcagaggctgaagacagagaaagagaacattgtgcagcaaataaaagctctgagtacccaagcaggcttcctgccacacccttctgcaatcccagctccatttgccgctccaggccaagttgttggcagcaagctgatgcctttcattggctaccctggagtttccatgtggcagttcatgccacctgctgccgttgatacttcacaggatcatgttctccggcccccagttgcttaaatttgaaggcgttaactgtggatcttccttccctgtggatcgagcatgattctatgatctgggttttcttctggctcttgaag

SEQ ID NO: 11992 - DNA, 685 bp, Vitis vinifera
  Predicted polypeptide sequence is orthologous to G798, G1897
gtgaaccattccccaccaagaagccacatctctgaaaatgccatcagagtccggggagaggcgcgttgcgagaccccaacaagtgggtgggcatccgccgcagtctgagcaccttccatgtccccgctgcgactctaccaacaccaagttctgctactacaacaactacaacctctctcagcctcgccacttctgcaaatcctgtcgccgctattggacccagggaggcactctcaggaacatccccgttggtggtggtactcgcaagaactccaagcgttctcgcactgctacttcttcctcttcatctaccctagaaacgacgccttccaaccccatttccgtctcgccagtcctgaaagccgaaacggagacgccgcaacggaatggattgagtctgaatggggatgtgtctgggggtttcacctcactgctcaactctcagggacctgggttccttgcgctcaatgggttcagcctagggcttggaccagggttcgatgaaatggggttcggacctgcgaaaggggtttggtcttatccagatgtcggtgatgttgttcttggtggcgatggcactggcagcggcggtggttcggcgtcgtcttctatatgcaacacgtggcagctaagcggcggggaagtcggattcgttgatggagattgctttgcttggccagacctc

SEQ ID NO: 11993 - DNA, 815 bp, Vitis vinifera
  Predicted polypeptide sequence is orthologous to G802
cccctcgagtttttttttttttttttttgaagtgaaaagaaattccattccttcaactctttaatgcagtcaacaatcaataatggctactgctacaaaagcaaaggacatacacaaaaagctaggagtcatggctgataaaccactcccaaaagctctaccaaagccgaaagaaagaagcaattaacttgaaatcattgagactcagcagcatcttcatctccactgtcttcactaccttgaggaggctggttctgatgctgatgctgttccaaattcatccccaaatcaaccctagtgctgttataagcattcagcattcccatgttgatatctgatagtcccaatcccagttgctgagacccttgtggctgttgcagaaccattggacccagttggattggactcaccccacccgagaaattcactctgtactgccctccgcccgttgcaaacggccaaatctgaggctccgaggccccaactccggcggttgaggtgctaacgctggtagtcaccggcagcatccagaaagcgctgccgccgttgctggtggcaggtgcaactgcccacatggccggagcaggtcgagctgaaccgtgcgtcgccgccggagaagaaccctgttcgtgatcttgaggcccgggcgccgcaggctttgttagcgaagacgagttgcaccgccggttcctagatgaggatacagctgatgatgaaaccccaagattctccggcttggatcgccgccgccgtcgtcaaagagcctaaaccaccatgaaacgagtggggagccgacttcgaggctcgtgccgatt

SEQ ID NO: 11994 - DNA, 720 bp, Vitis vinifera
  Predicted polypeptide sequence is orthologous to G807
tttttttttttttttctgaaaaacaaaattttgtattatgtagaccattttggactgtttcacaaatgtgaagagggaacaatgaagaaagtgggagaaaatgctgaattaagatctataggagttgtggattatggtgtagttaacaagcaggaaggggcatgaagatcgagcttgctatatagtaaatagcgggtttaaaaatttacctctcgacaagaaacaaatgtacaaatggtaacacaagatcacatccccttggcctttgatgcaagaaggcccattcgttctgtaagatgatccatatgctgggtattattccatccgttcacccctggctgtaactcatgtacattgaccacattatcttccagcatgcttgaatgaatctcatctgtgtcaccagtgagtgggcttgctgcaagaaactgttcccagaaagcatcattaatgctgggaagcttgggtatcccatccagcaagctatctacattggaatcaagcgagaactcatcagtttctgcaggaactaccccatctaaaatgcctgccattggatccatataccctggactcccagtttcagtgccaaccatgccaacattagggatttcaaccgtgctttctggaatgattccttccatttgagtgaagtcagtcaagacagtatcttcctgagaattaggtacattgacttctgggaattgagctgcttttact

SEQ ID NO: 11995 - DNA, 665 bp, Vitis vinifera
  Predicted polypeptide sequence is orthologous to G811
ggaaaggttgatccagatagatgggagttcgccaacgagtggttccttcgtggccagaggcaattgctcaagaacatcgtcaggaagaagcatagctcttgtggtaggagttcgtttttgctacaggcgaagctggaagatggtgtgaggaaatattggcggagattgagaggctgaagcacgagcagaagtcccttgaggaggagcttgaggggatgaccaagaggttggaagcaactgagagacgtccacagcaaatgatggcgtttctctacaaagttgtggaagacccagagcttattccgacaatgatgatggagaaagagaggaggaggcaattgggcgagaagaagaggcgtcttctgatccaatcgacatcgtcttcctcaggcaccgctgggacggcttcagtgaagtcggaagaggaagaagacggcagcactgtaggtataatttcatcgccggagactctgagccactcctcgccgtcgccggacacaagcactccggcgtgggtgaggccaaggcagatgatgggttggcctctcgtcgcccaacagccttaccctttggctgccattcccagtcccatatattccgggtctgtgaccggaataggacatttcaacacgatgtcgccgccgcctgaaaacaccatttctagc

SEQ ID NO: 11996 - DNA, 758 bp, Vitis vinifera
  Predicted polypeptide sequence is orthologous to G831, G1202
cgggcatcagcttcggcacccggaaggtaccgaaaccttctagacatgaatgcctacctgggtggatttgctgcagctctagttgaagatccagtttgggtgttgaatgtggttccagtagacgcaaaaatcaacacattaggagtgatttatgaaaggggactgatcggaacatatcagaactggtgtgaagccatgtctacttacccgaggacatacgacctcattcatgctgattcagtgttcagcctctataaggacagatgtgagatggaagatattctgttagaaatggatagaattttaaggcctgaaggaagcgtgatacttcgagatgatgttgatgttctggtgaagatcaagaggatcactgatgggctgaattggatgagtcgaattgtagaccatgaagatggtcctcatcagagggagaagcttttgtttgcagtaaaatcatattggacagcacctgctgctgctgaccaagaaggatcctgagaaacttcttttagctttcttttgaaatgtcttctacattttttttattctgattctttataatttgtttgaggcaattaagacagccttaatttagcttatattgaattgtttatttatgggcaactatatgccatgctagtagctgtctatagaatgtcttagtgcccactttcctaccatgttacctagctaccaaataatctaatggtttgactttggtgtgcattaaaaaaaaaaaaaaaaaaaaaaaaaaaaaa

SEQ ID NO: 11997 - DNA, 704 bp, Vitis vinifera
  Predicted polypeptide sequence is orthologous to G839, G1196
gctagaaccaaaacttcatggaaccatagtattcctcaaagtataattaggttctttggcgtaattcactttggttggttgatctgtgtgtgcattctaaagtgtatacgccttcagttctagattagattgatggccaattcagctgagccatcatcatccttgagctttacatcatcttcccatatatcaaatgcggtcaccagtcataacatgtcttcctcctctggctctgagacagggcctagcctcgaaatcatcagcctaagcaagctcagttctaacttggagcagctattggttgattcaggttgtgattatagtgatgcagagattattgttgagggcatcccagttggggttcatcgctgcattttggctgccaggagtaggtttttctatgatctcttcaagcgagaaaagagttcttctgagaaggatggtaaaccaaggtactgcatgagtgactttttgccgtacggtaaggttggatatgaagccttccttattttcttgagctatctgtacacgggaaagctgaaggcttcacctctggaggtgtcaacgtgtgttgatactggttgtgcccatgatgcgtgtagacccgctattgatttttctgtggaattgatgtatgcctctgctatttttcaggtaccagagctggtctcactttttcagcggcgtcttaccaactttatcgg

SEQ ID NO: 11998 - DNA, 757 bp, Vitis vinifera
  misc_feature (736)..(736): n is a, c, g, or t
  Predicted polypeptide sequence is orthologous to G852, G2633
ttttttttttttttttttttttttttttttcgcagtataactcatcccttatgattttctatttcattccaaggcgggcatttacaagaaatttatgttcaggatggagcttctaaaaagtcctcatgatcaagaataatacaaggggaaaaaaaatctacaggtgtatgctgtaactcctaaagtacgcacaggttttcacacccatgcacaggaggttgccaagatcctgttcttccaaccgagatagagggctccgttcctctcttgaagccagaaattcgggctatactccttcaacatatccttgatggcgagactcacagaggagcttaatggatatggattaaacccagccattaaaaatcttgacctccatttaccaagaagctcgtgccgttccaccctttcagccccctcgcatgctattatgttgactatgtctcgagctacacagtgctgctccgcattgatccgctgcttgtcattccttggccgtgcaacatcaatggactcaaacatagctgtatagtaatccagtgtctcaacaaaccgtgggagaaatgcggaagtgttggtgttggattcttgctcaacaagcgtcacaaccttgggttgcaggctcttaattagcctcaacagccggtctctgtgattcgcagtgctcacactctcatctggcatgtgatgtaacatgtatggaaaaattcaccagccaggggcttccccatgatanaaatcctaaaggttttctagt

SEQ ID NO: 11999 - DNA, 665 bp, Vitis vinifera
  Predicted polypeptide sequence is orthologous to G852, G2633
gccggggatttgtcgaagcctacaactactactcatctatgttcgactctcttgatgcaactctccccaggggcagccaggacagagtgaatgttgaaagacagtgcctggcacgggacatagttaacattgtagcatgtgagggtgaagaaagagtagaacggtacgaggctgcagggaaatggagggcaaggatgatgatggctggtttcacttcatgtccaatgagtcagaatgtgagtgatacagtccggaaactcataagggaatacagtgaaaggtacacagcaaaggaggaaatgggtgctctccattttgggtgggaagataagagcttgatttttgcttcagcatggaggtgactggtgtctagattattcagttgcagatatcgctacagcatctggcttgcctaggtattgttttggctgcgtatgaactatatttctatgtaggatcagtatatattgcgttgccactttatttaacgtagaattaggatataaggagatgtctgatctaagtcacttgacaatgaaattgtatgaagtctaatgcttataggactgcagatgaaaaaatatatgaactgagttgtaacggccattgattagtttaccaatttgtgttgctgcaaaaaaaaaaaaaaaaaaaaaaaaaaaaaa

SEQ ID NO: 12000 - DNA, 848 bp, Vitis vinifera
  Predicted polypeptide sequence is orthologous to G852, G2633
tggtatcggtttctggtgagccaattcagcggttaggagcttacatgtgatcaggactagttgcaaggttggctgcttcaggaagctccatctataaagctctaaggtgcaaagagccggcaagtgctgaactcctctcatacatgcacttgctctttgaaatctgcccatacttcaagtttgggcatatgtctggaaatggggctattgccgaagcaatgaaggatgaaagcaaagtccatataattgattttcagatttcacagggcgtccagtggatcaccctaatccaggctcttgcggctcggcctggtggaccaccacagatccgtatcacaggtattgacgattctacaccagcttatgccagagggggaggacccagtattgtgggacagaggctatctaggtttgctgagtcatgtaaagtaccgttcgagttccatgctgctaccatttctggttgtgaggttcagctcgaagatcttgagcttcgaccaggagaagcactggctgtgaattttgcattcataccgcaccacatgcctgatgagagtgttgacactcagaatcatcgtgacagactgttgaggctggttaaaagcttgtcccccaaggtggtgactcttgttgagcaagaatccaacaccaatactgctccattcctttcccgattcattgaggccatgaactattatttagctgtttttgagtcaattgacgtaactttgccaagggatcacaaggagcggatcaatgctgagcagcactgtctggcccgagaaattgtcaacataatagcatgtgagggggctgagagagtggaacgacatgaacttctggggaag

SEQ ID NO: 12001 - DNA, 709 bp, Vitis vinifera
  Predicted polypeptide sequence is orthologous to G852, G2633
ttttttttttttttaaaatgaacccatcaaacccacccaccattctgattttggttaaacgtaacaaaataaaaaaagagatttattcagtatggacagagcaccatacttcaacatatggatgcaggagtttacaaaggttaaacatgaattttacattatgtattacaaaacagatgaaatgtatcactccgggggattggaaaccctgcatcacatgcacatacaaactagacataagggaaaaaaaaatgaagatgcctatgaaaggacaatgatgatcatcatcgtagcgcaggggacatcatataaacatagatgtcggccattggggttcagcaagaaggaagttggatatcatcgtccaatggccgttgtgttatcatactcccataccatagactgtcatcactgtccatctatgaaaaaatagaaactggcttatctctattgctacctctatacctgtcataacatcccctattctgactgtcaataccaggccgaagctgataccaagttcctgtccttccaccccaacagcattgccccatccctttccaccaaggtataatgctctgaatagcacctaagcaaggtccttatcactgagttaacgtaagtgctcagtgggtattgccggaaacccgccattgtcaacctggatttcactttccgagagctcatgacgctccacccttccttgcct

SEQ ID NO: 12002 - DNA, 595 bp, Vitis vinifera
  Predicted polypeptide sequence is orthologous to G852, G2633
tttttttttttttttggaacaaaccacaccaggaacagcaaagcttttattattgtacgcaacaaccctacttgcgaattgttgcaccacaaatggttacatgtctttgagttccttcacacactctcaagtcgattacaagaaaatatccaaacttcatttgccagcatggagatgatatcctcatcagccaaattaatcacctccatgcagaagcaactattaagattttgtcttcccacccaaaatgaagtgcaccaccctcctgcttcaccttataccggttgcagtactgttttagaagctcttggattgagttattcacagatgagctcaatggacatggtctgaatccggccattgtcatccttgccctccatttccccgcaacctcatacctctctatcctctcctcgccttcacatgctacaatgtttactatatctctagcaaggcagtgcttttcaacattaatcctgtctgggttctctctgggcaatgttgcatcaagtgattcaaacacagccgagtaatagttataagcttcaataaacctggggaaaaatggggcagtgtttgtgttcacatcctgctc

SEQ ID NO: 12003 - DNA, 726 bp, Vitis vinifera
  misc_feature (687)..(687): n is a, c, g, or t
  Predicted polypeptide sequence is orthologous to G861, G1140
tttttttttttttaacctttttttaccagagtgcattgacaaggttcaacttgcaccttgaaatattaccgtctcattgacttgtaatcgtgtgtatatttaacatatagcgtgggggttaattttacattccatttaattgagttgatgttcctgaaaaactccagtctcttcagccacagtagttcccgacttcctccactggttattttttttaaccagagtatggcagccccaatttgagggatgtatctgaactttcatagtcttgtggaggcccattggagttgctaacattggttacagactcagatgattggccttcctcgtggaacatgttttctgaatcaccagcaacctgccttcggcggttggaaatctctaccacttgttgtcttaatcgctcgttctcttccatcaattggacaccctttgactgaagatcggttatctctttcatgattctttcaccctttttttgtatcactcggctcaatccagcttcaagggatttctctagttgctgcagatcttctatatttaatccttgaagttcttctcccctcatctgcctcagcttatggcttttatctgcaacttccttgctcaacctggagtgattggttgttttctactagctgcaactcaagagatggttgctcaagtttctcaagggtctttgattgnaaactatgcttctcaagtatctctttcatactggagcat

SEQ ID NO: 12004 - DNA, 896 bp, Vitis vinifera
  Predicted polypeptide sequence is orthologous to G861, G1140
ctctttctctatctttctttttctatcttccgaacaattggtggctgggagtgtggggtttgtgacctgtccacacaactggaagcaacacagaaagggtttggttgaaaattttccaatggcacggcggaagattcagatcaagaagattgacaacacagcagcaaggcaagtgaccttctcaaagaggagaagagggctttttaagaaagcacaggagctctcaatactgtgtgatgccgagatagcgcttattgtcttctcagcagcaggaaagctctttgagtattcaagctcaagtgtgagccaggtgattggaaggcacaatcagcatccacagactccagggaaaccagaaccaccatctctggagctgcagctggagaacagcacctgtgcagccttgagcaaagaaattgcccagcagactcagaggctgaggcaaatgaaaggagaagagctccaggtattaaaaatagaagaattgactgaactagaggaattacttgaagctggtctgtgcaacgtcgtggaagaaaaggaagaaagaattcgaacagagatcagtgatctccagagaaagggagacctactgcaggaagagaatgaaaggttgagaaaggagatggagaatatttttgaagcacaacctcttctttaacagggccactcatctgaatcaatcacaaataatatttgcagcttattaggtcctaatcaaggccatcacaactctgatacttctctcaagctggggtatgtttatttgatgtatttgcatgtcaaatctgagatcttatttcaattcaaaacaatcagtagtattacctatgcagatgcatgttttataagtaaagggacatgtgcccatgcatgtaacttgactgcaccgtgaa

SEQ ID NO: 12005 - DNA, 686 bp, Vitis vinifera
  Predicted polypeptide sequence is orthologous to G864
ttttttttttttttttttttttttttttttgtgaatcaaaacataatatccatttctgttttattaatgaaaatcatgaaacaaaaattccaaaaccttttcccctttttagtcctctaacaaatagagcataaagggaaaaacaggggaacaagggctaatcttcaaagttacagaaatcaaacacaagggatagaagggaagggaaaacactgaaacgaaggtttctcaagcaaagttcaagaaaacaactaagttgaacaaagaaccagagatgcctgagggaaaaaaaaaaacagcaccacacgtccgtttccatttttatgcatttgcttactgagcaaatggaggattgaaaaaaaatccaaaattattgtatgatgcttttattttatttttaatcatcgtgctatccaaaatacgaaaatcccaatataaccaagctaaattgctaaatagcagacgattaaccttttccattttctttttctcattgcgttgggcataaaacattcagggtttcaagatccaagctttcgataatcccgacatttcctcagcaacccaagggacccgaaaagaaaaccctagatcaccaattcaaaaaaaaaaaaaaaataataaaaataaaaaaagcaaatttagggatctgaatctgacaagatctagggttttgattagtaaag

SEQ ID NO: 12006 - DNA, 538 bp, Vitis vinifera
  Predicted polypeptide sequence is orthologous to G866, G883
gtttttttttttattttttttttttttttttacgaaaaataataattcatttctagacattgattttgaattttcttttcttttgtacactattctccggaacagtaagtttgactcctctttgacttttgtgccccggggaatctatggccacctggctgtgacaacttgctccctgacagccgatcctggattgggggcaggggaggaagcgtcaggttgatgggaacatgaggccaccggccggtgccggagtttgagagtggcggtgctctccctcgtaggtgacgatgagcatcgccggatcgtctggtgcgcgctccacgtgttttctcgctgggcagcctctcacgctgctacatttgtagtagcctcgtgggtatggtgagcccttgatcggcttctgaccgtactttctccaagagtactcgtcggcgggaatatcggcgatcttcgagcttatcgcaggaactctgatcgccctcttcacaccgatttttccttcttttcgagcaatggcagcgcccggaaacagaga

SEQ ID NO: 12007 - DNA, 722 bp, Vitis vinifera
  Predicted polypeptide sequence is orthologous to G866, G883
gcacctctccaacttctatcccttcaagcctttgatggtcgcctaagcttttaggagagagacatcttcctttgtctggtagtcgtctccaatggcggttgagcttctagggttttccaaaatggatgagcagatcgcgattcaagatgcggcttcggctggattgaagagcatggagcatctgatccgcatgctgtctcatcagaccaatcaaaaccacaacatgaatcagctcgattgcagggaaatcacagattacaccgtttccaagttcaagaaggtcatttccatcttgaaccgtaccggccacgcccgcttccgccgcggaccggtttcttcttctgattctccctcgtcttcaacctcctctgtggctcctcagactcacgcccttactcctgctcctgtcacttcacttcccgttcctccggcggcgccgcctccggcgagttttgttcagcggcagagtttgacgcttgacttcactaagcctaatcttgtgagctccaaccctgtgagtagcgatgtggtttctacgagtcagttcagcaaagagagcttcggcttatcgcagcctatgtcgtccgcgacaaattcgtcatttatgtcgtcgatcaccggagacggcagtgtttctaacggaaagcaggggtcatctctgtttctagccccagcgccggccgtttctgccggtaaacctcctctctcatcttcttgccgga

SEQ ID NO: 12008 - DNA, 689 bp, Vitis vinifera
  Predicted polypeptide sequence is orthologous to G872
ttccggagaatcctccgaagatcgccggcggaggatccctcactaggtcggagattcgagcggcagccgccaaattcgcaaatgaggactcttccactgcctcgaccagccactccagtcactccatgcccgaactacaagtggagtctccgtcgccgtcggtctccggagaaacgacccaggtggaaacggacagtgaaataaatttggaagggtcactttcagaattatttacaagcataggctccaatagttatgtgccggactatggaatatttcctggatttgatgatctctcagacaattttttcccacccgcaatgcctacagatgactatggagaagaagacatgaatgcccttttctctcacgacacattcctttggaatttctgaaggcgctgaattcagttgccagcactgagtcagaattcattattttcaaccattcgttttcccggaaatatttttgattccgggaaagggatcggattcgatggctagttttagtacagcctctacttgccttggtatattctttcccgtgtcaccttccattgataaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaagaggggaaaaaaaaaaaaaaaaaaaaaaaaaaaa

SEQ ID NO: 12009 - DNA, 749 bp, Vitis vinifera
  Predicted polypeptide sequence is orthologous to G878, G884
tttttttttttttttttttagattcaaacatatgctagtcatctatgtatgaaaaactgaacagtcatatacatcatttctgattgatgtacaagaagaaagtacatacagcatgcaattttttttataaattatatatgcagcaaaggtttagcccttatttctcatacagctttcgatggtttcttccttttcttctgatttctcctgcaggttttgaatttcttccttttccttaattccttcatttgtactgtgttagttggtttgggacaaccctgtgaccttagtggaataggtttcaacttggcaatttacaccgcaatctgctcttctttcagttgtaaaagtgcaacaggttttttatccttgtttctgaaacccatctctttgagtaaggcacgcttctcagccaccacattatgctgttttagctgtgttgcattactgttggcagtgttgtggctgctgtttctagctgctgggacatcatgattgtgtttcccctcatatgttgttatcacagctttaggatctgttgaagccctctcaacatgtttacgtacattacagcccaggctagtgcatttgtaatagctccttggatgaggattccctttgaccactttttgcccatacttgcgccacctgtagccatcatccaaaagatcaacttcacttcttgtctgcacaatgatccttggttcagtgactgtcttgtgtgatgatactacctcagcaggtgctgc

SEQ ID NO: 12010 - DNA, 646 bp, Vitis vinifera
  Predicted polypeptide sequence is orthologous to G878, G884
agcaagggattggagccagaggaagatgaacccaggagcaagagaaggaaaagtgagaatcaatccagtgaaacagtcattgtaggggaaggtgcacaagaaccacgtattgttgtgcaaaattctacagattctgagattctgggtgatggctttcgctggagaaaatatggccagaaggttgtgaagggaaattcatatcccaggagttactatagatgcaccagtctcaagtgcaatgtgcgcaagcatgtggaaagagcatcagaggacccagggtcatttatcacaacatacgagggaaaacataaccatgatatgccaaccaggaatacaaatgcagcaacctctgaaccagatatgcaggcccatacgaataaagagaaaccatgaacgatagcgctgtgaaaatcgattatctaacgaagtatagttaaaaaaaagtccagttggaacagaaatcaaacaaccagagctattctgacgctggccatgactattccactttaacatcctatctttttccctgggaatttcatatgtgaagccttcttgatgaagataattttgtgtggaatataataagaattttcagataggtggagttatcatctgttttagctttttctcgatcgataaaaaaaaa

SEQ ID NO: 12011 - DNA, 1664 bp, Vitis vinifera
  Predicted polypeptide sequence is orthologous to G878, G884
tattgatcaatggctgaaaacgatgaaacgtcactatcatcatcggcatcagcatcagcatcgagagcttctgctcctctacggcctactataacgctgccccctcgttcctccatggaaactctcttccctggaggtcccggcttcagtcccggtcccatgactcttgtctctaattttttctccgacaacgaccccgactcctactgccgctccttctctcagctgctcgccggcgctatggcctcgcccgccgctgttcccggccccaggcccagtttttccaccgaccctcaggtttccgcttcttccaaggaagacaggacttccgttgatgccgctggtgattttgaatttcggttcaagcagaaccggccctccggtttggtgattgctcagtccccgttgtttacagttcctcccgggttaagcccgacctgtttgctcgattccccaggtttcttttcgcagggaccatttgtaatgtcccatcagcaggccttagctcaggttaccgctcaggctgcacaagctcattcccatatgcaactccaagccgaatttccgtcttctttatcagtgtcacccgctgcatcattgacacagtttccatcctttgctagcaacacaaaagcacatgagcagatgccacccttagtatcagatgctagaactgctgtgaaggaatcatctggtttatctcaatctgatcagagatcccaaccttcttcatttacagttgataagcctgctgatgatggctacaattggcggaaatatgggcagaagcaagtgaagggaagtgaatatcctcgaagctattacaaatgtacacatccaagttgtcctgttaaaaaaaaggttgaacgttctcttgatggccaagtaacagagattatttataagggccagcacaaccatcaagcaccactacccaacaagcgtgcaaaagatacaggaaatcctaatggaaattcaaattttcaggagaatcctgaattagcctcccaaaaccagactgggaacttgaacaaaccgaaagaagggttacctgcatattcactgtccaagaaggatcaacaatctagtcaagccatacctgaacacttacctggatcaagtgacagtgaggaaatggatgatgctgagactagaggtgatgaaaagggtgaagatgaacctgaccccaaacgaaggaatacagaggtcagggtttcagatcaggtttcctcccatagaacagtcacagaacctaggattattgtgcagacaaccagtgaagttgatcttttggatgatggctataggtggcgcaagtatgggcagaaagttgtcaaaggaaatccttatccaaggagctactataaatgcacaaatccaggatgcaatgtccgtaagcatgttgagagggcagcaacagacccgaaagccgtcataacaacatatgaaggtaaacataatcatgatgtgccagcagctaaaagtagtagccacaacacagccaacagcattgcatcacaaaaaccacagaacgtggtggacaagaagcgggcctttattgacaataatgatcaatgtcccataggacgattacagttaaaagaagagcagataacataatctcttggagatgcaaacatgaaaagaggcaaggcgatgtagaa

SEQ ID NO: 12012 - DNA, 732 bp, Vitis vinifera
  Predicted polypeptide sequence is orthologous to G896
ttttttttttttttttttttttttttttttattttttttttttttttttttttttttttttataaactatctagttgatttcctcacaaaaactaagttggaagtaaatcaaatcttaacttaacctcatgatatataacctggtatcaaaacatatgatctgcaaaaaaataactcaagctgacaatcatattaggaaggggaattccaaagccatgcctaatgtttcccatgattgcaaaaaaatacaacaatagtttactgacaaaaaggattgggggcaatggcttttctcagtaactgtacacttaaacaagccacaggatggagcattgagcaattgagctctctgagtcaaaggatgaaaggctttgagtacacgtcaaatggttcgttggcagttagttggggttcctgcctcaacccaccactaaaactctgtcctgtcaaaagcatggggaaaaaaaatgtcacaacaccacccccaaaattgtctgtattacggatggttgatcgcattgaatttagcatgttcccatatgtagttgcatttccaacctctattgcttggatgaaaaaataagtcattgcacctgttgaagtgatctttgataaagccgacgtatcagcaaaggtttgattatcatcacagccactaaaggaaatgacctccccaccacttgttcctttccatatacctgatggggggcgatgatcctcccatacatactg

SEQ ID NO: 12013 - DNA, 541 bp, Vitis vinifera
  Predicted polypeptide sequence is orthologous to G898
tttttttttttttttttttttttttttaacactaaatgccattaagctcagtttatagataagttatactactactagaatatcctgaaaataacaaaactataaaacaagtacacaaatatcttagtcaattaaatcatccactaaccagaaagatttggctccacagacccacccatcattgcaacaaggcacttacaccatgaccataaaatgattatgtaataccaatgttaaaaataaaagagtccgatgacatgccaagacccatcatttcattcctctttctatcctccaaaagccagtctttatagccctccttatatgctgaaaatctttaagcctatgcataattacatgattggcgcaggcatcacactcagctggctgcaggaaggtaaattctgatggtatctttcatggtgaaccttttcctacaggtagggcatttaccctgggcagatatagcagccttaatgcacatcttacagaaaatgtgaccgcattttgttgacatctcatcaactaactgacccatgca

SEQ ID NO: 12014 - DNA, 719 bp, Vitis vinifera
  misc_feature (13)..(13): n is a, c, g, or t
  Predicted polypeptide sequence is orthologous to G904
agctggttgaagnatatgtagacaggttgtcttcgacggcgtcgttgtcaatctcctcacgtgcgctatcgttccggagctccggcaggtttttcaccggaagcagtcgccgcaatgaaactgccagcgtcggcgagtgggatttggaggcgaatcgggttggagaagagataagcgaaatgtttcggtggttttcggggatataatggtaatttcggtccatagctagggtattttctgattcattttcagccaattttcctcctacctctgtagataaaaaaaacaaaaagcagggataatttggtaaaaagaattagctccagttgcatcctgaccgttcatcagagcagaggtggacggcacagattgaattgaggtagcatttgtcagaaaattcataaaaatgctgccatcctccaccaccagtgaggataaaattgtagaaaattgcatttttgagatgaaaaaaagtatattattaaatttggatggagctgtaacgggaaagaagaaagacggtgggtgtgttcactgttcatttgggacctgtgatttggtaggccacgacagacggaattaaatggcctctcttcatttatggaaatcaacaaccttcttctacggttctacctcgcttttcatcgcattctccaggtcgcgtcttctttcttcttcttcttctcctcctctgtgatcaattccgttacgttttcact

SEQ ID NO: 12015 - DNA, 483 bp, Vitis vinifera
  Predicted polypeptide sequence is orthologous to G911
ttttttttttttttttgatcaaaagaaagaatggccatttcaccaaaaagaagcatgacagtagggtcacaaacaaagaggggagtccattcaggataatagctatggaagccgacttttgaaaagatatgagaaggattggatgacttggtactaagccaaagcaactccgaccacccaccgacactgaaagtcacctttctcggcctttagctcaaaataccactgccgtaaatggggcctttgtaagggtaatgagtcctaaaaattaggacagtgtccttttgagaccaccccaccttgtataaacatgctggcaaaacgctcgcaccagctttcatgccccacctctcggttggaatgatgtggatgcctagtgggcatgcacagcgtacagcagtccacagtgataacaaatgggtctgttgggagtggtttgaaccgacaccgatagggacattaccattgatgcttgagctgagt

SEQ ID NO: 12016 - DNA, 570 bp, Vitis vinifera
  Predicted polypeptide sequence is orthologous to G912, G2513
ggtgaggtgaggacaccggagaatgtgtttgttatggatgaggaggacgtttttggaatgccgggtctgctggtgaatatggctgagggtctgctgatgccgccgccgcatagcgtggcggatggctacggtggagatgacatggcggcggatgctgacatgtcattatggagttactctatttagtaattagtttaaagtaacagagggtaggtgggagtttagtagaattaactattagcccgtacttcattttttggccagtacggagatattaatatgtaagaaaaagtaagagaaaatcccaaaagtgggaggtaaatccggtggttggtacgtggcggttggcatgaagggatcaaatggaccattccctaataatatcgccagcgagtgtgtggaaagctacggaaagagcttgtttcagcttttaatgccttgtggtttggatgcagataaagagagtggttttgataaaatgctttgctatgtaattaaataaacaaagtcataatgtaatctaaatggtattgaatggaatggaagtgaatccaatatcatgtactgaag

SEQ ID NO: 12017 - DNA, 696 bp, Vitis vinifera
  Predicted polypeptide sequence is orthologous to G912, G2107, G2513
ggcttcactcagcactcaaatcagttaccgttctccttaactgctcttactaaatctcgacacttcagtcttcaccgttatgaatactacttctccaccatattccgaccctcacccgctcgtatgcaattgggattccctgaatttgcctgattctgatggaggcagcgaagagttgatgctggcctccacacacccgaagaagcgagctgggaggaagaagtttcgggagacgcggcaccctgtgtaccgcggcgtgcggcggaggaactccgggaagtgggtatgcgaggtaagggagcccaacaagacgtccaggatatggctggggacgtttccgacggcggagatggctgcgcgcgcgcacgacgtggcggcattggcgctgaggggacgtggggcttgcctcaattttgcggactctgcgtggcggctgcatgtgcctagctcccgcgacgccaaggacattcagaaggcagcggcggaggcggcggaggcgtttaggccaatggagaatgatggggttatgcaagatgagaggagggaagagagtgaggtgaggacgccggataatgtgtttgttatggatgaggaggacgtttttggaatgccgggtctgctggtgaatatggctgagggtctgctgatgccgccgccgcatagcgtggcggatggctacggtggagatgacatggc

SEQ ID NO: 12018 - DNA, 430 bp, Vitis vinifera
  Predicted polypeptide sequence is orthologous to G912
gggcaatgtttaatatgccaggtttaattgacagcatggccgagggtctgcttcttactccacctgctatgtgtgaaggcttcagttgggacgatgcagtttcacacattgacttgtctttgtggaatcatgatttcctgtcttaactcttaagtttcttctcttgacatttctggtcaatcaagtacagcccactgctgtccacaatttcactcccatacacacttttagcttgatcaataccactcatagtttcaaagtaaaacttggatagacttcaggtgaggatttccatggatataatagtttttataaattaagaacatctctagattgtacatcaaactagcatttttctaaatgtatggctttgccactcgaacccattcaaagaatttacacttggggccttatgggttccactaaattt

SEQ ID NO: 12019 - DNA, 687 bp, Vitis vinifera
  Predicted polypeptide sequence is orthologous to G913, G976, G1753, G2514
ctcgaatatggctcggcacgtacccgacgcctgaaatggcggctaccgcctatgatgtagcagcgctggccttaaaaggcactgatgccaccttgaattttcccaactccgttctgtcataccctatcccaaagtccacctccgctagcgatatacgcgcggcggcagcgagggccgctgaggctcagcaagcaaagcccgagagttcggagagcccaaaccccacccaacctaaaaaggaggagacaacagaatccagtagcttggcagcgggggaggatcaattcattgacgaagaggagcttctgaacatgcctaatctattggtggacatggccgagggaatgctggttagcccgcctagactcaagtcccaaccctccgacgattccccggagaattcagacagtgatagtctatggagctacacataatcaaagccagaaaggtggagaagcagaaccatcatcaccatcatcatcatcttcaggtaaaagaattaatatggtaaattttccactttgtttgtgagatttgtttttggatttccttttctttttccaacattgatgttgggttccgaagctgatcgggttgcagagatcccagttactaacctgtaagaaagcgtgtactgtacagctaccattaatgtgactagtgcttatatatctcaatgtcataact

SEQ ID NO: 12020 - DNA, 631 bp, Vitis vinifera
  Predicted polypeptide sequence is orthologous to G913, G976, G1753, G2514
gccgggagagtaatagtgataaatacttctatccctcataaaccccacactctataatatatggctcatagtcatgccacatgacatgcgccaagtagactaaccttgtccagcctatcttctccaatctccatccacacgtgccaaaaccaaaaacccaaaaaagaaaagaaaaaaaaattccaactccggataccaccacgatatggcgtccgcctccgccgggggctcagccaaacagccctcccctgggagacacccaatgtataggggaatcaggagtcggagtggcaaatgggtgtctgagatcagggagccacgtaagactacgcggatatggcttgggacgtttccgaccgctgagatggctgctgctgcctatgatgttgccgccttagccttaaaagggacagaggcggttctcaacttcccggactttgttcactcgtacccggttccggcatcagggtcaccatcagatattcgtagtgcagcagctgctgctgctgcgttgaagaaagcgcagacagacgatggctctgcagcacacagcaggcgtgaagatgatgggaggttcgatgttcatactaatactaatactacgtccgagggaggaattgtggacgaggag

SEQ ID NO: 12021 - DNA, 846 bp, Vitis vinifera
  misc_feature (764)..(764): n is a, c, g, or t
  misc_feature (804)..(804): n is a, c, g, or t
  Predicted polypeptide sequence is orthologous to G921
tctttccaccttcttccaccttagcatccatctcatcagcaatgtaattcgaatttattgatacttctcttggtttggacctcaagcctaatcctcctgcgaacagccttggcgacttctctcctaagagaggagattgtgtggatgtggatgtggaaaggaaaccctctccagtattgaaagaagacactggtggtttggtagaagagttgcgtaggatgagcactgagaacaagaagctaactgaaatgctatcaatcatgtgtgagaattacaatgctttgcacaatcacttgaaggaattgatgagaaagaactctgatcatcagctctttaattcaaggaagaggaaggctgaaagtgaggataatatcaataatattcatgggagtagtggaaataatactgagagtatctctagtgatgaagattcaagtaagaagccaagagaaagcaccaagggaaaggtctctagagttgttgtaaagaccgagaagtctgacaatagcctgcttctgaaggacggataccaatggagaaagtatgggcagaaggtcagcagagataacccttctcccagagcctacttcaagtgctcctttgccccaacctgccctgtcaaaaagaaggtgcaaagaagtgctgaagatcagtctcttctgatagccacttatgagggggagcataaccaccagcaaccttcaccagttgaggtgtcattaggcttcaaccgagctgccactcctgcttcagtcctcagcccnagctccatgatctctccacgcccaacagtaactctgatcntgatccaacctggattagctaacaacactgccaaaaattcag

SEQ ID NO: 12022 - DNA, 437 bp, Vitis vinifera
  Predicted polypeptide sequence is orthologous to G921
tttttttttttttttttttaaaactttatgtaaaaatctaagtaaaacagtagaatagttacaacgtcttggcctgtctccatgtccacatgccctaaacctgaaacctaatttgatgcaaattttcaatccaagcctaatcctaattttcctatgctctaaagttttcaacccaagccgcccctttaggcttgggtgggtcagtcagattcgatatgttcaacttggaaactgctgaattcaaccgtcttaacattggacttgggctgcaagtgcttcaaacctttttcttccccgtcttcgatctctatatttacatacactttgaagcttctgaaagtcaccatttttcagtttgattatggtggaaaattcttcctgaaatggcggctgcaagtgcagccttgaagcttggatctttggtcaacgaaaaggcc

SEQ ID NO: 12023 - DNA, 667 bp, Vitis vinifera
  Predicted polypeptide sequence is orthologous to G926, G2632
ttttttttttttttttttttttttttttttccagaagacagtactatgggaagaatggagtgaagttctatcaaatatcaaaataagctacaatgcccatcactcatttccttgtaaccccttttccccctcactgcaggcacaaaagcaaagccaaaaatgatttgccgcccagcaaacaaaagccgaaaatattttcatttgccttggataaaaaccaaatgaccaagggcttcccagggggctcactggaaggcatggggcctctgaaaaccctggtcagcaaagaagcttttccattgctggtcttcctcccctctctcactcgggggggaatgatttgttgtctgtgagtcaccaggactttggtagtagccgctgccatttttatatttggggggttcatgggtgtcatgtgcttgaggccctcttgcttcttgctgtctactggaggaattccaggtttcagtaaagtcagatggcaaccgctctgaacccgatgaactgacagattgtggtgaaggggctgagcctaaagctgtaaccttttcttcagaagcgtgtttagaagcttcagctgcattctttttggcaaaacggcctccactactccttgcccttctaagggcgtgctggtgtctggattcgtgcagatatggctttcgga

SEQ ID NO: 12024 - DNA, 646 bp, Vitis vinifera
  Predicted polypeptide sequence is orthologous to G926, G2632
gactgtatctcctgaggttgcagagacaccatggattcccaccaacggccatgatttccttccaaactcctaccttttagggtttattcctctgctctcatcccacattagatttggggctaggggatttttgttttcttggtggaaaagaataatgccgactaaacccaaaattgaggatcggcggatagaacctggtggtaagagcaatccgtcatcaacagtctactcccaaccttggtggcatggtgttgggagcaatgccatctccccagctgccttgggtggaagcccatcaaaatcaacttcagttgaacaccttaacagtcatatcacgagcaatggtttccagttacaagctaatggcaggctggatgatggaactacctttaataaaggaacacaacctacggtagccctgcaatctgatggaaggaatggacaggaacaccagcacctcaatcctactgcttcctcaacactgccaattatgagtgaacatcttgaaccaaattcccaaatggaacttgttggtcactcaattgtgttgacatcatatccgtatcaagatccacataatgtggggattatgacttcttatggggcacaggctatggtgcatccacatttgtttggaatgcatcag

SEQ ID NO: 12025 - DNA, 451 bp, Vitis vinifera
  Predicted polypeptide sequence is orthologous to G928, G931
tttttttttttttttttttgttcaaatcatattgtactaaaccaccatcttatccaaattcatctacttttgtatttccgaagagaaacaaaatggaaaaaaaaagtgaaataacagctagtaacaatctccgtatcttgtattcagctgacaaagctatgaactaatgaagaaaacacagccaaggatgactttccaagggacaccagcagccggatcgttcgatggacgatgaacacaagctgctgacacatccactgtctgcctcgtctgtcacccgaggccagacccacctaagttattgctcccagaatcattccttttcatggatccgccaatgtgaggagggtaggtggagaacctgaattctggctgcagaaagacgtcatcactgtttgagccgctagtgacatcagagcaggaggtggtggaagccccttctctgttgttt

SEQ ID NO: 12026 - DNA, 670 bp, Vitis vinifera
  Predicted polypeptide sequence is orthologous to G928, G931
tttttttttttttttttttttttttggagaaacaaaacaatggttcacaaacagagagtttcaagcatagcctcttctcaaccatgtttacagagccagaatgtatgcagttggaaatgggaaaggcagagtatttctactacaccatgaagtttgatgtgtttatcttcttaacacgcatgaaacgaaagtaacaaagccaaggatgaattgcccagaccagtgactccatcgatcttgttcctatcgacttctcaccggacaaccaggagcaggactccattgcccataagtcccaccgccaccaccttgcatggctccacccatgtggggagacatgcctgagaacctgtgctccggctgcctgaaaaggacatcactgttagagacactggtgacatcagagctggatgtagttgaagcaacaaatttgccagtatcagactgatggacttcatactcagttgtgtctcccttctggtgaaaatgaccagagccagatacactatgacagccagcattggaagttgagtccggttcttggagctttttcgtgctgaggaagcgtccaccagatcctctaaccctatttagggcatgaagatgccgagactcgtgcaatatggctttcgggctttgacaagtttgttctgggcctccatctttgctc

SEQ ID NO: 12027 - DNA, 793 bp, Vitis vinifera
  Predicted polypeptide sequence is orthologous to G929, G2344
aaatttgaaaattctcaaggtttctcgtttcccaccatactttttatttattattatattagcagctgagaagaagaagaagaagaacccaaaaaaactgtaacagggacggcacaaagagccatctttaagataatagtgaagctgacgagccgcaaaaacactcagaacttcaagttcagtcttcatctcctgcagctggagcgtcccatcctggcagtgcagctgcaaacattccatatgcaacacctccacaacttggggcaggacatgctatggcacaggcagcctacccatatccagatccttactatagaagtatctttgctccctatgatgcacagccctatcctgcacaacattacagcggacaacctatggtccaccttcagttgatgggaattcagcaagctggagttccttgccatcagatgcagttgaggagcctgtgtttgttaatgcaaaacaatatcatggcattttacggcggcgacaatctcgtgcaaaagctgaatcagaaaataaagttgttaaatctcggaagccatacttgcatgaatctcggcatttgcatgcattgagaagagctaggggatgtgggggccggttcctgaattcaaagaaaaatgaaagcgaacagaacgaagtggcatcaggtgacaaatcacagtccaatatcaatctcaactctgataaaaatgaacttgcctcctctgatagcacatcttgatatccgatcaggaagcaacagcagaaagttgttccatcagcagtgcctgggggccagaagttc

SEQ ID NO: 12028 - DNA, 715 bp, Vitis vinifera
  Predicted polypeptide sequence is orthologous to G937
agaggagtctcctcctctgcacccaatcttcaacccaatttacggaccggaccacagccaccacagcagcagaccgcccggaagcaaagaagatgttggtcacctgagctgcatcgacggtttgtcaatgccttgcagcaacttgggggctcacaagctgccaccccaaagcagattagagaactcatgcaggttgatggcctcaccaatgatgaagtgaagagtcatttgcagaaatacagacttcatactcgaagaatgccgactacctcggctgcccctccttccaatcaacctgttgtagtattgggaagtctgtggatgccccaagatcagtatggtgactcctcaaaggcgagtagttctcagtctgcttccccccaaggtcccctccagttaggcggagctgctggagggacctcaactacaggtggggacagcatggaagatgatgaagatgagaaatctgagagctatggctggaaaagtcaagttcacaaatctgtaaaagaggatgtatagaactcatcccccatgaattttgcagataaaaatagacatgggagggtaaatgactataaaaataatacagtatacgttaagacaatggatcttgagagagagaatgtgaaattttgcaggattagcttcaaaaaaaaaaaaaaaaaaaaaaaaaaaaaaaaaaaagagatcaaaaaaaaaaaaaaaaaaaaaa

SEQ ID NO: 12029 - DNA, 653 bp, Vitis vinifera
  Predicted polypeptide sequence is orthologous to G937
tttttttttttttttttaaatgcaagacagagaactttattatagaaaaggattatcatgtcagcttcctccagtcctccaacaaagggaagagatacaaagcctcaatgaaaaggtgagaagactcaaactgtctaaagaacctgcaaaatctaaccctctcttctaagagatgggtgcctcaaaaagacttcagaatgttagtttcgctctctgtatattatgtttttttttttctaatgtcacagtacgattccccatgtatatttgtatctgcaaaattcatggtgggatcagtgcatgactatacgtcatcttctcctggcttgtgaagctgatctttccaactgtggccctcggatttatcatcttcatcgtactccatgctgtctcctccagtacctgatacacctttagcagacccagctaaatggagtgggccttgtggagagccggactgggaaatgtttttctttgagacgtctccaacctgaacttggggcacccatgatccatttgcaggagcagctgaagtggatgggatcctccggacgtgaagtctgtatttctgtaaatggctttttacttcatcgttagtgagaccttccacttgcatgagttctcgaatctgtttaggagtggcttgagatccc

SEQ ID NO: 12030 - DNA, 906 bp, Vitis vinifera
  Predicted polypeptide sequence is orthologous to G956
cccctcgagttttttttttttttttttttgtagaataaaagatttgatcaatcggtaggcaatagaacaaatcctcattaattctttattaacagtttgttaaatgaagctagtacatgtcagttacctgcagtgagccccatacttgagctcctgctgtccatcaacaacatatacaacacccaacagggatacaactggtctacaaggcaaaaacaccaaaactgcaaccatcctcaagtcatttccaaggtggaaattggcctaaggctgcatatttagtgtaaaacaagcaccattagagtgaaagttggtcaggcaggaacaggtaacggaagtgagaatcaaagggaagaatcccacagttacgtgaaccaagaaggctttgtcgcctccgtgaaatgcactgctcaacaaaggcagcctggtggggtggaaggtaatgtgatatccatacagccagttttgcatcatccacaaagccttttgcaaagcagtgcagcatctttggcaccaataacctccctttgctgctcaaccccactgaggcccgaataaaatcgcgctgagcttcctgaagatcctccctcactttctttgctgtgtagatccttattgctggtgacgaatacatcccacagctgagagcaaaagctacaagaggttcacacgtatcaattgcagacttccgtagctcctctgacaccttcagtttgtgaagggcaagtagcaaagcaatttgtggccgatggacaggtggtttcatcttcagaatcacatactcaatagcagctgcactgaagaatgccccccacagtgtaagccgccttttgcatcaaagaaaagagcttcaggtcacttcttgggactccatatgccagtacgcatgcattatgagtgcatata

SEQ ID NO: 12031 - DNA, 738 bp, Vitis vinifera
  misc_feature (696)..(697): n is a, c, g, or t
  Predicted polypeptide sequence is orthologous to G958
gctctccccgacaacgttatcatagaagtgaatccttaccagcataacccctcatgtttacctgatagagtttggtacttaacaagctctgaggacaccaaatttgcagagggattctggaagcccaagggtgagccctatgagatattttcgaactcttctatcactggttggagaactacttttgaattctatgaaggtaccaccccacatgtccttaaaaccgactgggtgttgcaacagtacaagataactcagaagggacagtccaaaaacatcaagccaatggcctccagttcactctgtagagtcttccaaagcagggaacaaagttcaagccatgaaatgcagaaggaattgggggttgcaaatgttgctgatgaaaaccacacttgttccaagccttctgtggtttcaaatactgacaatagcactgggcaaggttccaaaagcgagtctcaggtgcaacatggcaatggtgagactggactattggctgcgccagaaagatctctgaatcaccctgtagacaacctgcctgaaattgattatttttctgatggtgactttttggagttgggggatcttgctgacccagtatcaccttcttccagttcagacaattctagttgcctaagccagacatcagatgaatgttttgattcattagccttgttgcgagatttagaatgtganncaggatgtggtttgcagtttagtgttgctgcatcggtcatg

SEQ ID NO: 12032 - DNA, 838 bp, Vitis vinifera
  Predicted polypeptide sequence is orthologous to G962
aatctgatttttagtttctgcttgtattatcaatgttattaaatagaacaagtatggaaaattggaaggagatctctcacctatgttagatttttttgatcagtgcctatgttagatttgatcacacactgccattatttagagtcaagtggtcatgctactgatgtaaactaagagagatgtaatgctcttgaacatttcatagattttaccattaagattggtgcatatgctagatatgcatatggcacacaggccaaataaatggctggtttcaatattatatatgccttcatcagtgttattcaaggtgttcgcctgggtcgccttggtgaccatgcaatggaaagtatggggcagtcccctgttgtagacccaggtgaggcatcttcaaacactagctacctagggaatctcctcaacaaagactccaaggtgataggatccgtgcccttctgaagccgaggtgacatagttatttttagatattggtgcctcaatatggaggctccctatattcgaaaacaatatatcattgtgttagatacatctctcataatgttatgtcttgtcttattagaaaactaaacaatcggaagttattagtagttagaacttcctgtctaccagctggagtaaattagaatataaattgtgaacaagattattattattattattattatcatttttatttgaactagttcaatgctttgtatgttaaagaacaaaaatttattactattgattgttgaatgattatcatgatgatgacgctgaagatgacattatatcttttttagcatctccgcaaaaagataaaaaaaaaaaaaaaaaa

SEQ ID NO: 12033 - DNA, 466 bp, Vitis vinifera
  Predicted polypeptide sequence is orthologous to G965
ttttttttttttttttttttttttttttttgaagtctctttttgggatctaagtcttgtgcagtctcttttaacaaaacttttccataatttttattacttttaaatataccttttatttgtaatgggccattggagaagctatgagattgtgatttagagcttatacagaaggcaagaaaggaagaaaagaccacaaaacaggtgtgagtgaacatacaattatgcccaagaaagtaaaacatggtttaagtagtcaagaaatgtataataatacaataatcaattcctttgtgcatctcttacttcatgttgatcatctaggattcagtctgatggcttttcgtattctacaatgcaggcggaccaaaacaacagaatggaaccacacgtcaataaagaaaatacaaaatgattggaaggttcatttttatatacaaaaatggtatgcgcaataatggattgca

SEQ ID NO: 12034 - DNA, 654 bp, Vitis vinifera
  Predicted polypeptide sequence is orthologous to G977
ttttttttttttttttttttttttttttttaggaaatagttccattgggatttgcaggtgcaccattatacaaaactaattaagctcgacagacccagaatgaagcaactcctcgatcatctgctcaatatgatcatcttcaagaaccttgaattcctcgtcttccccaccaacccttttgccctgcacttgtcgccgtctcttcgctggtgacccgacatccacttggcggctatttccggcattgccgtctgtggcgaaatttggagagtagtgaggttgttggaggtgtgtagctaaaggctctttggccgcttgaagtgatgccatgtagcatctatgcaatttagcagttaaagtcgccgagagaagcctagacgaagatgattgtgagtcgttgggattgtaactgaagttggtgcgagctcttggcccacacatgagcctggctgcttcatcatatgctcgtgccgcgtcctcagccgtttcgaacgtgcctagccatattctagtcttcagtaaaggatggcgaatttcagagacccaagagccccaatgcctctggcggacgccccggtatcgctgttgttgttttccagccatggtgtctctgaggtcgagatggaagaagatgagaagaaagaaggattcccc

SEQ ID NO: 12035 - DNA, 492 bp, Vitis vinifera
  Predicted polypeptide sequence is orthologous to G979
ttttttttttttttttttttttttgaacagaaacttgctcacttcaggtaataaaggataaaaaaggaaaacaaaatacaaaaacaactgcatgcaggagtcaactcccctcttccttatgcctgccctttttggaagaaaaaaaaaggaaagaaagaaaaagccaactacattttgaagcttcccatcaacctccaattcatgcatgctcccaaacaacccccttcacatagagtaagtacaagaagccaaggtagttgttgaggcaggagatgctgaatcacaacctgaagaagaagaagaagatgaggacaagccattctcctttacaccattttctgcactattacactcttcctcattgcctgcagccccttcaaacatgtagtcaatgttgtcctcaaaccccttctcataaaacaaatccgacaactccccaccctttccgaggggcacgtccgggactaggagggtgctgtaggcacagaagtt

SEQ ID NO: 12036 - DNA, 536 bp, Vitis vinifera
  Predicted polypeptide sequence is orthologous to G987
tattttcaatttattctgtaccgaaaatactggggtacaaaaattcacatgcattaggccaaactgctatcatacaaaatttcaatcaattaccttcatagtttgaatataaattaaattaaagaccctaatgggacaaagcttacatctgaaaagacgataagaagtcagagcacgcgcacaagaaaatggagccccagggttgtccagttctggactcttacgcgggaatccagcaggaggaagcatagagaactcggcccttccaaccctgcagcagccaatccccatctttatcaaccaaaaaatccttatgatggcccactttcaccttggtcttcaatttctttgcgagctgctgatctaacttgagttgcctgaacccagctttcagagtccgaacgtgccactgcttgtatgtctccggcctctcgaccctctgggatccttcacatgcgatcacattcatcacctcccgcccgcagaattctttctctctctctccctcgtgccgaattcctgcagcccgggggatc

SEQ ID NO: 12037 - DNA, 656 bp, Vitis vinifera
  misc_feature (77)..(77): n is a, c, g, or t
  misc_feature (598)..(598): n is a, c, g, or t
  Predicted polypeptide sequence is orthologous to G987
ggcattacggcggggaatacaggaatagagcttcccaaccgggtttccggccagcaaaaagagttgaggagacaggncgccgactggcaaggtattgtgagcgattcaatgttccatttgagtacaatgccatagcaaagaagtgggaaactatccaaattgaggatctcaaggttgacagcaatgaggtaattgctgtgaacagcatgttccggtttaagaatttacttgatgagacaattgtggtggacagcccaaggaatgcggttttgggcttaatcaggaaaattaatcctcatattttcatccattccatcactaatggttcgtataatgcaccattctttgtcacacggttccgggaagcactgtttcacttctctgcagtgtttgatgcgttgggtaacaacatagccagtgaaaatgagcacaggttaatgtatgagaaagaattcctggggcaggaggtgatgaacgtcatagcatgtgagggttctgaaagggttgagaggcctgagacatacaggcagtggcaggttcggaccctgaatgctgggttcagacagctcccattaaatcaggagctcacaaagaaatngaagaccaaggttaagtggggtcaccacaaggattttttggtggatgaagatgggaat

SEQ ID NO: 12038 - DNA, 680 bp, Vitis vinifera
  Predicted polypeptide sequence is orthologous to G987
gcgatgttatactattcatgttgtttggcatttatcgatttgtgtgactatgtgaatgtggggcttcattggttttttgtatatacaattgagcttccatcatcagatgttagtatgtgtgagcttcattgttgaagattttgcatcacgtgggatgtttaaaggtcgtaatgccagaaaatttctgggtaccaacgtcttcaaaaatttggtgaaatggaaagttgagtcattttcaagaagtgccaaatagtgttcttgtgttaactgctataagcagaccggtgatggaacttttttattccatgtttcacctcttttgggaaaacaaagtggggatgcagtttaaaatgatgtgggttcttacctttatgacaaggctaggtttggtattcaaggagaagcgagaatgtaagaaaggaaacgaaagactgaggagaaatacaattcaaaattgattcaaataaagtttttaattcactcttttttttttctttttttttacttctttcacctttcagaaagaagtgaagaatttcaaaatgtatgaattagggtttcatatttttttcattgcaacagataagttatcgattttccttctatcattttttgttttttcccttctcttgttggctacttatcttcaagattcaatcagagactaaagggagactaaa

SEQ ID NO: 12039 - DNA, 800 bp, Vitis vinifera
  Predicted polypeptide sequence is orthologous to G1017, G2567
gttttttttttttttttttttttttttttttgttgattgaactaatgcatttattttaagggaaattccaaaattcaaagattgcttcctcagttgtggaaaaaacaagaatctgggaggctttatactggaaagtccaaaactgcatcaaacgagctccccatctccccaaccctaggaaggataaaaaggtcagcatggaacaaaggatctggtcatccagctgtacatttgacaatttgaggtttcttattttctatacactcctacattgtcgctgcttgaatccattaaaattgtcaaccttttcgctgtttttgtgaagtcactaaatggttcatcgccgatatgtttgactgcaccagttgcatccctatagagcacatggttccgcatctcagaatcttctatagtaaacatttttgccagcttgccgcataattcatcataagatgtaagtaatgaaagatcaagagtgcgacccacatcctcagattccatgaaaaccttacagtgaccagtctccaagttgggctcggtttcacggtgattaaccttgtatgtttggtacccttcacaggatgagtgctctggaaggccatgttgatgaagtgcagatccagaaccatcagaaaaatttgccatcttatcttgattcccttctgatgaactattcccagtaataactggtgagaccgtatcaccagagcagctttgggacatctgttgctcagttagtattgatcgaccaaaaagtgtaaatcctgtctttctatcatcggatttctttgaaggctctg

SEQ ID NO: 12040 - DNA, 702 bp, Vitis vinifera
  Predicted polypeptide sequence is orthologous to G1020
gctctttctctctttttctctctctgtctccctctgttttcgttttcattcactgttttcacaaacacttgtaccaaaacacaaaacaaatggcgccgagagacaaacctaccggcgtaaccgccggcgctaccggaaacaaggagatccgctacagaggcgtgcgcaagaggccgtggggcaggtacgccgctgaaatacgcgatcccggcaagaagagccgcgtctggctaggcacctttgatacggccgaggaggccgcgcgtgcctacgatgcagcggctagggagtttcgtggagccaaggcaaagactaacttcccttcgcctaccgaccttgcggcagctgccgcgactactgctaaccggagccctagccagagcagcaccgtggagtcctccagccgcgaggcgctgtctccgggtgcgatcgctggtcctccggctctagatctcaatctgtcacaccccgccgccgccggccaattttccgcagttcgttaccctgcggttggtgtttttcctattgcgcagccgttgttcttcttcgagccattttcccgtccagagaagccgaagacccaccgcgatatgttcgatttagatcgagcggttgccgattttcaccctgcgattgccggtagcgttcacagcgactccgactcatcctccgtggttgatttcaattaccatgaccgcagta

SEQ ID NO: 12041 - DNA, 762 bp, Vitis vinifera
  Predicted polypeptide sequence is orthologous to G1020
gcacgtttcaatcacctaacaaatggctctcaaggagaaagtgaaggaaggagttaaggccaaagagccgcatttccggggagtgaggaagaggccatggggtcgctacgccgccgagattagggatcccaccaagaagagccgtgtctggctgggaaccttcgacacggcggaggaggccgccaaagcctacgacgccgccgcccgggagttccggggctccaaggccaaaaccaacttccctctccccaacgaagtcctccccttccccaacaccgacaaccacacccgcagccccagccccagcagcaccgtcgagtcctccagcccccacgcgcctctcgagctcgacctcacgcgccgcctaggaagcagcgacggtggctttccgttccattaccagccgcacgttgtgaattccgctgctgtggcaggcgtttggcctcacgcgcggccagttttgtttttggatgcgtttgtcggggcggaggggttccgagtcaacccggttacagtcgcctacgatggcgggtttgggagcccggttcagagcgagtcggactcgtcttctgtggtggactcggtccagcatgagagcagtggggcaacgagggttctgggtctggatcttaacttccctccacccctggaggcttgattttacctggagtctccgagtttctaaccgctagcggctaagcttatattaatattttttatttttcaatttctaggacaatatgagaatgtttgatggtctaa

SEQ ID NO: 12042 - DNA, 646 bp, Vitis vinifera
  Predicted polypeptide sequence is orthologous to G1020
ttttttttttttttccctattttcttcctatggtagaatagataaggaaagagaaaatttttcaagggaaaaaaaaaacgaattgaaacgttatccagtgaggacgcaaagatcagagaagtattcaggcgatttcaggcgggggagggcggttcagatcgagatcgatgagaacgcgtgcgcgaggcttgagatcgttgtggttcaaatcaaccacagatgatgagtcggaatcgctctggaccccaccggtaagcgcggcgcggaaatcagacgccgcacggtcgaacctcagtctctgaaaatcttgattcactctcccagtccgtaacatcgcgtcaaagtagaaaaggtgattcgccgcaggcaagcctccggtcggaacaattccggcagccggcgaaggggaggaaacttgaaactgatgatgctgaaacggaaatctcaaggcagtggcatatccagcagcagcaccaacgccaacgccgacgccacctccgtgcagcagattaagatccgatggagaggaatcaaccattagagccggcgaaaatccctcccggctggaagactccacggtgctgctctggctcggactctgattattgttgttcagattctcagaaccaaggaaagttggtcttcg

SEQ ID NO: 12043 - DNA, 510 bp, Vitis vinifera
  Predicted polypeptide sequence is orthologous to G1033
gttttttttttttttttttttttttttttttgggaacctacaatactatatttaaccaaagaagagagctgatgcaaagtgtacaaataacttaacaagataaaatggcagcacaaggtgcttcttttcctgtttcgagaagcaccacaactgtaaaagtgttaacatacagaatgcagcattgttgcactggatcagccagaatgaccaattcagaaagcatgcaagctcagtcttcatcatcatcctcctcctcctcctcttcctcctctgcactctcctcatcattgatcattcacttcagattttgacctgtcagattcttcatcaccatcatcagcagtgctctcctgcttcttgttgtaagcattcataattttttcgtactcagccttcttttttgcagctttggcctcatatggagctttttcagcctcagacaaggatttccacctctctccgccagctttcccaacagctgagacagccttcacattgggattttccccc

SEQ ID NO: 12044 - DNA, 910 bp, Vitis vinifera
  Predicted polypeptide sequence is orthologous to G1033
ttttttttttttttttttttttttttttttatgctgaatcattgagcattaagaaaaggtgagtacatggccatatgaacgaggccgctcctgaaactaagctttcacctaaaatgggagcagccgaaatttcataaaaaaaaaaaaaaagaacaaaaaaaaagagaactatttatcttgatagagttatcagaaatgggagtcatgatatcctagcgatcctacacaactggcagatctcccttgttgacatccttcactgctggttccctactcttcatcatcttcttcctctccactctcatcctcgtcttcctcgtcgtcgttcacctcagacctagatttgtcagactcttcctcctcagcagcagtcggtccctcagccattctcttgttgtaggcctgcatgctcttgttgtattcagttttccttttctctgcctttgctacatagggcgctttctcagcttctgacaacgatttccatttatcaccaccagctttaccgacaacagacacagatttgttggctggatgcttttctttgtactgcttcctaaactcctccatgaaaacgaagaaggcactagcaggcctctaccattttctgcctcttctaagattgataaagccttattcaagtagccattcttacacaatccatgaaccaagaccccataagtcatggaatctgcacagcaatctttctctggcaaaagctcccaaattgaaattgtttcatccaccttcgcattctcaaacaaccctctgattagtatgttgtaactaacaacagtacggcaaccctccttctccattaccttccacaactccaaacattcctcaatcctccctgctcgcaaatacccattaagcattgtattatatacaaccacatcaggagacaccc

SEQ ID NO: 12045 - DNA, 859 bp, Vitis vinifera
  misc_feature (51)..(51): n is a, c, g, or t
  misc_feature (847)..(847): n is a, c, g, or t
  Predicted polypeptide sequence is orthologous to G1033
tctcttctaacatgaaggctgccaagggtaagggggcagcaaggaggcacncaaaggaagcattgaagcctgctgaagacaggttagattgtctatattttgtcttgtgaaaaattcttacattctttggggagtttgtttagtttgagatgactctataaagctctgttccttgtcatgttcttagttgtcagttttgtggctgagttaatgagttctatcatatttgatggtggatacggtggttacaggaattttgtagttatggatcatgtatctctattcttttcagaaagattgggaagcgaaaggctgctgttaaggcagaaaagagtagcaaaagagcgaccacgaaagacaaaaaggccaagaaagaccccaacaaaccaaagaggcctcccagtgccttttttgtattcctgtatacatctcctcctgtttctcagtcaagttgaaattgcttcaacttgttgcaactgaattttcagatttcccttgacttacatcttgttaaaactacagtgaggagttcagaaaggtcttcaaaaaggaaaatcccaatgtgaaggctgtctcagctgtaagaaagcaatgttcttcaaatacttagttttatagtttttttactagttctatttgataaatttatttttggaataagaaattgatttagtcactgcatttggcaattgaaggttgggaaagctggcggagagaggtggaaatccttgtctgaggctgtaagtatttagagattttcctcttccctttctaaaagtactagcttggacacgtccattataatggaagatcacaagccttttgaaatagttgtcttccacttagnaatccagtgagg

SEQ ID NO: 12046 - DNA, 694 bp, Vitis vinifera
  Predicted polypeptide sequence is orthologous to G1033
ggccaagctttctgtgaagaaaggggctgctgctacgaaggcaggaaagaaaacaaagaaggaaaagccagtaaaggaccctaacaagcctaagaggccagccagtgcctttttcgttttcatggaagagtttaggaagcagtacaaggagaagcacccttccaataaatcggtctctgtggttggcaaagctggtggggataaatggaagtctatgtctgaagccgagaaggctccctatgtagcgaaagcagaaaagcggaaagtagaatacgagaagaacatgaaagcctataacaaaaaacaggctgaaggtaccaaagtagtagaggaggaggatgagtctgaaaaatccctctccgaggtgaatgatcaggaggattacgaagatggcagtgaagaggaggaagatgatgagtaaaatttgctgacgagggcagtgtgcgtgcagatgcattggccatcaaaatgtttgatcatctcatgtttagtctctcggaacagaaatatggcacaatgattgatcatttcttttaaatgtttttcctttttttggatgaaatatatatcctccagctccactgtgtttcatcttgttttgctccttaagaagatgaatagtgaacgaagaaaaatctgctctatttgtactttgctctcagattttagtgatttagcaaggggtttcttttgt

SEQ ID NO: 12047 - DNA, 734 bp, Vitis vinifera
  misc_feature (707)..(707): n is a, c, g, or t
  Predicted polypeptide sequence is orthologous to G1033
gattgttttcgtcttcaacacctttactctgttctctcctcacagctgttcccttcatttctctcctactagggaatatttccttcaacaatgaaggttaccaagggtaaagcagcggcaaggaaagacaaaaaggaagcattgaagcctgttgaggacaggaggcttgggaagcgaaaggcagcacttaaggcagataaaagtaccaaaaaattggcaaagaaggaaaaattggccaagaaggaccctaacaagccaaagaggcctcctagtgctttctttgtgtttctagaagagttcaggaaggtatacaaacaagagcatcccaatgtgaaggctgtttcagctgttgggaaagctgggggagagaagtggaaatccctgtctgaagctgataaagctccatatgaagctaaagcagcaaaaaggaaatcggactatgaaaagcttatggcagcatacaacaagaaacaggaaagtatggctgatgatgatgaagaagagtctgacaggtcaaaatctgaggaagaggaagaagatgaggatgaggatgaggactgaaactagcatgttttatagattaagtccttatggttgatcaggccataaattctggattatgtaatgatcataccttcgggttgtgtgtgattggttttgagatgggaaagcttgcagcctgtactgctgctaagtttccatgttangttacttgtgtatttcgtatgcatata

SEQ ID NO: 12048 - DNA, 779 bp, Vitis vinifera
  Predicted polypeptide sequence is orthologous to G1037
ttttttttttttttttttttttttttttttcatgcaagaagcaattgcaagtactatataatgattttcataaattcaaaagttattacattaaacaaattcagtataaaattacatgggcgatgaggctaattcatcaaagatggcaccacttttgttgcaccaacatctacttcataaacacgtcccaagggaataagcatcatatcctaagtctccttccatcaatgtcgtcttgtcctgttcctgtttcatcattgcactcactaaatcttccaaggaaccaacattattaaaagcatagctgctttggggttttctttgccccaaggggcaaccttgcttcaactgcaatgctgtatctgaagctgattcctcaactgcattctgctgcatgggcaagggattgacaaaattcaactcccccatcaaattgaaatccatatttctgtcaaatattgtgtttttcaggtccaaaccctggtcaaatgcacccattactccaggagcagggatcaaagagtttgctgagctgcatccaaaacttgaatggtgaaagagcttgtgtttatggtcatcccacacttttggggaataattcataatttttacagaattactactgattgtcattgcttgacattctaaatctgttcttgaatctggcagtggaggaggcattgaagtgacacaaaaaacatcacgtaaattattcccactttgcagggtcactgaaaaaatattgtctctcaagttactaggatgcaaagtaccctgtt

SEQ ID NO: 12049 - DNA, 961 bp, Vitis vinifera
  Predicted polypeptide sequence is orthologous to G1043
tggagaggcacacagacgccaccatgagcacaatggagtgcacctggtcggaaaagatctccggcgatcggaaaagagccatcgacgagctgcttcgaggtcgctccttcaccaagcagcttcgcagcgtcctcctcggaggggatcaacaggagtcggcccaggatcttctagtgaaaatctcgaggtcattcaccgacactctttctatattgaattccggcgagtccgacgaggccgtctcacagattccggcgagtggtcagctgtattcgccgggttggcatggccggaggtcggaggaatcttgcgagagtggtaagagttccaccaaggatcacaggggctgttacaagcgaaggaagaattcacaatcttggatcagaatcacccctaattttcacgatgacggttatgcctggcgaaaatacggacaaaaagtcatactcaatgctaaacatcaaagaagctactataggtgcacccacaagcatgaccagggctgcatggcaaccaaacaggttcagatgactgaagaggagcccccaatgtacaaaaccacataccacggccagcacacgtgcaaaagcatgctgaagtcatctcagattatggtggaaaattctactgcaagagattcttccattctgctcagctttgaatcaaacaatcaagatgatagcaacgcctttttctcatcattccccttgataaaacaagaggaagagatcccaaatgatgatcaggaggtgacctacaataaccataccaataacaacaacaagaacaacaacttctcatcctctgattatcttctgtcactggagctcaccacatttgaatccaatctggggtctgatcatggtgatgtcctttctgggggtaactcttcttgtacggacagcactcacagtttggatgatatgatgatggactttgatgatgttcttatcggttttga

SEQ ID NO: 12050 - DNA, 795 bp, Vitis vinifera
  Predicted polypeptide sequence is orthologous to G1048
ttttttttttttttttttttagttaacaaagaagaaaaagtgggttctaactggaaaactgaggaacagtgttaattcattttacagagtacaaacatctcaccagccatttttcagtccactagctcagcctacaccatcccctaaaccccacaggataaaataaacaacgaaaacagggggtatataggggaacataaatgtttcacaccaaaactccatgagcaagagaacctggtttcatctttgtttttgaagctttgcatctcttactcttgacataagactgtaacaaccataattcaaaaattttacttcctggccctcttggagccacacttttctggcctttgtcttccacgcttcccatcggaacggcttcccgacttaactggaactgtacgggaagagacagagctagacacatgatgcccaggaaccaaagcagggaacccaacagcagggattccatcaagagcacagcagactcctgcttggtcactgaagcaccaaaggccttctcattctgcaagtgaagacgtagagtttgattctctgcaaaacagcactggagcaaatgccccagccttctgcattccgattcaagatacctactcttcaactccaaatctctcacatacgtctttttcctctcccttgatctcactgcagcatcccgatttctcaactgccttcttcgtttcttagaggcctgatcttcatcctcccctcgtgccgaattcggcacgagggctctctctctctctctctctctctctctctctcctcggggcg

SEQ ID NO: 12051 - DNA, 785 bp, Vitis vinifera
  Predicted polypeptide sequence is orthologous to G1050
cgtcaatcagctgctcgctctaaagaacggaagatgcgttatatatcagaattggagcacaaggtccagacattacagacagaagctactacattgtctgcccagctaactttgttacagagagattctgctggactcacaagccagaacaatgagttgaagttccgccttcaagccatggaacaacaggcacaacttcgagatgctcttaatgaagcgttaactgcggaggtccagcgattgaaattagcgactgcagagttgggtggggaatctcaggcctctaagtgcctcgtcccacagctttccgtcaacccccaaatgttccatctccaccaccagcagcctacccaactcaacattcaccagttgcagcaacaacagcagcaacaacacaatcagcagcagcagcagaatggcagcacaaccacaaagcatgaatcaaaccaataggtttctaaaaagatgggaatggctcggagttctaggaatgccctctccaagaatcatacggatctcaatattccatactaccttactctactaccctcgatgcctttattcattttagtctgtgtctgttgggtccggtccgcacaaaagtcttgtttttttcttcttcttttcaagttgtggtactctctacaagttcagacttaagtatgaagtcatatacaggtcttttatatttaatttttatcataattatagctgttatttatctctgatcgataaccatattgggaatgtaaacattatttagacatgttttgttatatcatatg

SEQ ID NO: 12052 - DNA, 601 bp, Vitis vinifera
  Predicted polypeptide sequence is orthologous to G1062
tttttttttttttttaatcaaaaggagaatttattctaaagctggaattactaacgaaaatactgttttcaatgcttctaaagcatgactaagaaaacatatcccgctgacaatttatccaacctaccattctcatttaacatttgttgacctacttgaatttggcctgaacacagcctgtactactgggaaatgagaagagggctgcatttatgaactcctcgatgtatagaactacagttagtgccttcatctgtaagcgggtttcattttcgggcgtttgagctacagcataccgtggaagcctgccgaatccagaagtactgctttgatttgttcaggcagtacatcctggccttccctgcattgctcagctctgaatacatccaatgcaaacccattgaagcagctgatgacagcctgctggatgtccaatccaaggttgtccagagccctcattgtggagagcaggagacctggtctgcgggcacaaaacatatgaatgtttacaggccttccttctcttacccttacctccacccttgctggttgacttttagggcttggcaatgagctagggcatagctcttctttgacacgg

SEQ ID NO: 12053 - DNA, 708 bp, Vitis vinifera
  misc_feature (598)..(598): n is a, c, g, or t
  misc_feature (671)..(671): n is a, c, g, or t
  misc_feature (681)..(681): n is a, c, g, or t
  Predicted polypeptide sequence is orthologous to G1062
gcaacaaatcagttaaaaaaagtggaccaggaagttagaagaaaccattggaacagaaaattttagctatttcaccaacgcgggtaaggaggcagtaagtctcctcaaattacccaagcaatgcaaaacactgtgatttagaacaacaaagaaaaaaatacctatgcagctcctaaggtcatcagaacccggtgtgattcacagagccaaaagaagcattgtatgaaggtaggaatgaaaattacccttggctgactattaggacttggcaatgagcccgggcagatttcctccctaacacggcagggcaaggtaggaatagttggtgtcaatggctggaaacttgaagtaggctgcaataaagattgaggtgtgatagactccagttcattctggaggtcgttgatcctctgcagtaactccttcaagtactcaatagcatccgccaggattgaagctctatccatctatcaacaaaagaacatttaaacaggtaatcctaaatatcttcccaaaccatccaattatgcaacagaacaatggattatcagtctatgatcggtccattttcccagatcttagcatgcccttttatcanacaattcttcaagacaactagtttctctgattcaattcctcatctttaatcgtcaaatcacagcccaatcttnaatgactctncagaaccagtaattttcgggcatttct

SEQ ID NO: 12054 - DNA, 677 bp, Vitis vinifera
  Predicted polypeptide sequence is orthologous to G1062
tttttttttttttttccgacccagaaaataaaccgatgtgtagatgcaactaactgtcaaaggctagagaaaatttaaaaaagaaaagaaaattttcagataaacgaggcccacatccaagcaaaccccacactgaaattcaccagaaaattctcaccttgctgatctttggaacaacagacctcagcatgtagagcctatcgttcagcttctttctccggcgcctctcagccatcaaattcttcgccggcagcccctttttcttcccttttcgatctcctccaatggaagatccattcaaatttgagttgtctccaccatcatttgcagtctcctccaccttgtggttctcaattgcatcatcagaatcgtatatcaaaccggaccgagcagtgctggcttcgtccatatcatcctcatcattgctcttgtcctttctcatcttgtccatttcttcttccaccaccggcctcttacccttatcttctccggcaactctaaccggaattgcactgccttcttggcccgaaactccataattccccgctctttctgtcgaatttcgccggagaatcgctctcttctggaacagcgtgggctgtgacccaactgaagggagttctcgagcggtttcacaccttacacctgtccacaacagagaactcccacaaaccctc

SEQ ID NO: 12055 - DNA, 815 bp, Vitis vinifera
  Predicted polypeptide sequence is orthologous to G1064
cggttctagcatgtctgcaccttcccacctgaggagtagctactataatcccaactttgccaggaaccggaccgaatgggaaaggaatatcgatgaatctttgcgcagaattgtgctaccgggcgttggattatcatcggagaattcgtcttctacccttctgaatttttcttccagtagtgtgaatgccatgttacaggcaaagccggagctacgtgagacttgcttggatgtgtcagatgccgaggcaaccatagggagaaagaggcagccagagcaggatccgtcccatagtcagatggggaactacttgttgcagtcgggttcggggtctatcccgtccactcatagtcagattccgaccacgttttggatggtgactaatccaagtaaccaagtgatgagtggggatcccgtgtggacatttccttctgttaataacagctccatgtatagagggaccatgtcaagtgggctacattttatgaattttcctactccaatggctctcttgcctgggcagcagttgggttcaggaattggtggaagtgggggcgtggccgatggccacttgggcatgttagccgctctcaatgcgtttaggccgcttcctggcaacggggcaccggactcgcagcagactgcttcacatccccacaacggaggagaccatagacatgatacaactagctagccctcaccagttctagagatgaatcacaagtgtatggtttgatgcttttattttgtttttcttccctttctaaatatatatcggcatttacaaaaaaaaaaaaaaaaaaaaaaaaaaaaaa

SEQ ID NO: 12056 - DNA, 243 bp, Vitis vinifera
  Predicted polypeptide sequence is orthologous to G1069
tttttttttttttttttagcgaaaagaagctaaccatctttttattacaaacagaaaggaagcaaaaacaaaggggtttaatatacatagagaagcacggtttcttttttgttcgcatccaatttccatcgatggaaggtttgcaaaaacctctcatggcctttcagcgctcttgtgctcagtaagggggccgagcatgagcccatgagtaggggtcatgactcaattggccgccgttaggga

SEQ ID NO: 12057 - DNA, 562 bp, Vitis vinifera
  Predicted polypeptide sequence is orthologous to G1078
ttttttttttttttttttttttttttttttataagaaaaaggccatatatttattcagctgctaaaagagcgaacctctgatacaacaatccaagcaatttcctatacagaaacattccctttccccccttcccctaccaaaatggatgataaaaccgcaaaattccacatatttacacatcgaacgaaaaaacaacaaaataaaataagagctcatctctaaaaaaatcccagcccttatcggtatcaacttacctcaaaaacttccacaaaagaatattcaagcagcaattgcataggatctttcacataccaatgtaagtgcctccatgaacaggccagaaaaactggtcattgcctggaaaacccctggcaagcctgtttgaatgttattcagtgtcaatgctctggtcacttctaccgccttggaatgcctcaccatctcatcttcaactcgcctttggcaagctgcaagctcagctttcttctcagaaagtgggtctcgggcatccaacccctgcccattgtcaggcccagaatcaggaagccctataccaacccc

SEQ ID NO: 12058 - DNA, 397 bp, Vitis vinifera
  Predicted polypeptide sequence is orthologous to G1082
ctttgggaacggggtagactagaaatgcgccagagggcgctggttgataaggatttagagcggaaagttaaggacttggatagggaggaccagaagattcagaaggagattcaagccttggacaaaaagatggttccaattgcagggcacagtgacggcctcgcattagctggacatcttgtgtaccaaagtgaaaccagcagtaataatagtatacatgcgaatttgcaacatatttttgaatccatggagaggttcacagctaactccttgagagcctatgaggagcttttacaacgaattgaagaagataagcttgctgaggcatgagagtttttaatagtggcaagtgaaatgaaatcctcttgccgaattcctgcagcccgggggatccact

SEQ ID NO: 12059 - DNA, 631 bp, Vitis vinifera
  Predicted polypeptide sequence is orthologous to G1082
ggatgatcaatgttggtagtttacagtctggtctgcggcagatttttgaggccatggagaggttcacagccaacctgatgcaatcttatgaggagcttcttgtaagcattgaagatgcaaagtgtgctcaagagaacccataaacaccatggatttttgcccaagtgttatcccacctgcttatctggttctttgttggtccccaagcatgattatctctgaatggcctcctagaaattgttcaattatgcaatacttctttccagggaaattttacaaatgctggcccaattccttgttgaagtcaatgagggcaaagtgattttatagattttatcttcattggagccaagcatcctggttgccttatcggctgaaggtcattgctgaggacgagaccagtaactttcaatccccgcaaccaacttcctttccaacccatgctttaggatgttaagttctgacagaactgaagaaaagcaggactacacaaggtcgtcaactggagtgtggcttttgagtagtgatatacaagctgcgtcatcagctgtctctcttcttgtcatgtcaaaaacaaaatgctcgtgccataacaatcagctaagctgaactcatcaggacaatgctgact

SEQ ID NO: 12060 - DNA, 783 bp, Vitis vinifera
  Predicted polypeptide sequence is orthologous to G1082
tttttttttttttttttttttttttttcgccacaaactagaagcactgtttcacattaaacatggaacaggattcatttatgggaagaaaaaattcgaaaagaaagaagcaaagaaagcaaaattaaaagggaagaagagaacactcttgaatgactgcgaaagttatcattttaattggcccaaaggcaatgagccacacaaaggggttgcagtcttcacaacccccagcaggacccatgaaatttttccccttccccagctgctcacatgaccaaatgaaggtagggttccatctcagacctcttcacaaaactatatcctttgccaccattcatcataagaagttttgggctgacaaaatctgccattaagcattctgctgagattcaagaaatataaatcttactgtgcatcttaaaccctgacttgcttcttcccaaatcattgttgcaagtcaactccactagttcctccatttgctccaccaaaacctataatcacctcttgagaatctttactctcaggttcaacaccatcttctttagcaggcaccgtgcaatccagctctccagtgttcacatccgtgacatccaaaactcccttatcaagatctcccaacttagtgtccttgccctcctccaaagaatcctgcaattcacaaaaataaaaaaacacaacacctatatgacatgtcatcgttgagatacacaaagcccaaacaaacctgatacacacaaaccttcaattcaaccccattagcatttgaatcctcaaccacccc

SEQ ID NO: 12061 - DNA, 789 bp, Vitis vinifera
  Predicted polypeptide sequence is orthologous to G1108, G2394
ctttttttttttttttttttgatgtgcaccacctgatggggtgtgttattgaacaatttttggtatataacagactgtcaaaaggcacttgcctggtataacaagtatcttacaacctttcttaacctagaaacatcaaccaccaaaaaaaaaaatccatgaatgaattttaagtggtcattcattcatccaccatcagaagaacgaaacctaaaagtaccagaagcaccaattcatacataccatatgtgatgcacatatacttgaaaaaaaaaggggggtgacatatacttgtcaagtaaacatatttgctccacctgagcctttcaaccacaccaccattctcaccctctttcactagttgatacttaaccctgagagtgaacctaaaaagctctcaccgacctcacgcttgcagaggggacatagagcattgatcttcagccatttatccacacactccttgtggaagaagtgagaacatggcagctcccgaagctcgtcgttgtttgcatactttgccaagcaaatacagcatactgcatcttctccagagatcacccgctccctttctgttccagctgctacaaccccaccttcgcccgcacctgaattgccttctctatcatcgccatttctattttttttcagcttgaacttgtaggttggaagagcatttattgattctgatgtggctcctctagtctgtgtcagatcctctctaagccaaggatggaaattatacaagggaggcagcagcagattgtagcacatagaatcggacgcgtg

SEQ ID NO: 12062 - DNA, 947 bp, Vitis vinifera
  Predicted polypeptide sequence is orthologous to G1108, G2394
gggggttatggatatccattgagatatttttcactacaagcccgattgttgcatccatagtagtattgtccttgtctagagatgagaaaccacaaactccgttgtttgcttgggttgtgggttatgcagctggatgtgcagcaagccttcctattcttttctggcgttatcttcgccgcaaccatgatggtgagcaaggtttaaatcatatgcttcagggttcatcacaaggaagtactacattggaatctaattcgtacataactatctcattgacccggtctgcagcagaggaaaatctcccagatgcgtctacaaacacttggaatggtcatactatgggtgcttcaaatgctaggctcagtatattagcagactactataagatggccctggattgcttctttgctgtgtggtttgtggttggtaatgtatggatttttggaggacactcctcttttaccgcagctccaaatttgtacaggttatgtattgtgtttcttacctttagctgtattggatacgctatgcctttcattctatgtgcaatgatatgctgctgcttgccttgtataatttcaattcttggccatggggatctgagccaagttagaggagccagtgcagaatctattaatgctttaccaacctacaacttcaagttgaagaaaaatggaagtgccaacagtggagaaattagttctggagttgaaggtggggttgtgggagcgggaacagaaaaggagcgtgctatctcaggggaagatgctgtttgttgcatttgcttgacaagatatgcagatgatgatgagctgagggagctgccttgctctcatttcttccatagtgagtgtgtggataaatggctgaagatcaatgcatcctgtcccctctgcaaatgcgaggttggtgagaatactggggagtttgccttgatcatcaaactc

SEQ ID NO: 12063 - DNA, 934 bp, Vitis vinifera
  Predicted polypeptide sequence is orthologous to G1129
gtgtggccggagtttgggaaattgacgatgcccggaaccggatttaatgtggagaacgcaggatttgagtctgcaggaatactgaattgctcggggtttgagatgaatcatactacttcgagaacctccagttgcccactagcggcggcggaggctaaagttcgggagtctgttttgccagagaagatagcttcggcggtcggaagagagagcttcaagaagagaaaggctgataaggtgcagagcccaaaggttgttgcagaagaggaaaccaaagataagaggattaagggatgtgcagaggatggggagtccaagatcactgaggcaaacaataacaaaaacagcaccgccaccactacaaccaccgcaaccaccaccaccaccaacaacaacaatagagaaacatcagcagatacttcaaaggtttcagaagttcaaaaacccgactacattcatgttcgagcacggcgaggccaggccactgacagccacagcctggccgaaagagtgagaagagagaaaatcagcgagagaatgaaatatctgcaagatttagttccgggatgcaacaagatcacagggaaggccggaatgctcgatgaaatcatcaattatgtacaatctcttcaacgacaagtagagtttctatccatgaaactagcagctgtgaaccccagacttgacttcaacatcgacaacttcctagcaaaagaggtgtttcctgcttgtgcagccaattttccaaccatcggaatgtcttcagaaatgactaacccttcatatcttcactatgatccaatacaacaagtggctacatgtggggtggaaatgggaataaatcccgcagatctcgcgctccgcagaaccataagcgccccagtatcaatccctgacacttttctggactcctgcttcactcaaatccagccct

SEQ ID NO: 12064 - DNA, 642 bp, Vitis vinifera
  Predicted polypeptide sequence is orthologous to G1134, G2555
acaacaaagattgttattgatccagtagtattttgatatataaacagctgggttttatgaactacaagttcccaaatatttggagtgaaggagcttgttcagtagcaagctaaagaaaatattagtgtacaacactttacaactataaccacacccagagagaacttcagagtgaagtttttgcctagatgaattggacaagtttcttgatgattctacagttatggtgctgttctaatcagccaacatttacacattgtagaagaattcaacataaaaatagttgaatatatgagtaccttgcaatgtgcatgcatcttcgagaggacagccgaataccttgattaacctctgattgagaccttttgttacaatgaatatactaaatttccgggacgtactcttgggcatcttcatgttattctctagctaagcatgtgcattttttttgatgctcggacagttcctgaattttttgttgtagaaacttgacatactctactgcctcttctagcatatctgcagtgtttgtttgcttatccatattgggcacaagttcctgaagtttccttattctgtcactgattcgggtcctccgaactctttctgcaatgctgcgaggatgtgtagcacaaccccgct

SEQ ID NO: 12065 - DNA, 932 bp, Vitis vinifera
  Predicted polypeptide sequence is orthologous to G1142
ccgggggtggagagaaggaacgactgcatagaaacacatcaacagaaaccctaaacctgcaatcgaaaccctcgatacgttcggagaaagtctgaaagcacggcatgcagccagaaaacacgccagagggttcagagttctgccggtttttggccggtaacgtcctaagcgacgtcggatggtacgggtttcctgggaattgtgactttccggctattcaaagcttttgtagctcttcgttttaccctacggaggtgtcgggaattgcggatgtaccacggtcccgagctctgacggcttccataaatcacaaggaagctgagaaacgaagaagagagagaattaactcccatctcgataagcttcggagtcttcttccttgcagttccaagaccgacaaagcttcgctactggcaaaggtgattcaacgggtaaaagagctgaaagaacagacctcagaaatcacacaactcgaaaccctcccctccgagacagacgaaatcaacgtaatcctctccggagattactccgacgatggaaaatccatattcaaagcctctttgtgctgcgaagaccgcaccgagctcttaccggagttgatcgagattctgaagtcactccgcctgaagactctcaaagcagaaatggcgtcgcttgggggacgaatccggaacattctcgtcgtctccggcgacggagatcacagcgacgagtctgtcctctctttgcgcgatgcactgaaaaccttggtagaccattccagttccagcggtcggtctaaacggcgacgtttcggtgtagattgcagagatgtttctgattgattgatttggttcttgtttttttagcttgattatattctgttgtctaatctggtgatttgcgtggatgcgtggggttgtggaatgaagtagctagggtttgtaggagtc

SEQ ID NO: 12066 - DNA, 714 bp, Vitis vinifera
  misc_feature (560)..(560): n is a, c, g, or t
  misc_feature (619)..(619): n is a, c, g, or t
  misc_feature (647)..(647): n is a, c, g, or t
  misc_feature (690)..(690): n is a, c, g, or t
  Predicted polypeptide sequence is orthologous to G1146
gattttagtcgatagtagataatctggattttagtggcaactttttatcatcttcctagttttctatcaatgagagtgaatgagagagatggcttggagcgttgctacacaaaccttagaacgccaaacctcacagccaaacctcgccttcataaataaaaaataaaaaaatagaagaaggagaagaggaagaggtggtagaaaatatgatcaaagcaatgtttccatgcgctccagttcaaggctctacacttcagcagataagctagttcgtgcacatctggaccctttgttattgatattcctcatgggtatgttgaaaatgggggcaacatgtgtgaaatgaaggctcatagagccattaatggtttttcttacttgggaatattttatggcagtaaagtcaatggaggacttttggtggggcatccatggggcacatatgcccatatacctttttaaagcctttatctcacgttttcacaattttttttttataaaaaaattaactttcaaaaattctggattttcagtcacttcaatcttcaaattaatttttncaaaattaaaattttcaaattaatttttttttaaggattccattttcaaataaattccncaaatttcattttttaatttaatttttncaaacctcaatttttaagtttaattttgaaaactccaattctncaataatttccaaaatccaatttt

SEQ ID NO: 12067 - DNA, 800 bp, Vitis vinifera
  Predicted polypeptide sequence is orthologous to G1146
tgtgtgctcaggcccatcgacaggagctcatccaagatctttataagacttggcaggatcctgtaagaggaactgtgtctggtggaatgatcaaagaactgcttatatctttccggagagcaactgggcagaaacctcagcgcataatattctatagggatggggtcagtgaagggcagttctatcaagtcttactatatgaacttgatgctattcgtaaggcatgggcatctttggagccaaactatcagcctcctgtgacatttgttgtggttcagaaacgccatcatactagattgtttgccaacaaccataatgaccggaatgcagttgacaagagtgggaatatattacctggtactgttgtagattctaagatctgccatcctactgagtttgacttttacctgtgcagccatgctggcattcagggcacaagccgacctgcccattaccatgtgttgtgggatgaaaacaagttcacagctgatgggctgcaggccctcacgaacaacctctgctacacatatgctaggtgcacacgctctgtttccatcgtgccccctgcatactatgctcatctggctgctttccgagcacgcttctatatggagccagagacatcagatagtgggtcaatgacaagcggtgctgctgctggtcgtgggggcatgggtgttggaggaccaggtcctcgaagcacacgggtatcaggtgctagtgcagccgttagacccctcccggccctcaaggagaatgtcaagagggtcatgttttactgtgatcttcttctacattca

SEQ ID NO: 12068 - DNA, 777 bp, Vitis vinifera
  Predicted polypeptide sequence is orthologous to G1146
ttttttttttttttttttttttttttttgaaacaaagaaccttcttcacaatattaaatatactagatttcaaaatccttccattacatattccacactgtgacaaaacttgttggataagcttgctttcaaaaaaatcggtggttcaccactcacatataaacacaacactcatgtacagatatgtctttgcatttcttctttggtcccttcccagtgcctattttctttttctctaacagtagaacatcacattcttcaccttctcattcaatgctggcaggggccggacgcgtgattcatttgacgtgcgcatgcaatttggtattgcattctcaggcttatcaggttccatgtagaatcgagctctgtaggctgccagatgagcataatacgcaggaggaactagagaaacagaccgagtgcaccttgcatacgtgtaacagaggttgttcgtcaaagattggatctcatctgctgtaaagttgttctcatcccagagaacatgataatgagcgggtcggctggtcccctggattcctgcatgactgcatagataaaagtcaaactcactgggatggcagatcttagaatcgaccacagtaccaggtaagatgttcccactcctatcagtgctgcttttgtcattgtggttgcttgcaaagagtctagtgtggtgccgtttttggacgacaacaaatgtcactggaggttggtaactaggttccaatgatgcgcaggccttacgaatggcatcaagttcatatagtagaacct

SEQ ID NO: 12069 - DNA, 698 bp, Vitis vinifera
  Predicted polypeptide sequence is orthologous to G1150
gctttttctttttcctctcctttctggtctatcatatattttcaactcccaaagacccaatatctggcatggagcttgccagctaggctgcaagggctgccaagtggtgaaaggtagtgtctcttagaccagataagtcccacaaatgagaccttggaagggcacgtcatcctacatatttggacacaataaatggaacctaatctcacaactgggtccgcatttaagaactaggtagtaaaagaaagcgaaagattttagagcctcatttgctcttctaggaagaggcaaaagtttcttgtcccaaggagagggtgagataaggtgttaaatcctcattgatggaagggggtggtggtatttatgatgacccatttctcacagaaggaacgaaggtggaagattagagatgaggatgggtggatctttgaatgttgaaacgtatcaccaaaaagcaaagttgcaagaatgattacagtggcttttttgatgttgatcttgtgttagtggtggggcataagggttaggttttttgggttggtgttcatgggttattatgatagctccatgaccactagttcaattacttttgcaagcagggtgtcatatggtcgtgggcaaaacggttttatcaatcaatcttcgaagtatatgcatattattaactactatttgatgtcaatggcatgtgctatgta

SEQ ID NO: 12070 - DNA, 216 bp, Vitis vinifera
  Predicted polypeptide sequence is orthologous to G1150
caagcgtcgtgctgctaggagaaggatcgaagatcgacaccctagatggggagagcccagaagccgaaagcatcactagcttacgctctgacccgagaagcagggggcacggggaatcccgggggaatcggcagggaccaccttgcaaggttaaaaactccggggggaccgatagcgaagaagaactgaaaaaaaaaaaaaaaaaaaaaaaaaaaa

SEQ ID NO: 12071 - DNA, 888 bp, Vitis vinifera
  Predicted polypeptide sequence is orthologous to G1181, G1850
tttttttttttttttttttcttaaaatatatgcagattttcttcaaacaatcaatcaaagcaataaacaaagtctaagagattcagagcaaaagtcataacctctacattggcaatgatcctccttgtcaagtctacctctaacaagtaatgatcctaaatttgctccgggctgtaagccaaaagtttggaataaactagtaatgtttttcaaaacccatcccatccgacgagctggcaaatcttaaaaccattattcacggatcatgggatcatggatcattaagctgaaaccgtcaccgaaaatatcaaataattctatacttaatttgacattgcaaaccaacctaaccttgatgagcctccttcctcagcatttccagagagggcagctcgctgcggttccacgtttccacgggcaaaaattacacgtcacgtctcagggagagggcttccgagaaacaactagaatggagcttctaaatatacaattgaaagcgagcgacacgtgtcgatcatggcacgctcctgcctcgaaaagcgttcctaaggtgcccactgttcctgtcactatcaattctaatctaaaacgtttaatcaactgcggagttctagccacggagggtcttgatgatgatcagaacttccatccaacggctctgatttcacctcttgttgctgggtctgaccttccttctctgactcctcctcttcatctcttctgacgcgcttcacgccgatggaaacaccgaataatcgtgggcttaaatcgccctcggccttgacgccgctctgtccggcttccacaggcaactgtctctccgtcaacaagtccagcggcctgccttccggaatacctcctgcgtcaatttggccggcggcgtatttg

SEQ ID NO: 12072 - DNA, 839 bp, Vitis vinifera
  Predicted polypeptide sequence is orthologous to G1190
ttttttttttttttttttttttttttttttgcaggcaaattgtaaaagtcttatgtggatgagtttcttaaaaccaccggcattttttcattacacataaaaatcacaacctgggaaggtgtctttccaaccccttacatattttcagggccacaatataccatatttgtaataacaatacaacatataaaaggaaaaataaatagagagaaaaagatggagagaaaaggaagagtataagggggtacaagggtacaatgacttgtaccaattcatatgccttacaaagaatacatttatatatgagacagcagtagaaatgaaccaaataagattattgggtcctaattctttggatcgatgaatttgatgaatctgttcttggcttcttttaaaatgaactactccctccgtgagcagtatcgagtttaaactctctctgattctacctcatgaattatcaatactcagctcttcaagagatctataaccatgtcttggattgttttctattccttcttttcaccttgaattttggttagaggagtaccagatcttcttctggcaaatcaatatcttctccttctcgatgccatacttggtttcttcttttctgcaaccccatctcattcccttggcaatggtggcaacagcatcaacaaagtagctggattctcggattatagcatacccattgggacgtaggatccgatccatctccaagagcacatacttcatatcgcatctgtgactttcggctgtaaagagaccatcaaggtgaaggagatcgtacgttcgaggatatgttgagaaagcttcacaccagtcatggtaggtcc

SEQ ID NO: 12073 - DNA, 666 bp, Vitis vinifera
  Predicted polypeptide sequence is orthologous to G1225
ttttttttttttttttctccaagcttgagacctgccattcaaaataagaataatgtgaacccatgtgtctacattccactctcccaaacagccctcaaacaaaaggtagctcaagcacaacctgtaactcatcaattacagagccacgctcttgagaagagcataagtggtagtaccatatatcaaggcttgtttggaaagttcctagttcactacactaaaaagttgaggctaaagagaaacccaaagacagctatgagaatctaattgctagacagaagtagaaagagagtttttgaaggatgaaatgtaaaagaggtagctagttgggggtggcaatgcagtgatagcaccctcagctccaagggtagttttgggcatggagatcaacataagacagcagcttcctcctcaattattctaagcatgtggtgaactgcccctgctatgtcatctactgatgtgagctggcatccttcctcgaccttggcactaatggagtagaggactagtgggtccacggtggtgacattgagatgaagaatggtgaggtaaagagtctgaaaaccggtgaccatcttggagagcagtctagggcttttatgagagagaattcgaagatttgcatgggtttcaatcaaagtgacctcaatatctgctactgct

SEQ ID NO: 12074 - DNA, 729 bp, Vitis vinifera
  Predicted polypeptide sequence is orthologous to G1242
ttttttttttttttttttttttttttttttcgtatctttctttgaaggcttttgcatatctctcaacttcctcctctgtcttcccttccatttcaaaagcaatactttttacatcattccggccatacttctcacaagccctaatgaaagtattgaaatctcttctactccatgatgaaaatccctcttctaataatctctccttttcttcctgctcctcggcagtcaagggatctcccaagtcttcaggttcatccacatctatggagtcttttaactgattcttttgatgtgtttgcatgaggtaccgcacttctttctcatacaactcattcagcctttgtgtgttaaagaattggaaatcatgcagctggggcatgcgcggaattctaggctctctttgttttgctggagcaccttgccgcattgtttgcttaaagtattcagactctgagtaattccgcttccgctctctttttgggggctcaatccagttttcactgacaattttcttgaagtcaaacttgttctcatccttttcatcatcaaaatcatacaactcagcagtatcatccattttaaatttgatggcatcttctgtaaatttcttcatcttagcatcaagctcagctgttgcctcttctcctttagcaatgatcctgtctatgtcttcatccgtaattgtgctatccttggagctgaaaacatttcagcaccaaacctgaccat

SEQ ID NO: 12075 - DNA, 817 bp, Vitis vinifera
  Predicted polypeptide sequence is orthologous to G1242
cagacattgaaagaggagaggctagaatttctaggaaagatgagatcatgaaagcaattgggaagaagttggatcgctacaagaatccatggctggaactaaagatccagtatgggcaaaacaaagggaagttgtacaatgaagaatgcgatcgttttatgatatgcatggttcacaaacttggatatgggaactgggatgagctgaaggcagcatttcgcacttctcccttgtttcgttttgattggtttgtaaagtctcgcacaacccaagagcttgcaagaagatgtgataccctcattcgattagtggagagggaaaatcaagaatttgatgagagggagagacaggcacggaaagagaagaagcttgccaagaatatgacaccatcaaagcgtgccatggcaaggcaggcaactgagagcccgacctctgtaaagaaacggaaacaactgttgatggatgactacgtgagctcaggcaagaggaggaaatgatatttgaatgatcaaaatttccattttcttatattttgttaagttaaagtatcatggtatgaagttgcattggggttctataattctatcagaatcttctcgttttcgttttggaattgctacccaggatcaacagaagccataatctcactgatgtgagggtttaggtgtatttaactatgtagtagttatagtaagatgtataaaacgagggtattgaggttacttttgaaacctccagtattttgtttattggaggggattttggttagtctgttaacaaacaaattggcttagctgttcaggagatctatgcttaa

SEQ ID NO: 12076 - DNA, 563 bp, Vitis vinifera
  Predicted polypeptide sequence is orthologous to G1255
tttttttttttttttttttttttttttttttcgaagattgttgttccataaaaaaacaaagaactttacaaaattgaatgatgtctaaaaaaaaaagagagggttgtagctagctaggtacaaggttgaaggggcttaaaaagctaaactcacttcaacttattgtacaatatatatatagccatcaaaagtccaaccaaaacataccaattttgctagcaaataagcaaacttggcagttgacggttatttaacattcaagataggaaaacaaggtcctgcagcaaaggatgccctcttcacaaaccttcctttcattctaggccttttctccgcattcaatctcctaacctcgtaccttatcttcttggaaaacagcctagtccttcgcttctctcggtacctcaacactcttgcttctctacccccatccctgcctccaaaatttcctgttgtccatggagagccttggctggcccaggcagggatgacatcctcgtaattaaaactcaaagatatctttctcctcatctccactgcagccaccatcttctcctcatccc

SEQ ID NO: 12077 - DNA, 430 bp, Vitis vinifera
  Predicted polypeptide sequence is orthologous to G1255
ttttttttttttttttttttttttttttttgggggaatatatatataattttacaatatgtgacaaaagcttttcagcttatactcatcaactgttggattgaagacggggccgttgaaggcctaactaacacatccaagtttactgggaaataaacaaagcaaactaggcggttgacagttatttgttgagcaaaggaaaagctgcgggtcctccaaaggacgccctcttcacgaacctacccttcattctgggtctcttctctgcgttcagtttccgaacctcatatcttattttcttggagaaaagccttgttcgccgtttttctctgtatctggacactcttgcctctctacctccatctcccattgctgcctgttgttctcccattccaccaaactctccatatggatgatggacttgtattccc

SEQ ID NO: 12078 - DNA, 786 bp, Vitis vinifera
  misc_feature (712)..(712): n is a, c, g, or t
  misc_feature (731)..(731): n is a, c, g, or t
  Predicted polypeptide sequence is orthologous to G1272
tttttttttttttttttttttttttttttttaaaaaaaagccataaacatttagaagttcaagccaccgcggccaacccaaggccatactataaagaggtggcactgtctaaaagcataaccccaaaaattattatcatagatagataccctacaccttactacttactaaaccctaaagcaagaaaggattttaacatccttcagcttcctccaaaggaaagctcaccctaaaagacaaaactatacaaaacccaatttgtttttggaacaaaagtatttaacatggatatcaaagtctctcagcaaaagaacatcgaattacagacgctctcttgcaatttggggaggtggggcactggaacaggccctgctgacgtcagtccaccttggcttgaggatgtctctgacgtgtcttcaaacttcatgaactgaaacatctgagtagctgctaagtgggcatagcatatgggagcaactacggaaatggcagtggagctcctttggtacacataggataaagaatgcacaagctcctgaagatcatccgaagagaaaccaacttcatccaatagaacgtggtaatgcgtcggcctggtagtaccaatcattccagcatgtgcacagagataaaagtcattgttccgtggatgacaaactttgttgtctatgactgtgccaggtgggacgttatcatgagatccatgttgganaaacttggtatgatgatcnttctgcgcaacaatcaccacaaaatttgggagatcacttctcatcaagggaactt

SEQ ID NO: 12079 - DNA, 833 bp, Vitis vinifera
  Predicted polypeptide sequence is orthologous to G1276
gaggcagtcaccaacgattgagcctagtacttatgaaggggagatgatccctgaggccagcaatgaaggtagtgatcacaatcttgatctgaacttggggatttctcctcctttaagcaatggcccaaaggaaattgacggcttggggcatctccaatttcactctggctctcatgatgctcacaatggaaggagatcaatgatggagaaccctaatatagaaacagcgggtgacccgtctttcaaagggctagcaatgacatcggagcaccctcctctgtggactggtgtatatcccagcttctttcctggctatgaggaaagggcaacagagagaagaattgaagcaagttcttcacaaggactcccaaactgggggtggcaaatgcatggtcaggtcactgctactccaatgccattgttctctactgcagcatcatcaggattctcatcttcggctaccactgctccctccgccgccattctttcatctaaaccgcccaacacaacatcccactctatctgttttgcttcatccgcctcagccgtcaccacccctctcaatactatttccagatgaagcccccaccaccttaatccacccatcacacctccacctccccctttatcaaaggcggataggcaaccacaacaaaaacagagtggtcttcaaattcatttgtatgtttcaaatagtcgattgatatgcgccatgtctaggcgcccaactagtttggtaaaccattactctacaggatttattagtatcaagaaaatgctaatcccttttgcctttgttatgcaaaaaaaaaaaaaaaaaaaaaaaaaaaaaa

SEQ ID NO: 12080 - DNA, 823 bp, Vitis vinifera
  Predicted polypeptide sequence is orthologous to G1290
acatgttttttttttttttttttttttttttttttcaagtttcaaaatgaccatgaaatagcaggcaaaagtagtaatgggaaaaatgaatttttttttatagataattattcaggaaaaaaaatgttaatattctgttctttttcgagtttaaggtcatcttgaaccccattatgatgattcactttatttctcatccccttctgggttaggaaagagaataaaaatattgggccttctcccctccatttcaagtttcaacattataaggatattaacaacatgaagattctatagcatattatcaattcatcaaagaaaactgaaaaacagagggaaacatgctaaatacattcaggtaaaaacacttcaaaatggaggaaaaggtgcttgctagtgtataaagaaagcctcaacaagcattccattgggaaccaatgatgacaatttttatgtcacaaaatcatcaacatcatccagctgacataacagcaagcacaacgtcaggaaccttcctctccctctttctctgaaagaataatcaaaatttcaatagatgggaaaaggaggatggagatgacacttatagaaaagttcaaatccagttttacataatgtccccaatccaaagtgaactcaaagctcatttatgataatgaatatgtgcctaacctgcacaaaaatctctcaatatgaattaaaataaaaaagaacaggtttgctcatgtaatgctttgatcccaaatataatacttctactaccattaaaaacacagaatcgcaagaatttaatctattactatccagtttccacatctgaggt

SEQ ID NO: 12081 - DNA, 803 bp, Vitis vinifera
  Predicted polypeptide sequence is orthologous to G1290
ttagctcctgcaatcgataagcctgggcaaatatcatgtttttccaactctgtgccagcctgttgggtaaaactggcaaaagctgctccatgactaatttcaatgagcccctgtggcttatagccgctttctccactcttctgacactcgtggaatgattctgcttgataccacgttgtcaattctttataggcgccaggagggagtttctccgtgtaaaaagctctaactgattcaaaataagctctgtcaccatgtagatatagttcaacaagtgcagtattggcattgtccaatagcttctgtaacatgtcagaaccatcacttctaatgtaggccaaagagctcattattgacaatttttctaagggagcatttatcaaaccccccgagcctttcacaaatccacgtttcaaaaattctaattccagcagtggacgagctggaatagtggaaagagacttgtctttcccatcagtaatagtcactcccaatttggccatttgcaacttcaaagcatcgccagtaaaatgttgcatgacagactgtgccacggtgaaaacattgtcatcaccataagtgataagtacaacacatctgtcaaaacattccctgtatattgggggaactatctttttgaagcaatatctcatcagtagttcattgaaaatagaattaagcactaccgtgagagcacatccagaaggtatgcctgcttcagtgacatacacttggtttccacaaatagaaggcgtccgcttattgccagaagcaatttttcctctgcctattgcctacagggt

SEQ ID NO: 12082 - DNA, 648 bp, Vitis vinifera
  Predicted polypeptide sequence is orthologous to G1313
caacagcagcggaagtgcaggtgggggaattgttctgaagaaaggaccatggacgtcttcggaagacgcaatcttggtggaatatgtgaagaaacatggtgaaggaaactggaatgcagttcagaagcattctggcctttttcggtgtgggaaaagttgccgtttaaggtgggctaatcaccttagaccaaatctgaaaaagggagcattcactgcagaagaagaaaggctgataattgaacttcatgcgaagatgggcaacaagtgggcacggatggctgcacatttacctggacggactgataatgagataaagaactactggaacacccgaattaagagaaggcaacgagctggtttaccactttatcctcctgaagtgtgttttcaagcattgcaggagagtcaacaaatccagaatactggtggaattaatggtggggataaagtgcaccatgatctcttgcaaactaacagttatgagataccagatgtcatcttggatggttttaaggctaaccaggatgcctttccctatgtccctgattttcctaatctttctaccagtagcatgctaatgaaagggtttggttcttctcaatattgtggtttcatggctccaacaatgcatcgccagaagcgtgttcg

SEQ ID NO: 12083 - DNA, 399 bp, Vitis vinifera
  Predicted polypeptide sequence is orthologous to G1330, G2423
ttttttttttttttttttttttttttttttcgtttatcagatgtcggtgaactgcgtctgtacggaccaaatgtcatccacattccacaaattgtccgccgtggccgtgtcgccgccttcgtaccactgggtgtttggctccatggattggaaatccaatccttggttgaagtaacccgaggggctgattagcgaatctgtgtacccaacctggccggtctggaaaaaatccgggttttggttgtcactgaccgggaaattgtaaatctctgtcaggtccgagacgggtgaaacctgcgctccaaacgagtccgatgaagccgctgtgctaaaattctccggggtgtaaccggtgctgacttgcccaccgtagaaatcggcgcccccggctgccatccc

SEQ ID NO: 12084 - DNA, 486 bp, Vitis vinifera
  Predicted polypeptide sequence is orthologous to G1341
ttttttttttttttttcattggatatataactggttcttgatatatgaagaaagtatgtacaactcctgaagaaaggaaaaaagaaaaagaggaaagaaaatgggagtcatctacagctcatatagaaagaagattcatactatcatgaaaaaaaaaagggggggggggggaggaaaagaaaattcaagcagagaagaagccattaatggcagcaagaccaatctggctcttgggctccaaagcccacttcacaatctccgtgttctcttcacccaccgccttcttcacccaggagaacccctccagcctcatcgcaagggctgacacactagaaacaaagccaatctcctctgctgctgctcctcctcctccacaaccaccaccaccaccacttttttttgagttcttgaccctcctctcatactcctctgcaactagcatagcaatatctgacatctctctcttgattaaatgatgggtagttt

SEQ ID NO: 12085 - DNA, 959 bp, Vitis vinifera
  misc_feature (887)..(887): n is a, c, g, or t
  Predicted polypeptide sequence is orthologous to G1361
tcatcgatgcaaaggctgatgacatacttccgacactaacatgcccttcatgtggccaccaaatagaattccaagatcaggctgggattcatgatttaccgggactgcctgcgggagtgaagttcgatccgacagaccaagagattcttgaacacttagaggcaaaggtgctgtctgatacacataaaacacatcccctaattgatgaatttatccctacactggagggagagaatggaatttgctacactcacccggagaaactaccaggagtaagcaaagatggtttaattcgtcacttctttcatcgaccttcaaaggcatacacaactgggacgaggaaaagaagaaaggtgcataccaatgaagacggaggcgagacaagatggcacaaaacaggcaagactagaccagtttttgttggtggggcagtgaagggattcaaaaagatactggtgctctataccaactatggaaggcaaaggaagccggagaagacaaactgggtaatgcaccagtaccatcttggcaataatgaagaagagaaagatggagaattagtggtttcaaaggttttctaccaaacacagcctagacaatgtggtctgagcattaaggattcacttgataacaaatcaaatagtcgaagtgcgcatgatggtccgataataaaaagtgctgcattggtagaatattatcatccatcttttatctcttatgaccaagtaagccataatacagaaagcccacctcagctgattcccaacttggtagtccaaggcgacgggtcttccttcattcgactagctgctgatgcaagcaaaggaaacttgagaggaaatagagatggaagagctgatatatagcaacgacaatgactcctgggnggtgggattagtttgttgttgctgtgtaacactcgaaaataattaatagcatcagattttattaatgaggag

SEQ ID NO: 12086 - DNA, 897 bp, Vitis vinifera
  Predicted polypeptide sequence is orthologous to G1380
tttttttttttttttttttttttttttttttcacagaagtaaaaccattttatctaaatattttctgatatcctttctttttctgcttttttaagcatgagaacagacgagagaacagcacagagaggaaaaggggggaaggaaaaaggattttttttatataaaaaaaacatggatcatcatcagagacgcaaagccgtgctgtggagatcacccatgatgagctcgtcatcgtcggacggcataacattgagatcgaaagggaggggttttcgaactgaagttgcagcagcgatgtctccgttgtcgatcaccgaggacgacgagtcgcagtcactgtggcaatcgtcgggtaaaagcggagggctacgtgggtgccggcgcaacgtcgccggaggtaaatttgccggagctgggcgagggccgctaaaggactccacggtgctgctcatgccactcgacgtcggcctctgggcgtgaatctgctgctcctgaaactgatccgctcggtacacccggttgtggtggccgtcaccgaactgaccgttaaggttccgatcgaacgccggcaccgccaccgccgcccccgacaccgccggaaagtttgtttttgccttgggcccccggagagtcctcgcagccgcgtcgtacgcccttgccgcctcctccggcgagtcgaacgtccccaaccaaacccttgtcttcttccacgggtctcttatctctgccgcaaacctcccccatggcctcttcctcacaccccgatacctcatatctttgacgaacccagatccaccggccccccctgccgccgacgttgccagtgtagccgtcggaccgcctccctctccgcatattgcttgttctgtgatggagaaagagaagggctcgagggtt

SEQ ID NO: 12087 - DNA, 673 bp, Vitis vinifera
  Predicted polypeptide sequence is orthologous to G1380
ggacaggaggcaaaaaaggggagagagaaaataagagagagaagagagagacagcggtcggaaagaagagaagagaggtggagatggaaccagagagccaaacttgaagaggagagaagagagagaggtggcggccatatttcaacggcctagatttatctaaatcgaccacatctcgaaatctctacactccatctccatttctaatacttcttctccgaccaccgctatgcggcgaggcagggccaccgcgagagatgccccacagcaacaagaggtcaggaatcagggcaaagatgtgaggttcagaggcgtgaggaagagaccttggggccgtttcgccgccgagatccgggacccgtggaagaagactcgggtctggctcggcaccttcgactccgcggaggatgcagcccgagcctacgacgccgccgctcgatccctccgcggtcccaaggccaagaccaattttccgttgtcatctccggcggttccgttgaccgtgccgtttcaacaaccgagtcaatatcagattcaagatcagaatcacagtcatcagcatcagcctcagaggccaaccacgagcggtatgagcagcaccgtggagtccttcagcgggcccaggctctcaaacccgccgtcggcgccgccgcggccgcgcctccgggctcct

SEQ ID NO: 12088 - DNA, 728 bp, Vitis vinifera
  Predicted polypeptide sequence is orthologous to G1382
acatgttttttttttttttttttttttttttttttgcagccaataagagacagcatgaacagctatcaggaacattggatacttatgagaacatctacatgatacatctcatgcctattggactaattttacacacctgggggtaagtcttacaatctatataaccgatcacaagtaatcccacccccaaaaaatgagaagggaaaagagaagataccctccaatgcgcacacacaatctaatcgagatcctaagtaacttattgctactgaaaacaaaagtttaggtctggacaggttctgcacttggagtttgttgatcgtttgatttattattctcaggccccaaacatatatagggcactattgcaaggccaacattgtcgctttgttctgatttagctcttgattcgtcattcacatctgttgtagtggtattgggtcctgctgaattatgggtaactgtccttgctggaggcatatcatggtcgtgttgtccttcatatggggttataaccatttttggatcatgagatgccctctccacatgcttttttactggacatcctgcatttgagcacctgtaataactccttggatttgtattgcctttcactaatttctgaccatatttcccccagcggtacccatcattcacaatatctacctcactcacagtctgaacaacaatgcgcggttcaccacttggcttatcgggcggagtggcat

SEQ ID NO: 12089 - DNA, 541 bp, Vitis vinifera
  Predicted polypeptide sequence is orthologous to G1411, G2509
cggtcggattccgggtcgaccccgcgtccggtacagtgatgatcagcagcaatggacgcagcatgatcaggacatgtcggccatggtttcggctctttctcaagtgataggcaccagggacaacaaccctagtgctactcgtatggtgcagtcggctgattcatcttcagctctctctgaatcatctcaattaccaccccaagatcaaggaaatgtgaggagaaggcactatagaggagtaaggcaaaggccatgggggaaatgggccgccgaaatacgagacccgaagaaggcggcgagagtctggctaggcacattcgacacggccgaggatgcggccctcgcctatgatcaagcagccctcaggttcaaaggcaccaaggctaagctcaactttcccgagcgcgtccaacaacaaacaagtcagattgggtatttcatggaccacgcaggcatgttcgacgaccaaagccatcgtcctccggccatgccggcgcctcctccgcctcttcctcctccgtcgctgccacacgaatttctt

SEQ ID NO: 12090 - DNA, 879 bp, Vitis vinifera
  Predicted polypeptide sequence is orthologous to G1420
ttttttttttttttttttgattgataaagaagatacaaaacccaagtcttcatgattgaattaaactctagatacaaagaataacacacaaaaaaaacccacaaagtaggaaagtagttcttcacaggctgaggctagtaattttacagtgataatcagcaaggttcacatgtaatggtgaagttggttcgtctccaaagacaacctccatgagtcagtaagggaaattacataccagtaatacagataaaaaatctctctactactcctctttaggctccttaaacatctgggacggcaggaggtcctcaagaagtccatgatctctcagcagagaagctggagaaggacggagccgtctctcatggaggaaagtggggttaatggaggaggaattcatgtggttgaagttcaaagaaagagaagagttattgaaatagggttgctgctgctgctgatactgaggctgtggcatggcgaatgaggaagcagcagctgcactgaaggtgacagcttccggcggaatcccaagacttccacggggcatcactggacagggatgagtgtgctgaccttcataggtagtaacaacagtggtgggatcatcggaggatcgctccaccctctttttcactccgcaggcggcagtggtgcaacgatagtagctcctaggaaaagggctgttcttcacagctttttggccgtacttcctccatctgtatccatcgtcaagatgatcaacttcgctcttggtgatgaacgcaaatctcggctctctctgcctcttttggtcttctttttgggtttcaactgttgcttattcttctcctgatcttgctcttcctcctcgccgctttagtctgatcatcattcgctgct

SEQ ID NO: 12091 - DNA, 159 bp, Vitis vinifera
  Predicted polypeptide sequence is orthologous to G1446
tctgtgcgttcacacctctgaagaagatatcacagtgttagatttcgtatttaatgcgcaaactccagttttcaaactgctgaaaactaaaccactgaagaaaatccatacaagtgctataaaatccaaaaagaaaaaaggcgaaaaaaaaaaaaaaag

SEQ ID NO: 12092 - DNA, 549 bp, Vitis vinifera
  misc_feature (417)..(417): n is a, c, g, or t
  misc_feature (518)..(518): n is a, c, g, or t
  Predicted polypeptide sequence is orthologous to G1451
attcagcagctaccatgaactgcgtggtgagcttgctcgcatgtttggccttgaaggccagttggaggaccctcggagatcaggctggcagcttgtatttgttgaccgggagaatgatgttcttctccttggtgatgacccctggccggagtttgtaaacagcgtgtggtgtatcaagatactctcactacaggaagtgcagcagatgggaaaacgagggttagagcttctgaactcggtccccatacaaaggctcactagtagcagctgtgatgactatgcaagccggcaggactcaagaaatttgagcactgggatcacatctgtggggtctcttgactactgaacaatttaacagtaaagatactattctctcttctgtaatattagcatctctttcaatcgctctcatgttgngtagggctgcctaattctagcttaaagctcttatatttaagccaatactgtaattatatgatatctgccttctccctttctatgcttttgatatacatacnatacatatttattaggagactaatgttcttt

SEQ ID NO: 12093 - DNA, 697 bp, Vitis vinifera
  Predicted polypeptide sequence is orthologous to G1451
ttttttttttttttttttttttttttttttcatggcaataactaagtagcatgggggatacaggttgtatacaatacttgtacggacaagggggaagaaaacagacaggagagaaatggcacacaccataacggggaaatcccggacaaaatgcatacaagacatttatttcactcccaagagtaggacttgaagcaatgactctggagggttatagaactgattttccatgcattctcagtactcaagcgacccagcagagggtagtccagaaacaaggtctcgatcatcagttccactgctattcatcctttgagcactatttgggctgaatcctgattcaatcccctgtttccccattttctgcacatcctctggggaaagtatcttgatgtaccagacattattcacaaatgcctcccatgggtcgtctccaaggagaagcacatcattctccctgtcaacaaatacaagctgccagcctgatctcagagggttttctagtttcccctcaattccaaacatctgacccagctcctctcgcagttcatgatagctgctgaaccgggtgatgtctaatgaccgcccaaccgatcccgatttgtaaaccttgacaaatgttcggcttggagttggaggatcaacttgtcctgcattctgcaacaactctgaagggtcttgcacgcaaccaaataac

SEQ ID NO: 12094 - DNA, 684 bp, Vitis vinifera
  Predicted polypeptide sequence is orthologous to G1472
gctccatacagctcctaagtcaatcaattatagagaatgggaaaagtggaccaattatacagatccatgatcaacattgcatctgcatgtcactggtggtacccttaacaacatttatattcagtacttagcataagataacagtacagaaggctttgtaaaatatctacctaaggctccaagcttgttcactttttggtgaatattaaagaaccaatgctgacaagaggaattcatccataaacatcgaaaggtctcattctttgataaaacaagcttcctggatcagataaacaagaagcaactaagtgtcacaataaatacaagtaacagatcaaagaagttaagtgaaatgtgtctctaagcagtgcctggatcaagcctaggctaggttgtggtcccagtttccgagtggtcaacctatactgttaagattgaggcctaaaaaactctccatagggtagccatttgaatactaattccaatactgtgctgtaattccatctgaagccatgtgacaaagtcactcctcgatatagtgaggtcagaggcagggagactaagggcagtggttggcacaagcctccctctcctcaataagggcaaaaggtacttatagtgagcagtacggaatgaaccgatgctgaacgtgtaggaaaatcagcttcttcaatagaatcgtgc

SEQ ID NO: 12095 - DNA, 696 bp, Vitis vinifera
  Predicted polypeptide sequence is orthologous to G1476
ttttttttttttttttttttttttttttttgagctaagcatcgctgcatcttaatagtttctctcgctatgaccgaatccccatgacccccaagttttcgaggcatactcttcttacccagctccgatacaatctccttcacttaaattctctaagaaacctcaaatgatccccagaaattttcagttttctattctgttgaaatcgggagcttgggttctcgatgctattgagccaaaccttataggcaattgggcttttggcaatgcccagaacttgttagctcagcttcaggatgggttccaaaaaacacataataaagtttataacatgaacctgtatgtaaattaattccccacatgacaatatcatgcacaagattccattagagaaaacacgatgaggaaagggagaagacacaatggggttacataattaataattaaataataatatcacaccttaatttccacttttccagtttgcaggcttgtagctattgcaagagaggttacagcagcagagaggggggagggggggggttacaattgactagagaggatttgatgctaggattctagtggcttggcggcttgcaacggcacgacgggaaaaacgcgactcaggcaacggtgatcttgcaatgcctgacggggggagcctatcacggcacgttagggacgggctaagaggtgg

SEQ ID NO: 12096 - DNA, 560 bp, Vitis vinifera
  Predicted polypeptide sequence is orthologous to G1478, G1929
tttttttttttttttttttttttttttgccttggatatgcatatgttactgatgataaagcacatgacattaattcccctatatttttaatacctcagaggaacaaactctccaacaatttgtcttaactatatctaatcacataagactcaaagaaacagaaaaggcatcttcagtgttcttgggcacttggactcatcgcttgagttacaccagcttcgctcagtccagctaatcatggttggcagcgccacctcatgtgaagatcctatgaggtatcgctgtgtaagattttgacatgtactgcagagaaagcatcgaatgtgcctgaacgccaaaaagttagctccatgaacccacctatcacatttttggcataaaaatgcatcatctgcttgacaatacagcagggcccctggagctgcagagctcacaggacaccagcccaccaccaccatcgtctgaaacagcctccttgagtacctcggacttggccaaacggccttgctttccatcttctctacctctacacatctttaggagttctagaggacatcccc

SEQ ID NO: 12097 - DNA, 843 bp, Vitis vinifera
  Predicted polypeptide sequence is orthologous to G1480
ttttttttttttttttttgatccgtgatcagaaaaggcaaaagtgaaaaggtttactaacagcagagttacagaagccttgagaaagagagggaaaaaacacagtagatgggggatgttgagagcaactttgagatggaaaaagcctaccatcatgcttcttctacaccacactctcatccatggaatcaaggattcgataatcaaaaaacgaaactaaattaaacataagacaccaaaagcctttaaagcacatcagattatttcaggggacaaaaaaaaaaagaaaattaataggacggaacgacaccgtatccggcgtccaccatgaaagcagcggcggaggcggaattgtagatgtgatcaaccatctccgattccatctcggttcgctttgcgaaacggcctttgattcttggacgcgtctcggcgtaggcttttctggaggcgtatctgatggttttctcgaatttccggttctttctcttctctctgtacctcaacaccctcgcttcgcgatccattccagataattgggtcgcttgactcccagtagaaccgccgccgccgccgccgctcacttgcttcatcgaagggtaggatgtatcagatatggagttgcagttcccatctgggacaaccccaacatctgaagatgaaatgctttggcttagagattgagctgtatagttgtaggcagagagctttgatcgagagaaatccagttcaaaacaattgtcagcagggtggttcgtgaccggaggtgagggatctttggcttgaaccggaactacaccatcatttccacgcagtggtggtgatgatggtgtgggaattcgcatcc

SEQ ID NO: 12098 - DNA, 748 bp, Vitis vinifera
  misc_feature (57)..(57): n is a, c, g, or t
  misc_feature (104)..(104): n is a, c, g, or t
  misc_feature (184)..(184): n is a, c, g, or t
  misc_feature (191)..(191): n is a, c, g, or t
  misc_feature (216)..(216): n is a, c, g, or t
  misc_feature (233)..(233): n is a, c, g, or t
  misc_feature (235)..(235): n is a, c, g, or t
  Predicted polypeptide sequence is orthologous to G1480
ttttttttttttttttttttttttttttttctcaaaccttttcatttttcccccacngaaactttcgccctccaaagcggcccccccgatctgctctggatcanggcgatcgatcgataacaccaacaataaaaggcgattaggatattggtacatggccgcccctcaaaaagatggatcgacnccgatcnctgagtcgatcgatcgtgctccagntgagctgatctcccacncnaatctccgatcgcttcccgaaccttcccttgattctcggactcggttcggggtaggcttttcgtgatgcgtatcggatcgttttctcaaactttctgttctttcccttctccctggacctcaaaaccctaggttctcaatccattcctgaggaaatttgaccagtttgattacctgattcggacccggatcgaatcgatctaccgaaagggttggttacatcaaccatggcgttaccatctggcacgactcccacttctaaagaggaggacgacacactttggctgagagattggccgttgtaaaaggacttggaccctgaaaaatccatgtcaaagcagttgtcgttcaccaatggagctagaacactcttgctctgtactggaacaactccatcccctcccgaactttgctgctgctgctgcgattgaacctttgcatctatcgacgaataatccaaatcccccggccggatcgacggaattcccgatcatatgtccggtaccgccaactg

SEQ ID NO: 12099 - DNA, 726 bp, Vitis vinifera
  Predicted polypeptide sequence is orthologous to G1480
tttttttttttttttgcttggaacaaatcgacggctaccatgtcgtcgatcaaacatcgtcacttagtatatacaaaaacattcgtacacaagaacaacacagcataattgctctgcaaaaaggaagagcgagaagaaataacaacaataaaaagcgattagcatattggtacatggcccatcaaaacgatggaacgacgccgtatcctgagtcggcggtcagtgctccagacgagctgtaatcgacttcgatctccgatcgcttcgcgaaccttcccttgattctcggtctcgtttcggcgtaggcttttcgtgatgcgtatcggatcgttttctcgaactttctgttctttctcttctctctgtaccttaaaaccctagcttctcgatctattcctgatgaaatttgagcagtttgattagctgattcggatccggtgttcatcgatctaccgaaagggtttgttacatcaaccatggcgttaccatctggcacgactcccacttctaaagaggaggacgatacactttggctgagagattgtccgttgtagaaggacttggagcctgagaaatccatgtcaaagcagttgccgttcaccaatggagcttgaacactcttgttctgtactggaacaactccatcagttcccgaactttgctgctgctgctgcgattgaagctttggatcatcgacggataatcagatcagatacgatctatgtc

SEQ ID NO: 12100 - DNA, 704 bp, Vitis vinifera
  Predicted polypeptide sequence is orthologous to G1481
gcttacccgttagagttagttggaagaaatgaaggtatgcgagctctgcaactctccggcagtcatctactgcgactccgatcaagccagtctctgttgcgactgcgatgccaaggttcatagcgctaacttcctcgtcgccaagcattccaggactcttctctgccacgtctgccaatctccaactccctggaacggctccggccctaagctcggtactaccatctctgtttgccagaggtgtgtaaatcgcagccgtactgtaaatgagactccgtcaaccgatgaggatgaagatgaggaaggtgaagaagatggagaagacgaaggcgacgatgaaaatgatgaagaaaatcaagtggttccgtggtcatcgacgccgcctccgccgatctcctgctcttccgccagcgaagaggaatcttccagcaggttctgtaacggagaagaaggtccatcggattcaaaatcagcttcttcgctgaagccaatgcgccaacaatcgtccttcagacctacttctcaaaatgatctagggcggtctgtttcaccaccagcacacaacctgcgcatcttcatgaagtgaaacgaataactgcagcaaccaacaagctaatgttgaagcagagtgacgactgaggcaagatcaaccgcccatggcattttctactcactaattctccttccgtttcagcttattttcc

SEQ ID NO: 12101 - DNA, 823 bp, Vitis vinifera
  Predicted polypeptide sequence is orthologous to G1481
tttgggagatctaggatatttctgtgaattgaggaaagcctcttctttcatcttggagttacagacgaaagcggattgagagagatgaaggagtgcgagctgtgtagctttccggcgaggatgttctgcgagtcggatcaggcgaggctgtgctgggactgcgacgagaaggttcatggggccaacttcctagtggccagacactccaggagcctcctctgccatgcttgtcaagctcccactccctggaaagcctccggcacccgcctcgcccccaccgtctctgtctgcgaagcctgcgttctccgttgcgacaaagaccgacatcggagctccggtgaagaccgggagagtgaaggaggtaataccgatgacgaggaggatgatggtgatgatcacgatgacgatgatgagaacgatggcgatgaaggtgatgaagatgatgatgttgaagaagaggaagatggagaaaatcaagtggttcctttgtcatcatctgcggcgtctctgcctctccctcccgatgccagttcttcgagcagcgaagatggggaggcctcgagcaggttctctgccagaggccgcggaggtgtttcggcactgaagaggacgcgtcagaatgcagatcttgatctcgattccgatgatgacattggctgctgctcctggcaacacaaccacaaagcttcgagaacagcgtacgacgaagaagatgcttctttgagctcccggaggccatgttacgaacggcggcctacagagctgaaccgatcgctaaagctcgaagagatcgacgaaacagagtcaacatcgacggcgatca

SEQ ID NO: 12102 - DNA, 661 bp, Vitis vinifera
  Predicted polypeptide sequence is orthologous to G1481
aacagactccgtggatctgttttaatacaggagcgcgaatatcatatatatatatataggttaatggttaggagagacgtacggacacaatgccgttaaaaatgagtagagtaattgattaagggaaaataagctgaaacggaaggagaattagtgagtagaaaatgccatgggcggttgatcttgcctcagtcgtcactctgcttcaacattagcttgttggttgctgcagttattcgtttcccttcatgaagatgcgcacgttgtgtgctggtggtgaaacagaccgccctagatcattctgcgaagtggaatagatagggatttgagggaatttgattgacatggagatcgtacggagagagggagagaagagacgtacttgagaagtaggtctgaaggacgattgttggcgcattggcttcagcgaagaagctgattttgaatccgatggaccttcttctccgttacagaacctgctggaagattcctcttcgctggcggaagagcaggagatcggcggaggcggcgtcgatgaccacggaaccacttgattttcttcatcattttcatcgtcgccatcgtcttctccatcttcttcaccttcctcatcttcatcctcatcggttgacggagtctcatttacagtacggctgcgatt

SEQ ID NO: 12103 - DNA, 717 bp, Vitis vinifera
  Predicted polypeptide sequence is orthologous to G1488
gcgacagctgcaactccgtctctggttgcgagccgcagttcgccggagatattgggtctcggaattacactgatgctcatttctctagcgacctatgcgtgccgtatgatgatttggctgagctcgaatggctctcgaacatcgttgaggaatcattctcgagcgaggacttggaaaagcttcagctaatttcgggaatgaaagcgaacactgaggaagcatccgaaacccgcgacttccaacccgaaaacaaccaaaacccaccgctatcgctgcgagattttccggccaaggctcgaagcaagcgcgcacgagccatgccatgcaagtggacgtcgcgccttctcgcgctttcccctacaagttccttgtcagaaaccgacatcatccccccattccggcaagaaatcgacgaaatcggctcccaaaaagaaggaaagccccgaagttgtggccggaggctgcagcgatgggcggaaatgcttgcactgcgccacagacaagactccgcagtggcgaaccggacccatgggacccaaaactctgtgcaatgcttgcggggtcaggtacaagtcggggcgactcgtacctgaatatcgacccgcagcgagcccgacatttgtgttgacaaagcactcgaactcgcaccgaaaagtgttggagctccgaaggcagaaggagatggtaaggtcccagcaccagcatcagcagcagcag

SEQ ID NO: 12104 - DNA, 678 bp, Vitis vinifera
  Predicted polypeptide sequence is orthologous to G1493
gcagccacaaactgttggtggagctctaccgaccagacaacccgcggcttcttcagggtggaagtatcatccctctcctccgcatcatcttcctcatctttcctcctcttcgagtttttccaattcccttcatttgctgaagacgaataatccacgtcttctgatggtttttgctggcgatctccatcttccacacttccggactgctccaaatccttccactcgttcttcctcttcctaaccacatgctgccatatgttcttcagcgcctcaattcgaacaggcttaatcaaataatcacatgcaccatgagtgacacccttcatcacaacatgttttccgtcatcagcagacatcatgataacaggcaggtccatctcaagcccaatgtgctcaaggagcttgaatccgtccatgtcgggcatgtgtacatcgcttataacaatatcaaacccgcttttattccctcgcaacagggataatgctgtttctgctcgattgcatttagtaacttcataaaggcaagtccggagcatcttctccaagatcatgagacaagtgggatcatcatcaaccaccaggacccggagacccgccggaaactggtcggggaccacatctccggccttccgtgcaccactagaactcgcgccgtcgacatggatccctgtccgctac

SEQ ID NO: 12105 - DNA, 871 bp, Vitis vinifera
  Predicted polypeptide sequence is orthologous to G1493
ggggcagcctgttttatcaaatggcattgcgatgtgggcttctaacaagaaatgttattgttgaaaatggcagaggggctggattcaatccagtttcccagggcccttcagtggtagagttcccaatgaaccacactgcagaattgccaggtaacagtttccctcttgggaccaatcctgggatatccagtatccaatccaaagggctgttggaagaggttagctcagaaataaaaggatcaagaggatttgttccaagttatgatatttttaatgagttgcatcagcccaaatctcaagattgggaattacaaaatgtaggcttgacgtttaatgcctctcaacatgcaaactctataccaggaaacctgggtgtctcgcaatcggtgttggtccaccaagtcttttcctctggccaaaagagtggacaaaacatgaatacgcctgttgttagcaaggctatgttctctgtgggggcaggaagtgagcatgggaacacacacaacatcagtcaacacctcaacacgcttgttgacagttcatcaagggtcaagactgaaaaaaattcttgatccatgctgtgaaatcacccccttccctgaacactatgttcaggaggatctcatgagtgcacttctcaaacagcaggaaggcattggaccagttgaaggcgaatttgactttgatgggtattccatggataacattcccgtgtaaaacatgctccatgctccaactttcttttgtgattgcagtttctcgtgtacatagttgctgtttcagattaattttattaatccctgctggaattggggatgaagattcaacttcatgtctacttcatgaaacaggttcgcttgattttcactta

SEQ ID NO: 12106 - DNA, 600 bp, Vitis vinifera
  Predicted polypeptide sequence is orthologous to G1504
tggacgatttgtatggggatggagatgtgtattttagagatgaacctgctttccctggaggttcttcgatgagtacaagtgattttatatccactggcttcacaacttccccagattacttgatgctgcagaatgatgtcatggtgagcaaaacttctgagaggagttctggattggactccacgtccatccctcctgcgaaaatgtgcacagtgtgcaaggctacggtctcctcaacatggcgctatggccccaagggccaaggaccctctgcaatgcttgtgggcttcggtataagaaggaacacataaagctatgggaaactcctatccattgttcaaaccccaagggttcaacaaagagaagaaaatcctccacaacaaatgggttctaagttgtgtctggatatcggttgctcatctttttgtgtctctgcttatctcttctattactattttacatcatacatgatgacttcgataaaaagtctgatattttattgtttagtccatgagatcacacataggaactctctctttcagcgacctgtacatcacttcaagtgtttaraatctttgctgtaaaaaaaaaaaaaaaaaa

SEQ ID NO: 12107 - DNA, 797 bp, Vitis vinifera
  Predicted polypeptide sequence is orthologous to G1506
actctgcaatgcctgtggatcccgatggaggacacaaggaacccttgaaaactatacccctctacatgcaagggtagatggtgatgatgctgaggactacagggtttccagagtgaagagcatatctattaacaaaaacaaagaagtgaagctgctcaagagaaagcaaaatcaagataatgtggtggttaatggtgttgcctctgattatagccaaggttcccggaaggctatagatgaagatacaagtaacagatcaagttctgggtctgccatatctaactctgagagctgtgcacagtttggcagtgcagatgcaagtgatttgacaggtccttcccaatccattgtgtgggatacaatggtaccttcaaggaagaggacatgtgtgaatcgtccaaagccatcttcagtcgagaagctaacaaaggatttatgtacgattttgcatgaacagcaatcttcgtacttctctggatcgtctgaagaggatttgctttttgagagtgagacaccaatggtctctgttgaaataggacatggaagtgttcttatcaggcatccaagtgcaataggtcgagaagaggaatctgaagctagctctctttcagttgataacaaatcatacctggtaaatgaggtttattcacgcattggcgcccttcctgtaaatacaaacaataagggcatcaattttccaagtcctgggcttgaaaagatgaagaagcctgctggactggggatgcaacaagagcaaacaagagggacaagtctcagcacgaaaaattgcaaatcct

SEQ ID NO: 12108 - DNA, 730 bp, Vitis vinifera
  Predicted polypeptide sequence is orthologous to G1506
ttttttttttttttttttttttttttttggaaaaaagagcaaccatcccacctcattcacattaactccttttttgtgtttttggcatgcaaaatatgtggacccataatgggtttttggcagaagaaatacctacatagccctaaggattaaagtagtgtttaacatcattgtcagggacgcaaaagatgtgggtatgctgagctactactagtgctttgcagttgggtgccaaagcccgaacctggatgaaggagctctgcctgtgggaatgagttgttggatggcacatccagcagtagatcatgatcagaaatttcatcaccaaaggtgaatgaatccagctcaagagagccaccatcaggaggcaaggcaaatagacttctaggactgaagctagagccttcattgtctatatgttccttttctactgccttcataatcacccttctggggctcttcatcgtagttcttgcttctgaaaaattttgattttgggcatcacgagatctcttggcatttgcaaaattacttgctgcaatggccttaggttctcccgcaactacagacactccagtactattcttacatttcttaagtaaattatagtgttccacccatttggatttttcagaattcaacaatgcaagcctctgcaaagtcttacagtcttcagctttcgatcctgggaaagagatatcaaagaccccttccccaagcagctgctgga

SEQ ID NO: 12109 - DNA, 645 bp, Vitis vinifera
  Predicted polypeptide sequence is orthologous to G1506
tttttttttttttttgggtgtttctgagagattaggatggcatggttcttttgtggaaaaaaaaaaacttaaaaagatatggtagattgctcccctaagcttatcttaggccctataagaggaaagaaacagtagattttttaaaaatgggaagcattctattcaacgactaaaagactctttcctttgtaatatatgggcttggttcacgttgtttttaagttcgggtcctccatgcagagtttgttgtcgattagattcacagtgaagggtgctgttttttgtggtccctttatttaatttcttattggaagcgcttttaggcatctgtttatatttcccgtgtcctttgacttgatattttgccctcttgtttgtaatattttcttgctttatctacacgtaatcacgtatatacatatacagcacggcacatacatcaaacatcaacgtggaagaaacatgaaaaaagagcgcaatttcgaaattcaaagctccaatcctctgttaggttcccaaaaaaaaattgagagaaaaagaaagaagaccctaatgcaaaattcacaatctttcacctttctagcattttttgagactatatctttcaggaagtagacatagaaggagtacgaaccgttgattgga

SEQ ID NO: 12110 - DNA, 723 bp, Vitis vinifera
  Predicted polypeptide sequence is orthologous to G1510
ttttttttttttttttttttttttttttttctcttcaaccttgaaactttattttaatgaatgaaaatccttttttcttgcatcacaccctttccaatctcaaccgtaggatattttggcaataatatcatttgaatttcccaacccttttttttggtcacattaaatttatatgtaaacaaatgggggtcacatgatccaatgccacccaaaattcttaatttatcctccattaaggtcaacgtcaattgtgtaagcaagaatacctaaaccccctttttgggatttgtctggaacctcaaagaggtccattcccagccattggatcatggggtctttcgcttcagattttctaacacggacggagaaattaaggagagaagtttcctgatagcgacaggggtgacatcatggatctgagatcttgccaattcttccaacgacgtagttatgtgggcctggaatctttggggccataaccacctacagcccaataggttttggttttgtgtccatgttggggacttcgagtacacccagcccaaatccatgcattaggagcgtgtgatgtaattccattatttcattgaaattcgagagagaaaaaacaaaaggtcagtagggattttcccactttttctcatttctttctcttccattcaccactgtcatcaacattatcatgtccatcagcagcttttcatttgtcaccatctctatgat

SEQ ID NO: 12111 - DNA, 698 bp, Vitis vinifera
  Predicted polypeptide sequence is orthologous to G1510, G1779
ttttttttttttttttttttattacagcaaaagggggcttttatttgaagcctaagatggatactctatgatatttatttggagatcagctatggtgaagcaaatgatcaactcactctcgttcacaaacaaaaccttaatcataatccaaagaaaaaaatggaagtggggagccgaaatatcaattaatcaactgtaaacaaggtcacaagataaggccattaggaggatcgcggcttcttcttcatcccgagggaacactcgtctaaaacctgagttcttgcaaatactcgaagtgaaatcttcgaagcaaagcttcttctcggtgggaggaggacaagggggcttgcagagcttcttctgttgccctacattgcttgtatgcatcttcttttccttgttgggcagcttcatcttcataggcgatatctcggtcccaacggctgtgccattcgctgctgctgctgccgctgctgccatggctcgtctcgccttcctttgcctaattccacaggcattgcaaagtgacttgggacctctaggaccgctcctccaaagaggggttttggttgtgttacaatcactgcagactctaattgggatattactagtattgttggaagagttgaactcattaatattgtcccactgctgatgatcttcaaccttctgctcgattttcgctgtagtgcaatccg

SEQ ID NO: 12112 - DNA, 694 bp, Vitis vinifera
  misc_feature (533)..(533): n is a, c, g, or t
  misc_feature (602)..(602): n is a, c, g, or t
  Predicted polypeptide sequence is orthologous to G1512
ttttttttttttttttaagagaagaggtttaaaatattttcatctatcatctcatcttccccgtgcgttccatgcatagtccagttgataagcttacgattcataaccgatttacaaagtatacaaaaagggcaagggcgtacacctaaccatgattaaaacagggcaaggcacagaagaaagcaacagaagaggaatattgaaattctgttcagtgacttgtcagcttgcatctcttgccttctcaacctgggggtactgcttcctgttaggtgatatgagtttggatatgcatataagctctctgaattgccaaacaccctggcataaaccatttccccaaacatgcccaccggatggaagaaacttgttgctgtgctccctcccatgttgaacaatgatgatggagagtcatgttcataatcgttgtatggatgaggatcatattgctggttttgatatggattacggtattgaagttgctgaccattgtgggatgtagcatttatcagcgcttgggttccgcaagctgncggtctggggggtatggccatgccaaagcagtgtgtcttgccctctagctcagtttcactggggtttgnccccgaccatagagggggacaagggtagtgtgagatatttccgctttgcaaactgggcattgtgggtgctcatcagatgcgagggaggcact

SEQ ID NO: 12113 - DNA, 815 bp, Vitis vinifera
  misc_feature (739)..(739): n is a, c, g, or t
  Predicted polypeptide sequence is orthologous to G1526
ttttttttttttttttttttttttttttttgtaacaacaaaatgtgatgtatccttacattaaattgaagagtattattcctgattaatgaagcttacattgcaggaaatctattaacatttctccatttcttttaagggctacatttggaagtaaaatctttaacacaccttggagtcagctggggacttagccctgaacagacctgtctcaatttttgactggagggcagggacatcatctactttgcttgcaccactctatacttccgctttgaacactacttcagggttgaacaggttacaaaaataatgggattgaatggttaaaatctcttcagcctccacttagcttctgcccagtgccataaataagaggaccacctcaactactcagttagagatccaggctgggtggacggcttttgagtttccttagtcctgaacatcaagatttcaagagctctggaagccaaagcaaaaacccatcttcagcatggtgatttaatccaagctttacttgatgctcttaagtgaaaagcatcttcagttcctcaatgcgtgcacttcggacttcttgatcagtcaaggcaccagatatcattcgctgcttacgagcttgcactgccagcatcctttcctccaccgttcccttcacaatgaaccgcttgatcattaccctttttgtttgtccaatacgatgaatccgcataacagcttgttcctctacagctggagancaccatggatccaaaacaaaggcattggatgcagccggtaggtttattccaactccaccagccttcaacgacatta

SEQ ID NO: 12114 - DNA, 516 bp, Vitis vinifera
  Predicted polypeptide sequence is orthologous to G1543
ttttttttttttttttactaccatttaaaatattgaaagctatatatatcgagaatattcaacatgcataactatacttgtgtcgagttccaagcagcttaatttcaaacatatagtgccaaatttcttttagaagcaactgggcattattgatggcaccccttagggacatatatactaatagggaattctgaaagacaacaactgattcgatacaaacacataggatggggtattaatattgagactggactggtactgccgagtgaatgtcgtgtaaaagctccatcttctatagattacaaggccagtccatgaaactctgtaaagaagtaacttcaaagataatctcagttttgatgtttccgaagatagatctttcttatagttgcatttgcacaaagtataggcatcttcatgtcttggtgagaataccttgaaagtgtagatgcagggtacgatccttctatgcctcacccaggggatgttcaaattgagttacagaaacagcatgta

SEQ ID NO: 12115 - DNA, 788 bp, Vitis vinifera
  misc_feature (779)..(779): n is a, c, g, or t
  Predicted polypeptide sequence is orthologous to G1554
ttttttttttttttttttttttttttttttcagtcttatcttactatatctagtctttttttttctttgggttgggcagtggctaccccgaagcaaattaaagcgattatgcaaattgaagggcttacaaatgatcaagttaaaagccatctccaggtggatcctcaatacctttccaacctacaatttatcaacttcaataccgctaagcctacataactttttcattttgtttgtttgttctttaaatgttgcttttgcgttagagcattttgaaagaaagactaccctttataaatcttttgggacagtggaagttataatgagaataaaccaccagggacccagaccctttctatgcaataagacctcgcgaacctcaccacacttaattgtcccataaagtcaccatggtcctgcagtatcttattaccttccctctgaataactctttaataaattgatgtatgtataattttctagaaataccggcttcacaacagggggcaacaagtggaagatacagagccagcaaatcgacaagcaagtttccaagagccatggaaacctgagagccactccggaaactcctggagcacgtggagttagtccaacttcccagttgtccactaagcttagcggtgctgggactacttggaaggcctctgctgctgacaatgccaatagggtcgaaaacgagctatggcctcagaagccagttttgcaaatctggggacactgatgcaaacttattctcctataattttatgtgcaagggntatatgtga

SEQ ID NO: 12116 - DNA, 662 bp, Vitis vinifera
  Predicted polypeptide sequence is orthologous to G1560
tttttttttttttttggtgaggatacactgcttggtaatcctcgtatcctgtcaatagagagaaacccagatgaaagttatggtctaatgacacttgcagggttacaaaatgagacagggattaaccaaacaactagagaaaacctcctaccaaaagaaacagccattgaagtgaagtaaaaaggcaactgatgcagaaaactgggggtggaagactattgatgcagaatgggttcctacggtgggctggagcccaggtaaccaaatctgccagccaggacattcacatcttcttcttcctctccttcagcaccaggtaggcttgatggacagccaaatctctcattcaatagttcttcccagaactcctcatcaagttctttatcttcactttcaggagggtctagctcttcatgatcctctagctcctttcttggtctacccaacccttgcatttcaaaagcaagtgcctctagctctgaaacttcaaagccatttccttctgtgaaatgtacaggctcaatcttaatggggttcctcaatccgttgccatggctggatttagtgcctccagctccactagtcccttgatcaataggccttcttctcttctactaatggcttcacaagctctttctctctcttctgctggatactgctga

SEQ ID NO: 12117 - DNA, 559 bp, Vitis vinifera
  Predicted polypeptide sequence is orthologous to G1591
tttttttttttttttttgggaaagctaatcaatgaatgtgattgttgtctcattataccagtttctaaccagcacaatatataattcaaaagatcaggacttaccagtctaaaagtagcttgtacaaaaaccaattccatcaggaagaaggtgctgcagaattccaacagggcgaaacaacacagctttcagatcccaggacataacatcctaacgtcgaccagtgtgagagcctttcttccttcctctatatgtttcagttcccaaagaaaatggatgcacaggaaagcggttcaaatttcttgtttcaaactcattgcggggatttgaataagcatggtgggtattataattgctcttgtttaccccctgatgccatgatggaggcattacaaatgtatcagcataaggcctaaaaggcggcaatctcatcatatttggagtggagcacatatcatgactagaaaaccggtatggtgtatttccatggtgaaattccattggagagtggtaaaaattgtgggcaggatcagtatgcaactggatattggaagctgtg

SEQ ID NO: 12118 - DNA, 935 bp, Vitis vinifera
  Predicted polypeptide sequence is orthologous to G1634, G2701
agaagagataagaggtttgagagagctcttgctatttatgatgagaactctccggatcggtggttgaaggtggcggaaatgatcccagggaagactgtgtgggatgtgatacagcagtacaagatactggaagaagatgtcaacgatatagaagcagggatgcttccaattcgtggctaccttgccccttcttttacactggagttggttgagaatcgtggcttggatgcgttaagaaagaggaccgccactatggttcgagcttctgatcaggagaggaagaaaggggttccatggacagaagatgagcacaggcgatttctgatgggtcttataaagcatggtaagggagactggagaaacatatcccggaattttgtagtatctaagacgcctactcaagtagccagccatgcccagaaatacttcgctaggcagctttcaggagggaaagataagaggaggccgagcatccacgacatcacaacggtcaatctgaccgacactactcccccagagaacaataaatctccttcattgcatcactcaactgcacttcagtcgcagcagaagtccactggtgctccaaaagtaatactggactgggatcattccaatgatggagccctcatggtattcaattcgactcatggcaatttgttcaggccatcgccatatgaagttgcttcgttcggtacccatcatggagctcatattgtacctcgcaatccagtgtttcaaatccaatctgcaagacatcaagttcgtggatgagcaaatcgggtccagaagagaagagcaggggagttgatggacaaggaagcagtctctgtagttcctcagtggattgaggagaattctgatgttatggtgccctagataggcatggttttttatgtgattacatgaatgaggagttgagctactacttaaaa

SEQ ID NO: 12119 - DNA, 725 bp, Vitis vinifera
  Predicted polypeptide sequence is orthologous to G1635
tgaaactcatgacaaagagattcacaatgaaggatcttggaccgggtcaaatactggatcagtgaacgaggggggcaattgtgatacaaattgggatgttgaaacccagagccaccaaccttatttagacacgatggaaaaagaatcagactcagctttcgagttaaagttgagcgagagatcagccttctctagaggaagaacaaacacggacaagtgtgtgaaggggtttatgccatataaaagatgtttggcagagagagacacccagtcatcaataataattgggaacgagagggaggagcagaggaaccgcctttgcttgtagcgtctctcactggaaagaaatcccctagagcgcagtttcccttttagtgcatagatttttttttgacagattcagaaactgattcaggtaccgttaaagaagaaaatggggcagtaaaacggcagccatttctgaagctttgcaaagtctcttctacttctctactagtactaccttttcccctcatctgttcaaatccataaccctactcctttacttgcaatctcttttgtcctttcggaattagcttttatattcctttttaattctttttgcctttgttgaaatgtgaatccttgatcacactctaattctggtaatgtcctggacacctatgattggaggataaatttacataaagtgcagcattttcgaccaaaaaaaaaaaaaaaaaaaa

SEQ ID NO: 12120 - DNA, 211 bp, Vitis vinifera
  Predicted polypeptide sequence is orthologous to G1637
tttttttttttttttttttttttttttttattaactaggagttagatagatacaaaattttaggtttctaggttcataagctgcataaatatacagggtgtatgaaaattatttcagttccgggcacctccccacaaatcattaacatgaaagttcccctccttcaacaatcccaattccccaacatttccctctcaacccctcaatctaa

SEQ ID NO: 12121 - DNA, 664 bp, Vitis vinifera
  Predicted polypeptide sequence is orthologous to G1641
tttttttttttttttttttatgagaaccttcctatttggtttcacatttcatgattttgagatctcaagaagaaacataatcccgtcaccctcaagttcaaatactatggactagcaaaagtctcgaataacatattcacataaaacggggaaaaaaaacacaaacacagctattctagtgaactgaaaagaagatgtggcattctaagccatgttgaattcaaaacaactgctacctcatccatgaggaaagtgcggggtggattgcatctgaaaaaccatactttgaggtccaatgtaggattcattaaaggcagctctatgcagattttggccctgcattttaagcccatatgagttcattccataaggagaggacatgaaaatatttccatgtgtcggattgaatgccatgggtgctccactatttggttgactccattgaaaagttgttctattcatgggagcagaattgggctgcttgggaaccccaatggactgatctggcgaaggaggtcttttattttctggtgaaggtgttcgagtgtcggtgagattgactgttgttatgtcatggatgctggctcttctcttatctttccctcctgaaagctgcctgataaagtacttttgagcatgactagccacttgagttggcgttctg

SEQ ID NO: 12122 - DNA, 502 bp, Vitis vinifera
  Predicted polypeptide sequence is orthologous to G1645
cccacgcgtccgatgatgggtagtttttcttataccatacagattttctatccctattgcagtagagctcgacagctgattccaaagtgaagcaaatagagtagccgaccagcatgggcgatgataacaggaaatttacctagatcctaccgctctaaaagcaagtgcgatccgacccgaagaaaggggtgtgaaaaaaagggaagcccacgcaacccaccaggcccttgaaactgagaagaagctgaacgggcattctatataatgcttagtgtgtaatgaaggaggttgatttggagtttgtggtttcttggggttgaagaataatatatatagcttggcgcatgtgacatacgtatgggttgatttggagtttgtggtttcgagtgttggatatataatccataagtactatgtgtattaggagtttgcttaattaataatagagctgacttaggtcagtctccatgagaaaaaagaaaaaagaaaaaaaaaagggcgg

SEQ ID NO: 12123 - DNA, 686 bp, Vitis vinifera
  misc_feature (570)..(570): n is a, c, g, or t
  misc_feature (609)..(609): n is a, c, g, or t
  Predicted polypeptide sequence is orthologous to G1652, G2776
ttttttttttttttttacctcaaaaaaagctgcaactttcctttttattttttatagcacgtggggtaattgaatctggccaaccaggaaaagacaaacacaaacaataaccctactgctaaactgaacctcagcagccaagtagacatggtgatcaccggtggtgtaaggtgaagatagctttttacaggcattaatttctcttaggaggtgtgaagacgagacaataacttcaggttatacctaaaggaaaaaaaaacaaaaaacagacggcaatgctaattaaaaaatgatttggttcttcagttcatatgaagcgtagaaaaagccaatcggaggtttctgacgaggtcctccacggtcatgcaaaattcgtcttccatctgagcaacaactgtaataaccataatgtaattcccaaatggcaagctactgctattgacgacggttagatggagtttctcgatttcatcaagtattttcacagtaaatcccttttgtctctcgcaggggattctaatgagtacgtccttattaaagactcttgcttcaatttctaagagtgtttgnttgaagcagctatcagagttctgatcagatgaagagtgntcattatcacagagctgagatttcttcacagagaccactgattccatggttttcgttgccgtctgtacctcgagcat

SEQ ID NO: 12124 - DNA, 586 bp, Vitis vinifera
  Predicted polypeptide sequence is orthologous to G1660
ttttttttttttttttgaaaagacaaaaaagaagcttcattccagctcttaacagcagaatacaattgttgtcatgagaaaacagcccacgaggcttctgcaaaatgagacggccacaatggcaaagacatatcaacatcctcaaattcatacatgctatatatgctacatcacagcacaatgtctaaggaatcagtcacagtgcaaaacaggaacccgaaccagcctccccaactagtgtttcagattttaggagcaccaattccagcaggaaaacgaggaagggatgcgcccagtttttcgtatatactctgcttgctgctcagtttttgctgcttgtcgactcctcttggcttctgctgccgctcgcttctcctcagccttgtgccttgcagctgccagcttgttcatcagcctgtcatgggcccttccccttatcctttccacctccacctcaattttcctcatctcagcttctgtctttgctttctgatgattttcccatacttgtattttgagctcttcgcgttcaaacctggccatatacttagctttctccgcctcctcccaagctgctgcacgtgtc

SEQ ID NO: 12125 - DNA, 713 bp, Vitis vinifera
  misc_feature (11)..(12): n is a, c, g, or t
  misc_feature (608)..(608): n is a, c, g, or t
  Predicted polypeptide sequence is orthologous to G1718
ggcacttacgnngcggggatcttcttctctctaaaatcccttcctgtttctgtttctgtttctctttggaggaaatggcttccgaatctgaggcttcagggggcatcgtctagtgcatcttttcttgagaggctcataagttcaaggaacagagacctctccatgttcatacccttcatcttgggcttcactgacacaaccacaaggcaagaatcggatgacccagatgatgaaaccactgatacgccaacccctcgcgacagaatcatcctcatcaacccattcacccaagggatgatcgtgattgagggcaattcgagctttgattctctgctgagagagctggccagcaagggtgggcagcccccggccaccaaggcctcgattgaagccatgccgtcggtggaggttggaggggatgatgggagtgtgtgatttgtttggaagagtggaaggtgggttgtgtggccaaggagatgccatgtaagcataaatttcatgagaattgtatagtgaagtggttggggattcatgggtcttgccctgtttgcaggcatcagatgcctgttgatgaggaggatttggggaagaagagagaggggagtgtnggtgacgaagaagggagggggaggagaagggttgagagggagatttgggtgagcttttccttcaacagtaatagcagaagaaatgattcaaatcaaactccttca

SEQ ID NO: 12126 - DNA, 578 bp, Vitis vinifera
  Predicted polypeptide sequence is orthologous to G1743
ccgaaacttcttctgcacacgctttctcttctgggtttcatcagaaaactcatctcctacttcttccgcttcctgggtctcaccgattttctggaaccggacattgtgtggacggaggggtcgacccaggtgccggaatttcagtcggtgtcggcggttctgatccgggagatcctcccggtgatgaagttcgaggagctggtgggggccggcgctggagacccgccggaccagtgtgcggtctgtctgtatgagtttgaaggacaggaggagatccgacggctgacgaactgccggcacatatttcaccggagctgcctggaccgttggatggactgtgatcagaagacgtgtccgctttgtagaactcccttcatccctgatgatatgcaagaagccttcaatgagaggctttgggctgcctctgctcttcctgatttctatggagactactctcctcttggtttatagctcctctccttttcctttcttttcttttcttttcttttctcagagaaattttttttttttcgatgttgattgtatatataccaaaaaaaaaattgatatatgggatg

SEQ ID NO: 12127 - DNA, 695 bp, Vitis vinifera
  Predicted polypeptide sequence is orthologous to G1743
gagaagctgtgcgattctctctctctctctaaaaatcttcatcgtctctctttagaactgttcaatttttctctctagagctcttcactctctctctctaagtttccatggggtttcctgtgggatacacagaggttttcctcccaaagcttttcctccacacactctcctttctgggtttcatcaggaaactcattttctcgctctttcactttctgggtctctccgatttcctggaaaccgacgtttcgtggtccgaaacgcaggcgcaagtgccggaataccctccggtatcggcggttctgatccgtgaaatcctgccggtgatgaagttcggggaggcggtttgcggcggcgacgcgccggagagttgcgccgtatgtctgtacgacttcgaggtcggagaagagatcaggcggttgaccaattgtaaacacattttccaccggagctgtctggaccgttggatggaccacgatcagaagacctgtccgctttgtaggaccccatttgtgcctgatgagatgcaagatgagttcaatcaacggctctgggctgcctctgggatcactgatttttacagtgaatacggtaccgtttcgggcttgtaggtcggagatttttcatgggttttattttattttttaaattttggtttggtgagggtgagagggttgaactgtatatacatgaag

SEQ ID NO: 12128 - DNA, 396 bp, Vitis vinifera
  Predicted polypeptide sequence is orthologous to G1752, G2512
tttttttttttttttttttttttttttttccgagaatcattaatccattaccctcattcttatttaaaggcagcagaaacatatacagaacctacaacccaaacatggaccgagaaaacataagaagcaaggaaaggagattgatgatcagagaatagcacaaacagaagcggtttctgaatcagcggcggtggaggcgctgctggactgatcgccgagtttgacacctggccaatcacggcagagacagtgttcgccttccgggactcgtttatggacggagggaacatgccttccgcacccaccccatgtggtcttcccacaagtcgagcacttcacctcgtagcacatcttcgtcttccttctcaatttcttcttcaattttttagggtcccc

SEQ ID NO: 12129 - DNA, 482 bp, Vitis vinifera
  Predicted polypeptide sequence is orthologous to G1767
ggagcttcccacgcactagcaacgagcgcctcatgctcgaacgcgcctccggacgcgcaatcgtcgacctggtggcttgcccgccgtcggagtcgatcgaacggcgcgagacggccacgcgctggtctcagcggctccatgcaagcgggttctctccggtgtcgtttagcgatgaagtatgcgatgacgtacgtgctctcctgaggagatacaaggagggttggtcaatgacacagtcctccgacgccggaatattcctctcatggaaagaccagccggtggtgtggaccagtgcatggaaaccttgatccaccatcaccactctcacacgcatagagtttgattcccacgtgtatggtttttttttctttttttcctttttttgtggtggcacgtgcatggcatggagtttgtgggtgtgttaggatggaaattgctttaattgaatagagaattgaagtaatatattctcattcctcttt

SEQ ID NO: 12130 - DNA, 729 bp, Vitis vinifera
  Predicted polypeptide sequence is orthologous to G1772
attggcggcttaaagatgtatttgagagttgctcaagtctcagatagggaatttacatatatatcgcccacaaaagccccaataaaaggctatttacagtataatgattttcagcatagcgaagaaaaggaaaattaaaaagggggggaaatgcaatttaaaagaaatgaatttatagtttctcttccagggtagatctcaacaagggagagggatgtgtaactcaagaagggaaaaggaaaaaggaaggcagggaaagggttttaagtatggcatcacaaatgatctgatcccatgagagagaaaccaaggcccactctttaagttagagctgtacacttgtatttgaaacgaaggctgaaactttcaaagattagttcctatccacgacctctgctggcaagttgagatcaatgcctccgagaccctcctttctagcccgcttcctagaagaatatccactctcatatgaactcccagagcctgaaggtcgatcaaattctgctgtccctccatctgtgccattttctgaagatggacagttatcagcattgctggctttattgctctgacaggttataagttctgatgccctttcaatgccctttgacttatatggagcaatattgtggatgccatgttggagagaacccaatagatcattctcaatgcattcatacattttcttacagagggtatccgtgatcactgataggttgatgacttgca

SEQ ID NO: 12131 - DNA, 673 bp, Vitis vinifera
  misc_feature (156)..(156): n is a, c, g, or t
  misc_feature (204)..(204): n is a, c, g, or t
  misc_feature (257)..(257): n is a, c, g, or t
  misc_feature (281)..(281): n is a, c, g, or t
  misc_feature (395)..(395): n is a, c, g, or t
  misc_feature (489)..(489): n is a, c, g, or t
  Predicted polypeptide sequence is orthologous to G1789, G1911
ttttttttttttttttttttttttttttttgcgcttgatgatagatattccattaaaataggggtgggaccgggattacgtgcatacaagagcggacagagagagtcagacttttttttttttttttttccgtttttttttccttaaatgaaaagnccgcttctattttttcctaaaatataatttaataggagccaggccttnggatttcttgcaggtttaggatacttcaaaagccaacaggggcttttcgtctntttgtagttggggatcggagatcngcccgactcgatatgcttgggggcccgaataaggatctcggaggggggcttgatcgacgatcgatcgatgccccccccagcgtgggccacattctgccagcgggggggggtggnccgtgacatataagggatgagccttttctaacagtttgttttgttttggggcccatgagccagacctctggagaaaaggagatgccatggatcntttcaaaggagataacaaaccaagggggttttaaaaaggactaggggggattagaaataatcgggagataggggttcaatcttctaacttaaaaaaaggcctaaaggaagggtacttgaaagaagagagggagctgagttggaaggatgttgtgtccccggccgtgatggccgaattcccgggc

SEQ ID NO: 12132 - DNA, 439 bp, Vitis vinifera
  Predicted polypeptide sequence is orthologous to G1789, G1911
ttttttttttttttttttttttttttttttctgatcaatagagatccccttaaaaaaaggggggtacagggattacatgcatacaagagcagacagagagagtcaaactttttttttttttttttcggtttttttttccttaaaggaaaaggccgcttttactttttccaaaaatataatttaaaaggagccaagcctgggactttattgcagctttaggagacttcaaaagccaacgggggcttttcgctacttgtagttgggaataggaacacggcccgactcaatatgttgggggccccgaataaggatctcatagggttgtttcacctccccgggagattggccacccacagggtgggccactttctgccaggggtcgggggggtcccggccatataaggatagggcctttccaaacagtttgttttgttttggg

SEQ ID NO: 12133 - DNA, 763 bp, Vitis vinifera
  Predicted polypeptide sequence is orthologous to G1789, G1911
tttttttttttttttttttttttttttttcaacgtacaatctattataacaagtaaatacatttgtttctgcaaaattccattacaatatggtaggaggataaagggatgaaggacttgcaaaacaaggggcgaggacaaatcctacaggaaaaaaaaaaaaatttatactttacactgtatgggggaaaaaaggaaagggaaggaaataaacttcttgttattctagtactccattacttgctttgtagcatgaagcaaaaaaaaggaaagggaaggaaattaacttcttgttattctagtactccattacttgctttgtagcatgaagcataatggatccttattgctgctaattcgtcatattatctgcttaaagcttcaaatacttcaacctaggagaggaaaaaaaacagaatcaaaaggaagccctctgttcttcatcgttgaagttgtatcctttgttggaggctccagcttttctgtagttaggcaatgggacttggccaaactcaatatgcttgacatcctccacaagcatctcatagtgcctcttcacctcctccacagtcttcccacccacagccctggccatgttctgccagcggtccggggtgtccttgtcatacatcaccaaagcattctcgaacagtttgttttgcttggtagtccagttatttgaactcaatcccatttctgaatctgcacacaaattgtaggtggggggcgcagtaccaaggataggaagattgaattgtatcccc

SEQ ID NO: 12134 - DNA, 484 bp, Vitis vinifera
  Predicted polypeptide sequence is orthologous to G1789, G1911
tttttttttttttttttttttttttttttctgataatagatactccattaaagcaagcgtgctaggtgaattgaattacaggcattagagggggatacaaggcaaagagagagagagaaagagaaaatttcttctggataagtctgcatctgcttttctcaaagatataactatataacttggtcatgcctagtcttggacctttattgcagctttatacacttcagcagcctctgttcttgatcaccaatgctgttgcttccagtggacttgtaattaggaatcggaacatggcccgattcgatatgtttgaggtcctcaatgaggatctcatagtgtctcttcacttcctcggcagacttcccacccacagccttggctacattctgccaacggtctggggtgtccttgtcatacaaggctagagccttttcaaacagtttgttttgcgctttgaagtccataagccagagcccatgcgaga

SEQ ID NO: 12135 - DNA, 611 bp, Vitis vinifera
  Predicted polypeptide sequence is orthologous to G1789, G1911
ttttttttttttttttgataatacttcattcatatatagaaccattacattaatttagcagcacaatggaagacaaaacaagaaaagacatggacacaatatttttcagtaattctgcttctgcttctgtgtcttggatagatacctcagagggctctgttcatcatttcatggccatgcccacttcacctgtaattgggaaatggaactttgccggactcgatgtgcttgacatcctctatgaggatttcatagtgccttttcacttcctccgcagatttcccacccacggccttggcaatattctgccagcggtcaggggtgtccttgtcatactttgccagtgccttttcaaatagtttgttttgcttgggtgtccaagaggagccagaggtacgtgaagaagtcatagagttggatgccattagttgatttttgaagtatgggcttttggatttgcaagaggaaaggaaaaaaaaaaaaaaaaactcagggaatgcagttggaaaccaaagtgaaaatgcaggagtggctggtatgaatcccacgaaatggaaaagaaggaaaaaaacagctcagttgcttcagtcaaggaagaggagttggaagtc

SEQ ID NO: 12136 - DNA, 503 bp, Vitis vinifera
  Predicted polypeptide sequence is orthologous to G1809
gcaggagcccaagatgtctcttcccaatcccaccccctcggcttccaggagttacgagcaggagggatcatcttcttcttcgccttggaggaggcacactgccgattccttccctcctctcaatattcattctgacaacaagcacaaaaagacagcgatgaagatttgttcagagttcccgacgtggaagcgcagcccccttcggattcaacgcgaaccaccaccaccaccacaacaacaaatactagtaataatccagaggttcaacaacaaactagcagcggcaagcgccggaggggacgcaatcctgtggatagggagtatagaagactcaagaggtacacattatttacacatcacccccctcctaatttttatgtttacaggtgagttcatcacatattgatttgagcctgttggccaatgtataaagatgggcacattcatataccattgactcgatgtgatctaatataagtatcaagtatcaaactttaacaatc

SEQ ID NO: 12137 - DNA, 609 bp, Vitis vinifera
  Predicted polypeptide sequence is orthologous to G1809
gaatttataattgaatatgtacttactaaggaaataatagtcatatagattggttcagtggtagtaattaataggttacacaattacatttagtgtggcccccaaccttaatgaaggcagcatgcaggctgaggttgccttaatttggaacacaatttgtagatacacttttagtaaatcaaaatgattacagtcaggtgatagtggctccatggcactggacatgacccagacagtgataatcatgtagcacagctaagtgcatatctgcaaggctaatttttcaggtgtttggcaaatgggtttggcgcagattcaaaaataaattgatctgatgacaggcagaaggatgtggtagaagttcttcagctcttgcccaactgatcatgctttgactcagtactactgtcatccatcttaggcctagtgttcatgaggaccttacggagcatggtgttttcgttaacaagagttgagattttctcttctagttttgagttcctgtcctgcaactcctgggctcttgactccagatcattcacatacaccttctttctttctcgagcttgttggggagaaaccctgtttctcagcagtctcctcgtgccg

SEQ ID NO: 12138 - DNA, 753 bp, Vitis vinifera
  Predicted polypeptide sequence is orthologous to G1823
tttttttttttttttttttttttttttcagaacacaacatatataacatagaattcgaacaacgagaaagagaggttacaagcgttgaataagttctagacggaggaccacaaataatggtagaagcaaataattttgttaacatacacttcctgccaagggagttttatttcatggggcatacactattgaacaccaaatgagacgataaaaatgagggataggcgagatcaatgatagcagccacgagtgtaagtgccacaatgtccggttttactaactcttttgtttcctctggggaggcaagatccatagcttttatactgtccacaaggcgcacctggtttcttcccaatgagggctttgtaaacggtattcttggaaggatgggaagcctgcaacatcctgtttgtttcaaaacccatcaaaaactcctcctccggggctatgtccccaaccagccactcctcttgatcgccattgcagcacccacttgtggaggagttgcccctcacaggcgacacagctctacagatatgtgcgtggaggagcattatcagaatcagtactgttgttgccagcaaagaaggacctcttctcacttcaactcccatattttgatgtggttggagcctggggggtgttgcagatgagaaagaggatttaaagcaacactgtgaccccatgagccaagttgctgcccagcgggaccaattgtcggcacaaaaagacatactcatttcagttttcccc

SEQ ID NO: 12139 - DNA, 244 bp, Vitis vinifera
  Predicted polypeptide sequence is orthologous to G1832
catgtattcacgggaagtgatattgtatatagagcataatgatgttgtgaacgggagaacaaacaatcaaaccttttggtgtttgcttgaaaggaagggtttggatttaccaactcgcaacttggaagttggaactaggttcagttgttgaaaccgagggctcaggaaacttccactgcatacaacaattaaacaagtctattcataatttataaaaattttcaacaaaaaaaaaaaaaaaaaa

SEQ ID NO: 12140 - DNA, 889 bp, Vitis vinifera
  Predicted polypeptide sequence is orthologous to G1835
gctgcagcagaacataagaagaaaaagaagatgaagctgtcgcttccactgggtcctgtggagatgaaccaaaatccacccgcacaagcagttaggaaatgcatgcattgtgagataacaaagacaccacaatggagggcaggcccaatggggccaaaaaccctatgcaatgcctgtggtgtccgctacaagtcaggccggctcttcccagaataccggcctgcagcaagtcctacgtttgtccccgcattgcactccaattctcacaagaaggtaatcgagatgagaaacaaagcttgtgaaaacactgcaatgactgcaagcgcaccaacggggaccacctccccaccggagctcattccaaatagcagtgtttcattggattatatgtgaaggaaggaggatgtagagaacagttttcctagttggtggagtctctccgggctgcctctcaagtttgggtcttcatgttattttacttaccggttttttcatttctttgttcattggtttttgtacagaggtggaaagggggtggataggagctatagatgaccatatttttagcaagtagagaaaaggatgaaatgagaaaactgagaactgagaaaaaaggggtaggagagaaatggaagcttagtggtaggagggggaaagggatttaggttcggcaatatttaggtctctctggtcaagttcagtcagtcattagatgttgggttttgtgtctttgtctcttttccgttttcttttctcctttgatgggaattctttttgcagttcatttgtttgtaggatattctgagataagtaatgggggttgaaatgagataagaaaaaaaaaagataaagaaaaaaaaaaaaaaaaaaaaaaaaaaaaaaagataaa

SEQ ID NO: 12141 - DNA, 830 bp, Vitis vinifera
  Predicted polypeptide sequence is orthologous to G1837
ttttttttttttttttttttttttttttttctgaaacgaagaaaaatatattaatagaagaaaagatacaagagaaagaagagatacaagagaaagagaagaaaccaagagaaggatgagaggtccttcccacaaaaacaaaagctgaacgacagagaagacacccaactatagaatgtcaaaggacagctttgctgtccacacttatttccttattttagcccacacttctttcttcattttagcccacaattgtttccttatttctccatttataattctatacagttagcatacattatttgacaaattatagtttacatgtatagggatagaatcatgcggggatttatttgctttccatgtatagcatccttgtaaagtctatatataatatacaaaactcaacgccaaggtattcagccattcacacaatattttgacataaaaaactaaaaataaagaaaaaccccaacactctcaaacttttgaatcgcaaaccgcagtccagttgagttgtaaaacacttgaggaactcctctaaaagctgcagtacaagaggctcaacttattgcatttttcaagacctaactaggaggaagaagattggcaatgttgaggaaagagagggattgtactatttgaaccccaagacaagtatgaccaagcttttgtctcaaaagctatttaaaaaaaaaaggaaaaaggaaaaaaaaaattgggtgggtacattcaataccacttaaaatatattcaaggaggatgcaactagctctagaatccctacatgctccaaccattaaccttaataaaggtattgaaaatcaaac

SEQ ID NO: 12142 - DNA, 236 bp, Vitis vinifera
  Predicted polypeptide sequence is orthologous to G1837
ttttttttttttttttcttttttttttttttttagggtctgataccatagacacccaagcaccttccggctgccggagcccatactccgtgagcatgtctaggtacctaccagaaccccaggtaaaccccgtcagaggaattaccgtcaccagggggcggagagcctcacttcgccttcctcaacctggtcatgagtgagagttccccctggtgtcacgcctgaatttggcacgtc

SEQ ID NO: 12143 - DNA, 265 bp, Vitis vinifera
  Predicted polypeptide sequence is orthologous to G1837
tttttttttttttttttttttttttttttttgggaagacttcctcaataacccattaccataaatgttactatcagaagatccggtgtttcaagatttggagcaagactttcacaacatcaaacccagtaaagaaacctgtcactaataacaaactgatggcatacacctaaaccctaaaagctcaatgtggataaaacatttcaatccaggcgttcatgggaagagtggcagtcaaagggcagcctgaaaccgatgatcaatga

SEQ ID NO: 12144 - DNA, 641 bp, Vitis vinifera
  misc_feature (623)..(623): n is a, c, g, or t
  Predicted polypeptide sequence is orthologous to G1838
ttttttttttttttttttttttttttttttaagaaaaaagattagggctcccattcaacatccattgagaagtttacaaaacctagttttcctagcataactagaacttcatcttgtctcaaacaaaacctcatatgtttcaacaactgctaaaagtcatgaaagaggtggtgggtcagatgtgggtcagctgggtaggaagcacaaacaagagcttttgctaattgttagcataattgtgcggtcagtaggactggtgaggccatatgaaaaactcagctggaggcggcaacaaagccattggggttggcatagaggaggaggtcgtgcctggggagttggaggcgcccatgttactggagtgaagatggttgaagaggttgtgatgataaaatgcagttgcagtatctaatggaattccacatgggattgcaggaattggttggattgcgccgaaagtgatgccactgctgctggcgctggactgagtttgctggtccaggttcaaacaaggcttctgatctgattcaagcgagagctttagccgctttgctgctccaccaatgggaagagcactatttgcaattgcttccacatcatatcggttcatctcgaaatgatcnaccgcattcacaccccga

SEQ ID NO: 12145 - DNA, 876 bp, Vitis vinifera
  Predicted polypeptide sequence is orthologous to G1852
agcctgctgggggacatgtctccccaaccaaaatgagtttgggcttgaattgtgtgatgaatctgatgattcaagttatgcatggtacttcaagcttaagaaatgtgtgacaaggatatcctctgtcaaggatgaccaggttgttgggatgataccaaactggccagacaggctaacaaaagctccctctagggcaacacttctgaagaatggaattgatgtatttgaagctgatactcggcggtgggcaaggagggttgcatactataagaactcattgaacttgaagctggggactgcagctatacgcaatgttatggacatgaatgcattctttggaggttttgcagcagcactcacgtctgatcctgtgtgggtgatgaatgttgttcctccccgcaagccatcaactctgggagtcatttatgacagaggtcttattggggtctaccatgattggtgcgagccattctcaacataccctcggacttatgatctcatccatgtaactagtatcgaatcattgataaaaattctaggttctggcaagaacaggtgtaaccttgtggatttgatggtggaaatggatcgaatattgcgtccagaaggaacagttgtgattcgagattcccctgaagttatagacaaaataggtcgcatagcacaggctgtaaggtggacggcaaccatacatgagaaagaacccgaatctcatggaagggaaaaaatccttgttgcaaccaaaaacttttggaagctaccttctgcatcccattgacatagcctcctgttctttgtaattaagagataagtgggatcagagtgaggaggaaaaggtacataaaactggaaggcttgtgcagtgagttttgtatt

SEQ ID NO: 12146 - DNA, 492 bp, Vitis vinifera
  Predicted polypeptide sequence is orthologous to G1855
tttttttttttttttcggttaatcattttccacttttccagaacaaacctcaattagtctcattatttattcactgatgattataaatatctgtctgaataactgtctctccttcactaaagaccactaaaaatcaatcaaaatctctatcctattaacatgatttatgtgcatttaatgttttggatcaataacaagaaaatttctcaaagcatctagaaaaatttacctattcacacttctcatttgtctaccaagattatcttctctggatggaaaggcccatactcgctgtgtagaattttgcttttccatctcattcgatctgtgatgccttttactttcgcaaagatgtcaatgtgatctctgattatagcatccccttcctgacgaataattcggaacatctcaaatagaatatcaagaatgtcacatttgcccatgtagatgctgaaaactccatgagcatgtatcatatcatatgttcgagga

SEQ ID NO: 12147 - DNA, 423 bp, Vitis vinifera
  Predicted polypeptide sequence is orthologous to G1855
tttttttttttttttttttttttttttaagcaaacctcaactagcatcattatttattcactgctgaatatagatatctgtctgaataactgtctctccatctctaaagagcactaaaaatcaatcagaatctctatcctattaacatgatttatgtgtatttaatgctttggatcaataacaagaaaatttcacaaagcagctagcaaaatttacctattcagacttcagagttgtctacaaagagtatcttctctggatggaaaggtccatactcgctgtgtaaaattttgcttttccatctcattcaatctgtgatgccttttactttcgcaatgatgtcaatgtgatctctgattatagcacccccttcaggacgaagaattcggtacatctcaaaaaaaatatcaagaatgtcacatc

SEQ ID NO: 12148 - DNA, 754 bp, Vitis vinifera
  Predicted polypeptide sequence is orthologous to G1863, G2334
ttttttttttttttttctataaaagctcaaacaagtgtatcaagagttctcaaaagttaaaatgagtcatttctccccggattccgggaaaatttttgtcatcccctgcagaaactaggaaaagaacattgttctaccacatgggtaacgccatcaagaaacccgcaaaatttacagcaatcaaaggaatgccagaaaaaatggtttctgttttcattcgttacaaacacaatgttttctggttcctgaatatttgccagagttttgagtcttgttttattccatacctaaaacttgaactcgcaaatgtagttttacacacagagctacacggaaagtgcacaagcaaatcagacaaatcttcttccaagttgcaaatggtagagctcctggaaatccgaaatcatgattctttcagttatcgtggggagaccgagagctggttgttgagaagtcagaggaggccattgggatcgaaattgagagctgagttgtggagaatgaggtctggttggacctctcttcctcaaggccggaccaggagtctctggttttaggccactcgtcaaagaaaggacggagagactgaccctcctgtttcacaacctctcccgacgcaaattcgctgctgaagaacgaatgctgggggtagtcactctgcaagatggagttttcacttgattttgatggggggaatgatgagacccgtgatggcatcagaggccatgtgctgtccaaggcgagtccatctgaa

SEQ ID NO: 12149 - DNA, 781 bp, Vitis vinifera
  Predicted polypeptide sequence is orthologous to G1868
ttttttttttttttttttttttttttttttgcagtctttcactgtaatggaagaagagttggaaaaaagatctgctgtgtggaatgttgtgaggagaggagatgataaaagtgaatcgaaaacccattaatgcaacaaccaccaccgtcctagaaaatgaaaactcaagtagatttgtcaaagaatcagagagagaaaagagtagaaaaccagatcaaagggcatttaaactcctgtccatatgagaatcacagcaagagagaagttgaggcctgacctggccaagactgagtcctgaggaagatccataagcagcaacattcccatttcttcccatcattgacggcatatgggtcgccggaatcataattcccgccggcatatttcacacccagaagccctaaccagcctcaataagtggactttctcttatgttatagtgggtttaagggcagtgctttgagagattctctgcagctatctgagcaagcaaatgggattattacaagtaacaaacaggcagtgctgactatggtttttgcctttgaaaaagaggtctcaaagtctatctcttaatacgtgccagcccaccagaaagcgagtagggatgacaatttttttatacggcctttgacagtctaaaaccagactaatttcaacaaaacgaaaaaaaaaaaatgtaacccccacgaagatctcggagaatccaactatgccctaatctccctttctctctcttcctcccaatatctgcaaagaaaaacataaaaaaacgtaaaaa

SEQ ID NO: 12150 - DNA, 569 bp, Vitis vinifera
  Predicted polypeptide sequence is orthologous to G1868
ttttttttttttttttgtttgaaaatgtcctgatttcgaatctaaaggtgattcatggtgggtggagcccatggacatgatttccagccctccaccggaccacacccacaaaccacaacaatgtccctcctgttagaaacaatccctcaaccaaccattttcaaaacccttgttggacccagacacagacgcagcacagaacacttagattttctgaaaacaatttatggaaaattccttacgtccaaactccactaagacggttcagttttcggaccacccaggtgaagaacactcttgggggaaatggcatttgaggagctgctcactgggagagaaattgaaagattgctgtttgaggtggcaccatctctgactgagttatcaacagcacaactagctgtcctagcgccaagttgggaagcttccacatgctttcatgaacgctgactgcctctgtgcatgtgccgcacacagtaattctgatccgggactgcttcttggctacaccaccatttcttcccaaccgttcttctacatctccctggaactggattcatgctgttttt

SEQ ID NO: 12151 - DNA, 770 bp, Vitis vinifera
  Predicted polypeptide sequence is orthologous to G1880
ttttttttttttttttttttttttttttttgctcatgatcagcccccattagtgaacaaattgaatagaagcttacaaaaaaagatacatatataatccatgatgatcatactctccatttcccaaattaatgaacaaataacatcacacagattacagaatacaagccctccattgatcagattctgagtggagaaaatcacaacaccccttggtatatgaatatatagaagaaaaggaaaaggaaaaaggttaaaattaacatgaagatggatgtggaaaagaactatgggttagtagttttagctcgaacggatcgatgatgattgttctctactacttcgccctcggttatggcagatgacatgtaactaagtaccagggagttctcatccggtggtgcgacgtttcctgcagtcctcgttcggaattgttgcttgcaggcatgacaagtgatttggaggatagttgagttgatttgctttctggcatgttcttttagtgcttgtgccttgtccaattccgcttgtgcctgctgcctgattctcttcgcatgggtaaattctttatcggctagctcaatctgtcgctttgcctgctgccttgcctcttctgcatagaccttctccgccatggccagccttaactgctcgcgcgcctcttccttgagcctcgccgctccaaacgtagctttctcactggtattgcactccctaggacaccttgcgggtgccgaatataccttgttgatcagattggtaatgtttgat

SEQ ID NO: 12152 - DNA, 672 bp, Vitis vinifera
  Predicted polypeptide sequence is orthologous to G1880
tttttttttttttttatcagaaacgaagaaaaatatattaaaagaagaaaagatacaagagaaggaaaagatacaagagaaagagaataaataagagaaggatgagcggtccttcccacaaaaacaaaaactgaacaaaagagaaaacatccaactttagaaaactaaatacaaagaaaaactccaacactctcaaacttttgaaacgcaaaccgtagtccagttgagttgtaaaacactaagaggaactccgctaaaagttgcagtacaaacggcccaaagagaggaatagaaaagaagcaagtcccataacatctcttccattctccccttatcctcaaaaatcctatcgtttccccttatcctcagagacattcatcctccacgactttccctctccttttatgtttcctttaacttcatgtcttctgtatttatccaatgaacttcctgaagcttactgcagaaattgctttatcctacagacatttaaactgcctgggcagtaaaaatcaagagttttccttagaggttgaagcacgctaattagtaggttcttggaacttgccgcagtcaaaattaagcttggatcagctattcccattaacaaacttagataaagcactttggagttggttccattcccagatgtttcagtctcaagtaagtttg

SEQ ID NO: 12153 - DNA, 924 bp, Vitis vinifera
  Predicted polypeptide sequence is orthologous to G1902
tgctgtcgttgaagtcaaagaccaaggaagttgcggtaagttatagtccttattcgtttctgaactttatttatttgcatgtatttttgttggatttgattcaattattattgccttttttctttgattacaaatactactgttgttcccttttcattatccttttcttggagatgaaggaaattggattatgtattactcgaccataataccatcagatcagtcacagctttactgatatctgtgacaccatacccttttattgcaaatttctctgacgataatcgtaagtttagaatctccgatgttgaagggcccttatcagatgccaaggattagaagctgtaagccaggagatcatcaatcatggagaaccaatggcatagtttatagaagagcagacccctgttttagaaaaatattatttcccttggtttcagggattgggaagaatcttgtgcggtgtcagggtcagaggattcttccctcacccgtttctccattaatgcggatgatgtgtttcacatagcccttttctttgaacagattcgtcgaacatatctatctataagaatattcatttcggtggaggaccccaccagtcaatatcgatggacccataaaacctggcagctttcgcaaccatgggttggctgggttagctccttccccggatttcgctatcctttcaattaaatatattttagagatttgccctttaaatctaatttgattttttccttcaattaaatatattttatggatttaccctttaaatatgatgtatcaccatatttgctctggtcatatgatgtcatggctgatgtatgttggaatccttgaataaaactagaataattgtttgaccggatccttctagcaagtatcagcttctaggagtaactttgtaaggatatgaaattg

SEQ ID NO: 12154 - DNA, 810 bp, Vitis vinifera
  Predicted polypeptide sequence is orthologous to G1902
tttttttttttttgtttctctctcttgttttagataaaacccagtggagaatttgagttggtttcatgagaattgaagtgaaaagtctgggagaaaatctgggtgattatggaaatggaaatccactttgagggatggaaagggcctttttgattgattttgttcttgggtagtggggagtgtttttggtgattttcttgttctttttcttttctatgaagaatccatttttgggtcttgaaatatctttcactttttgtcctttcgcttgcattttggtcacttcaaatcttgtgaagtcaagaagtttctgaaagacccagttcagatctctaaaaacccatctgattttctttccaaatctttgttcaaagacaaacccattttccagagcaagagcacctcaaatgccctcgctgtgaatccaccaacactaaattctgctactacaacaactacaatctctcccagccccgccacttctgcaagaactgccgccgctactggaccaagggcggcgctctccgcaacattcctgtgggtggcggcagccgcaagaacaccaagcgctcctccaaccccaaacgcccttcttcttcttcctctacgtcgtcggtgtcttctccgccggtgtcgtccacttcaaacgctgctgctcagaagtccgagccctccggaatctacgttacggcggcggaccaggaccgaagaatgctcgacatcagcggaagtttcagctctctcctggcctcgaacggccaattcggaagcttgttggagagtctgaatccgaccgggtcggttcgtggg

SEQ ID NO: 12155 - DNA, 901 bp, Vitis vinifera
  misc_feature (883)..(883): n is a, c, g, or t
  Predicted polypeptide sequence is orthologous to G1927, G2184
cgggggggaggaatgatatttttaaggacttaggggacctgggcaagctggcagagatgaatgaagatggatttaatttctctagtagtcacaaaggcaaccattctctggatcagtggccccctgctgattcttttctggagttacgtgatcttgatcatccattgaaaatcactgtcgaaggtagtggatctggttttgtcccgcctggtggtgtttgcatggattgcgactgttgcaataactctgaacactttgatcatccatttaatgattttggtgtgaggcatcatgcttctgcatcaattcctaatcctcctgtgctggcggataggtcttatgggtttgagaatctgatggatgtgttttcaaagagatgtgttggagaaaatgcaaagcagggatatgggggatatgaatctgcatcatacagcactgaacaatctgaaccagacagtggacatgtggctcaaacccacaaaagaggagaacagcaaacaaaatattattcaaggttccaacaattgttggagtccatccccagtcgacctgcttcagcagcagagcatcctggttctagcaacggactgagaaaaaatacaagaactgtcttgtgtgctagtgttggggttggtgggtgcaccgaggaggcactgtcagacaagttggagttgtcatgcctgggttattgtgggtgcaacctgcataggaggagggagtttaggaaggaagcagctctctgggacgggaatttcatgtttgtcctattcttggggatgctctcagctttaatgtgggtgttcatagctgcaatcctcatgaaacttggtaggtttgcatgggacctcctccttgcttagcttatttattttccatttttgtntttctttcttttgttgcc

SEQ ID NO: 12156 - DNA, 727 bp, Vitis vinifera
  Predicted polypeptide sequence is orthologous to G1928
gcagcaccacagtttcaatctaaaaccagatattccaccatggttagcttgcccacaagtggttgaagcaggcccaggccccccatctattgatctctcctcctcattattctctgcaagtctagaccatcccttgatataccatgaaaaccctaaccctaattccacgcttccatctttccatcacacagcttctccacacatgtctgcaactgcattgctgcaacaagctgcacagatgggtgtaacaatgagcaagccttctccatcaccacccatgctcagaccccaccaagctcacatgtctgcagccaatgctggtttcagttctacagcggtagccacatctacagctggttctgatctgggtttgtcttcacgtgatgagatggcaagtgggttcattcatggcttggcttcttttgggagtaaagctgctgttacctctggtttcatggaacatgtagctacaggagcaggagcaggagctgcagctccttctctatttcatgacatgatgagttctttgtcttctgccagtgggtttggaggcccatcttttgaagaggcttttaatgggatgttgaatccaaagagagagaataatcttcaagaaatcaccaaaacagcaatgacaaaatcccatttcagcagaagtgatcatgaaggtggtggtggcaatgatggcttgacaagagatttcttgggtcttagagcattctctcat

SEQ ID NO: 12157 - DNA, 632 bp, Vitis vinifera
  Predicted polypeptide sequence is orthologous to G1932
tttttttttttttttttgcaaaaacatatatgtacatatgatatgatatgatatcgtcgtctctaactctttcaaattggttgttcgctctctctcttaaggaaaatatgaaaaaacgaaacgccaggaaaatagaacagagattacagatcaaaacgactccgttaaaatgctacatggtcagggagagttatcatcacagccacaacggtggaggctcgttcaagtcgatgggcaacccacgtcggacaatcccaaaaaacgatgccggagtagggacttccggtgccggaaccgcgacggaaacagtactgtcagatttggcggagggaccaccctcgcagctcatgtctttgagaacacccgtctgcagaaactcaccgagtacgaggcggccggagggcgagctccagcggtcggatggcgcgttgaggtcgagtgataaagcagtggcgggtgcggggaagttggttttggtcttggctcctctgaaggatctagctgcaccatcataggctaaagcagcctcttctggcgtatcgaaagtgcccaaccagactctggttttcttccaaggatcgcgtatctcagctgcgtatctcccccatggcctctttctcactcctctgtag

SEQ ID NO: 12158 - DNA, 845 bp, Vitis vinifera
  Predicted polypeptide sequence is orthologous to G1938
ttttttttttttttttttttttttttttttgcaattatacagtacagaagccattacaaaaaaaacccaggttttcaacaatgctacttctttgatgttcttcccgaatcctctccctttatgaagtcgatttctccaaatctactgccctgaaccttgagaatcatccttaacaggaggttgctgttgatgctgatgctgatgctgatgttgatgctgctgttgctggtgcaccctggcctgccccatctgctggtaaatctggcttaagggttgtgagttcaaaaccccaatatgaccatcctgggataggcccagctccaaaccaggaagctgctggttactcccacccaaaattgaagtaaaactcataggacccagatttgttgcaggcaagtcaaacccagggaagggaattttttgcagataattggaactttcattccccaaattgggggttgatggtccagatgatgactgaaacccaaaaccactgactgggggccatagccctgtggccacatggggtctccccaaatttgcacctaccattgcccaactggtcctactactccctgacccaatactggacccccccaattcatcaatcttttgatgcaatcctgctgatatagaagttccctgttgcgacacagagcctcctgccgccgctaaagccgacgccggtattgtcccagtaccagtggccgctattatggacggctcggcctgctgcaacaaccactgtatggtttccccgtcagatttgtgacccaattccctagtcaactgaaaaattctggctgcacaaagagccggcatccttattctcctccctctgcctt

SEQ ID NO: 12159 - DNA, 747 bp, Vitis vinifera
  Predicted polypeptide sequence is orthologous to G1958
gaaaaagccacttgcagaaatatagaacagcgagatacagaccagagtcatcggaaggatcctctgagaaaagattgacatccattgaagaaatgtcgtctctggacttgaaaacaggtattgagatcactgaagccctgcgattacagatggaagttcagaagaggctgcacgaacaacttgagatacaaagaaatttacagctgcgaatagaagaacaagggagatacctccaaatgatgttcgagaagcaatgcaaatcaggaattgacaagctgaagacgtcatcatctgcactggaaaacccctcttctttatcatcagataccataccaaattcccctgctaaaagtgaaatggaagcatcccatgatgagcatgacaaaacaggaaccgacctagttaatgacagcaaaacatcaagtggaaatccccaaaacctgggcagggagcaaaatgcaattgaaaccgaagctcttttgggtagcgagcaaaatgcaattgaacctgaagctcctaggaatgttgaacaagatgctgcttgtgaatctaattcccaaccctcgaagcgtgcaaaagtggatgagtcatccatatcatctgtcaaatcagcatcgagctgacaggaattgtcaactagtgaatcttctagttcagattgagttctcaagtaggacagacttagctgactggtatatcaatctttggaacttttgatgtcctatctcttccttttggtcaagtcct

SEQ ID NO: 12160 - DNA, 736 bp, Vitis vinifera
  Predicted polypeptide sequence is orthologous to G2010, G2347
gtactacttctcctttctcccacataccatcaccttcttcaagtgttgatctgattgttcaattccctcatttatggaagctaagaaggtggtgaagaaggagatggagggcactgaggaggttgatgaggatgatcaattgggctgttctgaggatgacaagaagaagaaggccgcagctgggggctccgggaagaaggccgccgccgcgatgaggtgctgtcaagctgagaggtgcactgctgatctcactgatgctaagcagtaccataggaggcataaggtctgtgagcatcatgccaaggctcaagtggtggttgtgggcggaatccggcagcgcttctgtcagcaatgcagcagattccatgagctctcagagtttgatgaagccaaaagaagttgccgcaggcgtttggcaggacacaatgaaaggcgcagaaagaactcagctgatcatgcagaaggctcaagccggaaaggcactcagctgaaggaactcgtttgtgggcaggttgatgatagaggcagaattcagattacaatccaagagaatgccgcttacaagcatttccagatcagatgagcaaaggttgtaattgttttcccaccagcatgctctctctcttctgtcattgtgaggcactactagaataatgacagtggttctactgttctacctcatatgtatgtattgaacaaatgtactgatgcatagcatagcatatgctagctgcag

SEQ ID NO: 12161 - DNA, 211 bp, Vitis vinifera
  Predicted polypeptide sequence is orthologous to G2030
cgattttcgggtgcgatgtagcccattgtcacaagtgccagccataacaggattacggacactccaagcgaattgtctctgattttcttattagcccggaacggcattgtgactaggaccactgcagccatcatggatgaagtcatagctattgagtcggtgatgatgaaggctttaaaagccgcactcccacccaaacccccctgcccaa

SEQ ID NO: 12162 - DNA, 806 bp, Vitis vinifera
  Predicted polypeptide sequence is orthologous to G2035
ttttttttttttttttttttttttttttttgcatacacatgaatatacatttattgtggattataaaacagagaaaaacgcaccaaatctctatacattaaatggggaaaaaaaaaactgcacccctaggacctaacactcgaactctaatcaccaaccaccgctacttacagagggaacgcacacaacatcatcttaacaaacaccaacatgtagtccacatggtcctgttctgttaaaaggcaattttacaatgcgtagatcttctcacggtcagaattatagtcttccaaatctgaaatattggccgagtacataaaccatgagaaagatttgcttccagttgcccttctgatccgtctctgagaatcattgccgaaaatgccaaaatgctgccggaaaacaaagtaggccatgaaagcaagagtcccaacaagaatgggcgttcctattagggttatggtgatagacatccatgagcctccctggcccacgaccacaaaggctattgacaggaaagccgcgcctgtgctaatgcaggcagcccacatcagcttgttaaccactgaaacaacctgtttctgagctctagtgtcccaggccaccaaagtgatctgaaccacaacaacagcaagagatatgaagagagatgtagcattcaagaggcagaaaacttggaaccctacattgtcagctatcctagctttccctacttcgggtccacccattatatattggccaggcaagttgaatatggctaggaaagcagtggaggcaaaaagaacggcaacaactgtcacagaatt

SEQ ID NO: 12163 - DNA, 641 bp, Vitis vinifera
  Predicted polypeptide sequence is orthologous to G2052
tttttttttttttttttgtgtttctcagaattgttttggatttcttagagaattgttctggtcataaccttcataaggtacatcttcatttccataaaatcccatgtaattgggatcccctgagtaaggcgacatgcagccaatgcgactgaagtcatcggcaaattcaacttccccaggaaaatttgagtatgatgaacagggtgagatttcactgtatggattccatgaactcattgagtttgcaaaatcatactgtggaacaaattcagatacagtctcttgtccttgctgatagtcctttgaagaatctagaattagatcaggtgagacccagaagtctgtaggattggtcccctttgaagaaagctcaaaatccacaggccgtgcggcttcataaggggaagccataggactcgaataattactctcattgtatgcatgactagcttgagatggaatgttgtctgagatgctcaagatctcattcgagattgctgcggaggtgaaatcaccattgcttgaactgcttcccacctgctttcctttcgcttctccatggaaatcacttgacttttgtgtcggatcattcttcttaacaacacgacacaaagcaaaagccccctgaaaacctgatcctt

SEQ ID NO: 12164 - DNA, 632 bp, Vitis vinifera
  Predicted polypeptide sequence is orthologous to G2059
agcccatgtcatcatgtcctttattccccacaccccagctgagccaaagccagcatcttcccggatttgaatggctcaaaataaatcaaagccttgcaaaccatccctcaaaaggtctgagtgactactggctcagcactaccaagacacagcccatgaaatacacgggaagaagaatgctgaatcaccaacagaaaacttcgctgtcgtcctcagcatcgtctccgggaaagttgtttcgaggggtgaggcaaagacactggggcaagtgggttgctgagataaggttaccgagaaacaggaccagggtttggttgggaacttttgatactgctcaagaggctgcttttgcatacgatacagcggcctacattctaagaggagactatgcgcatttgaatttcccagagctaaagcatcagcttaaggccaattctacaaatggaaccacggcagcccttcttgaagcaaagttacaagccatatccaaaggcatttcagctcacaaagagcccattgctcctccaccaccgccatcaccaaagcagcactacttgccttacgacaattcaaaagtagcgaaagcagtgagccaaaaccccacaagtaaggagtggcagcttgagttggag

SEQ ID NO: 12165 - DNA, 671 bp, Vitis vinifera
  Predicted polypeptide sequence is orthologous to G2067, G2115, G2294
cggcacgaggcacatttcagcacagaaaaagaaaagttcacccacaggctcattgacatagagagatcagcccttccaacactttgttcatcatcaaagctttctgtataagctctctttatcaatggtgaagagtgagccaaagatccaatcagagccgttgaagccaatgtcatcaccatcatcatcttcgtcaacatcgtcatcgtcatcatgtaggaagaagaagtacaagggagtgagaatgaggagctggggttcatgggtgtccgagataagagcaccaaatcagaaaacaaggatatggctgggttcctattccacgccagaagctgccgctagagcctatgatgctgcactgctgtgcctcaagggcgcctccgccaatctcaacttccctaccatcacttcttcttaccatcttcctgatactctcttgtcccctaagtccatccaaagagtcgctgcagcagctgccaatagttttgcagataatgccgccgccgccaccgccaccaccaccaccactccaccctctcctcctcctccctcctcctcatcatcaatctcttcggcatcgacttcatcttcaccatcagatcaactcgatgacgatgtttcagtactaatgtcatccatggccaatgaaccaatgtccatgatggcatcat

SEQ ID NO: 12166 - DNA, 909 bp, Vitis vinifera
  Predicted polypeptide sequence is orthologous to G2071
cgggcccccccattgtgtgtttgttttctaaatatagtagtgatgattatacatgatgttctatgtttatggcttttggttttgagtttgagtttgttaagttataggggttttctagttttgaatattttggtggtggttgggtttagttttgggataatgatgaaccaagtaccttaatttcgatgggtccttagagcttattcatagatagctttgaatgttctgtctcatcttgcatatctttcattgatttgatgaattttgggtctacatttgaagaaagagagcaaaaagaaattggggttttcttgcagatctgcttcatttggttggatatataagacacctctcatttgttgggtttcagtgaattactaaaaaataggatcaaacatgaatttcaagaacttcagtgatatgccgccagaaggaaatggtggtaagccactgggaaatttctccttgacccggcagccttccatatactccttgaccattgatgagttccaaaactccttgggtggagttgggaaggattttggatcaatgaacatggatgaacttttgaagaacatttggacagctgaagagactcagaatatgacatcctccgctggtggagaagggagtgtccctggtgggaatttgcaacggcagggttctttgacattgcctcggacaattagtcagaaaactgttgatgaagtttggaaggacttgcttaaagaaaatagtgcattgaaagaaggtagtattggggggccaccaaacttgcagcagagcaacctactttaggagagatgactttggaagagtttttggtgagagtagggtagtaagagaaatgctcaaccaatgttaggccaataatagtggatttacggttatatcacagcccatcatgct

SEQ ID NO: 12167 - DNA, 782 bp, Vitis vinifera
  Predicted polypeptide sequence is orthologous to G2071
ttttttttttttttttttttttttttttttcgtcgaattgtctccaagatctgatttttctggacttccatatccgcctgtttcttctgcaattcttcattcgcctctttcagttttgcaacttccatttcaagttccaagggataagcctgcttacgagctcgtgatcttgcagctgattctctgtttttaatcatccttctctgccttctctctactactttctccagtgcaccgggttttcttccccgctggcttccattaaacacataaggagcaggcgataatgaagatgtgttcatattactcttcccaattacatcaaaagatatgtggcttgcaggagatccagaggcacccaaaacagccccagttcccaaaccaatcatggccattcctccactctgtagcccaccattctgaaccagaccattgttaaccgtaggatttgcaattccaaccactgcaccccgcacacccgagctagcaagctgagtggtgtttgttaaatgcattggagaggaaaaagccacagtcgcttgcttgggaaagagtggctgctgctgctgctgttgttgatgatgatcctgctgctgttgctgagaaggtctagctccactcatattcaaagctagactaggaggttgattaggaactaaataattactctctgtcatccgattagttaaagcaccattatttcgacctgattgctgaaacccaagccctaacccagcatgattgggctgtgatgataaaccgtaaaatccactattatcccc

SEQ ID NO: 12168 - DNA, 730 bp, Vitis vinifera
  misc_feature (709)..(709): n is a, c, g, or t
  Predicted polypeptide sequence is orthologous to G2085
aattggcacgaggcaaaatcagagggctttaacagacttccctggaccatacaatcaacctcatagagcagcttctttaaataggttccgtcaaaagagaaaagagcggtgttttgataagaaaattagatataatgtccgccaagaagttgcactcaggatgcagcgaaacaagggtcaattttcttcgtcaaagaagtctgagggaacttttagctgggattctgtccaggattctggacaagatgagagccctcctgaaaccttatgtacacattgtggcaccagttcaaagtccactccaatgatgcgacgtgggccaactggtccgaggtctctctgcaatgcatgtgggcttttttgggcaaacaggggatctttgagggatctttccaagaaaaaccaggatcattctctgaaccaaattgagcggggtgatggtgaagctaatgattctgactgtggaactagtggatacataaataacaatcatgttgctttctcaaatagtgataacccggctttaatacctgagcagtaactgtcaagctccctcacaagaaaggcttctgccattacctctagcatcattcaaatgaagtacaaaggtgttttagtaatttcttctacttgtctttatatatgtacaggtatagtagtggcttaatcaatatatgaggttctctctttgtatttcttttacactctntgggtacttttaatcgtatag

SEQ ID NO: 12169 - DNA, 869 bp, Vitis vinifera
  Predicted polypeptide sequence is orthologous to G2094
ggcgcctcctttataatgggtgcctttctttgatcttggatcttcggtctcatgctccgtttcattccattttttggtacaggggtcagagtcggaagacatgaacaacaaaaacccagatgctgtttcgtcggctgggagccaggttaacgagccgaagaagacctgcgctgattgtggcaccaccaaaacccctctctggagaggcggtccagctgggcctaagtctctgtgcaatgcatgtggtatcagaagcaggaaggagagaagagccttcctggggttgaacaaaggatcaacagatgatagaaaagcaaagagaagcagcaaccactcccataacaatggtggcggcaacgggaacaataaattgggggactcgctgaagaggaggctcttcgcattgggaagagaggtgttgttgcagagatcaacagtggagaaacagaggaggaagctgggagaagaagagcaagcggccgtactgttaatggctctgtcttacggctacgtctatgcttaaaatattagctgtagtagtagagaagtactagaagtgaacaaatagaatcaagagcgccacaaagtgtacctacccaccatttcttttgttgtctcttccctttttgtttttgtttttcaatttttggtctgttctttacacagctcttttttagttttaactttctaactgtttttgggatttggagaggagagggtgaagttgatgaagaagaagaaattgtaagaatttaagagtgatctgttttttgctaacataatatttcatgtttgctctagatcttatgtactcttcttttttgaaaatatttccatggattttcttaaaaaaaaaaaaaaaaaaaaaa

SEQ ID NO: 12170 - DNA, 760 bp, Vitis vinifera
  misc_feature (54)..(54): n is a, c, g, or t
  Predicted polypeptide sequence is orthologous to G2140, G2765
ggcagatggacaaggcatctttgcttggtgaagttgttagccacttgacgatcntgaagaggactgcagcagaaattagtaaaggctttcttgttccaatggatatcgatgaagtaagggttgagcaacaagagggtggtttagatgaggccccgtattctatcaaggcatctctatgttgtgattataaacctggtgttttatcagatttaagacgagcacttgacaccgtccatctgaaaacagttagggcagagattgcaacccttggaggtaggatgaagaatgtttttgtgatgactggctgtaaagatggcaaccttgaagatactgaaacgaggaagcttcatgcaaactctgttcatcaggccctcaggtctgtgattgataaatttcctgcttcacaggatttctcatcaagaagcacgtcttcgaacaagaggcaaaggatttctattttcaattcttcgagctcatctccatttggagacttccggtgagacgaatgatttcttgattataatttgcatctttctttgcgttgttttcctatgtccatatgcattggctggcattcaggttggtatacagggattggtagcatgtaattcttcactatagacacaagaggatgtgtacaaatgtcatatgcctgcttcttagatggctgaatgtgatatacttggatgtaatatgagttatagaatgtaacagaggtaccttgttgtaattggagttgaaaagttcttctctgatgccc

SEQ ID NO: 12171 - DNA, 655 bp, Vitis vinifera
  Predicted polypeptide sequence is orthologous to G2140, G2765
tttttttttttttttacggagccatgaaaattcatttatgatacatttaaatggcatgcacatgggagaatgctttccacgcatgatacattcatgttcatgtttgcagctgcagatactcctgcattttatcatcattcatcagcccacaggccgtgttttataacatattacgcttacaaactagatatattgcatagtcattcgggatatacagatacaggatcaccatatgtatatatagagagagaattcaccaccccaagatctatgctttcaggaagacgagctcaaagaatcaaaaaaggaaacccttcgcctcttgtttggatgtggtgttctgggcgagaattctgctgtcacagaaactttgtctaggacagaactgagggcctgatggacagaacttgcaagaagccggtgtgcctcagaatcattgctcttgcgttttttgcagcttgtgaaaataaacatgcttttcatccgccctcccaaactggagatttctgacttcactgtagttatattgagggcatcaagggcttgccttatatcagagagaagccgagagctgtaatcgcaacagacagatgccatgaaataagaattccatctcctgtccatcatcatgtggttctactcttacttctcaact

SEQ ID NO: 12172 - DNA, 770 bp, Vitis vinifera
  Predicted polypeptide sequence is orthologous to G2142
tttttttttttttttttcaaaataaaaggtaatatatatttgcctgttagggaaatctgtgcatcccaacaagcccaaaaatactacatgtacaattggtcttgttctcaactgggtagtttataaaccaggagaagacatgaataaccccctcccaacaggggaaggaacccaaaaaaatgaataaattaaatagcaaaaaaagaatattattgaattgtcatattagtttttgcaagtcttgtgccttttcagggcttggtcagagtctccaccactgcttgcaactctagaacgtgccgtggcatgattactagagggaacctggttatccttgataatgggtgttggggcagtaggtctgctgtttgctttattacctaaatcaatttgcactgaaatgctggcttttgacaagtccactcccgaactctgcaatgcttgtgtcagagtattcaacaacccttgggaatatgcactcgagatgctgatggtacccccttcaatagttagctcctgctctttcaacttatcacttgcaacagtgcactcagtggtaacagatgatctgctctgccataactgggattgtggcagagatgccatattttcagcatcaggtgccagcctaggcggaagttgggctagtccaccacctcccacaacaggagtgaagatgtttggctgcaactgcatatgaatgggtaccgccttgtttgttagtccagggtggcgatccattgctttgaaggtagtagaagcactcaagt

SEQ ID NO: 12173 - DNA, 543 bp, Vitis vinifera
  Predicted polypeptide sequence is orthologous to G2142
tttttttttttttttttttttttttttttttttttttttttttttttttaaaataaaaggtaatatatatttgccggttagggaaatctgggcatcccaacaagcccaaaaatactacatgtacaatgggtcttgttctcaagggggtagtttataaaccaggaaaagacatgaataaccccctcccaacgggggaaggaacccaaaaaaaggaataaattaaatagaaaaaaaagaatattattgaattgtcatattagtttttgcaagtctggggccttttcggggctgggccagagtctccaccactgtttgcaactctagaaggggccggggaatgattactagagggaaccgggttatccttgataaggggggtgggggcagaaggtcggctgtttgctttattacctaaatcaatttgcactgaaaggctggtttttgacaagtccactcccgaactctgcaaggctggggtcagagtattcaacaaccctggggaatatgcactcgagatgctgagggtacccccttcaatagtta

SEQ ID NO: 12174 - DNA, 686 bp, Vitis vinifera
  Predicted polypeptide sequence is orthologous to G2142
ttttttttttttttttttttttttttttttagcaaggatagaaaagcagcttctcaatatctgcatggaagcctctatatctgaaataacatagtaccaaactaaaacaacactgaacaaggattcttccaaggagaatcaatgcttcctggcaaaccatgagctaaacatgtacatttggtctgaaccaagttgtttgtggaccatcttatgcctacctcataaccctttctttttctattctttcccccaagccacaaacaaaattttaaaatgaaattaaaaacaaaaaaatagacaatggaaaggaaaagagaaaaagaagcttataatgatactagcttgtgtctgttctgagcctcttgtgagcttgatcagaatcctcactgctgctcctaaaccccgaatgtgccattgttcgattactaggagatgggttttcataatcctttgcatttgatgttgttgcattcagtcctttatttgctcgtttcccaatatcaatctgtactgagatgctagcttgtgacaaatccacgccggaagattgcagcgcctgggttagtgaattcaacaacccttgagagtaggcacttgagatgctaactgttccactttcaattgtcagctcctctggttcattcactgcattgcttgggacagcacagtcagttgtacacggtcta

SEQ ID NO: 12175 - DNA, 775 bp, Vitis vinifera
  Predicted polypeptide sequence is orthologous to G2144
ttttttttttttttttttttttttttttttagtttctttttcattgttggttaacaacgaatagatttcataatgttgtttcaataacccaaacatgttaagattaggaaaagtaacataagtaaaacttaacacatcagaaatctttagttagcatccaagaggattgagacccatatattaatgcaacccatcaaactgatataaatagaaaaaaaagatcattatgatggaattcagatcatatagagaggcaccaaaaaacagttggcaaacctcaatagttagaggtgggggccaggggcttcaggactcatcacacaaacaaagcctcattaacaaattgttcctggaaaagtttaaattctgcatctcccataatattgtagacaagaactgttcaaatttaacactctaaattagatgcctcagataagcaagtctgacctctacttggcgttgtagggattgtacgtggctgataatttcatccagcactaaagctgtacctgaaatcttattacaaccagggaccagctcttgaagaagcttcatccgggcgttaatcttctctctcctagccctttctgctaagctatggctatcagtggcttggccgcgacgagctcgaacgtgaacgtacggaagcttctcggcctcttcggaggtctcattcgatgcgtttttgcactttttcgtcgaccctttggccttcttctctcgctcctttcgcttcgttgatcgctgattcttgttctcaaccgttggattggag

SEQ ID NO: 12176 - DNA, 856 bp, Vitis vinifera
  misc_feature (854)..(854): n is a, c, g, or t
  Predicted polypeptide sequence is orthologous to G2147
tttttttttttttttttttttttttttttgtaaagtggaggtggattaaaaacaaccacatatatagattataaatggatgtgtatatataatataactacatgcccataccaatttttgcaacaccaaaacgcctaacatttcaacagcagtagtgagtaatggggttggggtccttcccagttatttattgacccttcttcagtactgcaatgaaagcaacctacacaacctaaacttggaagattaaaagaagagtggcagaaaaaaaacccaagttcataaagtcccttaacaacgcctactacaacaaaaatattgactaaaattcaaaaggaacaacacttcaccccgtgcccagcagacactaaaggcaaagatgatcttcctcccagaatatacagctttatcccattccttccaccagaggccccctctccccaacttccgcagatagctctaagatgggatgcctgtttgtgttttcaaaggtaccacatggatacatcctgctttggcagtgggtccaccgtataatctactgctgccaagttgaatggagacccaaatctaaagtcagcaatgttgtcatttgggttggtgtcaaatggagaatcaaatgctttacactgatcaaactggatctcacttgacgagaaaacagaatgatttaagggcatgcttgtttcttcagtgatgttgccacccatcataaccccctgattgaagaagttatcatctagctgaagttgaaacttctgctgctgctgctgctgctgcggctgattttgatcttccataacattaaggttcccaggattcaagctcttgtttccctggagatttgtgtcatnaa

SEQ ID NO: 12177 - DNA, 853 bp, Vitis vinifera
  misc_feature (853)..(853): n is a, c, g, or t
  Predicted polypeptide sequence is orthologous to G2226
agctcattaatcgacttctgctgtcaattccacatcttgggatcccatgaatttctctgctgctgctgcttcttctccttcctgatcactccaacgcccccatcatcttctcaagctcaaccctatcagaccctccttctccgcaaatctaaatcccaaaactccaatttggagcagcatgggactatcgagtctcccagccccatctgaaggagtactgtgtgtgcttctggtgaacacagctctctccatctccatcttcaagggcatagtccgggccatcctccatgtcattggaattcacctctccgcaaccccatcctcctccgactcccctgaacccacctcagagccctttgagtttaggcggaacccatctgagacctgcatggaggaattcaggagcaggaacccagcaatcaggtttgacacagtgtgctcctgcaagcgccctgaacatgactgtgcggtttgcttgactcgatttgaaccagactctgagataaatcacctgccttgtggccattttttttcacaaggtttgcttggagaagtggctggactattggaacatcacctgccctctgtgcaggactcccttaatgccggaagaggaaacatcttgcttttggtaagcaatatctgggagaatgacaagttgaggaaatattcaaatatcactgtacagcttatgtataggtgttttacatgaatatcatcagctaggtgtatcttttattcatatgttagttatatgctccagttttatgcctttatgtgaagaatctatatgatatcagggtcacatatcccatgtctatatatgtatatatatatatattgtacatgatcn

SEQ ID NO: 12178 - DNA, 797 bp, Vitis vinifera
  Predicted polypeptide sequence is orthologous to G2239
acatgttttttttttttttttttttttttttttttgcacaaaatggaaattttaaatttcatatcctcatcaacaacacggttatttacaacaaacagagacgaaagaatgggcttcagaagggttcccatgggctccggcccagtcaaacaggtgatattctctggaggtggtgggcccaatatatcgacatgatatgaaactccagacttggtctcttttttaaaaaaaattaaaaaaattgagatgatttataataaagttttaatgaaaatgaggaaaaataaaataaaattaaaaatacgtgggaccgctaaaacttaaaccggtggtcgcggggagccgacaggttgacgaggggagacgaccggtggtgttccggcgggatcgcgtttggcaccaaaagacgccttgggagtcaatgtaggcttgcgcggtgaaattgaggatgttgcctcgccgtcggcagccaccttcggcgattttaacgacgatgctctggagaagaacggcggagttatggagaaagtccaccgatccgacttccccgaccgctccaaacggtcaaaacggcggaagttttttcctcggctgcttccttcgccgggcggttcggtatccctgccgcgagctcccttcccttggcaacaccaagaaactcgtcgtgcggtgtaagctcgcttcattatctgtttgcgcacgtcctccggcagcttcaaatgaaccgctcgcagtctcgcctggttggatgacgagtgaccggtaagtgcgaccgaggaacttcgaggcgcgtcgat

SEQ ID NO: 12179 - DNA, 596 bp, Vitis vinifera
  Predicted polypeptide sequence is orthologous to G2239
acaacacgccgtattcggcgcactttagcacacactccccagaaaaagaaaaaattataccgaggcgatgatcagcggttcagtttcccaggcgaacaggaatggtgccactctcgtttgtgggctgcttcgctttggtggcttttctcagcatggcacggtgtctctctggattctcttgctcttgctgcctttcgccggagctcagtccgactcctccaacgatccgtaccagcagcagcggttcagttcatccatggcaattattatcgtaatccttgtagctgcgctcttcttgatgggattcttctccgtatacatccgtcactgctccgactcgcgtaacggcggcagtattcgcgcggccgccggagccgctcttggtcggtcgcgacgcggtacgcgtggtctggatcaggcggtgctcgaaacatttcccacgtttgagtattctgtcgtgaaagggctcaagatcgggaaaggcgtgctggagtgcgccgtgtgcctgaatgagtttgaggataatgaaactctgcgtttgattccgaagtgcgatcacgtgttccatccggagtgcatcgatgcttggctggctt

SEQ ID NO: 12180 - DNA, 691 bp, Vitis vinifera
  Predicted polypeptide sequence is orthologous to G2290
tttttttttttttttttttagagagaagtagtgttctgaattctgggtcttctacaaagttaatcataggaaagtcaattaacaacaatatggtgaaggaatcaatcaaagaccgattgttctactgtttctaaagttggagctgccagccaacctaaaggtgaaacgaaataaggatctgcagtggtaaaggcgatggacgataactagatatgttactatgtatatatatacatacatatatatatatatatatatatatatattaatcctcgtacaaaatgattgtttgagatgtatgtatccaagcaatgacagtgtcgaccttgtgctcaatgcttggtacatataggtgtatgtgatatggagtaaaaagggatcacttctggcttgggatggcttcatggcttccttacaaaatgttccgtacagagttgaatccataggctctagtctcggcactactgcatggccgtctttttctcttcatccattgcgcattccaggaggcaccatgtccccaagcagtccttcatcagtgggaagctgtgggcttggctcagccagtgcgcgtgcttctctagcttgggctgggacttggtgtgactgtgccatgctaccactatgagaaacttcacggtggaacgacatatctggataataaaagtgtgatgttaatggaggggtcata

SEQ ID NO: 12181 - DNA, 832 bp, Vitis vinifera
  Predicted polypeptide sequence is orthologous to G2291
ttggagtctaattaggattaactagttgagttataatataattagaacttgagtcatgataggttattagagtcctagtagactttggatgttataattagaattagaatcataataggttattaaagtcctagtagactttggatttcttagagaagcctataaataggttaatcaatgtaaatcaaaggaatgaatttgatgaataatattatactttcttttattgcaaggttgcaaccctcaatggtgagactccattgatttttcttctaggtgagactcctagaaggccttagtgagactctaaggttttccatcttttcttcattatttcttctttctctctatttcttatcttataattttctctaccataaagattattccttgttcctctccttacaccctaaaaataaaaccctagcccacctacccttgagtgtaggcaaccatcctagggttgtcctacatcatgtctcctttattgctttgtcttaaggggcggcagtttgggattcatactgaaaggagaagagatagaaaaaaggagggatccaatttcaaacaacgattagtgagtagcccttgaggcctggctaaagtggttagggtttgggttggggttgtaggaggttcccaagtttgcggtccattgcaaaaaaaggtttacccatgaaaatgattagtgagcagatagattacctatattaataaaaatgatcaaacatctaaagaatacttcctacaaaaaccttttgtatgttggggggattccatttagtacaaattggatacatgtgacttcatttgtcctttagcttcttatttg

SEQ ID NO: 12182 - DNA, 668 bp, Vitis vinifera
  Predicted polypeptide sequence is orthologous to G2291
gctagctccacatttacttttcccttaacctcagtggtggaagggatagaactagaactgaagagatgagcaacagaagtgacaactgagcactttcttctattctgcgccttaggcttactactcatattcctcttcatttcagatgatgacgacgaagaagatggggatgagagaggcaacaccgaggggatctcgaagttggtcctagctttcgaccctctgagccgcctcgccgccgcgtcgtatgcacgcgctgcctcctccgccgtgtcgaacgtgcccagccagtgcctgcatcgcccgattctgtcgcgaatctccgccgaccacctcccccacggccgctttctcactcctctatagctcttctgcacggaaacgtcaccgatatttttcttatccaccactgtcttttcggcaccgaagcgctgtgaaaccggcacgaaccccgaaatcccgccaccatcacagctgctcccactctttttccctccaaagagaacgtgttggccaacaaccgcagctattccgtcaagaaccggaggaatttcggcttccttctgggtaccatcccccaaattccccgataaatcggccaaaacagcaccattactgggcaggttgacgagctccgggacagaaacagaagaaagtgagaagtgagc

SEQ ID NO: 12183 - DNA, 346 bp, Vitis vinifera
  Predicted polypeptide sequence is orthologous to G2311
ggacttcggaggaggaggaggcgctacgcgccggcgtagcgaagcacggcaccggtaagtggaagaatatccagaaggatccggagttcaaccattttctgttcacccgttcaaacatcgatctgaaggacaaatggcggaatatgagtgtcagtgctagtggacaaggtccaagggaaaaatcacggactccaaaaacaaaggccaacacagatgctcccagtgctgctaccgtgtccaatccacaaaattccagttcagctgctcctgttacaggtgatgcctcagcagatgccatggatgatgcttcaaagaatatactggatgggaaaagtgctccaaggta

SEQ ID NO: 12184 - DNA, 481 bp, Vitis vinifera
  Predicted polypeptide sequence is orthologous to G2348
tttttttttttttttttttttttttttttttttcccggaactacttccctttctatcgcccaggagtatttatttttgcttggggggcgttgcttgttgattcggaattcattccgcccgctgcttgttagtccggaccgaaagctagcgatggttgcttttactgaatgcactccctccatggagggggattccttccctccctttacctacacgacccttgtttggatttccccccccccggacgggacgaattaattgccgtatgtatggcccggaccactgattgattcctttaatgaatgctttacaaactaatgtgggcggttccttcctcactgactgactgccttcggtcggtcggttggggggagctagctccctacctagagtgagattaattatctattggccggccgtttattcacgcaaggagggagtaaagatatccatccaatcaagggagggataacgaaagaaa

SEQ ID NO: 12185 - DNA, 819 bp, Vitis vinifera
  Predicted polypeptide sequence is orthologous to G2348
ttttttttttttttttttttttttttttttgtaagagaagaggcttaagctggagctgctttctggtgttttaggataagaacagctctagggtgtggggagggggaaactagggctacaatcaaacatcctacatcagtttttgcctcaaatacatatctcgggatggtgcaagggcaacaagcagtttgccagttaccaactgccagtacagagtcaaatagaggcacacgatgagcacatccagattttaagggatttcaggaacctttaatcacatttcctatcaaggacattggatatgcataaaacaagagacgaaatgcacagacattctgccaaaacttctaagaattgtcaaacaaacacctgcggatagacactgccaatttgccaacctcatgagggtggagaaggacagcacatatcccaaaacaagcggcagcggcaacaatcatataaagaaaaggtcgtgaggtcatggctttctttgacaaaataaggctgcaggatttccttggctgttccttgattgagttcatattcataacaacctctctgttcaatagtgagacagtttcacttctatctgtagaagttgaacttgccattgctgccaacccaccgtttgtgcttatttttgtgtcctcagggggaaagacaacagggagcatgttgttgtggaagcagctaggatgatccccttttgtcacagaatttccagaatgcagtactaaacccccactactgtgaagtttctgatgaagaatcttactagcatgatccatgtacttataaagcagcctcaaatcagtatca

SEQ ID NO: 12186 - DNA, 707 bp, Vitis vinifera
  Predicted polypeptide sequence is orthologous to G2372
cccatcagatgtgcaccatcaattcactggatgacatggcaacaaagttgaacactgtgtctactgagctgaacataggcagttcactgtctgacaacttatcaccagatagccagggcagtgtgcatttctttggtaccaaacctgttggaaatcaggacggcaactcctcaacaaaagttggtattcattcatttcagttgtttggcaaggtcattcatataaagcaacctgttgaaggtaattgcagcgctgatggttgcacagaagatggtagtaaaaaaatacaatgaagctaactgtgtcaacaactcactagatctttctttgacgtactcttatacaaagctgcttgatgggtttgatgtccaccaaatatcctcatcttttcaagtggatgtgtctattttatgcagataagaagctgtacgggtgctagaggcaggaagctgactcaatctattttgacttctgcaggaagtagtgtctatgctagtttactttagtttgctgttcactatgctagtttactttagtttgctgttcactatgctagtttactttagtttgctgtctaggagtttcaaatttgctgtaaagccattctgataacactaatgcagggaaatatattgtttcaccaaaaaaaaaaaaaaaaaaaaaaaaaaaaaaaataaaaaaaaaaaaaaaaaaaaaaaaaaaaaaaa

SEQ ID NO: 12187 - DNA, 543 bp, Vitis vinifera
  Predicted polypeptide sequence is orthologous to G2379
ggtcggaattccgggtcgaccacgcgtccgggacaagatcagccctatccccaaccataaccctaatgccgttgtgtattccggcggatcgtcatcgaagtcgaggctgcagtcggcggggtcgacggagagctctcgcggcggaggccttgacgacggcgatgacgaagacgtggtgttcgatggccgggtcaggaagcatcggatggattcgatggatttatcggatggagcggcgtgtagggaattggcgagggcgattttgaagtttggggagatttatgagaggattgagtgtgcgaagcagcagcagatgatggacttggagaagcagaagatggagttcactaaggatctggaagttcagaggatgcatatgttcatggatgctcagctcgagcttgagaagatgaagcaccccaagtttgcatctggctctgggaagaagttatagctgggaatggcatgaagaaccacatctccctatcctggaagagaaggtgatttgatgatttgctttgcagattccccctcttgaaaatg

SEQ ID NO: 12188 - DNA, 280 bp, Vitis vinifera
  Predicted polypeptide sequence is orthologous to G2382
ttttttttttttttttttttttttttttttccggatggataaacacagtagagagtaaattaattagaaaaaggaagaccggaaagcaacccaaggcatacagaaagtatacaataggggccaaaaggcaaaaaaagagcaaaacaggaggaaaaacaaaaacctcacccgctctcacctaaagcccaaccaatcaaaaaagttgattaaagataaagggcaaacatctatatacaactttgtccaagaccataaactacatacaaaacaatgcttcccc

SEQ ID NO: 12189 - DNA, 720 bp, Vitis vinifera
  misc_feature (694)..(694): n is a, c, g, or t
  Predicted polypeptide sequence is orthologous to G2382
aagaagcggaagctaaagagcctgatttcaagttatgcatttgctccacgtgtagcagtgccttcagctgtggctgctccggccccaaaaccatcctttggtggtcgtaattctcttacagattggactgaacatgaaacatttgtcttgctagatgcttggggcgatcggtttcttaaacttgggaggaagagtcttagatcagaggaatggcaggaagtcgcagagaaggtttcacgggagtcaagaaccgagcggacagatactcagtgtcggaatcgtttggatacactgaagaagaagtataaaaaggagaatatgaagtcaggggagactggtggtggcactaataaatgggtttattttaagaagatggatatgttaatgtctgcagcgccacgtcaagctgggctttcttgtggattggactcaggagagtatgttttcatgaaccctagagtttatttgaaccgtccaaatgggttggatgagatgagggacagtccagggaattcaggatcttcaggaggtgaggaggatgattcagatggacttccacccaagagaaaaagctgtggacaggacaataatgagggatcttccttcagattgctagcaaattctattcagaaatttagcgagatatatgagaagattgagaatagtaaaaggcagcagatgattgaactgatcnaaatgaggatggatttccatagggat

SEQ ID NO: 12190 - DNA, 670 bp, Vitis vinifera
  Predicted polypeptide sequence is orthologous to G2382
ttttttttttttttttctaatcaagccaaaagaacataggtttaccgatttccaattaaagtagaaaatcaagctaatcatacaaagcctccatgccaattacattccataaaatctgtaactctcagaaaaaacaacaggtaatctctgtttgaattgatagaaggggggccctttatccatggcaacttcagcaaggttcggatgttataatcccttgtccaatcttcaactgctgcatcaaccactgtagttctcatctgaagcatcagtgtcttcatcatccccttgccgtatttttgcaatctctgcctgagttctctctagcatctccttcctacgcaactccaattctctatgaaaatccatcctcatcttctccaactccatcatctgctgcctcttggtcttctcaatcttttcgtaaatctcaccaaacttctcaattgaatctgccaacaacctaattgaagatccctcctcatcgtcccctcccgggttagtcctcttcagaggaagcccctctgaatcatcatcaccatactccgaattcccagggctatccctcatctcatccaatccgttcgacctattcaaatagactcggggattcataaacacgtattccccggaatcaaccccacaagcaagcccatactgttgccgactt

SEQ ID NO: 12191 - DNA, 713 bp, Vitis vinifera
  Predicted polypeptide sequence is orthologous to G2404
ttttttttttttttttttttttttttttttggcaccaaagaatgaattctcttgcttatacttaaagttgttatctatacacaaagtggaggtgaacccagaaaccagaggggagtcttagcttagcaattagcattgggcagctgctgtagccttgcagacagggcaactatttttctgccccagccattgctttatgcagtctatgtgatagccgtgcccgcactccagctttcccatctcatcatctgcttcatattcctcctgacaaatgctacacttccaatccaattctgtaggtaagtgtgctgacaattcgtccaaaattgagagtttgcttttcctgaggcagcgaccaatctcatcttcttgcagtcctgtactcacatacccgattcgatcaccaagctcaagcagttcctcatatgacatgttgtcaacatctagtctccagtccctgtatcggtcatgtccatttgatcttcctcccatcaagaagttgctttcaaacaacacaatctctgcaagcccttcaggggagcgatgtcgaacatgacggtaatatctaggcccaaacacatctgatcctgggcgcatcattccaatggtagggtcagaatcatgaaaagagatgtgctcagagtttgttgctcgccttgtagggcaagaagctcgctccctctggttgatcttgtctccatcaactttccccc

SEQ ID NO: 12192 - DNA, 645 bp, Vitis vinifera
  Predicted polypeptide sequence is orthologous to G2404
agaaaatgggacgccggaaacaggtgcttataaacttcttaatgaattcagaattgaattaaagccagaaaaaaaggcataaatggtgttccacgctcagttgtaagccgcagccgcagctttgcagacagcacaagcatttttccgcaggagccactgtctaatacaatgtatgtgatagcagtggccacaatccagccttcccacctcatcatcagcttcgtattcctcttgacaaatgctgcacctccagttgtcaccggtggaggatagtaaggggagggaatccaaaatcgggtgcttcatgttcctcaggcaccggaatatctcatcttctctcaggcctgtgcctacatacccaattctgtcacccaaatccagtagttcctcatacgacatgtggtcaacatcaagtctccagtccccatatcgatcagatccctccacattctcgccaaacagtaggctactctgtagcatcatcatctctgagcgagagagacctccagaagagccatgcccaaaatcatcatgtcttctagcataagagatatgtgatccagaagcctgatcatggttgcctctccttcttgtccgaccacgctctctgttattggttctgtgagcattgaccctccctcttga

SEQ ID NO: 12193 - DNA, 460 bp, Vitis vinifera
  Predicted polypeptide sequence is orthologous to G2430
ttttttttttttttttttttttttttttttggagcagttataaaaaaatttaattaaacccaaataaaattatattccttaaatttgtacttccaaaaaaattttacaagcatgaactacggcacattgaaaccggttattaaggaacactaactacaggtagggatggcaacaggtcagggttatcggctaacccagccccgcccacccctattttagggttttgggaacagcatattcaggatagaggcaggtttgggaattattccaaaaaaccacatcagattcaggctgtgctagggttttcttcgcctcaccccaccctgccctggattggaggtaaatatgtacttttatcttatgtgttcaattaattaaaatatcactttagtcattcacaaacctaaccctaaacaaagcaaggggaatctctcgtcattccaaaaccatcatgtgctca

SEQ ID NO: 12194 - DNA, 778 bp, Vitis vinifera
  Predicted polypeptide sequence is orthologous to G2455
gaccattttagcggtaagtgttccatgcaccagtctgttcaccattgtgacagtcagatgcgggcattgtgctaatttgttgtctgttaacatgggagctttgctccaaacagttcctactcaggatctccagtcacagaaacaacagctaagctgtggagatccaagtgaggattgtggatcatcttccaaatgcaacaaattttctgcatttgagtctgcagagcatgaacagccaagaatgcctccaatacgtcccccagagaaaagacaacgagttccttctgcatataacaggtttattaaggaggaaatccaaaggataaaagctagtaatccagatattacccacagggaagcttttagcacagcagccaaaaattgggcacattttcctcatattcactttgggctaaagctggatggcaacaagcagggaaagttggatcaggcatttgcaggggaaagggccacacaaggctcatggattctatttaaaaaagtgatgcccactttgggagtgggcagctagtttttcaaaaaaaactactggagaaggaggttggggaaacctccttaattaacaggaaagcaccccttgaaaaaccccccccccgccttattttttgtgttgggcttttttacgaaaatttcctatgaaaaaaaagtgtttttttttttgtccggggattgcctttttttttaaaaaggaatattttaaaaccccaaacacgaaattttttttcccctggggaaaaaaggggaaattttttttttt

SEQ ID NO: 12195 - DNA, 700 bp, Vitis vinifera
  Predicted polypeptide sequence is orthologous to G2455
gttcttttctatcttcaatcttcgccaatacttctactgtcatctacttttgtgtaagaagattctcttttatcaggtgatctacaaccacactagaatgtctctggatatcgcttctgaacgtgtttgttatgtgcactgcaacttctgcaacaccattttagcggtgagtgtcccgtgcaccagtgtgttcaatgctgtgaccattaggtgtggccactgtgctaatcttttgtcagtgaacatgggagctttgctacagactgtccctcttcatgatcttcagaaggagaacctacttttccaagcctctagcaaggagtgcggatcttcttccaaatgccacaaggttgctgtaatggattcttcagataatgagcaacctagaatgcttccaaaaggtgcacaagagaaaaagcaaagggtcccatcagcatacaacaggtttattaaggaggagattcaaaggataaaagctaataatcctgacataagccataaggaagcctttagtactgcagcaaaaaattgggcgcatttccctcatatccactttgggctaacgctgaacaacagcaagaacgacaaagctaactttgatgaagcattttctggggaagggccaagaaagacccaaggattctactaaggaaatgatattgtggtcagtaaactaaatattatagtgtgtttgtttaca

SEQ ID NO: 12196 - DNA, 679 bp, Vitis vinifera
  Predicted polypeptide sequence is orthologous to G2456
gaggaatcaaaaagatgtcctcctcatctgccttttcaccggaccacctctcccccacctccgaccagctctgttacgtccattgcaacttttgtgacactgtcctcgcggtgagcgttccttgcactagtttgttcaagactgttacggttcgatgcggtcactgcaccaacctcttgtccgtcaacatgcgtggactgcttcttcctgctgctaatcagcttcacctgggacactctctcttctctcctcataatattctggaggagatccgcagcccaccgtccagtatgttaatcaatcagcccaacccgaatgaggcggtcatgccggtgcgaggagtcgatgagataccgaaacccccagtagttaacagacccccggagaagagacagagagtcccatctgcttacaaccgattcatcaaggacgagatccaacgtatcaaagctggaaatccaggcataagtcacagagaggcctttagtgctgctgcaaagaattgggcccactttccacacattcactttggtctcatgcctgatcaacccgtgaagaaagctaacgtgcgccaacaggaaggagaggacatgctcatgaaagatggtttctttgctcctgccaatgtgggtgtctccccctactaactactgaaactattagggtttctttgttcttc

SEQ ID NO: 12197 - DNA, 497 bp, Vitis vinifera
  Predicted polypeptide sequence is orthologous to G2457, G2459
ccacgcgtccgctgggttttggttttacaggtgagtgttccatgcagcagcttgtttgacatcgtgaccgtccgatgcggacactgcaccaatctatggtccgtgaatatggcagctgcatttcaatcactgtcatggcaagatgttcaggcacccaactacacttctccagattacaggattgacttgggttcctcttccaaatgcaacaccaagatggccatgcgagcaccagcctcgaatatctctgaggaaaggattgtgaatcgccctcccgagaagaggcagcgagtaccttctgcttacaatcagttcataaaagaggagattcagaggatcaaagccaataatccagatatcagccacagggaagcattcagtactgctgcaaaaaattgggcgcacttcccccatatccatttcggtttgatgttagaaaccaacaatcaaccaaaactggacgagggctctgagaagcacctaatgtcaaaggctgc

SEQ ID NO: 12198 - DNA, 757 bp, Vitis vinifera
  Predicted polypeptide sequence is orthologous to G2520
acatttgatgctgctggtgtggcatatagttcacaagcaacaagagaatatggccgggcctcatcgccagaatggttgcatatgcaggttggtggtggttttgaccgaacataatttacataatcctagtaatttggtaataagagcattaagaagctgttcttcctccttcagtgactgtcaaatactatcatgttgtttttaagttaaagagatatctatttccattttcgacattgggcatggaggtgtaatttctgtctataagacttctttgatttaaaatctggacatctccatttctgtgtgttagaaaatgatttcttttatctcaaaatatgttgcagcagcttgatgttcttctttgtactaatatccaaacagaaccccccagagtaggtattgttcttgtaaaagattactgcttgttcagagtttgtaattcttaaagagtttaatccagccggtgttaaccttgtttagcgttggttactacgaacctgaaggtctgttcagtgaaatcgatgccagtttagccctatggttagttaaaagcccttaattagtcgataaaaggcatttgcttggtgggattgaagcatctagtctcttgccaaaagaacgacaccaagggttcattctgaagcatttttttcttttttttgtccaagtcttgataggtttaaaatgttcatgtatccttcgattttaaattaaattttatttttggatatagatgtgcatttaaaatgtaaaa

SEQ ID NO: 12199 - DNA, 816 bp, Vitis vinifera
  misc_feature (802)..(802): n is a, c, g, or t
  Predicted polypeptide sequence is orthologous to G2520
ctgtgacggagcagagtgggagtcgtggcggtggaaggaagaggagggatgtgagttcggaggatgagtcttccaagattgtttctactagtagtggcagtggcatgaatgcatcgaatggtaaacgtatgaaaatatcaagaactcctgatgaaaatggtggttcaaaagcagaattagaagctagttcagtggctggtgaaaagcccgctgaagaatctaaacctgctgagcagtctaagcaagactatatccatgtgagagcaagaaggggtcaagctactgatagccatagtctagcagagcgagctaggagagaaaagatcagtgagaggatgaagattcttcaagatttggttcctggatgtaataaggttattggaaaagcacttgtccttgatgagataatcaactacatccagtcactacagcgtcaagttgagttcctgtcaatgaagcttgaagcagttaattcaaggatgaaccatactgttgaaggatttcctttgaaagatcttggggtacagacatttgatgctgctgcaatgatatatggatcacaagcaaccagggaatatgctcaaggatcgcaacctgaatggctacatatgcaggttggtggcagtattgaaagagcatcctagtgttatagagaactgtcatcaatgggcaataggggaaccgagcagcaaaattaattcttcaacatgtttcctgaagtctaggaccactttgttgttggcttctacatgttatccagagccatgcttcctaaatatgtgtcagtccttgcatttgtaancagaaacctaaatc

SEQ ID NO: 12200 - DNA, 844 bp, Vitis vinifera
  Predicted polypeptide sequence is orthologous to G2522
ctttttttttttttttttttttttttttaatcaaactaaatttccattaagctacaaaaatatcagtacaaccccactaatgtgggtgaatggagtaagaaaccgagaatcatctggcttttttgggttgggactgaagaaaattagagtcaagtggcttagaaacagcaaaatatatacactgcccatgtatatatcaatggaacttctcagccacgcatcaaatcaatgtcaacaggagaatttcgcatatccaactgccgtgaacctggccacacacccatcgatgaggctggagttagattttgactggctggaacagtagtgggagtagtgattggatgatcaactgtctgacgttctgaatccccagcaccttccacactttcccccatcttgttctttgtctttgaattgccccatatgaagctcccaactatcacctgaacgggacttgctgctgtaagcattcctccaactccaccaccaatgacacgaccatcaggactagcaagggagacacttagaccaccggttcggttgcgggagccaccattatcagttagcaaataagagcctgacagacatagtatctcaaaacgtccctcatatgtgacggtgccaccagaggttgaaggctgacgaagggtcacagtggatacagctccatttgctgataagatgcatatagctcttggcccctgctgtgaaaatgacataattttcgttgcaacatcttctcctactgcaacggtgatgacatgtggagtaaacccatcccagccgaaccagacagccactcaccaagagaagctagctgctgcttctcccagtcctggtggcg

SEQ ID NO: 12201 - DNA, 773 bp, Vitis vinifera
  misc_feature (747)..(747): n is a, c, g, or t
  Predicted polypeptide sequence is orthologous to G2559
tctgctttggctgtttccaaacatcgaaagtgtttttccttttctctggtgagttctgttttcgggctttcgtgggaatcatgggagcagaggaagcaaagaaagatacaagtgaggtagctgcagaggaccaagctcaagagaagagtgtgattccactgcctgaccctgtggacaaggtctctcgttcaaaaacatctgccaatgttgaaaaggcaacagacaaccccaatgagaaaaactcaggagcaacggctgaaagagatgctgtgcttgctgcaatcgaaaccgagaagaggttggccttgatcaaagcatgggaagaaagcgaaaagtccaaagcagagaacagggcacataaaatgcagtcggcgactggaacatgggagaatagcatgaaagcatctgcagaggctcaactgaagaagatggaggaaaaattggagaagaagaaggcagaatatggagagagaatgaagaacaagatcgctgaaatccacaaggcaaccgaagaaaagagggcaatgattgaagccaagcgcagggaaaatcttctcaagatagaggaggcagctgccaaataccgtgcgtcaggaactgcaccaaagaagcttcatggatgtctcggcagctttgatttttaggctaaaatttgaaggacccagagaatgagaatggggcaatgagtttgcctaccttgtatatttggcttgttgatttccttatatgtatgaattcgttcgatcnaaaagataaaaaaaaaaaaaaaaaaa

SEQ ID NO: 12202 - DNA, 833 bp, Vitis vinifera
  Predicted polypeptide sequence is orthologous to G2559
tttttttttttttttttttttttttttcataataataataataattgccaacaccaaggtttcaatcaccttcataacttggaagacacagagttgatttaagttagttttgccctcaaggtatgtacacacaaatacacaactatgcacacagacataataaatttataatgagcaacaaatttccagaaaataaccacacaacacatctaaaaatcaatagagaaacataaaagaaaatatacaaatagatattcaatcaaaacctgagaatttgagcatcaaaagcatcccagtaacttctttggagcacttccagtagcacggtattttgcagccatctcctctgccttgagaagatcttccccacgtctggcttcaatcattgctcttttctcttccgcttccttggggattatcgctatcttgtttttcatcttctccacatattctgccttcttcctctccaaattttcctcaatctttttcagctcagcttccacagatgctttttggctgttctcccatgcttcagtggcagatagctttttttgagctttgttctctgctttacacttttcactttcttcccatgctctgattagtgatagcctcttctctgttgcaactcgtgcaagcacagtgtctctgttgacagaaccaccctcagagcctttctcttcaatgggttctggaaccttttcgacgatggcgagtgctttggtttcatcaggcttctcttccggaggaggagctggcggaattacggctttctcctcggtcacatccttgggagcttcggttggttcaggcggaggaggatccgtcggcgt

SEQ ID NO: 12203 - DNA, 582 bp, Vitis vinifera
  Predicted polypeptide sequence is orthologous to G2567
gtcactcaagtgaatgggtgataagtgaagtaatgcatcatggctagatcgatcggtctatcgttccaaggattcgatcaataatggtagcttgagaatgagaatcgattggtttcattcacgattggacaccactaataggtgttaaaggtgatggaaaaaagaagattggggaaatcccagggcgaaaaccgcggtgattggaaagacctttttatattgctatatatagcatagcgcaataggcagttggtcactgtagggctcgggaacttagaatcttagaatccgtccttatgtgacgggcggttttttctagtaggttgggtagtcatgttagtaggaaaaaaaccctactgtggcatttcgtgattgagttttcatgcctactgaaggagatagccagacgggaacctttcttagcgggtcacgattagatagatggtagtgaagagcagatgaactagacccgaaggagaggatggaaagtgttcaccaggttctaccacttaaggaatggcattcagccaggtaagtaagaagtccatagtagcggtccatacagacaataggggctaggtg

SEQ ID NO: 12204 - DNA, 685 bp, Vitis vinifera
  Predicted polypeptide sequence is orthologous to G2575
gctttcatgactaagagcgagatcgatcatcttgaggatggatacagatggagaaaatacggacagaaggcagtcaagaatagcccttacccaagaagttattacagatgcaccactcagaaatgcactgtgaagaaacgagttgaaagatcatttcaagatccctccattgtgatcactacatatgaaggacagcacaaccatccatgtccggctacgataagaggcaatgctgctgcaatgttgccaacttcatttttctcatctgctacagtgggatctagcttccctcaggagtttctgactcagatgcttcccccgaataatcaaagcggtccgaactctatgtactatcacaacattactccccaccatcagcagcagttccaacttcctgactacggattattgcaagatatagttccctctttcatccgcaagcaggagccatgaactctctctattaatgtagttgttttgcatggtagatgaaccgatacctatatgtctagcttttatatatgaagggatagcagtgaatgcatatttctggcctatgatgttcgagtacaaatattatccagatcttacagaactccctaatgcatatttctggcctatgatgttcgagtacaaatattattcagatcttacagaactccctcacttcagatcaactttatct

SEQ ID NO: 12205 - DNA, 844 bp, Vitis vinifera
  Predicted polypeptide sequence is orthologous to G2592, G2713
ttatttgtattatgtaaagttatagagaggcaaggactcaatgtcatttaagagtatcattcaggatatgaggggggaatttgggagcatttctagaaaagggtttgaagtgaaatttaactatgggttgagatcacggtcgcaccgggtggttcaggatagttccatggtggttgatgcgttgagacagagttgttgggctaacatgcctcctgaattgctgagagacgtgttaatgaggatagaagcatctgagagtacttggcctcctcggaaaaatgtggttgcttgtgctggtgtgtgcagaagttggagagaaatcactaaggaaattgtgaaaaccccagaactgtcgggcaagttgacgttccccatctctttgaagcagcctgggccaaggggctccctccttcagtgttatataaagcggaatcgtagcaaccaaacatatcatctctatctcggcttaaatcaagcttcaactgatgatggaaagtttcttcttgctgcacggaagtgtagacgtcctacttgcacagactatatcatctctcttaatgctgatgatgtttccaaggggagcaccacttatattggaaagttgaggtcaaattttctgggaaccaagttcactgtctatgatgcgcagcctccaaatgcaggagcaaggattagtaaatctcgttcaaccaggcgactgggttcaagacaagtctcccctagagtccctgctggcaactatcctgtagcccacatttcatatgaattgaatgtcttgggttccaggggtcgatcgagaatgcagtgtgtcatggacgccatccctgccaatgccattgagcca

SEQ ID NO: 12206 - DNA, 800 bp, Vitis vinifera
  Predicted polypeptide sequence is orthologous to G2592, G2713
ttttttttttttttttttttttttttttttgataaaaagaaaggcagacgaggagactgagttttacaattgtgcgataccggttatctcggccgattcagttacaattgagtttacagcaacagaataacattttaacaacaatctcctatcctaggggcaatacaaattaaatgaagcaaacccaaaaaaaaaaaaaaaaggaaaaaaaaggaaaaaaaagaaaaagaaaagacagaatgagtaagaaaacatagcatttctctgcttttctcaccatctttttgtctattatctttttccccctcctattcacaagctaatttggggtcaaagctgctcaagcagatggcaaatgcctgaaaggcagacagagggtagcgataatccatagtgaacatgtctttcccgacttttccaaactggagaatgatcttgtcatgctctggtggggctggttgagatggtgtgggtgcaccagcggctggctgggtggctgcaatcaactgaaagttcttcactgatgcaaccgttactcgcccccggaagttcaggcaccagcattgtaattgctcgtgccatcttggagccttgtttttaagaaccaagggccttgcttttccctcttcgtcatcacatggtccacaaacctcagaaaatcgagagctgctgaactcaacagagtggtccagtgaatttgagaaggagatgctcctgaatgagtcttcaagagcacggggaaggagctctggctgaccaggaacacttcctcctgcatctagtgatgaggccgggattga

SEQ ID NO: 12207 - DNA, 743 bp, Vitis vinifera
  Predicted polypeptide sequence is orthologous to G2592, G2713
ttttttttttttttttttttttttttttttagccccaaggtaaatttaacttgcattccggggtctgcaaaagtagcaacacaataaagaggtagttctttatgaaatatggttgttatgtacaaagatggaacaccacatacagcgcatgggcatgggctatctttcttaagtccccaacttctacttcaaatttcatgaagccttcccgcattgggagcactaaaaaataaaaataaagatcaaaatagaaaatgaaaaccttgaaacaacccaccagcttctcatttgatgtgggcattagcaggcccagcagttcaatcatatcacccaaacagtatttgagtattcattgcattggcccactccactctacaatcaccataccttctgctttaatgtcatgtgtcattcacaagcaattttggtgtcaaagctgctgaggcagattgcaaatgcctggaaagcagagattggataccggtaatccatggtaaatagatccttccccacttttccgaactggaggatgatcttctcatgttgctggcctgcaggtccatcctctggagaagccaccagttgaaagtttttcactgaagcaactgtcacccgtccatggaagttcaaacaccagcactggagctgctcgtgccacctgggagacttgttcttcaacaccagcgctccatcctttctatcagctaatggttctgataaagaattttccacacggtgtgatt

SEQ ID NO: 12208 - DNA, 840 bp, Vitis vinifera
  Predicted polypeptide sequence is orthologous to G2592, G2713
ttttttttttttttttttttttttttttttcttctattcacatgccaacttagtgtcgaagctgctcaagcagatagcgaaagcctgaaaagcagacagaggatatcgataatccatggtaaacatatccttgccaactttgccaaactgcagaataatcttgtcatgatcagaggctggaggctgtgatggtgttggcgcaccagcggccggctgtgtggcagcaatcagctggaaattcttgactgaggcaacagttacccacccccggaagttaaggcaccaacattgcagctgctcatgccatctgggcggcttgtttcggagaaccagtggtctgtcctttccctcatcctcttcatcacgaggcccaataatgtctgagaaccgggagctgctgaactcggttgagttatcaattgattttgagaaggagatgctacggaacgaatcttcaaggttgcgagggaggagctcagcctggccaggcacagtgccacccggctcaagggatgaagcagggattgaatgcatagtgcagtgcatccttcgtggccccctggtgcctaagacgttcagctcatatgtgacctgggcaatgttgtagctgccagttgggactttaggagaaacctttttcgagtagaacctccggctcgttcggccaggtggggagagttgagaaccattgtatggtggctgtgtatcataaattatgaactttgtgccaaggaaatttgacctcagcttcccaatataagtgctgcttgatcttgatatgttatcggcatccatggagattacatattctgtgcaagtagttctcctgtttcgttttgc

SEQ ID NO: 12209 - DNA, 823 bp, Vitis vinifera
  Predicted polypeptide sequence is orthologous to G2592, G2713
ctctttttttgggtgatggttggatgttaagggtttttgtagaaaaatttcatctttgcatgattgatctgttgtatgtatggatctatggtttccaagtgaaagaatcgatctttgatagtggtgtattggtattccgaccttgagatgctcagttgtatgcaagtgtaactgtttgtggtcattattttactcaagaggaatataatttatgtgacaagattggcagaaatatcagccatattggagtgaatgtcgtttcgcagcattgttcgtgatgtgagggatggctttgggagcttatcaaggcggagttttgatgttaggcttcctggccatcatagagggaaatcccatggctcagtccatgagttgcaggaccagcctctggtggtccaaaacagtcgttgggctggccttccacctgagctacttcgtgatgtgattaagaggttggaggcaagcgagagtacatggccatctcgcaagcatgttgttgcatgcgctgctgtttgcagatcctggagagaaatgtgtaaagaaattgtcaaaagtccagagttctctgggaagcttactttccccatctctctgaaacagccagggcctcgggatggaatcattcagtgcttcattaagagggacaagtccaacttgacttaccaccttttcctttgccttagccctgctttgcttgttgagattgggaaatttcttctgtctgcaaaacgaaacaggagaactacttgcacagaatatgtaatctccatggatgccgataacatatcaagatcaagcagcacttatattgggaagctgaggt

SEQ ID NO: 12210 - DNA, 674 bp, Vitis vinifera
  Predicted polypeptide sequence is orthologous to G2592, G2713
gggactatccaatgcttcatcaaaagggataaatctaacttaacttaccacctttttctatgtcttagccctgctttgctagttgaaaatgggaagttccttctttctgcaaaaaggaatcgccggacaacttgcacagagtatgttatctccatggatgctgagaacatttcaaggtcaagcagcacttacataggaaaactgaggtcgaatttccttggaacaaaattcataatatatgacacacagcctccacatacctgtgcacatattcctcctccagggagaacaagcaaaagattttattccaagaaggtctcgccaaaagttccaactggcagctacaacattgcccatatcacttatgaactgaatgtgctgggcacccgtggcccacgacggatgcattgcaccatgcactcaatcccggcctcatcactagatgcaggaggaagtgttcctggtcagccagagctccttccccgtgctcttgaagactcattcaggagcatctccttctcaaattcactggaccactctgttgagttcagcagctctcgattttctgaggtttgtggaccatgtgatgacgaagagggaaaagcaaggcccttggttcttaaaaacaaggctccaagatggcacgagcaattacaatgctggtgcctgaactt

SEQ ID NO: 12211 - DNA, 575 bp, Vitis vinifera
  Predicted polypeptide sequence is orthologous to G2604
tttttttttttttttttttttttttttatctggaacttttggcagttcaagaaacataaaagttaatgaaaataaatagatccagtgtccttgatgccactcatacaatacacacttgtcaaagtaaaagaaaccaaagtttttcttatccaaaaattttcaaatgaactcacagcctaaaaatcttctcatagaatgccgttcacacacccagcctgctggtaaagctaattattcttatagatcgcgcaaatggaaaataactctatacatgtggtctgaggagagttctcttcttgttgagggatgcaatcatgtgggataccatgtatataagaaccaaagctgtagagtctgtaataacagaacttctcatcacttttagcagttgaacttgtgttcagtagagcttgttgaggccccaacagatgtcacaaaattgcaaactgcacatttcacagatctagctccatattggtacatcaacagcatccggcaattcccgcaattaacatgtgcaacttgatttgcttccaaggctagattgatagtgtgacaacatgaacactgtacac

SEQ ID NO: 12212 - DNA, 440 bp, Vitis vinifera
  Predicted polypeptide sequence is orthologous to G2628
tttttttttttttttttttttttttttttaccctaaacacataattttatcaaggatttcattatcgtcaaggatagagacagatttctttccaaaatcattatctacatcttacacaatgaaattctcagaaaagatttcaaaaccatataaaggtgaccttaattgtcattcactggccaccagctcttcggtttctcctttgctcatactgaggatcatctgtaggcagctcataacgacaaacagggcatgtattccgtataccaagccatggcataatgcaatccccatgatagcggtgactgcaaggtaactgctttgctagttctccaacattaatctcatccttacaaacagcacaaagtgcattattattctccacatctccttgtgtcaaaaccacaacaggaagatttttgacaacagattttgaagca

SEQ ID NO: 12213 - DNA, 592 bp, Vitis vinifera
  Predicted polypeptide sequence is orthologous to G2639
cggcacgagggagagaaccttaaaaccctaagctgaacccagatgggccaggcgtttaacaaactcgccggcgagcatggtgccggcaacggcgagggtcactccaaggaagcagccgtcgccaaaaccgccggattcttcgtcttctctggaatcgccatgagcatcctcaaagctctcaactcttgcaacaacgacaacaacaaactcctaacccactcagtgactgaaccaagtcaaccgactgacccatcccactctcgagaacccatcttcaaggagaaggaggttcgggagtcgacgcagaagacgatagatattgtgaagggagatacactgtggggtctctctagaaaacatggggtatcaattgatgctattaaagaggcaaatgggcttaccggggacaccatctatgccggcaagaaacttgttattccatgatgcaaatccttgctcttaatttcggcttttcagttttctcttctgattatgttgttggttatgttgtgtaagataaaaatggttctgagaatcctattttttcttgttccttctcaaaacctgttctaagcaatttggaaatggcatg

SEQ ID NO: 12214 - DNA, 601 bp, Vitis vinifera
  Predicted polypeptide sequence is orthologous to G2639, G2640
ttttttttttttttcagagaaaaactataaacaaatactactacgacaaaagagacactacatgccatctggtttatacccaaataaacaaagaaaaaaaatcaaggttaataataataataataataataataattaaataagccttgaaatgtgaacaaaaacaaacatcatccacatttcttcctctcgttctccatttttgtttttcctctttgtttttgtttctttgttcctagttgaatgggtgggtgttaaaaatgtactagaacaaaatcgcactattgccttgcagataaaagagtgaaagttgatgaaagagagagaaagaatgagagagagcagaatgtggtgtacgttcaaggtcttgggtgtgggaagaattgcgtaccagccatgaaggtgttaaggggagctgggtataaagaaggatcaagaaatgcggcggctgcaccggcactgccactaccagtggtggcggctgtggcagtggaggtactggcggctgctgcggcaccagtaatgagattaagctgttgaagtcctccgccaccggcggaggaactctcgcctccaccgtaatgaccttccggaccatgat

SEQ ID NO: 12215 - DNA, 434 bp, Vitis vinifera
  Predicted polypeptide sequence is orthologous to G2649
ttttttttttttttttgtaaaaagcaaaaatgtataaaataattaataaaacaaagttctgtaaatgagccaagaaatagaaacaacggataaattctagacacatgcagctgctttattggattccaaaaccaatgccattattatccttgctacaaatattcaagagcagtttttcctcccagcaatcctctgcaaccagaagcatcataagcgtcagctttgtgaagaattggagaagaagaatccacattccttccactagcattagtttccaactgtagttctgaaatacatggatagctacccttctcattaaccccttgatcatatagaaaccccttaaatacatgcccattaatcttcaccattgcctgataaacatactcattttggccatcctcaatggccgtgacccggatgcaccgaaacac

SEQ ID NO: 12216 - DNA, 702 bp, Vitis vinifera
  Predicted polypeptide sequence is orthologous to G2682
ttttttttttttttttttttttttttttttgcttcaactaataaaaattttcattcaaatggcatcatacaaaggacatggacaatgcccaaattcacaaaaatccataaaagataatatatcacttgatcatgaaaagatgaggcaagactacaaatacactgcctccctcgacaagtgagactcaaatactctttccagcctctttccatatgtcatcacaattcgtgacattttttcaatataccactctctacagatggagatcatcaaaatacgattacacattccccaaatcacgatttaaaaaacctatacttaagaggcaggaaacatggcagcacacatgatttcatgaatgcatggtatttaacatttgactttaaagaaacacctactgtaataattgtaaaaataaaatatgaccgatgcaggatgtaatgagtatgtgggtgatgaatcccaaccccacataatgagtatacacgaaaacagtgaatgatatgaaatgcaacttgactatgacaaacaagagacttcgatacaatgcaagacacaaattaaaagagagaggggggaggtgttgttggaacaagaaagagaactggttgaaggaaggagaaaatgtggaatatagcactgggttgatttgacgtgcctcggacactttgaaccaattttctgcagtcatccaatccgccc

SEQ ID NO: 12217 - DNA, 718 bp, Vitis vinifera
  Predicted polypeptide sequence is orthologous to G2717
tttttttttttttttttttacttcactacaaaatcctcaaaatcaatgaacctactatggcttccagccagcaaaaaacctcaagagaaagcacattttgacaggataattttgcattttgtcacattcacaagcctaacaatatttacagctataaaacatgttgcaagagctaatgccgcactttgatgctcatcagagtcctaatgcacggttccattccaatgatccaaacagccagatttgatgtttctaccatcaggttcgaagtgttctgcatttcaaagccttaaatgctgcttctgcaaaaacatgtgctgcttctgcttcagcttccgcttcctccgcctctcttgctgcttcttcagcctcagcaatagcagcttctgcctcagcaactgctcgtgcagcagcagcagcagcttcatgagcagtcatactcctcatcttcaccagctctgcatcaatctgagatttagtaaggattttgatgtcacccttatctgcttttgaagaatccttttgctttccctcctcaaatggcatggtagagcttcttctcactacaggaggcatcaaacttgttgcaatcctgtagttaccctttaccttagttaacttgccatttgctaccaaaagctttaattttgttgacagcagctttttgaagtttggagggccaaatatgctcctcatgtacatagctatagcagtctgt

SEQ ID NO: 12218 - DNA, 673 bp, Vitis vinifera
  Predicted polypeptide sequence is orthologous to G2723
attcggcacgaggtcctcttacatctccaacttcaatactcagtatactgtcgccttctcaccttcatctactttttcttcatattcacccaactcttctatgaccttattattccagcttctatagttcttatttcattcccccatcaatatagtaatggcatcccatgctttctcctcttcatgttattcaagctcctcttggacacagaagcaaaacaaactatttgaagaagccctggctctgtacgacaagaacactcctgaccgctgggcaaatatagccaaggctgtgggtgggaaatctgctgaggaagtaaagagacactatgagatcctggaacaggatgtcatgcatatagaaaacggccaagtccctctacccatttacaggtcaactgggagtagcagcggaggaagtgttgatgaacaaaggcacttgctgaagaatctaaagctccgttgaagcaaaagactcagttatacgacaaatatacatcagctcgagcatatgctaaaaagaagatgcagacgcatgtattagaaagagaaaaaaagaaaaaggtgaataagaataataaatataggctcaaactaatgaagcaagcaagatgaagtagttatctgtgtccatgtatctcaatttgtcgctactgcaatgaattcgcaaatt

SEQ ID NO: 12219 - DNA, 697 bp, Vitis vinifera
  misc_feature (607)..(607): n is a, c, g, or t
  Predicted polypeptide sequence is orthologous to G2723
ctcagctccctctcttctttcagtacccttcctttaggcctttttctaagttagaagattgaagccccatctcccaattatttctaatcaccttttgtcatcttttagacagacttggtttgtaatctcctctgaagtgacccatggcatcaacctctctcaagagctctggctcatggaccccaaagcaaaacaaactgtttgaaaaggctctagccttatatgacagggacacccccgaccgctggcagaatgtggccaacgctgtgggtggcaaatctgctgaggaggtgaaacaacactatgagatccttattcgggacctcaagcatatcgagtcgggccgtgttcctattcccaactacaagtagcgaaaagcacctgttggcttctgaagtatcctaaagctgcaataaagtccaagacttggctcctattaaattatatttttggaaaaagtagatgcggacttatcatttaaggaaaaaaaaacagaaaaaaaaaaaaaagtctgactctctctgtcagctcttgtatgcatgtaatcactgtaccacccttattttaatagaatatctattatcaaaaaaaaaaaaaaaaaaaaaantaaaaaaaaaaaaaaaaaaaaaaaaaaaaaaaaaaaaaaaaaaaaaaaaaaaaaaaaagggcaaaaaaaaaaaaaaaaaaaaaaaaaaaa

SEQ ID NO: 12220 - DNA, 714 bp, Vitis vinifera
  Predicted polypeptide sequence is orthologous to G2741
taaagtgaggtgactccagaagccctacaccatactatggttgtgacagctttctgatacctgccatgcggtcttcctcatgccaagactgataaaagatcagcggcaagtgagagcacactcgcacgaacgcgctacgttatctaccgcgaatggctggtatggcagtatcacttcagacatcgctaacgatctcgcagttccagcgcgtaatctcatccaagcacaatcgtctacgatatcagtttgcctctggactcggtccacgcaacgctagctcatccaatcatatcgcacacggcatgtacgctgacttccaggaagaggaaggcaccactgatggcgactttggtggctgaaccgatcccgaaaccggcaacagcgtagaagatgatgacagcacatgcgagaatgcttcctaaatcgtcatgggccctggtaatacggtgaatcaggaagttccacattggaagaagatgtatcttcggtgcttatacagtatgcacggtcgcagcacgcatgtatcaagcttttacgggaaccgatatacctcccttaccgatgaggacattatgcgcatgctcagcccgagagtgtggagcgtcatgagcggacctctacgttgttgctcttattcttgcagtgtgcgaatatcctcactattcactactttttacgccaaaaaaaaaaaaaaaaaaaaaaaaaaaaacatgt

SEQ ID NO: 12221 - DNA, 625 bp, Vitis vinifera
  Predicted polypeptide sequence is orthologous to G2754
ttttttttttttttttgagcaaaaactctgagtacagctgggtctatgttagaagctcatccaatttagtgaactggctgtcattcaagtggggggcctcctgaggcactacttgttctgcatcctcttccttcaccctttctttcatcagcatctgttcttcctttgccatggttccggatataatagaagaatctccattttttttttatcagaccccactacatcaaacccagtgaacggaatgcagtcggcgttgggatgattaataatgagactcatatcggaatagcatagcgtgaaacttcagcctggaagcatatttcccagggaatatcactctcacaaagccatcggtgctgctagtctcgggtagtaaaatgcggatcaaaactttccgcaactagttccatgggagcagataggtgtgaaggatgaaattgctaggaaaaacagagtgaaaacgacaaaatccaagaaatatttagacaaagacacgtttcatgaatgatggatgagctcgaaactggtgggacagttcgaatggtttcaacatacagacaggtggcaccatcatcatgtaaccatgcgggaagaaacagagatcaggcgagcagaaatgaaa

SEQ ID NO: 12222 - DNA, 723 bp, Vitis vinifera
  Predicted polypeptide sequence is orthologous to G2763
ggttgagatttgagaattacggaagaatatctttgaggcgagggattggatggcgtcatcggtgatctcgaatcccgtaacaaactccgacagatcacgcgagtcgtccaaaaggaaaaagaagaagaaaaatcaaatccagagccaagtcagagatcagcaaaatcagaaccacacaaaatggaagagccaagtccagcaacagctttactcctccaagcttctccaagctctgcgacaagttcgcctcggttcttccaacgagacgccgcgccgcggccgagccgtccgcgaagccgccgatcgagctcttgccgtcgccgctaagggcagaaccaggtggagccgcgccatcctgacaaaccggctgaagctcaagttcatgaaacacaagaggcagagagtgacggtgaccggacagaatcggtcgaagaagcccaaagtgagtattctacgtctgaaagggaagaatttgccggctgtgcaacggaaagttcgcgttcttggccgtttagtgcccggatgccggaaacttccattgccggatattctggaagaagccactgattacatagctgccttggagatgcaggtcagagccatgaccgctctcactgaactcctctccggcgccggcgccggcgccggcaccacctccagtaattcgccggccgacactctcggcccgagccggcctccgacgagctaaatgtcatatattgc

SEQ ID NO: 12223 - DNA, 624 bp, Vitis vinifera
  Predicted polypeptide sequence is orthologous to G2766
ttttttttttttttttttttttttttttatgtatatcaatttggccctatagcaaggcccatatattagacatatcatttgttttttcgctcattggaaggggaaattaccaaaacatgaaaaaagaaattagcaagttaatacatagaaggatacaaaaaatggtcgtaatgaattaggaaaaaaaaagttttggcattatatacatgtttgggttcaataatgaggtcttaacttaggaaggttagtcttgattggattatccaccttcttcaagaaacttgatgcccaacccttacttgcttcatcactagtccctctgactaaacattagagggcttgcttgcaaccacaagtacagttctccagttctttattgagcttctgcacttcattttgaagacctttgatatgttgcacagccaagtccaacatggcagcatagctagtttgcttatccatgttaggaacaagatcttgcagtttcttcagtttcccgcttattctagttcttctctccctttcagcaatacttctaggatgagtggcacagccacgcttagctcgaactttgcatggaacagagtcttcaggtacttgcagcagcttctctactgctgcccc

SEQ ID NO: 12224 - DNA, 858 bp, Vitis vinifera
  Predicted polypeptide sequence is orthologous to G2779, G2859
cttcttccttagaaatgaactcaaacatggaactgatgaacaaccggagtgcaccagagaattcccacatgaatggtcacggattcatggctttctccaatgtgggattctctatacatcaccaacaagagttccctgtgaacttcagggataatactcaaagccctgttcattctggaggtctaagtgctgtccaagttcttcagttctcatcgcagcccggagattttggccaggaaacaaagactggaaaagtgaattttgtatcatctcctccagcttctgggtctgagttccttggagataataagaacttgggtggaagaaagaggaagagaagcaatgagagagaaaacaataaaccaagagaagttatccatgtgagagcaaagagaggccaagctactgatagtcacagtttggcagaaagggtaagaagagagaaaataaacgagaaactgagatgcttgcaggacctggttccaggatgctataagactatgggaatggctgtgatgttggatgtgataatcaattatgtccagtcactgcagaaccagattgaatttctctctatgaagctttcagcagcaagcaccttctatgacttcaactcatcagaggcagaagctttggaaaccatgcaggggacaaatgcatatgaggtacatgaggtggagaggtcggtgaaagaagggtatggagggccttctcatctccactcaacatggcctttttgactgcaattaggcttccaatactttgcataaccatgaagccacatgaatataatcttttacttaaatgcagagcaaatgcgatagtgcacagagccacagtattgcccacgcacatggg

SEQ ID NO: 12225 - DNA, 481 bp, Vitis vinifera
  Predicted polypeptide sequence is orthologous to G2779
ttttttttttttttttttttttttttttttgcccaagttattctttttcttagtactactaatttctttcaaaccacttccagaagccatagaagaaatgttctctgagctgctttttgattgttccatcacctttctcctcttgctttcatggaaagcatttccactcgagggcatgctctgaaccactggcattgagctcagtccattggactcaaaactagattgaagattataagcaaacgttcccatgagctcaggctgctggtgggccaaaagattctccactgaaacatcagttatgttgaaattctccaacataattggattcatctctgcaaactggttcaccatttccatggtcacatccatgcccaagaaaggttgagaaggcctaaagctctgcatactgtcagaaaaatcaactattacacaattccaattatagagcctcctgagagaactcaagggatgttccccc

SEQ ID NO: 12226 - DNA, 672 bp, Vitis vinifera
  Predicted polypeptide sequence is orthologous to G2834
gcggaatagtcgctatagaattatctctgcaatcttgaatctgatttaattggcatttaatttagtacctgagaaaaggatttgaaaatggatctcaaagataggctttctgtagatacctggacacaatcatcttcatccgggaatgaattaccgaaagatcaacaatcattcaccaattttagtttgcagcagcagcagcatcagcataagtgggaagatccttctgtgctagattacagtgttaggattgaaccagctttccaggaattcaaccagacttctgcaacctcatcatctcttccttgcaaccctaatagtcaaatcaaaaacttgaaccgagaagattgtcagatgaatgagatgctagaacccaatagaatccaagactgggatccaagagtgatgcttagcaatctctctttcctggaacagaagatacatcaactccaggatttagtccatctgattgttggtcggagaagccaagttttgggtcgaacaaatgaacttgtagctcagcagcagcagcttgtcactgctgatctcacttctattattgttcaattgatcacgactgctggtactcttctcccatctgtgaagaataccctttcaacggctagtccttctgttggacagcttgggcagcttggtggagtactgtttcct

SEQ ID NO: 12227 - DNA, 698 bp, Vitis vinifera
  Predicted polypeptide sequence is orthologous to G2834
tacatgggtcacctaaccattgaaatgtgatttcaataaaccccaggacccctaatgaaaattgaaataacaatctgactgctactcaagatcattagaactagactcgcctccagtctttcttgtatagctacaagaccctgggacaagaaaagagaatgaactttctgagtcttcaaatgggggtcgagggaactcgtgaaacccaacgagactacaaggatcaaaggtcaatggtgagaaaaaaccagtaggctcgtcagcacccctttttacatccatcatcatatcttgaactccacttccacttgaagcatttgaactgaagttgaaccccacacttccaaccttatttgctgctccattgccttccccatggtcagatggcccaacagatcctttagtttcatcaaggggaatagcaggagtgtggccttggaagagagcaatatgcccaaaaagcttgtcttttcttgagaaagtggttccacaggaacaaagccacttatccttgccacaatgcttctcatgagttttaagatcagcaataactgagaacttcttggtgttgcacctgctgcaagtgtagcttttgtcgcaatgagtcctcttgtaatggtttttcacacataaaatagttttcagaggttgaaactttttatgatccttgttgcgcttgcaccagcaaaagggcagga

SEQ ID NO: 12228 - DNA, 837 bp, Vitis vinifera
  Predicted polypeptide sequence is orthologous to G2834
tgaaagaggagatcgacggcggtgatgacgatggagattgcgaggttatcggactggacgccgttgaattgctagctgagcacattcacttttgcgatatctgcggaaaagggtttaagcgagacgcaaatctccgaatgcacgtgcgcgcacatggaaaccagttcaagactcccgaagccctagcgaagcctgataagtgtatggaaacgcagcgacgcgtgcggttctcgtgcccctaccagggctgcaaccgaaacaaaggtcacaagaagtttcgggcgttgaaatcggtgatatgcgtgaagaatcacttcaagcggagtcactgccccaagatgtactcctgtaatcgctgcaacaagaagagcttttcggttctggcagacttgaggagccacttgaagcactgtggagagtccaagtggaggtgttcctgtgggacaagtttttcacgaaaggataaactgtttgggcacatggccctgttcgagggccacatgcccgcagtcgaaaatggggatgagaaatcggtgctgtcagcagcagcagtagcagctgccaccatggaagaagatgagcatgaggacgaagatgggattggaaaggaagaagagaatgggatgtttgagggattgtttcaaggatttggttcaattggggaatactgtttgcaggatgtgttgaggtctcctcctcgactatatgatatttccgactttttggattagccgggtattatatggggtatccgtatgtatacatagatgtgtattctttgtaacaataaaattatgaccctgctttcatcactcttgttgtagctgctctttcatt

SEQ ID NO: 12229 - DNA, 392 bp, Vitis vinifera
  Predicted polypeptide sequence is orthologous to G2847
ttttttttttttttttttttttttttttttttttctgggaatattttatggaacaaaatatgagctgtgcaaagcttgtgtgggtagtcggtctagtgacaaagggcccagttggcaacttggcactttgggatttttttttttttttcgggaatattttatggaacaaaatatgacctgtgcaaagcttgtgtgggtagtcggtctagtgacaaagggcccagttggcaacttggcatacatgcatgtacagtaaaaaaaagtttggcaaaaaaattctttttcacttcttggatgaggtgttggccatggcaggaaaccagtaatcagcaccattgttgtttgccacgtgttctgtgcattccactgggaccagacacaggcccctgctc

SEQ ID NO: 12230 - DNA, 749 bp, Vitis vinifera
  Predicted polypeptide sequence is orthologous to G2850
gagcagagggcatttcagccagatttttcctaccataaatatttcaaacttgagtcaaccttcttccacaatttctagctccttggacatgaacttgcaggctttggatctattaacttctgcaagatttagtgggacttttagccagccctcgcacaataatcttggcctattcaaagatagtctttcttttggtcttgatcacttgcagcaatcaactaacaggccatcaaatagctctagtaaaatatcacccttcaccaatggagttgcagaagtaaagagacccagcagttttttggagccaaaagcaactcaagcaacacccaagaaatcgcggttggagtcacgcgcttcatgcccgcccattaaggttagaaaagagaaattaggagatagaattgcagctctccagcagctggtggcaccatttggcaagactgacacggcatctgtactaatggaggctattggatatatcaaattccttcaaaaccaggtcgagacactaagcgttccttacatgaagtcatcacgcaacaagagcagtataagtatgcaagggggttcagcggacggggagggaagcgaggagccaaggcgagatctccgaagccgagggctgtgtctagtgcccttgtcatgcatgtcctacgtaaccactgattgcgggggtggtggcgtttggccacccccaagcttcggcggaggaacgtaatctgtattataagctagtacattgataggta

SEQ ID NO: 12231 - DNA, 861 bp, Vitis vinifera
  Predicted polypeptide sequence is orthologous to G2851
agtggggtgttttgcagagctgatcagtgtaacaaatgatggctggaaaccctaactggtggagcatgaataacatgcgaccaccctcatcgcagcagtcttcttctgctttcttatctccccccactctcttctctcctagatatgtacctgaatcttcttcatcactgcctttcaattctttggctgacaccccagaccttccacactcatggagccagctacttctggttggatcatcaggtgaggaagataggtttggttcaagtgattttcaagctaagaatgtggaatgggaagaccaaatcttgaatccatcccagaggattcccgcagttgatgtaaagcaagaagtagtctctcaaagtagccacccctataatcatggagatgaaggctttcagacatcaagacctccttggtcccaaatcatgccagtttcctctcctagggttcaaccctctccgagccaaccaccactaaaggtgagaaaggagaagctgggtgatagaataacagcccttcaccagttagtttccccatttggaaagactgacactgcttctgtcttgttagaagctattgggtgtatcagattccttcagggtcaaattgaggcccttagctctccgtacttgggcaatgcatcaggaaacatgaggaaccaacagtgtgttcaaggcgaaatgaattgtatatttcccaaagaccctggtcagctcctgaacgacaactgcctcaaaagaaaaggatcagcacctaatcagcaggatacacaagatgcaccaaaggacttgaagagtagagggttgtgcctggttccggtttcgtgcactcagcaggttggaagtgacaatggag

SEQ ID NO: 12232 - DNA, 730 bp, Vitis vinifera
  Predicted polypeptide sequence is orthologous to G2851
gcccacgcgtccggggagaggaattgtatatttcctgaagaccctggccaggtatgctttattggatctattgctcttcaaaggcgtttagagaagcttgcatttgaaaaagctaccaattctactgcttgctcttttagaaaaaaggaagtgtagaaagaataaggttttcagctttatggtctttaatttttattaaaagccacaaaagattgattaaggacccatttatgtgccttaggaatcattaggggttgactaagtgttatgaacatgtgaatgcttgggttgacgagttcatgaaaatcctaatgcttttctttatcatgttgttttgtctcactagctgttgaatgataacggcatgaagaggaaaggagcttccgaccaggaatctcatgaagaaccaaagaaagacctgagaagtagagggttgtgtctggtgcctgtttcatgcacactgcaagttgggagcgacaatggagcagattattgggctccggctctgggcggtggctttcgataagccgattccattttagatgcagcacattggagctaattgaaatgatataatatcatgagcagtcactctgctaaaatctaaggctgattgctcatgatgctatgcattcttgattggatttatgtgtgctgtagctgggactttggaagtccttaaaaaaagtactcctaatttaagatcagctgatcatcatctatcttcttt

SEQ ID NO: 12233 - DNA, 930 bp, Vitis vinifera
  Predicted polypeptide sequence is orthologous to G2854
ttttttttttttttttttttttttttttttcggcagcaactgaagagttcatattatatatgtatataaatgtaaaccatattttgtctgccaagtgcattcatgaccttaaaatagcctccagcccgctcattagtttccacaaagaacaaaagagagacgaatgaaagaggagctaaaacaaaacaatgtgtaatgtctaagcaaagctgatcccagaatcgatcaccatcatattacacccagtttcaacacccgaacaaagccactaccccaccaaagagtggaacccattaaacgcagccatcaagacctctccacttcatcagcaacagatcattgctgtggctgctggtaatttccatatccaggataggctccatagtacatgttagggtcttgaggaggtggcgcatacccatatgcctcatatccttgagcatatccataatatccaccattccactgggcctgatctggctgggcctgtttgttcgaaggactacgcccccatgaaagacgaatactctgtgctcctaattgagtaccatttaacccagctaaagcttgctcagcacaagctctattagcgaattgaacaaacccacagcgcttgcctactggtattttcacatgaaccaattcaccatattggctaaacacttgtctcaaatagtcatcagtaacattggagtccaaaccaccaacaaatattgttgtgttatttggatcactctcaccctgatttccttgagtattctgaaaagaagctttctggaattgctgaccaccaacaggtttcttggtagcagcagggccaattcgcatgggtctggttgaacagaacattccattcatttcattcatcgcacgcagttgttcaccttcatctccaaacctcacaaacccgtaacccttagaacgcccccc

SEQ ID NO: 12234 - DNA, 664 bp, Vitis vinifera
  Predicted polypeptide sequence is orthologous to G2854
gttttgtagaaagttcctactttaccaaagccatccaacgccaaattacataggaccaattccagagaaagtcattagaataacaatatcaatcaaacgccaatacttaggtctacgtataggataggtgaattaaacccagagcctaacaaacaacttgagagtagaagagggggaagaaaggaaaaagtaaacaccatgcaagcgcctggaaaggcaggccccgctctccattgaacagcattaaagaaagacctatcaacactaacacacagaattggatgcagcagccaatatccctactaccagtgtcaatctggaacaaactaaactctgcatactccgatatgaataagatatttgcctccattttcaagtgacctcttaactccactgcccggcttatgatcaaaatcactgctgcggctgctgctgctgtggctgttggtaatttccatatccagagtagccatagtacatgttaggatcttgcgcaggcggggcatatccatatgtttcatatccatgtgtatatccataatatccaccatattggtttggatctggctgaggctgaacagctccaacagatggatcctgtctgtttgaaggactccgaccccatgagagtcgaatattttgaccacccaacggaattccattt

SEQ ID NO: 12235 - DNA, 423 bp, Vitis vinifera
  Predicted polypeptide sequence is orthologous to G2907
tttttttttttttttttttttttttttttttggtcaaacaggaacagagaaccagctggaggtgtaacagggggatctggggttatgagaaacttctgggaattacggaggatttcacagatttcagttgggcgaagccaacggttttgtgcttctagtagtatctgttcaagggctaactgttgattcggaacataacgcctgctctcagccatccgcaataaatactcctccgaaaaccctagctctcatcggcgaaactgcgattacagattcggccacgaaaatgaatctgcgagcgtaggaaagtgtggggcaaaagaagtataccctcctaggaggagagaaatagcatgaaaaccagttaaaaagaatgtgaaaatagaaataaatattatagaggattcaaagtcaatgtatccc

SEQ ID NO: 12236 - DNA, 709 bp, Vitis vinifera
  Predicted polypeptide sequence is orthologous to G2969
ttttttttttttttttttttttgactaaaatcaaatggcagaactagatcatatacattaatactgaagataataatagtccatgatcggagaaaagaacagaactagctgatatcacacccaggaaataagctcgtgactcacacagagtatactattacaaagcaaggtagcacagaccttgggttgaataccagtaactcttcgtcgtccaccaaccttgtcagcgatccgccgccgcctatggcgcttctgcccaccactgaatcgaatccgccgtcctccttatccacatcgtcctggtcgcttccgattcggccggccaccactctgcacacaagcatcgctctcttcacattcatgaacctgaactcgtcttcgatgtcctccgggatcgtggcgtgtgctctccagctggtggataacgtggagattccgtccaacttgggtgagaatccggttctgatgatcccacagacgctgcagtactggtggttgcagacgctggagtttccgttttgccccaaattgcagaggaacgtcgagcagtgaaacctcaggagctcgttgccgtcggcgatgcacctctcgtcgcgtctccgaacggcgccgtttcgcgccgctttggattttacagactctctgtactcttcgaacctcgccagtattttcgagctgttgtggattttcaagatccgctgaattttcg

SEQ ID NO: 12237 - DNA, 646 bp, Vitis vinifera
  Predicted polypeptide sequence is orthologous to G2981, G2982
ggaagtttcttacaaattatcagcaacttattgttcttcaggaatactcagctgttgggaaaatcaaagtttaaagtttacttctcctttttggcgtgcggaaagtagctactggaacatgatgagtgatagacacctgggagatattcttgggggctttgatcataaccatacaggcaaacagagccctttctcagtttcatcaagctacgaccatactgcaactgctagtgagaatacaccaggagtgaaccatttggctactgatcatgagaataacagcactcctctatatgacagtgcagcaaagaaaaagagagtatcaagaatcatcggtggggggctgcggcagttcagtatcatagtttgtaagaaggtggagaacaagaggacaaccacatatagtgaggttgcagatgaaattatagcagagtttgctgcagcacacagtaaaacagcagtatctctggatgagtttgatgagaagaatatccggcgacgggtttatgatgcattgaatgtccttatggcactggatatcatcactagagacaaaaaggaaatcaggtggaagggacttccaactgcagattggaaggatatagaagaggtcaaggcactacgtgtgaagcttatgactaggatg

SEQ ID NO: 12238 - DNA, 861 bp, Vitis vinifera
  Predicted polypeptide sequence is orthologous to G2983
ggagcatgaaggtgcatcagttcgcacgtggattctgggagcacgaaccctccctcacgcttggctgcaagcgtttacgccctcttgctcccaagctggccaacagtgatagtgtcgctgctttcgatctcaagagcttcattagacctgaaagtggccccaggaagcttggatgctctgatgataagagagattcacctcaggtggaaacacatccaggtgggacgcggtggaatccaacccaggaacagattgggatcttggagatgctgtataaaagtggaatgcgcactcccaatgcacagcaaatagaacaaatcactgcacagcttggaaagtacgggaagatcgaaggcaagaatgtgttttattggttccaaaaccacaaagcacgggagagacagaagcagaagcgcaacagtttgggtctcggccactgtcccaggactcccacatccataactacaataaccttggataccagggtggaagtgggaagagaagaagatagtccaaacaagagaaagtgtaagagctggacgtttgaaacggtggaagaaaataacagatactacagagaggagggagataagactctggagcttttcccgttgcacccggaaggcagatgaaggggtttgaaaatttaatttaaactctgtttcattgtgatcaatttgctttcatgtgcttttccatgtttttctctctttgtttggggaaagaagaaagacaagttgtttctttgtggcctcctgcttattattcctgacttgaaaccaaagtgttttgtcactctttattcgatttctggaggtgattccttttgacaaaaaaaaaaaaaaaagataaaaaaaaaaa

SEQ ID NO: 12239 - DNA, 743 bp, Vitis vinifera
  Predicted polypeptide sequence is orthologous to G2989, G2990
atcctttatttcgcatgacctcctcattccttactccttacctcaaaattttttatcatcatgttcaccgccaccatcatcattaatgcctaatcttagatgcttcagcccacccatggatgtcaccgccaccgccacagccacccgacccactgatattgagactgaaacaaccaccaccaccaccaccatctccacgccttggacggttgcggggagttcatgccgtcgccgacttccactcctgccgaccccacctccctcaagtgcgccgcctgcggctgccaccgcaatttccaccgccgcgaccctgatgaacccaccactcatgtcatcgaaatccaccgccacccactggggccgccccgccggagctcaccctcaccgtccccatctccaccgccaccgccccatcactcgtcatactactcatccgcaccccagatgctcctagctctcagcagcggcggtgcggggccgtccgatgagcatcagattcatcccataacggtgacgaggcaggacaacccaaatggaagaaagcggtttcgcaccaagttcagtcaagagcagaaggagaagatgttctcgttctctgaaaaattggggtggaagatgcagaagagcgatgagggtttggttgaagagttctgcaatgaagttggtgttggcaaaggggggtgctcaaggtttggatgcacaacaacaagcacacttttggtaagagagatattagcagcaat

SEQ ID NO: 12240 - DNA, 499 bp, Vitis vinifera
  Predicted polypeptide sequence is orthologous to G2997
tttttttttttttttgagaagaaaaccgccttacctagtgcataatatttcacaaatcgtctttcaattactctcagactgaaatcccacagttgggatttctttaaatgaccaaaagataaaatagagacagtggatcaatttggatatataggtagaagaggaattggatgattacaactgtttgatctggcttatctttgaccaagatgcccttgtaggtggaccacatttccagtgtgcagctttaactgctactgggctcgcccggaacaagcaaagcatcttgaagggtatgtcttgtaggcaagcccagggtgtgcttgttgttgtgcatccaaaccttgagcacatgacgtttcacgcccgtttcgctacagaactgctgcaccactgcctcgtcatgcttctgaatcctccaccccaaactctctgccaaaccgaacatcttatccttttgctcctgcgtgaacttggtcctgaacctcttctttgatga

SEQ ID NO: 12241 - DNA, 757 bp, Vitis vinifera
  misc_feature (672)..(672): n is a, c, g, or t
  misc_feature (674)..(674): n is a, c, g, or t
  Predicted polypeptide sequence is orthologous to G3044
ttttttttttttttttttttttttttttttcgctaaatatattttattagcagaagaaagtgcgggcaatgaccaaagtcaacacaaagaagcaaaaaaagaaacaaaagacaaactaaataccacaaacaagctgacaagataacaaagaaggcctaccaaccaacaagcaacccataagtgatcaccgaagaccacaaccaaactcattcgggaaaacaatcccctgcaaactcaaccagtgaggaagcgcccttttagccaaggcatcagtttcctggtttgttgatatgggaccccacacaaagcaacaagctaagtctttggacaagttgacaatccttaaaaaggaatataccagacaaggaaacaatccgggtcatatacttttcatacttccagggccttctcctccccttggcggctcatgaaatgataatagcagaatctctccagtataaattccctaacccacatggcttcacttggcattctttcgcattggtgcactggtgtatatgtgcttaaatactgtctttgatattaactcgtgtgttgtgcactattagacatcatgcatcttagctactgatctctctagttcttggtcttatttataaagaactgagggtagaaaactcaaacaatgtgttgcagtttcttctccatttngntcccaagtctggttttcttttggtttttatattgcatgattatttggggttttgtagtgatttctgaacactgtaaatacccc

SEQ ID NO: 12242 - DNA, 451 bp, Vitis vinifera
  Predicted polypeptide sequence is orthologous to G3055
ggggcggtgggcctccaaaggtaacaacagacaccatggtggcaccagccctttctgctcctgctactgatgtttttcacatgggagtgggagttccatctcaaaggccttctgtagtggcccccaagcctggccaaaggccccttcagaaatggaaagggcccgacaagatcagtaagatttatggtgactggattgatgacctcgaataagaataggctcacaagaacttgtttagagggtgattgctggtggaagacaccgctggtgaagttattcgaacttgtttaaatttttgtatctctgacctgttctttggcccccttttttttttctttttctccagagttggaactttagcttccttttgtattattaccgtatgtcaggaaccatcctttgctctgtggatcatatgcagattctataatgtaaatcttctagttttctt

SEQ ID NO: 12243 - DNA, 807 bp, Vitis vinifera
  misc_feature (17)..(17): n is a, c, g, or t
  misc_feature (735)..(735): n is a, c, g, or t
  misc_feature (781)..(781): n is a, c, g, or t
  Predicted polypeptide sequence is orthologous to G3059
gaatctccgcatgatcnacagagatctcaacaattgattgagtctcctgatccaaaattctattcaggaccgatttgtcaactctgagtattcttcctcgaggtcaatggctgatgaatttcgccgtctcggtcttggagatggtaacgagactcgtagttgggatgatgaaatatctaatgagagtccaacgagtgtgatcgagagtgaccgggtcgagaggattgacgtggaacgaattacgctgccaaagagcatctccgtgaggtcgaatgggtacttgaagacgagtcaacccggaacgagtgaaggtggtcggactcggatcccgaatcggcttcgaactacgagcccactcaatggaacgcaaaaggtttacgtgcgtggagtcaagaaagaggaggaaccagtggaactggaggtgtacaaccaaggcatgttcaagactgagttgtgtaataagtggcaggagagcggcacttgcccgtatggcgatcactgccagtctgctcatggcatcgaggaactccgcccggtcatacgccacccacgctacaagactgaagtctgccgcatggtcctcgctggtgatgcctgcccatatggtcaccgctgccactttcgccatgccttaactgagcaggaaagggttcatgggacaactccagccaagggcaatcaagctggacagataaacagtaagaagcgcacatagactgacggaaatgatgatcnatagatgataatcctgttgctgagagcactgtgattgcgtagatcnagatggatataattctcgtaaaatgg

SEQ ID NO: 12244 - DNA, 900 bp, Vitis vinifera
  Predicted polypeptide sequence is orthologous to G3060
tccaagcaagaaatggagtcctttccatctggtataggaagcaaatcgaagccatgcacaaagtttttcagcacttctgggtgcccatttggtgagggatgccacttcttgcattatgttcctggtggcattaaagcagtgtctcagatggttaatcttgggggaaacacacctcttgcaccacctgcaagaaatcctgcagtgcccccttctttcccagatggttcatctccaccagctgtgaagacccgcttgtgcaacaaatacaactcggctgaaggctgtaagtttggggataaatgccatttcgcccatggtgagtgggagcttgggaagccaacacttccatcccatcatgaagatcatcgtggcatgggatcaggcaggttggctggcaggcttgagccacccccacctggccttgctgcagcagctagttttggagcctctgccactgctaaaatcagtgttgatgcttcactggctggagccatcattgggaaaagtggggtgaactcaaagcaaatctgtcgcctgactggggccaaattatccataaaggaccatgattcagatccaaacttgaggaacattgaactagagggcacatttgatcagatcaagcaagccagcgccatggttcgtgaactcattgtgaacatcagctcagcctctgggcctcccatgaggaacccagcaatgcaagcctctgctgcagcaaacaacttcaagactaagctctgcgagaacttcacgaaggggtcatgtacctttggtgagaggtgtcactttgcgcatggagctgatgagttacggatacctgcagggatgtgatgattgtctctctctcctcttctcttaccttcggctaggactgactctttgcaatggccttttaag

SEQ ID NO: 12245 - DNA, 627 bp, Vitis vinifera
  Predicted polypeptide sequence is orthologous to G3060
ggcatcgttggctggagccatcattgggaagggcggtgtgaactcgaagcagatatgtcgccaaacaggggccaaactttccatacgggagcatgattcagatccaaatctgaggaatattgaactggaggggacttttgaacagataaaagaagcgagtgcaatggtaagagaactaattgtgaacatcagtgcaatgccagggcatgcaagaacaactgcaatgccaggtggtggccaagcccctccggccagcaactacaagactaagttgtgcgacaattttacaaaagggtcatgcacctttggagaaaggtgtcactttgctcatggggctggtgagttgcgcaaatctgcaatataaatggcgcactgctgtaccatagtagtagtggggtggggaggggacatgagtgggaaatcagttcgccttttttctttttttatcattatggcagctggaatttaactttgttgaagtagcaattatcatatcatagagctctgggcttctaattttgctttacgaacaactacattagctttagtagccttgggctttgtcttaagagtggcggtagatgctattaattattcctcctgttgtgtgtgtgtgtatttgctttc

SEQ ID NO: 12246 - DNA, 424 bp, Vitis vinifera
  Predicted polypeptide sequence is orthologous to G3075
ttttttttttttttttattaaaaattatttttcttcaatgagatatgcacttgatacaacaagcatagcaactgcatcaattaaatgttgtgtggtccaccaaaactgagatccttctgagctacatggaaatgcataaaggaaatcttgttaatgctcatcagccagatcgcatacagataaatgcacatacttgatggatctttgaaggcccaagctcatgtcttagctgatctctctgctaaagccttctcagcagatactctctcaggaacaaaatctgatagaaagtcaaatctcttgcatttgctaactgctgatgctatgtgcttgtaagaaacataattcttgcgatccttaacagaacatgcatatgcatcattaacaaattgttgaaggaactcctcagaagctttgttgatga

SEQ ID NO: 12247 - DNA, 881 bp, Vitis vinifera
  Predicted polypeptide sequence is orthologous to G3091
ttttttttttttttttttttttttttcactcttaaaataaaatctattattaaattccatatatagacattctcctgtttacaaggagtacatcctttatctaaggctctacacaaaaccactatttacatttcactccacttcccaaaacttatgtataatcactcctaaaccccactcctattattattattatcatatgctaaccttattttttttctacttcaccattcagtccttcatattagtcttatttctttcctttctgttctctgccttctgcttctgcttccactgctgcaggcttctaagccttccttctatgtacacactgcttgcgataagaggggagcctttctccaatgctggcctttttggtaaaaagctctaggactggagggccattgtgaaaactagtattgtatatgagggtattttcggaattagctgatgagcacgatacttgtaggagactaatagtattctatgattagtcctcccattggggccctgtgcggaatcccctttcttcgcttggccgttctgtaatttactgcagttgggggaggtgtcgagggactaaaactctggactgcgttctgcgcctgccgcccatggctgctgctactgtacgattcctccgagtccgacgacgctgtcgccggctgctgatgcttcttcttctggaaattcgttgacgtacccacaatcttgcagccaagggaacagaagcggaatgaatcgaggaggctacgctcgcagacctcgcaggtgttggtgactccttttccaggcctaggctgcgggcgttcattcaggaagagactcttgcgctgttgataatgtaggtctggacaccggtgagtccagcactttctgat

SEQ ID NO: 12248 - DNA, 899 bp, Vitis vinifera
  Predicted polypeptide sequence is orthologous to G3091
tccgcactctggacgggaactgaattctggtgaaatgtgcaaagtttgccatcggatcatatttaaaccaagcatctatacctactgctctatctcatgcaaggtcgcagcagtttctacaaatctgaccagttcagatcctccctatcttgccccaaaaaagccaaaaaagaagcccccaccagagccaagtgtgaataagacacagagtcccccgaagagggtgaataagagaaaaggggtgcctagcagagcacctttcttttaaactgaggaaggaaacatgatccctgctactgaatgatggagtgtggactcaggcagcagtgaagaggtctgtcttaatggggaacttacgatggataagctcaaataagaaaaaccatgcttggaaactggtcttattagtaggttatgctatcactatgctttttgtggttctgtatttgccatgacttgtagacgtaccctgctttgaactctttaacgtttgctgtgttttttgcttgttatgaatttgccatgactgatcatcctatgtatgcatctgctctgaactcttaacacctgctcagttaacggagctccatggatgacacccctataagcattggtgcagcctttgttatgcacagcattcaatccttgtttatgacaaaaccaagctttccaagctcagagaagtgagactagagtgcagaaagcaagctgcacctgccatgagcttgagctccattaagctcaaacatgggatgcatgttagctagttgattgttcagtggtaagaacagtatatatccctggttatacaggacaaggttgggggaaaattcatctttggtggtaagtgttcattgcttctagtactcctctggctgctgatactttatatgccaaat

SEQ ID NO: 12249 - DNA, 819 bp, Vitis vinifera
  Predicted polypeptide sequence is orthologous to G3091
ttttttttttttttttttttttttttttacaagtaggaaaatcccatacatatagtataaacacgacatattattcatatcacattacaatatgccaatatacaccatcctatcccatttaatgtctacaaaatatatttacattttaattttcatcatacaactacattcaccataacctaatcacattatcatcaactattataataagcctataccttcacttcatcttcatcatcatcttctcccccaatttcttcaccattttatttcttctgactttcttctatatacattatcccagtcaagatctttagaccttcagcttccaacaccggcctccatggcgaaacagctcggaatgttggcttttctgctgtatattcatgcttcttatcacttttttttgggtatatttttgtagtgaactatcagtagagatatatttctgatcagtactgtatgataagggctcccaatggggctctgtggggcactcccttcctcctcttggccgtccggtaagtcgcggcggcggtgggaggcggcgtggagggcgtaaagctcgggatttgctcttgctgctgctgccgctgctggctccgttcagggattccgagtcggagccttctgtttccatgcacagcttcttcttcctgaagctctttgatgtcccaactatcttgcaaccaagggagcaaaaagtgaaggagtcaaggaggctgcgctcacaaacttggcaagtgttggtgactccttttccaggcctgggctgaggcctctcattcaagaacacaattctggcactgttgataatgt

SEQ ID NO: 12250 - DNA, 426 bp, Vitis vinifera
  Predicted polypeptide sequence is orthologous to G3091
gtagatcccttgcctaaggcgaagaatgagatggccatggaaagaggagaagggatatcaaggagagaatcgtcaagggatgaagatgaattgcgtgaaggcttacaacaagacatttacccgcccacgcctcctccacctccttcaagtgcaaggagaagaaaaggcattccccatagggcaccctttgcctcctaattgcccttaaaaaactaatatacccgactcatctttttctttcacaaagtactctttgggaggggtttccttgtcctaatgtggggtagggtaccctttgggtgggggtgaccaaatacaaaagggtaagtgtgcttccctttttggtttggggcccaaacaacaaattctctcttgcggagatgcaataatgcacaattgttattgataaaaaaaaaaaaaaaaaaa

SEQ ID NO: 12251 - DNA, 926 bp, Vitis vinifera
  Predicted polypeptide sequence is orthologous to G3095
ttttttttttttttttttttttttttttttcaggagagtttttttttcttttccatttactaaacctaaaggactttacaggatttcaagcaccatttatctatttgtgttatccagttgaaagcagactgttgtatcttaaacactcaaaatggggctcgatgaggaataccctttcttctcctggcattgctgtggttgaaaatgggaggagttgctggaaaaatgttgttgatggtctcgtctccggagctagacgcagtggacttgtcagcagcaacagtagcatcatggtgcccatccagggaaatggttggcccatctatcatcagccgactgaaaagatgcgtcctctgaaacttcctgggtgtggatgattcatctgattcggacccatggaaggtttcacgaccatgtttcagtttcagccaaaatgtgaggtccggatcgccccgcttcatggctccaagcttgcagcccaaagaacagaacctgaaagagtcaaggaggcttctgcaacaaatctcacaggtgttggtgacaccctttccaggcctgggctgtgggcgctcattcagaaatacaatcttcgcactgttgataacgtaggtttgaacgcaagatatgtcgatgtacttctgaatttcattaaccctcaccacgttgtggtacgaggatcgtcttatctgaacaacgcagtgatccttgtgatggatcaaacagtaggaacagagggcatctcccatacaatccaaacaaaacatattgcattcgctcttattagaatctccatgaataccgcagggaacgaagtagctagctctcagcattggcttcaaccacggcggacccagatgatcgttccccattcgcccaatcgaactcaccatcacttttttgtggtgaggaatctcccgctgctgatt

SEQ ID NO: 12252 - DNA, 324 bp, Vitis vinifera
  Predicted polypeptide sequence is orthologous to G3111
tttttttttttttttttttttttttttttttttttttttttttttttttttttttttttctaaggtttgggaaatatattttacatgcacaaaaaaacaatcatggaaaaattacatattcaaagactacagattttttgaaaccctaaatggatgggaagttgaaagaattcaattggaggaaagaggaaccctagttaaggaaaaaacatattcacatcgtcttctctctccttcaatcgggactccgtctcagctcgggggctgttggagttggttggaactcccccacacttcggacttcgggaaacaaccagaatctgc

SEQ ID NO: 12253 - DNA, 546 bp, Vitis vinifera
  misc_feature (17)..(17): n is a, c, g, or t
  misc_feature (26)..(26): n is a, c, g, or t
  misc_feature (36)..(36): n is a, c, g, or t
  Predicted polypeptide sequence is orthologous to G3111
ggtcggaattcccgggntcgacccancgcgtccganacattaaaaactgtaaaattctctaaatctgagctctctttctctctcctcacaggtcacatgactcatccgtctagattcctcggcggcgtgaactcctcggcgaccgcatcacaggagtccgccgccgtcgactccgacttcgtcgtcatcctcgccgcgctcctctgcgccctaatctgcgtcctcggcctcgttgcagtagctcgctgcgcctggctccgccggatctccggcgcagcgaacctcccgggcggttccgctcctcaaactccggccaacaaaggcttgaagaagaagatcctccgatccctcccgaaggttacctacgcagccgagaccgccggaaacctaacggactgcgctatctgcttgactgaattcgtcggaggagacgaaatccgagtgctgccgcagtgcgggcacgggttccacgtcggatgcatcgacacatggctaggatctcattgttcttgcccttcgtgcaggcagattctggttgttgccaga

SEQ ID NO: 12254 - DNA, 678 bp, Vitis vinifera
  Predicted polypeptide sequence is orthologous to G3111
gcacttctccatctctctcttttctactcttagtgatgactcgttcttcaagattcctgagcagctggaactcatcggcagcggaacccccggaggcagtggaggtcgagtccgatttcgtcgtgatccttgcggcgctgctatgcgctctgatatgcgtggtgggtctcatcgccgtagctcgctgcgcttggcttcggcggggctcagcgggaggggcgcgcgcgtcggccacgcaaccggcggcgaacaaggggctgaagaagaagatccttcagtcgcttccgaagctgacccacgacgccacagtgagcggcaagttcgcggagtgcgccatatgcttggcggagttcgtggagggtgacgagatccgagttctgccgcagtgcgggcatgggttccatgtgttgtgcgtggacacatggctgagctcccactcctcctgcccgtcgtgccggcagatactggtcgtcaccaggtgccggcagtgcggcaagttccccgcaatttccggcacggcaacgtcggacgcggaactcaaggcaagggaacagggtactgctgataatgggtttctaccataaccccatcacgatgtattttccatttctcctctagaccctcaccatgtacagaagaactgccccattttctctgtgcttcttgtattttcctcat

SEQ ID NO: 12255 - DNA, 685 bp, Vitis vinifera
  Predicted polypeptide sequence is orthologous to G3111
gcattttagcattaggaaggggtttgcattttttatcttgtatatggcctttcagttggagcgaggtttgcatggccttgagcctgctgttgtagccaactttccaacaaagaagtttgctgatgagtttttctcccctgcagaggatgctcagtgcacagtttgcctagtagaataccaagctgaagatatattgcgtattctcccttactgcggccacttcttccatgttacatgcatagacatatggctgcagcagcattccacatgtcctgtgtgtcgaatttcattgtgggagtttcctgagagaaaatgcttgatgcaacccatgttcagttcagctgttcgatcacattttggcatggaatcccgcaacacacattcatacaactgtttgtcaactggccgtgggttttcatcgagatctcacgacaaccacaggatggaccccattcaagaggatcagtttgggccaggaggtgacggagctgaagctcaggagagcaccctccccttgaccgatgctaatcagcctgcaaaggactctgaaaataagcacatagaaagcccatcaaatccatgaaatccttcgtttcttggaatcctggctgcattcatcgtgctttctgatagaatcaaattggaattgaaatttattaaaaccatctccttggaatgctctttt

SEQ ID NO: 12256 - DNA, 715 bp, Vitis vinifera
  Predicted polypeptide sequence is orthologous to G3967
gcttcactctataacctcattgacattcatagcaaagctgttgcatccattgtcaacaaggcagaaccactagaagcacacttaattcatgcaacagtttggaaggacagccctgggcataaagatggcagcaaagaaaatgactgtgcaagcactagctgcttcaaatcagtgaatcccttgcttctgcactctgaagattcagcttattcaaaaagtttacctaaatttgagaaagcaccacatttaaatgaaggcacaggaaatagcttgggtaaaggtattgcaagcttcccattagatgcttcagaattggccaatttcctcactatggacaggcatataggatttagttgcagtgcacaagttcttctaagatcagtactcgcagagaaacaagagttatgtttctctgttgtttcacttctttggcacaagttaattgcagccccagaaacaaaacctagcgcagaaagcacttctgcccaacaaggatggagacaggtggttgatgcgctatgcaacgtcgtatcagcatcaccggcaaaagcagctacagcagttgttcttcaggctgagagggaattgcagccttggattgctaaagatgatgatctaggtcagaagatgtggagaatcaaccaaagaattgtaaaattgatcgtggagctaatgaggaatcatgatagacctgaatcgctagtaattttgtcaa

SEQ ID NO: 12257 - DNA, 733 bp, Pinus taeda
  Predicted polypeptide sequence is orthologous to G28, G22, G1006
gggagagtattccgatcgactggggattcgacgattccgtcgctccgtctatgacctcttccttatccactgcctcaacgaagctcccgttatgtgaaaacgattcggaaaacatgattctgtgcggttaccacaatgaagggatgcccccaacgcccaaggaggagccggtgacggaaataaagaaggaagagagcttttccgtcaaacgggaggaggatgtccgtcaagaaacggtagccgcgatgccgaatccgaagaagaatgtggggaggcattacaggggcgtaaggcgaaggccgtgggggaaatttgcggcggagataagggactctgcgcgcaatggcgccagagtgtggctcggcactttcactacggcggaggaagctgcgctcgcatatgaccgtgccgcttacaagatgaggggatctagagctttgcttaacttccccctccaggttgtgggggaggacagtgatatatttaataccatgcggaggttagaaaaggcggagagtagtggtgagaatgagaatgaattgagtgggaagaagaagagggaacgtgaggaagcgagtgaagaagttgagtgggatagagaatgtcgaatgagagtggaagatgaggtgtgttggggtatgatgattaatgagcttctacgtggaacaccaccacttacaccatctgccattttcacgagcttcgacggtctcctctcccctcggcaacttat

SEQ ID NO: 12258 - DNA, 731 bp, Pinus taeda
  Predicted polypeptide sequence is orthologous to G28, G22, G1006
agtggcagcggcgttcataatagtatcaatgatcatgattatgatgatacggagaccaatggcatagccaccatgggatcctgccaaaatatcaacagcaaatcaatatcggaaggcaatgaaaatgaatttagacaacaagattgcgcttcttgttattcttattctttcaaggtgaagccacaagaagacgagaatggcgcgatgaaccagatctggggtaggcattacagaggagtaaggcggcggccctgggggaaattcgcagcagagatcagagatccctccagaaagggttccagaatttggctcggcactttcgacaccgccgaagaagctgctctcgcatatgaccgcgctgctttcagtatccgtggagccaaggctctggttaacttccccctcgctgttgcgccgaattcagagaaaggctcgccagtgggtcacatggaacgtaagagaaagagaagaagttgttagagtgttaacctggaaagaaatctcaatacgtagatctgttatgtgtcgattgtttgggatttttcgattgtaaaatccaaaaatatctagaaattaatgattagaaaagagtcatttgcaatgaaatgaaaatggggagtaatctaaagcgccatgaatcaacgagtgtgtatggaaaaattaacagttgcttctgattccttcccattctcatctcattattatctatcaataaatatattactgtgcag

SEQ ID NO: 12259 - DNA, 924 bp, Pinus taeda
  misc_feature (192)..(192): n is a, c, g, or t
  Predicted polypeptide sequence is orthologous to G28, G22, G1006
tcgcagcggagataagggactctgcaaggcagggggctagagtttggctcggcaccttcaataccgcggaggaggcggctttcgcctatgaccgtgctgcttacaagatgcggggttctaaggccttgcttaatttcccgctacaggttgcttcagggagcgataagacatgtagcagtgtagagaagccanagagtaatggcgagaattttcttcaacatctcaccaccaggaagagggaacccagtgccagtgctgaagtcgactctggcagagagtgtcgggtgaaattggaagaaattacgagggagaacgacatgatgtcgaaggatatggtggatgagcttttatatgggagaatgacaacaccgccactcacacctagtggaatcgacatgagcttctccaatttcctctgccctggacaacttatggtcaactgaggttgtccattcactttctctacaatttataattatttcaatttttttaaatccccactgttgatcttgatctcgatcttctccatggtatggattccatgctccacataagtatttcgtttaagtactctactaaagaaaataatacagaaatgcatgtgaaaaaagatctgtaatcaatggctagatttcttggccaattatgatttttcagtatgcaagcgccgaaatgaggagtgaggaggagatcactttcagggcctattcagcaaattgtccaagagacagtgaggaggaaatgcaaatttgtaattcgagaagagtctgttcgtttgacatcggatgtatcattgacctggtttcggtttgttccgtcaaagccaaatcttgctacagaacatttgtgtgtaattcttaaagacaattcttaaagttgacccttattaatctcagtgatatcctaccgtcattctattttttt

SEQ ID NO: 12260 - DNA, 900 bp, Pinus taeda
  Predicted polypeptide sequence is orthologous to G28, G22, G1006
gcgcggcggcaccaggttttcccgtccggtgctctccatcaccgttccgcggagggaatacttcgagtgggagaggcgttccgctagctggggcgcggattcaaggaattttgtgaccgcctgttgcccggcgtccatcagacggtgcctttcctgcgactgggggaagcttccgttagatgaaaacgattcgcaggacatgtttctatatggggttctcaaggaggcgacgcagaagggttggacgccgttaactccaaaggaaatcaagaacacagacgtcaaacagataaatcctcggcaggagacggcgcgtgaggtgtcggaaaaggaccagaagagcgggggaaggcatttccggggtgtgagacggcggccgtggggtaaatatgcggcggagataagggactctgcgcggcagggatctagagtgtggctcggtaccttcgacacggcggaggaagccgcctttgcatatgatcgcgccgcttacaagatgaggggcactaaggccttgctcaattttccccttgatttggttgctaagtccatggattccctcagtgaggatgagagttgctgtagaaagaggaaattgaatgggcaagcacagaggggagaagaaaagaggcaccaccatgggccgaatttcgaagagtgtggggtggaatctcaggaatcgatcgtggtggaggatggagagcagaagagatttagacgatgaatgaatattcgtgagcgtggggtggattctgaagagaaccgatcgcggtggaggatgcagagcaaaagtggtttactctatgaacggatattcctcatttggctgagggattcggtgaaagtgacttgtaaatattatgaatatttcatataaagttatctacactaattctttct

SEQ ID NO: 12261 - DNA, 915 bp, Pinus taeda
  Predicted polypeptide sequence is orthologous to G28, G22, G1006
aggcatttgatttcaaactacgaaaatggcaatgaacagcacacagcaatgtcaagaaccacaacaatatgcagaaatgagccatttacttgaagatttagacggcctatatgaagaatcgtccctctgtgcgatgatgagaaatagcccgtttgataccagcagaaactcgagccctgaagtagagagcttcatccagagcgcactcgcaggcaattccgtcgacgacaacagaggggaaacggagatggagacggaaatgccgactccggccgttaagccctcgcgtccctccttatccgtctccgttccccgacgtgaatctttcgactgggagaaattctctgtcggccgaggattcagaaatgtcgccagcgttacacctccgtgtgtcagcccttgcttatccgctgcctgggcgaagcttcctttaaatgaaaacgattcggaggacatggttctgtacgggatgctcaaagaggccgccaacaagggatggatgcctgtaacgcccaaggaggagacggcgatggaaacgaagaaggaagccgaagtttttcccgtcaagaaagaggccgaagtctttcccgtcaagaaagaggccgatgtccgtcaagaaacgcgaacacagcagccggtggcgaagaagaagattgtgggcaggcattacaggggcgtgcggcagagaccgtgggggaaattcgctgcggagataagggactctgcacggcaaggggctagagtttggctcggcaccttcaataccgcggaggagggcggcggtcgcctatgaccgtgccgcttacaagatgcggggttctaaggctttgcttaatttcccgctccaagttgcttcagggagcaataacacatgtagcagtgtagagaagccaaagagtaatggcgaagattttc

SEQ ID NO: 12262 - DNA, 807 bp, Pinus taeda
  Predicted polypeptide sequence is orthologous to G28, G22, G1006
acagcagggcagagcctaagcatgaacatgttggagttgattcgccaccatttgctggaagtggaggacgaaatggatattatgcatctgtatcacccaggaggaaatgatccatcctcttcatcgtcttcagtatcttcctccagagtcagctcggaatatctccatggcactgccgccgccacagcaagtggttcatgccaaaacagatcaccatcagaagacaatgagagttcacaatactcttctgcttctacttctgtatccacagtcacaagaagaacagaggcggtaaatataaatgtgaagccacagccacgggaggagcagagtgtggaaaagaacaatcaaattcactacagaggagtgaggaagaggacatggggtaaattcgcagctgaaatcagggaccccgccaagcagggggccagggtttggctcggcactttcgtcaccgccgaggaggccgcactcgcatatgaccgggccgccttcagaatccgcggagccaaggccgtccttaacttcccccttgctttcgcttccatttcagagaatggatcggccgtaggtcacatggggaacaaaaggaagagagggagaggagaaacaaacgaggagtgggcggcatgtgatcgggggagctcagttagttgagcagaagctgaaggtattcattatgatttgatcattttattattatgatcctgaaaatgtatgactgagattgaatttgtaataatccaacaattttgtgaaaatctatctccattatcctctgcgagtacacattgcaagattgtggtg

SEQ ID NO: 12263 - DNA, 691 bp, Pinus taeda
  Predicted polypeptide sequence is orthologous to G28, G22, G1006
gaaaaatatttataaacaacaatacaataaaagtcatctatcatttaactgcacttgccgactagagtaattacaatttctctaacgttctgaatcaacatagaacgggaaatcaagcaacttggagcgggaaattaagcaaggccttagaaccccgtatcttgtaagcggcacggtcataagcgagagccgcctcctccgcggtattgaaggtgccaagccaaactctagccttctgccgtgcagagtcccttatctccgctgcgaactttcccaacggccgctgccgctgccgctgccgcacgcccctgtaatggctaccaacgttcttcttcttcgccaccggctgctgtgtttgcgtttcatgacggacatcggcctctttcttgacgggaaaagcgtcggcttccttttttgtttccatcgccgtctcctccttgtgcgttacaggcatccatccctcgttgccggtctttttgagaatcacgcacaagaccatgtcctccgaatcgttttcgtttaacggcagctttgaccaggcggcggataagcaagggctcacagacggaggtgtgacgccgagggaatttctgcatcccccgccgactgagaatttttcccagcccatagattcgagtcgcggaacggatacggagagcaagggacggaacggctcaacggccgttgtcgg

SEQ ID NO: 12264 - DNA, 911 bp, Pinus taeda
  Predicted polypeptide sequence is orthologous to G481, G482, G485, G1364, G2345
acattgcggcggactgcgggaagtattgttttcagtaattcccttaattgggtcccagaatacgttctcagatccgaaaacggttcagtccatcggaggttatagcgattcgaaggcctgaaaaccctaaaaatccttatccccctttgtctttgaatggcagagaactatggcagcccggatagcagcccccggtcggagaacgaatccggcggcggtcacatgggcggcagcgatttctctgtgaaagagcaggatcggttcctgcccatagccaacgtggggcgcataatgaagaaggccctgcccgccaatggcaaggtttcgaaggacgccaaagaaactgtgcaggagtgcgtctctgagtttatcagtttcatcaccggcgaggcctccgacaagtgccaacgggaaaagagaaagacgatcaacggcgacgatctgctgtgggcgatgacaaccctggggtttgaggactatgttgagcccctcaagatctatctccacaagtacagagaaatggagggcgagaaggtctctatggccaaacaaggagacccgactccttccaaggaaggtaacaacgccattaatggctcctcaattgaaaaccctaatgctaatgcctacagtggtttgaaccccggcggttataatagggtacagtcgcagtctctgccacatatgcagcaggctgcctatgggcaaccgccaggtggaatggtctatggccaccacggccacattatgggggcttacaatatgaccgccccaaatagcagtggtggaaatagcagtggtcagcaacagcagcaagcccccagaggccaatggtagaaatatttactttttcttttctgtttttctaatttttatgggttcatgtggggacagctgggtgccttagttaa

SEQ ID NO: 12265 - DNA, 958 bp, Pinus taeda
  Predicted polypeptide sequence is orthologous to G481, G482, G485, G1364, G2345
aataaaggcagcgagagggtgggaggtgattggcaaaagcgaaaaattaaaaaaggggatttgagcgaacgaacgaacggtgaagatacacagaggatctctcaacggcttcatctccgtcgtcgtctctcctccttccatctccagcgtccgatctgatcttatcaaaggaagcccttaaatccctccagctttccaagcgcgggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggagtttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatggaaagaaagagtcaaatgtacatcaagggattccaaatatgcagcagtctcagatgcagcatcatcatatggttacaatgcaggggcaatgatctgtcatgatacatgagaggtcatgaattgctggttagtatgtagccgatcaaatttagatggctagttttgtgaggatcaaatgaaaacaattcatttaacttaattttatgttactgggcaaagcttttagcttgacctaaatgataggtagtcgtgatagctagctttattgtacatggaagttgtgatttgtatgttgctgtacatgtgaattgttgtcactgtaagcat

SEQ ID NO: 12266 - DNA, 908 bp, Pinus taeda
  Predicted polypeptide sequence is orthologous to G481, G482, G485, G1364, G2345
accaaatcggaaaaagaactaaattatttgacactttatcctaatccaacgggaatctatttggtcgctggtctccggcgtataacgtcttctgtgacgccacctggcgcctgctctcgattccagaattctatccggttgggtattaaattaaggtgattgttggttacagacgttctgtggacaccgagtgagtctcctagccttggaatttggcaccatctcgtcccgcagccatttcagttcgatctcccgccgtcagaaaaaataatccccaattctccagctgtccctgccgtgtctgcacgcgacaggtctgcccgggctttggtctgtggaatttcatgccaatttatcacctataaactccacccgcatctgcccacaaaccccacaagtcacacccctcttcgtcttctttgaaatctcagatgggttctgccaattagctcggatccttgcctcttcagttggttttgtgagcacacacgaggccaggacccgggtatcaacgattcccctcaactgacgtaacccatggcgaccactcggcatcagcgcagtcccgatagcagcccgcgctcggaggatgaatcaggagcgcacacgtacagcaaccaggatggttccgtgaaggaacaggatcgatttctgcccattgctaatgtgagcagaatcatgaagaaagcccttccagctaatgccaagatatcgaaagatgccaaggagacggtgcaggaatgcgtttcagagttcatcagtttcatcactggggaagcctctgacaagtgtcagagggagaagaggaagaccatcaatggggacgacctgctgtgggcaatgggaactctagggtttgaaaactatgtggagcccctcaaggtctacctgcagagtacagagaattg

SEQ ID NO: 12267 - DNA, 767 bp, Pinus taeda
  Predicted polypeptide sequence is orthologous to G481, G482, G485, G1364, G2345
cggccgggggtggaacaagcatgacgttgtgaatggtccacttttttttctcccctcccatgcccggtatttctctaaatgccgacgcaatggaaatatgtagtctgtaaaccctaaaacttgtaatgcccatagcaaatcatcagcgttcatagtcttacgcttgtttttcatgcacctgtcacacgccaccctggagagcagaggagttgcagctggtgtggtttgttcggttgtaataatgtgttttcaggaatgcagaggagatccgctggagaaggctttgggttattttctttttgtccttacatacagcaggttgctgtgattttgcgataaatggaaagtcaagagatgggggcacacttgcaactctgtcaagaatgaccgctttctctatgtttttggcggatatggcaaggacaattgccagacattcgggacagctggtctctccacgcacctccactgatacggttcttggagattgagtcagggcagctgatggtgttaaatgccataacttagcccataacccctcgggatcctatcctggatagacgctcaggattttatctcggaaatcgacggtgataaaccacaggtcttggttcaaaaggaattgggctagggtttcatcgggcatttgcatagtcattgcgaggcaatgcctctcgacgctggttacttctgcatttgtagtatggcatcttccattcggctcttcattcggtgaacccataccttcagcttctctggtttgcagt

SEQ ID NO: 12268 - DNA, 843 bp, Pinus taeda
  Predicted polypeptide sequence is orthologous to G481, G482, G485, G1364, G2345
cggccggggggacggtttggatgggttgttttgcaggtttctcacctgcggcgcgcgtttggttcgttggatgacaaaaaacacattctaattgtatttattcatctcccctccaagagagcagcggcagccatggcagacttagcgagctccgtcaccagtcaagaaagccctcactcagaagatacgaacaataacagccaaaaccagggttccaatgcccgggagcaggatcgattcctccccattgcgaacataagccgaattatgaagaaggcagttcctgccaacgccaagatcgcaaaggacgccaaggacactgtccaagaatgcgtttccgagttcatcagtttcattaccagcgaggcgagcgacaagtgccagcgtgaaaagcggaagacaatcaacggagacgacttgttatgggccatgggtactctagggtttgaggactacgtggagcctctcaagatttacttgcacaaatatagagaggcggagggtgacagcaaaggagctgctactagcagatctggtgtgggagatcctactaagaaagattcgagtaattttggagcattaccaaatattaggtgaataaattatgttcgataaaccagggattgaaccatattcaacaggtcagattttgcaggaagtggtcattagagaatctgtataagatgcttggaaggatgaaattgtgggattggaagctcctagtaataaaatacatgtttaatttttttgaaataataaaataacttgtgattaaagttttgccgagtaaccaatatgatcattgtacataagataagtgcatgactgtagctctctcatttt

SEQ ID NO: 12269 - DNA, 677 bp, Pinus taeda
  Predicted polypeptide sequence is orthologous to G1760, G152, G153, G860
ccgcgtgccgaattcggcacgaggtctacatggaaataccattcccgcggaggacgaagggtcaacattgactcctgagcgtgccctcactgggggacagggcaagcagcctgctcacaaagaaaaggagaaagtttcaagtaattttttccaggaggctaaacggactgatgaaggacgcgtcggagctgccaatcctatgtgatgcgcgagcggcctccatcgttttctccaacagaggcagactctgtaacttctcctgtatcaggtcccgcatgtttattgaacgtcagctttggatccaacaatggaggatatgctcaattaaaacgtatgtgttgcgagttgtggatggattccctattaatcatttttatttttattttagctattacaattttcccagaaaagagaagtaaacaatttaaattgtttttttaactgacggttataggcttttgaggattatttttggatacattgagcgctcccaacttgtaaataaagactttattttgcgtagtgatgtttggggggcttatgaatatcaatatcagaaaaggttgcaggggtcacatgaggaaaggatattttaaaggaaaatatcagtaatcttactatgactgtggatatatatatatatactggtaagctttagactttatttggttttattc

SEQ ID NO: 12270 - DNA, 880 bp, Pinus taeda
  Predicted polypeptide sequence is orthologous to G1945, G2155
gaggctgccatggccggactggaaccagggtcctcggcctcgttcaaacctctgaagaggatagcgccagcaacgccataggcagaacgggatcccgggcgtgtatgaataacaataacagtattgcaaggagggagtgtactgggttgagcttgggtgtggccaggaaacccaggggccgcccgccgggctccaaaaacaaagcgaagccggcggttataatcaccagggacagcgaggatgcaatgaggcctcatattctggaagtagcgggcggccacgacgttgtcgagtgtttaactcagttctgcggaaggcgccaggtagggctctgcgttctgagcgggagaggaatggtgactaatgtgaccatccgccagcccaacgggtccggatccacagtcaccttccatggcagattcgagatactgtcgctttcaggggcttataacacaccctccggctcctcttcttcaatctcctctggtctctctatttctctggctggcgctcaaggccaggtcgtcggaggcagtgtagccggcgctcttagggcagccgggccggtcattgtcatagttgcatcgttcaccagtccttctcatcacaatcttccacaagacgatcaagaacagaatggtaatggaaacagtgctgctgttcctccgcctgcaactgttggggcgcctaatggatacaacattactccatcgaattcggattcctgcgtctacactgtatcgcccaaccctatcagttcccagcttccaccggatcatgttctgccatggccgacccaggccagtgttcgtccgtactcaattcgctagtttctcaaattttgtactcatcgatttatttgtcttcaaaatcccacatc

SEQ ID NO: 12271 - DNA, 795 bp, Pinus taeda
  Predicted polypeptide sequence is orthologous to G2
acgaactttgatccttacttatatgaaaaagaaattcttgaagaaagaagagagagtcagacttctacaggttgtgaccagaatttggaccttagccttgggattggtcatgttccaacgcaattaaagaaaagcccttcatacaaatctagggcagaagaagacagtcaaccgaatcacattggaggttcaacctattcgaaccatacacaggattcgaaggttttgtcatgtctcacatctaaaggggacgagaacgctgtaccggagtttcaggtgttgcctcgtggtcatgccctatattggaattctcaggtgctgcaagttccagaggccatgaaatacaaggaatctgaagctcacaggagtgaggataatgcttatgagcaaactgcaacatcagggagccaattatatcctgaccatctcgggaactgcaagaaattgaatatgatggaggatttgaaagagcaaagctttggagtccctgcatcaactgtacccttttggcctatgagacaacaacaattaggatggacttggcaactgcatgctaagggaccaactagtccagtattcaccaccaacagatcctcctcatcaggattctcaccgcaaatccataccgcattcgttccttcaacacacgggtctcacaacatgggattacaatgggcagcgcaatcgactgatccctgcatggttcaaaccccaagcccacatctgtcaactcgtctgaccaatggaactgattccagcgaccatatggtgggttcaaatcttgattttccagcc

SEQ ID NO: 12272 - DNA, 598 bp, Pinus taeda
  Predicted polypeptide sequence is orthologous to G2
gggcaaggccctcacctgttgttatcatagaagggtaaattatttagaaatcgatgctgacgatttccctactgccatttgcgtgatggatctcagccgaacgtgttaatttctataccaggtggcctttctgtgattagttcatcttggtataattcaggctcgaagtttgttactgctcctgccccattgcatctgatggcagccctatcataggctcttgcatcttcgatctcactatgactcccatcacacttgtagaatgttacactgttgtactgagagctcctagaccgcgggtcatgcctgcttttcttactcggttgagtgccttccatcatgccttttgatgctcaacaaggtcgggtgaatcacagaacgttacattcgtccagcgagatcaggttagggtatcaagcggtggtttttccgggtcttcgaccgggaaaaattgttgggtaacgccgtcgtttccacccgggttctcattggcatgcaatatcagattcttcggcatgattttctattcttcttgtgatgcctctggtggtggttgaacttgacatgtgccgtggaaattttcttgtgagggtccctg

SEQ ID NO: 12273 - DNA, 812 bp, Pinus taeda
  misc_feature (449)..(451): n is a, c, g, or t
  misc_feature (680)..(683): n is a, c, g, or t
  misc_feature (721)..(723): n is a, c, g, or t
  misc_feature (732)..(734): n is a, c, g, or t
  misc_feature (737)..(738): n is a, c, g, or t
  misc_feature (762)..(763): n is a, c, g, or t
  misc_feature (765)..(765): n is a, c, g, or t
  misc_feature (769)..(770): n is a, c, g, or t
  misc_feature (772)..(772): n is a, c, g, or t
  misc_feature (784)..(785): n is a, c, g, or t
  misc_feature (791)..(798): n is a, c, g, or t
  Predicted polypeptide sequence is orthologous to G4
tcactattttcttcatcacgccattgctttgtgttctgcgaaggcagcaacagctgttttgaaaacaaaaggatgtgtgaaggtgccataactacggatttcattgccgcgaaccaatcccggcgtatttctgccagggatttttggccggatttcgataccttctatgacttgttcttcaatggcggagccgtgtctgaatccatcaataaatcgggcagcttcgacgacgcatacaaccggaagaataagacgagcaagaatattttcaactccaagcatgaattttcttcaggtgctggaaatgaggccattcctcctttgaaggatttcgaaaagtcctcggccaagagcaccaagaggaagaggaggaatatgtacagaggtatcaggcagcgtccatggggaaaatgggctgccgagattcgagatcccagaaagggcattannngtttggcttggaacgttcaacacagcggaggaggccgccaaggcctacgatacagaggctaaaaagatcagaggtaagaaagccaaacttaactttgctgatggctcctgttctgtaaaaatggacagtagcaagaaaatgtcaaggaagaaagtaaagtcatgtacaaaaacccctaatttattattggggttgaatatgaacagtgaggtaaaacctggcttattannnnattactttgcaaacagtcaaatggaaccctctttgggnnnatgtcttcnnntcnnatcttccagtctatggctccgacnntntggnntntcggtactctgnntacctnnnnnnnntgctccatttcgaa

SEQ ID NO: 12274 - DNA, 884 bp, Pinus taeda
  Predicted polypeptide sequence is orthologous to G4
catgatcagtaactttaaaccttcatattcaccaaagcgtgatctattagagggttactgtctaaacggccaaatgaaaccctctctgaaggatgtctgcagatcggctcttcaaaactatggctacgatgatatggagtatggggactctctgttcttaaaacccagagctccatttcaaagcaattcgaacgtatcaacagtccaatcttctgagcaaagcaatttgagccaaactttgcagaaatcgtactcttgtgagctctgtagccataactattcagaggtgagcaatttcatgtccactgcgtgtagcgatgtcgcacatttcgaaccggtgaaatcttcccatccaggaggtcattttcattcagatcagagcagcatctcacttgatggggcacatttcccatggggtcatgaaacaaaaaccccagaaattacatctgaatatgatgacacgaatgagtctccatttgtagccataaaaccccaagtcaatggtgttgttaaagacagatctgttcataccatggacgtcagcggtggaacacaaactttttgtgtgaattcttctatggaggtcaacgatgggacacaacgttctgctgtgaacatccccattcaggtcaacagtggcacagaatgctacaaacagaggataacatcatgcagcttcagttttccaaacaattatcagctttggaatcatatcttgggttgccagagagtcctaataataaagcaaccatggatggatcaacagaagtagcgggtcatgctccaggctcttttccacatgaggaatgttccctgaaaccatggttctttgaggacttcccaagttcaagttcagtttatcaaagcaatcttagtgatatgtg

SEQ ID NO: 12275 - DNA, 874 bp, Pinus taeda
  Predicted polypeptide sequence is orthologous to G4
cagaggtgagcaatttcatgttccctgcttatggtgataccccaaaatttgaaccagtggaatcttcctatccagtaggttattttgattctgatcatagcagcaactcatttgatgaggaacatttctcatgggctcatgaaatgaaaaccccagaaatatcatgtgtatataatgatgatggacatgaatctgtatttgtggacataaaacctccagtccatggtgttgttaaggacagacctgtggatacctctataaacgtcaacagtgggacagaaagttttggcgtagatacctctatggaggtcaatgacgggactgaaagttttggcgtagatacctctatggaggtcaatgacgggacagaatgttttgctgtggatatccctgttgaggtcaatggtggaacaggatgctacaaaacagaggataacatcctgcagcttgagctttctgaaaatttgtttgctttggaaaaatatcttgggttgtcagagggtgacgcagcaggctcttttccagatgaggagtggtccttgaaaccatggttctttgacgatgtgccaattttagctttacctcatcagagcagtcctggcgatccgggaacttcaggttcagtttatcaaagcagtgctggcttttgcttttaaagtttactgttaaaaaaaagcagactggtttgaattttgtgttgcatgtccatgtacagcatgtagagtcttttaaacttgtgtgttgcactttttatttatgtttttaatttgtttgtgtgtgtaaagtctcttccaaggctactagaattcatatgtagtagtttggttctcaaacatttgggataatagagttcatctatgttatagattgtttg

SEQ ID NO: 12276 - DNA, 1032 bp, Pinus taeda
  Predicted polypeptide sequence is orthologous to G4
gtaagcaggcaacgacgcctgttttgctttagagtttaacagaaaagaagaatgtgtggaggtgctatcatctcggactttataataccccctgcgagccgaggccgccgggtgactgccagggatatatggcccgattttgataagttctctgagtttattaatggaggtgctgcggtggagtcctttgatgtcagcgttgatgtcgatgacgacgaggaggattccgacgatgacgagttcctcgattttgaggagagctatcagaacaagaagaagaagcagcaacagccgatatcccccaccaagggtttcgagcttcctttagctcggggtcttgatggaccggcggccaagagcgcggtgagaaagaggaagaatttgtacagagggatcaggcaacgtccatgggggaaatgggctgcagagatcagggatcccagaaaaggcgctagggtttggcttggtacctttaatacggcggaggaagctgctcgggcttatgatgcagctgcacgaaagatcagaggtaagaaggcgaaagtaaattttgttgatgagccaccaccctccgttaagaaggaaagtaataatgctaagggttccaagaaagggtccagcaagaaaataaaatcatatactaccccaaaggctgactttttcgaaggtttcaaaacggcgaaaccttcgattgcccaatacaacttccatcagaaattcccaaaccctagctgtgatgatctagggtatcaaaaccccttatcgccattacatgccatctgcaatcgaaactttgtcgccaaacagtcaagttccgcgttgcctgcatactccactgagttttctgatttcgatgattccgaggtcgataatctggtaccccagcctgcgagttttgaaccgatgaaaaacataaataaacgaaaagggtataattcctttgagtccgacaccagctgtgtgtctgctgatagatcccatatctcgtgggttacagaagtgaaaacccctgaaatatcttctgtaccaaaa

SEQ ID NO: 12277 - DNA, 722 bp, Pinus taeda
  Predicted polypeptide sequence is orthologous to G4
cggccggggacaaaagtttcagttggggttgggagaaattagacactatgtgtggaggcacggtaacttggaattctaacccggttagtaagagtgagcgagccattttggaggatttatggactagtttgcatggagttcgccggcattttcatgagtccttctttgatttgtacagttcagatgacgatgatgattttttggattttcctgatctttttaaagaaaatttaagtgccaagggtttacggattgccaagaaagaatgccctttagctggaggggggcttgctacatatccttcccattataaaggaacacctaacaccacaagagattctcaatgcaaaggagcagccaagaccacaagtggtaggaagaagaagaagactatgtatagaggtataagacaacgcacatggggcaaatgggctgcagaaatcagagatcccaaaaaaggaatgagggtttggctgggtacctttgatacagcagaagaagctgctagagcttatgatgcagaagccaggaagattagaggaaagaaagcaaaactcaattttgctgatgacttgttacctcccaagaagagtaagaaggtggtaaagaagcttaaggataatatgattacagaagactcacataaaaagacatgcatgcacttgccagaatgttcagcaagctcaggtattgttcagagccagaaatccaatgtgaaggct

SEQ ID NO: 12278 - DNA, 828 bp, Pinus taeda
  Predicted polypeptide sequence is orthologous to G5, G974
ctggcagaacttagaatgccagaggcttctctagtctctggaaattctgaagtcttgtgttcttcgtcatcttttttccccaacttaccatcaaatggcttcggccactctgatggcctggtatggcgcccgagttttcaagggcagaaccagtacagcggagaatccattgaatcggccatggttttgtatgaattgttacatgtacagcagattcagcaaatacagcagcagcagtttcaattgcaacaacaacaaatagcagcagcggcttcaatccaccatatgggtcgaaaccctctgggtcccagagctcagcccatgaaacttcatggcagcagcctgtcaaagccggctaagctttacagaggcgtgaggcagcgccactggggtaaatgggttgcagagatcaggttacccagaaacagaaccaggttatggctggggacttttgatactgcagaggaggcggccatggcttatgacaaggctgcttacaggctaaggggtgactatgctaggctcaattttcctcaccttaaacaccatttggaagcaaattccttcgccccctggactggtaattctgtgctgccatcgtctgtggatgccaagctacaagcaatttgccaaagcttgaaacaacccttggaaagcatgtctaagaccgaagaatcagaagaaatttcatgtgcatatgagaattcgggctctcttgggtcggtgcgggatgaagatgcgaagaagaatgatgttgtgtctgtcaagtccgagacttgtgattctgatagtagtgatgattccaccattacagcgttgaactcagct

SEQ ID NO: 12279 - DNA, 888 bp, Pinus taeda
  Predicted polypeptide sequence is orthologous to G5, G974
agccccattcacagcaagtactggggtcttcagcctaccattatcagcagcagcagcagcagctgaaacaattgagggatttatctttatcaagaaacctacttggggcaagagctcagcccatgaaactttctgctaaaaatgattcaaaactgggtattgcaaggcctgccaagctttacagaggagtgagacagaggcactgggggaaatgggtagcagagatcagattacctaggaatagaaccaggctctggcttggaacttttgacacagcagaagaagcagcgtttgcatatgacacagcagcctaccaactacgtggtgagtacgcaaggcttaattttccggacttgaggtatcttttgctctcaaattcggataacggtagccataatgttctttcgccaccgggtaatgcgttatctgtgctgaaatcttctgttgatgcaaagctccaggcaatttgccagcgtttatcccaggaaaattcttcagaaaatcgtctgatggcacacagtgccaacaatgaagctctggagaatgtcaagtgtgaagtttctggaagcagcaatagctcaacgatctgtggtgcagaatctgcttctacgtcacccagtaaatgtgaagtcgattcatcgactttgcagaaagcgccctctttctctattttcgctgaactggacgagtgtctcaccaaaatgccttctttggatccagaagtgatcgaggacgttctgtcctcttaaatagtgttacatttcctgtgcatatatatatttaggctgtcagtttattaggagagccaaggctcttagctgagaccaaagatgcacgttttgcagctgcatcgatgttcatcaatattatagcagtgtctagaaatgt

SEQ ID NO: 12280 - DNA, 921 bp, Pinus taeda
  Predicted polypeptide sequence is orthologous to G12, G24, G1277
aggagatccggagcatcacgtactcatcactcttatgtggccaaaaccgccgacaaattagagccagccaaatatgggtatatatctctactccttttatccttaattttcatccatccgtctttagagatttttcttgtgtctggcgaaaccctcgtcagagagcgagagatctttaatggagcacgaatgttcgacttctgaacctcatggcagcggtggaggtgggggcatgaagaggtccagtacaggagcagggggaggagggggagtaggaggcggcggcggaggcaagggaagcccgtacagaggcgtcaggatgagaaaatggggaaaatgggtttctgaagtgagggagccgaacaagcggtctcgcatatggctcggttcctattccactcccgaggccgctgccagggcctatgatactgccgttttctacctcagaggaccctccgcgactctcaatttccccgaggaagcacgtaaggagcagcagagcgacctcaggctttcgcagctcggggagctctcaccgtcctctattcagcggagagcggccgaggtcggcgcggccgtcgaccatgccatgcaggcgggcccggttcctgctcagaccctgagggaaataaaccaagaaaatgatatgaagaacgccttgagttcaaaattgagcgagggcaataatttcaagatcgaagcaaaaaataatatgaggcagcagggcttgagttcgaaatcgagtgacaatattttcaagtttgacgaaaaaaataatacgatgctgcagggcttgagttcgaaaccgagcgacaatattttcaagtttgaggaaaaaataatacaaggctgcacgggttgaatttgaaacccaagcgagtgcgatattttcccgttcgaagaaaagagtaataagaagct

SEQ ID NO: 12281 - DNA, 814 bp, Pinus taeda
  Predicted polypeptide sequence is orthologous to G21
cgtcgcgtgccagtttcgatgaacatgagcatgcccgcagtccatgtgcaaattctgcttctcctcctgctttaacaaactcctcttcattttctgattcctctgacggaaactgcataccttccatattcaatgcggttgaatccgcttccactggaagctccgcctcggattgtacgcggagattaatgcacaatagaatgcgtaagcgtcgtagacaggagattaataatgcagacgagcctggcgaagtggagtctgccgtgtgtaatggagatgaggagcagggggtgagaatcaaagaaaagcggcaccgtgtttacaggggcgtgagaatgagaagttggggcaaatgggtttcggagattcgagagcccaagaagaagtccagaatttggctggggacgttccccatacccgagatggcggctcgggcccatgacgtagcggctttgagcatcaaggggaaatccgcgttccttaattttccccaaatcgcctcgtcgttgcctcgccccgccacattgtcccccaaggacatccaggccgctgccgcggtcgctgcggctgagtttcacatgccttcagaagaagatcgtagtgaggatcgatcccttgaccccgtcgggatgaacaatgcgatccctagtcatacagactctgtgatccctgcacagtccaggaatatcgaagaagcagcagccgtttccgcgtcgaattcgatttgggtttcgagttttctttcggagaacgagtggatgaccatatacgacgatatagtgttggatctgcccaatattgtgggaaacatggc

SEQ ID NO: 12282 - DNA, 690 bp, Pinus taeda
  Predicted polypeptide sequence is orthologous to G27
cccgcgttcaattccatacttcaataaacacccaaatgctccactgacaccatgctgcagcgttctacctcctccattttctctacagaagtcatggataatggaatcgcttttgttcccgaggctatgctcacttcgtcagaatacgcagaagcaactaccaaatctgcagccacaggtaagggcgggatcaagaggattcgtaggcaacaggaggctgccctttcgccgccagaggaggcaatattgaatcagcaaagtccaccgtacagaggcgttcgtcgtcgcaattgggggaaatgggtgtctgaaattcgagaaccgaaaaagaaaacccgaatctggctcggctccttcgacaccccagagatggccgctcgagctcacgacgtcgctgcattccacttgaagggcaagaagcgctcgttgcttaattttccagagctgattgatcaccttccacgacccatttctttgtctccgcgcgacattcaggctgctgctgcagaagcagccgttgcattccattgcggaagtgcagaaaactctggaagattgaacgacgagtataaacgagcaaggggaagccccataaaggtttcagtatgcaacgagagtgcagtgacctgttcctcagatgggttgtcggcaataagtagttcagacatcgaaacagcaagtggcgaggta

SEQ ID NO: 12283 - DNA, 783 bp, Pinus taeda
  Predicted polypeptide sequence is orthologous to G27
agtttgccccttcgctgcaacagaagagcgcgttgcagccgcaatatccagagtacagaggcgtgcgccgtcgtagttgggggaaatgggtgtctgaaattcgggaacccaaaaagaaaacccgaatctggctcggctccttcggtacgccggaaatggctgctcgagcttacgacgtcgccgcattctgcttgaaaggcgggaagcatgcggtgcttaatttcccagagctcattgactaccttccgcgacccatttcttcgtctccgcgccacattcaggaggccgctgcagcagcagctgttgcgttttcttcatcggcaagtgcgaggaactctagattttcgatggagagccacaaacgagcaaggaaaaccccaggaaaatctccagtaactaatgagcatgcagccaccgcctcttcagatcaactgtttaccccaattagctcagacattgagtcagagtccggtagtgagttatcggagcaaacgaattctactaatttgtcgccattttttgcccccacaaaaggtctggatgggtgtgtaatagaagaggacttgttcgaatatgtaaacttattttcggatctggcagaagcccttctgctttctccccctcctctgttcaatattcatgaagaggagcacaatttggaggaagggtttctttggtctgatttttaaaatagcagaggctctataaaattagagactctggtaatattctaatccgcttagacatcatgtaaatttttaaaaagttacatccctacatctt

SEQ ID NO: 12284 - DNA, 981 bp, Pinus taeda
  Predicted polypeptide sequence is orthologous to G38
atgaagtcgggaacaagaaattccgcaagtacatcatcatcggttctggcgaggtgggcagatcgaaaccggtcgagtgcatcgctggcgcagggcagcaacaacaacagcaagttgaagcagaggaagatcccggccaagggatccaagaaagggtgcatgaagggcaagggcggccccgagaatgcgttgtgtagttacaggggtgtgcggcagcgcacgtggggcaaatgggttgccgaaattagagaacctaaccggggcgcccgtctctggctcgggacctttgccaccgccgaggaagccgcgcttgcctacgacggagcagcccggacgctttacggatcctatgctcggctcaacctacccgactcttcctcctctacctccgcctcctccgcctctgcgacagcgacgtttcaggtcaacataacttcttccatcaccagacgccgcactgctcatttctcgaaacccaataaaaattcgctcagcaacccgtacgatcaagaagattccccatcttcttgttccacggcagaggctgcaactcccaaaccctacaaggctaaatcaaacgactcggaagcaaaaaccctacccgatgcccaaaaaaccctagctgatgctaaaaaagccctaccagatgccaaaccctcgattgaagacgcagagacatttggggaaatgttcaagccctttgatttgctttacacagatccaagcccgacgacaggatcatctggactctgggagagcctctccgacgtggcctctcctatcactagggatccgatatcgggccacctggcagctgctgcatcctgcacggatttggaattgattgattattccttgatgcagccttcagctatggagctttcttctctcgaggatttgaacttccaaactcatgaaccagatcaactcgcacctgcaacagaaattacacaagatttgaatgctttcatggagtttcaa

SEQ ID NO: 12285 - DNA, 795 bp, Pinus taeda
  Predicted polypeptide sequence is orthologous to G43, G46, G1419
acgcgggggccccccggacgtctggggacgcctctgtatcgctttgtagtcgaattttctgcaatctcaccttgtgccctgattgcttctgtgttgcagatcacaggcgtgctggccgtgaatccagacactccaaatatcgtcgtctcatgctgtcgccgtctcccgctgtcccacccgtgcttgccgctgttgccacccgtttgtgaaccggtggatatagcattagtttgtagtttgagcgtttatttgcatgttggcattttagcttgagcatagtttgagcttgagcataggttggcaggtgtagatgtgcatgcaggcaggcgtagacgtgcatgcaggtggtgtaggtgccacccgtgcttgccgttgttgtgcttgccgttgttgccacccgtttgcccctgttgccacctattcctattactgcatggagcttcagtgttacatcctgcacaaatgccagagataataacttgccccccggacgtctgcggacgcctctgtatcgctttgtagtcgaattttctgcaatctcaccttgtgccctgattgcttctgtgttgcagatcacaggcgtgctggccgtggatccagacactccaaatatcgtcgtctcatgctgtcgccgtctcctgctgtcgatgagatgcagaccatccatgcttagcgacttcgtcgagaagttccaagagcatcatgtcatccaaatcgttttccttcagacagcactgaaatttcaggattccatcgataactttaaattcaaaatccagaggacataagatctgt

SEQ ID NO: 12286 - DNA, 909 bp, Pinus taeda
  Predicted polypeptide sequence is orthologous to G129, G136, G140, G146
tgaggatccgctgcaacggaaacagtcatatctttctctctctcagcttttgcgttacgagatgatccggccgcgggtactgatttccccttatatctctctgcaggtctagacatccaccagtaagcagcttatcttgggcttgacaggcattagcaggaacagggttgccttcacgtaaggactagaatgggccgcggaaagattgagataaagcggatcgagaatactacaaatcggcaagtgactttctccaagcgtcgaaatgggttgctaaagaaggcgtatgaactgtctgttctttgcgatgcggaggtggcagtcatcatcttctccaaccgtggaaagctgtacgagttcgccaataagagtgttaatagaactattgagagatacaagaaagtatgtgcaaaggatatgcgatgggaaacaagtacctcatcgaagaattgcgaaaatctaagacaggaaatcgacattctaacaaaagttaacaggaacttgatgggagataatctctcagctttaagtctgaaggaactcgacctacttgaagctcggattcaaaggggaattcagagcgttcgatctagaaaggaacaaatattactggttcaaaacgatttcctacgtaacaagattgcagagtgccaatgtgaaaatgctagtgtaacactgcatatctataacgaagcacctcctcaatttgacacccaagatctgcttcaatgaaatttggttgatgcaattcaagaacgtcaataagaagatttaaataggtctcaatttctcgttcgacgtcgagaggaatgtcagttgttttgaagtttcactcttctgccatgtaaaactgtcaccaaaagttgggcttctattctatttagatagtagctctgttatttaattttg

SEQ ID NO: 12287 - DNA, 867 bp, Pinus taeda
  Predicted polypeptide sequence is orthologous to G129, G136, G140, G146
gaactaagtgactgattacttagatcatatccagaaggaacatgttggttaggcaataatgttgtaaatccatgtgttaggagcgaggaaagtctcttgccatttgtacattcttccaacttttcttgaagcatcatgttgtttatccttaacgtatgttccttactctgaagggctcttatttcatcgagcatcagttcgtgcttttttgctcgtacttgatttattcctctttgtaggcgactctctaattgatttagctcctcgaatgagacagagccaagcccttctcccattaaatatctgttagtaagttttagctgatcaatttgttgtttaagtaaatttatttcttgcttcattttctcgtctgaagtattattcgaaaagttcatatgttttgcagtctgtgaacacttttgatatctttccaatattgacctcatacttctgttgttgttgttgttgctggtgcccagctcgtacaactttcctcggctggagaaaacaatgagcgctacatctgcatcgcacagcactgaaagctcgtaggcttttttcatcagaccgcctcggcgcttgcagaaggtcacctgcctgtgcacgctgttctcgatcttcttgatctctattttaccacgccccattttgagcaaaatcccaagagtttctcaaaatctgagtgaacttacagaatagccgaggttccttccactagtttggactagcttcagggtttacttgggtttttgcagaaatattactcaagctctcatcaatgtcttggtatttaagaactgttgcagcagcaacacacaaaaatacaagaatccttccactagtttagactagcttccggggcactgg

SEQ ID NO: 12288 - DNA, 822 bp, Pinus taeda
  Predicted polypeptide sequence is orthologous to G129, G136, G140, G146
aaaaaaccaccaaaatactattattgcaaattgtttttcatgatttattgtcttatggatatatagacataggatacctcgtcattctccttaaatatacaaacaagaaagttggtagaacccatgttttgaagtcataatgttccacaaggaaacacatctacaacgtactatatgttacatctcaacatttgaactaagtgactgattacttagatcatatccagaaggaacatgttggttaggcaataatgttgtaaatccatgtgttaggagcgaggaaagtctcttgccatttgtacattcttccaacctttcttgaagcatcatgttgtttatccttaacgtatgttccttactctgaagggctcttatttcatcgagcatcagttcgtgctttttggctcgtacttgatttattcctctttgtaggcgactctctaattgagttagctcctcgaatgagacagagccaagcccttctcccattaaatatctcatctgaagtattattcgaaaagttcatatgttttgcagtctgtgaacacttttgatatctttccaatattgacctcatacttctgttcctgtttctgttgctgatgccaagttcgtagagctttcctcggctggagaaaacaatgagagccacctctgcatcgcacaagactgaaagttcgtgggctttcttcattagaccgcctctgcgcttgcagaaggtcacctgcctgtgcacgctgttctcgatcttctttatttctattttaccgcgccccattttcagcaaagtttctcaaaatctgaatctaatgccttccaacc

SEQ ID NO: 12289 - DNA, 860 bp, Pinus taeda
  misc_feature (126)..(126): n is a, c, g, or t
  misc_feature (155)..(155): n is a, c, g, or t
  Predicted polypeptide sequence is orthologous to G131, G135, G155
ctgatcattttctcggaaactggcaagatctgcgagtttgcaagccacgacgacatggcaacaatactggaaaaatatcgaatatacacggaaacagatggaaacatggagtcttcgtcggtccanagcgtgaagattcgtgaatcacaactcanagcgttgcgtgagaagatgaacaaactgaagaaaaaggaacgaaacatggttggtgaagacttggattcattaacgatgaaggaactgcaacgacttgaaaatcaattgcaaattgggattaaaagaatttctgataaaaagatgaaaatattggtacaaagttccaagttattactacaaaaggtacgcgcattggaagaggagaaaattgaacttgaaacgaagttgcgaattagaggctattccttcagttcagccactaacctaaatcttggactttcgtatagtaccatgcccagcgggctctgcgacatgaacagcaatggagattccttctccgttgagataccttaatcgaatacaataactaaaatttctcagtacggatctatccactatttattgcagcttcttcaaccaaatcatgtattagaagtccccaaacggatatatatatgagacgatcatgtatattttaatccttctgatttacaggaggtcacttccccatttccatattgttaaactaaattacacagaaaaatgacattttaccatacgttaagcacggagcaccatgtggctgctcctatttgcatataaattaagcatggatgaaattttaattgtacatgtaacagtgaaattttatttgtatactgataaaagaatgcttactggttagatgaagtgatttgtaagaa

SEQ ID NO: 12290 - DNA, 821 bp, Pinus taeda
  Predicted polypeptide sequence is orthologous to G137, G145
tcggagctgtctatcttctgtgatgcggaagtggccatgatcgtcttctcaaacacaggcaaactctatgagttctccagttccagcatgacaaagatactagaaagacatcggaagtgttccactttggtagaagatatcagcaaagatccacaggactcaaacacagagttgacggaattgaagagaaaaaccgataacttacaaagatggagaaggcatgttatgggtgaagaccttgatcaactaagtgtcaaggagttgcaacaactagaacaacaacttgaagaaggattaaaacaagtcaaattgaaaaaggagcaacaactggagggagcaaagaagtcgcgccataagaaggtaggtggaaaattgaggccctcgatattgtcattgttcttccaaagatatgaatcatggaatactttgtttgcaaagacttcaaatgatgaaacgtggttcctacgccataccatggctatgtggaaacaacagcttcagttgtcggaactgagaggaaaatatccatgtgatcagtatcctataccaatatccggctcctcgtggcactctactgctggaaactataacactcacgtcctgtcaaggcattgcgaaccgactctacatattgggtgcccgtctggctctactggaaaccatattcctggccatatgcaatcgggaaattacgacggtcgctaatagtggctgcgatggagggtgacaactcgtcaatttaatctcctacgtttattctttgtaaagagcatatttagtcgaacaattgcaataagttgatagatgctgataagcatcgg

SEQ ID NO: 12291 - DNA, 764 bp, Pinus taeda
  Predicted polypeptide sequence is orthologous to G137, G145
gtttatttcaagaaatgcaaataaccgctagacatatatttcacataaacgaatggagtatattttttgctctttcggcatcttgtctgtttatataaacctagctatgttaattgttgaactaatatacaatttacaaattcactaagggaaggtaattaaattcattggttatcaccgtcgagattagccattgtcagtgaactggcagataattcacataacatatcgtgaattaaattttcaaaacatccagccctgcgcaccgtaagttcccgatgttcttcggccagaagtagtgattccagtaggggcagacgggcacccaatatgcagagtcggttcgcgatgcggtgactggacgtgggggttataattctcaagagtagagtgcgtcgagctacaggatatttgtataggatactgatcgcatgcatattgtccttccatttcggacaacttcttctgcagcgacttgtttgtttcctccagaagctgctcctttctttgtaggtcttcaatcatgtccgacattaattgattctttttcgatatcacctggtgtagtcctccatcaagctgttgttctaattgttgcaactccctgatagttagtctatcgaggtcttcacccaaaagatgcctgctacacctttgtaaggttttaaccttttccttcaactgcgtgaactccatgtttgaatcctgtgtaaatcgagcggtatcgcgtcctgaatttgaacatgtccggtatctttccaata

SEQ ID NO: 12292 - DNA, 843 bp, Pinus taeda
  Predicted polypeptide sequence is orthologous to G137, G145
ctgtagtaattcacacttgaaaagtatggcgaatcgactaccatgtgataaaccgtagtgtataataatattttgcagacacatacacattggatttaaacatatcatgtgttgtgaatgggacaactatttttccatcgctcttttagcggccagattagcatacaagatttatgcaattaaactttgtcgacaagaaggtctaatataccagtagggtttgtttgcccaataaaacctccgctatcatagcagtaaatcaagcctactgctatacaatgaaaatagggttttttttaatgataatataattctaatttcgtaatttaccacgctttgggcttttgttgtgattgaagtaactgataatgataaatgttaaatatcaaacccaccatccttgcatgtattggttcggcgtttggttgtgcggcggctgatgaggagggacgatgctttcaggagccacaggctgataacctttggcgaagttcctcaatctggtccagcattacctgcgttttccttgacctaagatgtgtcagagcaacctccagctgacgttcaagctgctgtagctccttaacatttaacggacccagatcttcccccaacaaatgcctttgtgatcgctgcaggagctcaaccttacccttcaactttgtaacttcttggtgccaattctgtgcttcccggtccgaaacgcctgtggtatcttgcattgcatatgaacatttttcgtatctttccaacgtcttgttcatgctggaactggcaaactcgtaaagctttcctctggtagagaaaattattagcgccacttcggcatcgcacagcactgat

SEQ ID NO: 12293 - DNA, 877 bp, Pinus taeda
  Predicted polypeptide sequence is orthologous to G138
tatggagtttccgatctggtttagggtgaagtgccagaaaaggatatgcgaacttctacttgacatggcaataggcgatttgatggacatttttataatgctcgcccaaaccgctatcaggggcacacatttagatgctcaaaattaaacaaaacctaactcggccctttgtgagcgggtttcagttttaagaaaactatgtcattcgtcagagaaatacgcggccagtagcacatacaccattgctccgtcgtggacagggaccactcccagaactttggggaagggagagagctaacggccttcaggaagagaaagaaaaagtaggtggaatagtaagggcctgtttaagatggggcgaggtcgagtccagctgaggaggatcgaaaacaaaatcagtcgtcaagtaactttttctaagagacggaacggactgatgaagaaggcggcggagctgtcaatactgtgcgacgctgaagtgggcttaatcgtcttctccaacaaagacaaactgtacgagttcgccagttccagtatgaccaagattttggaaagatatcggaagcgttcaaatttaatacaagatatcggtaaagatccacagaattcagacattgagttgacgcatctaaaagaagaggttgaccgcttacaaagatccagaaggcatcttttgggtgaagaccttcatcaactaggtgctacggatctgcaacatttagaacaacagcttgaagaagcgttacaaaaggtcacattaactaaggtatttaaactcaggtgtaatattttgaaatcatacttcatattttagtgaggatatgcgatagtattagtatacatcaaatatttagtgataatattaatatatttaaaa

SEQ ID NO: 12294 - DNA, 571 bp, Pinus taeda
  misc_feature (544)..(544): n is a, c, g, or t
  Predicted polypeptide sequence is orthologous to G154, G627, G1797, G1798
ggagagagagatgttgggggaggatctggaatcatgttcaatgaaggaattaaatcagctggagagccaagctgaccgaggattgaagcatatacgagctcgactgactaaaatgctagtggatgaaattgatcaacttaaatggaaggaacggatcttaaccgaagagaacctttttcttcgtaaaatgtgtggtgatgaacatgtggatggttcggcttttagaacacctcccgcacaacttagaagcatccagaacattgatgtggagactcaactggttataagacctccaactgtacaacagcaccctgacgtcgatagtcctcgataactgttgcatatgcaaattttctactttcatgaaataaacaaacagtacaactgcagcctcattttgttcgccttttgtaaacgtataattactattgcatatgttagctttcctctcatgtttttgtgatatggaaataaacacgttgtggatcaagcttgaaattgatatcaaacctttagcatgctaaatgaaaatttgcacattatnaataaataagaaatattttagatattt

SEQ ID NO: 12295 - DNA, 450 bp, Pinus taeda
  misc_feature (388)..(388): n is a, c, g, or t
  misc_feature (399)..(401): n is a, c, g, or t
  misc_feature (423)..(423): n is a, c, g, or t
  misc_feature (425)..(427): n is a, c, g, or t
  misc_feature (432)..(437): n is a, c, g, or t
  misc_feature (444)..(444): n is a, c, g, or t
  misc_feature (446)..(446): n is a, c, g, or t
  Predicted polypeptide sequence is orthologous to G154, G627, G1011, G1797, G1798
gatggcaaggggaaagacacagatgagaaagatcgagagcgcgaccagcaggcaggttacgttttctaagcgcagaaatggattgatgaagaaagcttacgagctgtcggtgctctgcgatgcccaactgggactgattgttttctcccccagagggaaggtctatgaattctccagtacctgcatgcagaaaatgttggcacgatacgaaaaatgttcagaaggaagtgacacgagtacatcaaaagagcaagatgtccagtgtttaaaacgagaaagtgcgaatatggaagaaaggattgaaattcttgaatccatgcaaagaaagatgttgggcgaggagctggcatcatgtgcattgaaggatttgaatcagttggagagccangttgaacgagnnntgagaaatgtacgagcgcgaangnnncggannnnnngcgaagngnatgc

SEQ ID NO: 12296 - DNA, 779 bp, Pinus taeda
  Predicted polypeptide sequence is orthologous to G154, G627, G1011, G1797, G1798
caattcgatcttgattttccagagacgatgtgattgaccattctgtgggcaaaagagagagaggagaatggtgaggggaaagacccagatgaaaaggatcgagaacgatacgagcaggcaggttacgttttctaagcgcaggaatgggttactgaagaaagcttatgagctctctgtgctctgcgatgccgaagtgggacttataattttctcaccaagagggaaactatatgaattcgccagtcccagcatggaggagattttggaaaagtataaaaaacgttcgaaggaaaatggcatggctcagacaacgaaagagcaagatactcagtattccaaacattccaaagaaaagcttgcaaatatggaagaacagattaggattcttgaatcaacccaaagaaagatgttgggggaagggttggaatcgtgttcaatgacagaattaaataagttagagagccaagctgaacgaggattgagccatatacgggctcgaaagacggaaatattggttgaccaaatagaatgtcttaaaaggaaggaacgtctcttaagcgaggagaatgccttactcagtagaaagtgggttgatcgtcaatccgtggacggttccggttcaacatcatcttcaattggattgggaagcatcgagcagatcgaagttgagacacaattggttataagacctccaaatgcacaggatcactgttctgtaaatagtggccattgaaattattatttaaactgatccatgttatcaaaattttctatgtgat

SEQ ID NO: 12297 - DNA, 753 bp, Pinus taeda
  Predicted polypeptide sequence is orthologous to G154, G627, G1011, G1797, G1798
gaggcaatacgagtctcgacggtatagagacagttttgtgttgagagacttgaagaatactcgtgtaattactaattactaattttattggcctatctatcctcggattccaaacagagttcaaaaagctggttcggctatcgttagcagtcatgaggtcgcaattttagcgcctctttaatatctgctgggtgcttgttctcattgcctggaaccagatctacaggagactgtaattcactgttttgcactgtagaatggagaggacaagaatggtgaggggtaaaactcagatgaggagaatcgagaacgccaccagcaggcaggttacattttctaagcgtaggaacggactgctgaagaaagcttacgaactgtcggtgctctgcgatgccgaagtagcgctgattgttttctctcccagagggaaggtccatgagttcgccagtcccagcatgcaaagggtgttggataagtaccaaaagtattcacaagaaagcggaataagtgataggacgaaagagaaaaatactcagcatttaaaaggagaaattgcgcaaatggaagaaagggttaatattcttgaatcagcacaaaggaagatgttgggggaggatctagcatcgtgctcaatgaaggaattaaatcagttagaaagccaagctgaacgaggattaaaccgtatacgggcaagaaagacagaaatactaatggatcaaagagaacaacttaagagcaaggaacggatgctca

SEQ ID NO: 12298 - DNA, 852 bp, Pinus taeda
  Predicted polypeptide sequence is orthologous to G154, G627, G1011, G1797, G1798
cgagctggttgggctatttcaggaagccattattgggtttagatttttgcagccggcattttctgctggtgtttgttgcggttctccgttccgcgggtctgattgattaattaaagagcaagagtgacgaaaggagtctggagaatggcgagaggaaagacccagatgaagaagattgagaacgtgaccagcagacaggtcacgttttctaagcgaagaaatgggttgctgaagaaggctttcgagctctcggtgctgtgcgatgcagaagtgggacttattgtattctccccaagagggaagctctatgaattttcgcgtccctgtatgggaaaattgttgcagaagtatgaaaagaattcacgagaaagtggtataaataatgcggctaaagagaaagatactcagcattcaaaacgcgaaattgcaaatatggaagagaaaattaggatcctcgaatcaacagaaagaaagatgttggggcaaaatctagcatcatgttcagatgaggaattaagtcagctacaaagccaagttgaacgtggattgaaccgtatacaaagacgaaagaatgaactattaatggatcgaattgaacaacttaaaaggaagtgtgctgatctcgaaggaggttcggttttgacatcatctgtgctccagcctggaagcacccagtgcattgattttgagactcaattagttatgggacttccaaatgtataagatcaccttcctaaactcatcttgttttcattatacaaataagctactgcatccttcctgttattttgtaaaccaattctcaacagtgtgaatcaagattagaatgtgagtgtaatcctttttgtattt

SEQ ID NO: 12299 - DNA, 653 bp, Pinus taeda
  Predicted polypeptide sequence is orthologous to G154, G627, G1011, G1797
actcaatcaactttcaccctctatttattcccataaacaccacaagtatcagcaatttactccaattgaatcaaagccagttgtatactccacatcacaatcaaaagtatcagggtctcgctcaccaagaaggtcaaaatctggatcacaatcttgaaagatagaaaatgggtcttgatttggagttgttggcctttaggtataataaggttgcgcttctgcatcttgatctactccagctgcaatgtgaaagtatgcttatatatggatctactcctgctgcaatgtgaaagtcttcttttatatggattggtatatggatctctaacttggttatgaccgactctccatgactttgttttcaaccacaccatgttttattaattgcttatgtatgcctccattgttgcccagttgttgtccaaatgtttatgtcgatttgtttcttgcaaactggtaaatattggcagtttcaaataaaatgatgagggaaacttcagaatcaaagagaaccaaaagcttgatcaatttcttgagcagtcctctcttgcgtttggagaaggaatcacctcgactattagggttttggatgtgtttcagctccaacttctttcccattttgaatagtctgtagaacctagaaacatatacta

SEQ ID NO: 12300 - DNA, 871 bp, Pinus taeda
  misc_feature (108)..(108): n is a, c, g, or t
  Predicted polypeptide sequence is orthologous to G154, G627, G1011, G1797, G1798
gagaatgggaagggggaggactcggttgagaaagatagagagcgcgaccagcaggcaggttacgttttctaagcgcagaaatgggttgctgaagaaagcttacgagcngtcggtgctctgcgatgtggaactgggacttattgttttgtcccccagagggaaggtccatgaattctctagtacctgcatgcagaaaatgttggaacgatacgagaagtgttcggaaggaagtaaaacaacaagtatagcaaaagaggaagatcccaaggctttaaaacgagaaattgcgaatatggaagaaaggattgagattcttgaacgcacgcaaagaaagatgttgggcgaggaactggcatcatgtgcattgaaggatttaaatcagttggagagccaggttgaacgaggcttgagaaatatacgagcgcgaaagagcgaaatattggtgactcaaatagagcaacttcaaagaaaggaacggatgtttagcgaagagaataattttctccgaaagcggattgtcgatccccattccgttttgacaactcctgcaagtggatctggaagcctccaaagaagtgaagtcgagactcaactggttatgagaccgcccagttaaaatgctgattttcttgttaatagttctcattgataatcactgtattcatatctgtgttattaatttattatgaaatgtttatgttaataaaaagtaaaggtgcttgccaaatagcatctcactgctcaacccttaaaaaaggtctcccatgcaggtaactcattgttttttaaacaaagcgcgtgttcaaaaaatagtcagtatgcaggcttactatcaatacatatttaaaagttttatttttatatatttttt

SEQ ID NO: 12301 - DNA, 859 bp, Pinus taeda
  Predicted polypeptide sequence is orthologous to G154, G627, G1011, G1797, G1798
tagcagacaggttactttttctaagcgcaggaacggtttgctcaagaaagcttacgagctgtcggtgctctgcgatgccgaagtgggactcattgttttctccccgagagggaagctctatgaattcggtagttccagcatgcagaaaatagtagaaagatatcaaaaatattcggatgaaaatagtatgaataaaacagttagagaagaaaatactcagtctttaaagcgggagattgcaaatatggaagaaaccatcaggcttcttgaatcaacacaaagaaagatgttgggggagggtctggcatcatgttcagtgaaggaattaaataatttggaaagccaagctgaacggggattaagccatattcggtcacgaaggacggaaattttaaagaatcaaatcgatcaacttaaaaaaaaggaacgcgtgttaagtgaggagaatgcttttctccgtaaaaaatgtgctgaggctagatatacggatggttcggtttcggcaagccccacaaatggagttggaggcgtagaacagattgaagtcgagacacaattggttataaggcctccaaatgtacaataccgctttcctgttaaaaatcttcattgtaattccttgctagtctgatggatgttattttcaaattcaaacatgatcttgatttattatgagtattcttatcttgttaagtttcaaaagagtaaaggatgaaaactcattttaagttcaacctcattgtttaacaaaactaaaaaatacatatatattagccttactctgaaaagactaaattagggcttccagaggatgactgctgtaattagtaatttttttatataaatctgctttccatgc

SEQ ID NO: 12302 - DNA, 742 bp, Pinus taeda
  misc_feature (515)..(515): n is a, c, g, or t
  Predicted polypeptide sequence is orthologous to G175, G877
aaggtggtgaaaggaaatccaaatccaaggagttactataaatgcacaaatgctggatgtccagtgaggaaacatgtggaaagagcatcacatgatccaaaagcggtgatcacaacatatgaaggaaagcataaccatgatgtgcctgctgcccgaaacagcagccatgataatgctgcaaaagggaatggggcagctcctctagcaatgcagaataatgtcccagcgcctatgaatgctataccacgacctgttccccaagttcaggacattgtatctcggcctgttcctcaagttcaaggcattgtttcccggtttgatagacacttggatcctaggaatgaatatgtaaaacgtgcatattatgaaaaggttgtagatgagaacctacatttgcaagataagaatggtgggagtcttgacttgaaaatgggggcagggatgggttttgggatgtttggtttagctaataatcatactgataaaaggcaaattgcagaagggcatccaccatnttccaatgcagatacatagcactacaagccatgggttacctggcatccaatttagtggaaagcctaccgttcccgttcagtcatattttggtcaagctaaagataatggcatgagattcctgaggccaaaagaagaacaaaatgacgattctggttttgggaacacattaactttcaatcccacgccaaacccatcattgtatcaacaaatcatggggaaactatca

SEQ ID NO: 12303 - DNA, 366 bp, Pinus taeda
  Predicted polypeptide sequence is orthologous to G175, G877
acacaccccaattgtcaagtgaagaagaaggttgaacgttctcctcatggacaagtaacagagattgtctacaaaggtggccataatcatcctaaaccccaacctagccgtcggtctgcagttggatctgctcatatgattcaggaaggggcagaaagtactgaagctactaccaaagttgaaggtgggaatacatggagaaacacagaacttggtctcttgaaagataaagatgctgcaaattgctctaagacatggaagaatgaacctttggagaggtcctcatcagcttctgttgtaactgacctttcagatccatcatcaacagcccaagttcaaagctccagccgcctagattcactaggt

SEQ ID NO: 12304 - DNA, 780 bp, Pinus taeda
  Predicted polypeptide sequence is orthologous to G179
ttttgaatgcaagcatatttagataaatattttatgaaagaactaccatcaaataaactaaacaaactaaacaactggttgtgtacctgttcatgaacatatatacttccactgtcaatatccacaagttgtattcaaagatatagcataaatcgaaagagtgcagcacccattagaaaattaatagactgtcttatagactgtcggcattatgttgcagtcccatcattcgtttattgatgctgttcaaagttcccgggaagataattacggactgaagataaatgctgcaataatggggagacggtaggttggcgttgctggtgaagtatgtcaggctgtgcaatataatagatcacacacgggctctcatgattatgtctgcccaggtaactagttatgactactcctttatcacgggagtcgcgttccactgttttcttcacatcacagttgctatccgagcatctataatagttcctcggattggtgctgttcttcacgaatttcttcccgtacttgcgccacttatagccgtcttctaggatgtcaatttcggatctggtcagaaaggcgtatttgagaggtcgttctgcctttctcttcctgctgctcttcttagggcttattgcctcctcaagctcatggctttggatcacattagaactgtgatccagatgaaagccccggatgcacggtggattactgtaaagagagtccgcatattcttgctgcatacctggtccagtgttgacatcttttatgttgttaacctcatca

SEQ ID NO: 12305 - DNA, 766 bp, Pinus taeda
  Predicted polypeptide sequence is orthologous to G184, G186, G916
agtgatggttgcctttggaggaaatatggacaaaagatggcctagggcaatccatgccccagagcttactacagatgcaccatgtcaccatgctgtccagtgcgcaagcaggtgcaacgcctggctgaagacagatcgattctgataacaacatatgagggcagccataaccacatgcttcctccagcagccacagccatggcatccactacagcagcagctgcctcaatgcttctgtccggttcttccacatcagctgataacatcgcactaaatgcaagcttcatggcaggtgccctcatgcagcatccttgcaacacatcaactgccagcatctcggcctcagctccattccccaccatcacactggatctcacacacaatcccaaccaaatggccaacgctccaggtcacatggcagcctcaaacccaagagcactagcaggactcccagctcatgccatgccctttgtaggcatgccacaccaattccccaccaacacaccccagggggcattattccatgggcaatcaatttacaatgctccttccatgtttgcacccttagcaggccagctgcaacgcccccaacaacccatgatgcccacaccaccaaagctcaatattcaagctggccaaccaccaacaccacaacaacaacaaccatcattcatagacacagtcagtgcagctacagctgccataacctctgatcccaatttcacagcagcccttgcagcagccatcacatcccttatcaacaaca

SEQ ID NO: 12306 - DNA, 935 bp, Pinus taeda
  Predicted polypeptide sequence is orthologous to G184, G186, G916
gcgatggcaaacttgtggcggacataaatcacttgaaggagaaaaaccagagcctcaactctaagttgaaacgcatgatcagtaaatataatgacctgcggaagcatatcgggcttctcatgcaacagagagggatcgatggaagccaggtctgcaatccagatcatcgaatcaaagaccaagtgtgcgcaaagtacttcaccggatctgatcattgttgggaacaaggtgaagaaaaagagaagaagaaggccaaatttatggaagatcagcagctgcattcaaagaagacgaagattgagaatggggtcacttcgtacctggatgataacccttgctgtgatgacaagttaccgaagaaccagaatcaggtgctgaacaggagctccggcgaagaggcagcggccgcaccaaaaagaatcgtatctgtgcagacaacatctgtgacatctctggtaagcgatggctgccattggcgaaaatatgggcaaaagatgacaagaaacagtacactcccgagatcttattataaatgtgctatggtgcccggttgcccagttaaaaaacaggttcagaggtgcgccgaagaccccacgattgtaataacaacctacaaaggcgaacacactcattctctgagtcctctggctattgctgtcatacatgcctcgaccaaccaacccacgacttgcacctcgtctcccactatcactctcgacctcgcagataaccaactgaatccagcattctacttgcaccctgcacatttaacagctggcagcttccagcaattgactccattgtctagcgatatgggtcaggtactggataatcagagtcaagtgggtcaatcagcaatcatggaatctgtggcttctatgaaggcagatcccaatttcactaaagcgctggctgtagccatagctggttctatt

SEQ ID NO: 12307 - DNA, 888 bp, Pinus taeda
  Predicted polypeptide sequence is orthologous to G184, G186, G916
cccgagggcgtataccgatgcacgatggctgttggctgccccgttcgcaaacaggttcagaggtgcgcggaggacaggtcagttctggtaacaacatacgagggaagtcataatcacccgctaccgcctgcagctacagccatggcatcaaccacgtcagcagctgcctgcatgcttctttcaggctctacaacaagcaacgacggaggcttcaattcgagtttcatgcaggccgccgcagggagcctaatgtcgtgctcacccgcctccatggccaccatctccgcctccgctccatttcctactgtcacgctcgacctaacgcaaaaccctaaccctaatatgtatcatcgacagccctccggcttccccatgcccctcggaggtttccaacaactaccctcacacccacctcaaatcttctcccactccctcttcaatacttccaaattcgctcccctcagcggtcagcagttcgatccgcagcaacagcaggtaccccacttttcaggtcacccgatgcagcagcagactcatatgccggtgcccatttctcaatacaaagcaccacaatcgtctctaatggacactgttagtgcaattacaacagatcccaacttcactgccgcccttgcagctgccatcacgtcaataattagcggccagtccaacaacgccaacactattccatcgcaggctcctccctgtgccagggctgataatcctgcatcggctaaattgctccagtgattcttagaccataatttatcttctgccatggaggaccaatctttttgcagagggattcaaattctttgcagatgtaacagttgtgtctgtctgcggagacggtcattcggttgagtaacatgatttgttgagaggtca

SEQ ID NO: 12308 - DNA, 883 bp, Pinus taeda
  Predicted polypeptide sequence is orthologous to G184, G186, G916
gggtcacgccagtacgtttatctcttttcttgcaacgagtttcacggagttcccaatacggaggtaggagactttgaagcttcgacaacgcacatgacatggaagcccacaaaaagaagatgactcttcttgtgaccgagatcaatcgcatggcagaggagaatcgcaagctcaactctttgttgaggcgcatgataactaactatgacgatttgcagaagcaaaccaagcgcgttgatggaagccagatattcagtccagaaaatcgatctgaagacaatttcaatttcagaatattgtctcgaagatctgataataccgactccggcagtgcagtttcccatcaccgttccgattctcatgaacaagttggggataaggatgggaagaacaccagatttatggacgatcagcagcggccttcccataagaggaagataaatcatttgcagttggatcagtttcagaacgggatgattaatccgtccatggaggagtcaccaacgaagaagcatcaggggctcagcaacgactccttcgagcacacggcgcccgtaaccaaaaaaatcgtatccgtgcggacaaaatctgaggcatccgtgataagcgatggctgccgctggcgaaaatacgggcaaaagtcgacaagaaataatccatgtccgaaatcttattacagatgtgctacggcgcccagctgcccagttaaaaaacaggttcagagatgcgcccaagaccccacaattataataacaacctacgaagacgaacacactcattctctgagtcctctggctattgctgctatgcgccctggtttgtccaaccacctcgttggtagggagatgaatacagaaaatttcgtaacaggaaaccagtttat

SEQ ID NO: 12309 - DNA, 817 bp, Pinus taeda
  Predicted polypeptide sequence is orthologous to G184, G186, G916
cggccggggatttatgatctaaatggcagtcctggttcttacagaatggtttgtaattcatgcagatgactcttcttgtgactgagatcaatcgcatggcagaggagaatcgcaagctcaactctttgttgaggcgcatgataactaactatgacgatttgctgaagcaaaccaagcgcattgatggaagccaggtatttatggttttgggaagcttataacaaagccttgggattcaattaggcttcaagaatctcaaatgttctaatgcattttcttcttgatctcgtagatattcagtccagaaaatagatctgaagacaatttcaatttcagaatattgtctcgaagatctgataatagcgactccaccactgcagtttcccatcacccttccgattctcatgaacaagttggggataaggatgggaagaacaccagatttatggacgatcagcagcggccttcccataagaggaagataaatcatttgcagttggatcagtttcagaacgggttgattaatccgtccatggaggagtcaccaacgaagaagcatcaggggctcagcaacgactccttcgagcacacggcgcccgtgaccaaaaaaatcgtatccgtgcggacaaaatctgaggcatccgtgataagcgatggctgccgctggcgaaaatacgggcaaaagtcgacaagaaataatccatgtccgaaatcttattacagatgtgctacggcgcccagctgcccagttaaaaaacaggttcagagatgcgcccaagaccccacaattataataacaacctacgaagacgaacac

SEQ ID NO: 12310 - DNA, 542 bp, Pinus taeda
  misc_feature (442)..(444): n is a, c, g, or t
  misc_feature (504)..(513): n is a, c, g, or t
  misc_feature (522)..(524): n is a, c, g, or t
  misc_feature (539)..(541): n is a, c, g, or t
  Predicted polypeptide sequence is orthologous to G187
aagatatagaaggcggaggcgttccatgttcatgttcagttagttataaggactatttttcggcttacaggctcgctctctgcgttcatgtgcttttcttccctgcccttatcttcatcacatccaggcgtttactctgctgaaatcctcttttttgtagtatttttgtaacctgttaggtaaatttgattcatgagtcatggttattacgataataacgctggttttaaatacttggtattagtggtctttgctattaagcccatgtaaaaagctcggagattctttaatgtaatgtgctaaatttgagtagaaggatcaaatccactttggagatagacatctgtaatctacatgtaaatagacatacagctataagacttagttaggcatgcatatttttgctagtaaagttttatgtagatctaggtgctaggggagnnnagcatgtggcgttccaaattggatccaaaaagtttcaccattcaagtttaaagggaggannnnnnnnnnaacttgacnnngtgaaagaatcaagnnna

SEQ ID NO: 12311 - DNA, 827 bp, Pinus taeda
  Predicted polypeptide sequence is orthologous to G188
cggccgggggcaaaaatgcaaggcatgggagaaagcatactcatggccgttttgatataataacatacagcatattttaagctgcttgggatgaaaagttctaactctttcgtataaacgcctccttttccactgcttttacaaaatttgaagttttagtttttaccctacaatgaaatactctaaaccctaaaaatactctgctaaaacccaccaaaagatgaaaaactgaaaaccctagtaaaatacactgccaaaaccccaccaaggttaggaatgcgtaacataggataggacagatctgtttccgcacagcgccaaagccagcaaaaatgtggaggtcgaagggtggattgatcttccgcaaggttttctcagcaatcaacgcttcttcatcgatccactgcagaggagcgcacagggttcgaatcgcagccactaggcaccaaaaccaggtagtttctgcaatccccatacgtttatattcttctgcctcatcacacgtcgaagatttcgaaggccccactgtgaatgaaacggtttcatatcctgaaaacgaagacctatcatacagtgagaacgaagacgtaagcaattttgacgaagccatcgttgaaaccccagatgtacaggaggattctgaaaatgccgattccgaaaagaaatccgatgaagatgcagaaaaagttgtttctctccttaaaaagaacatggacgccgaagagctcgtagcagaactggaaactctggatttgaatttaaataagaagtttgtaggcaggtcattaaaaccccagctgttaaacgaagcaaataattagttttct

SEQ ID NO: 12312 - DNA, 807 bp, Pinus taeda
  Predicted polypeptide sequence is orthologous to G196
cggccgggaacgttggtggtgtctgccctcgccagagtttatcgccagtacatgtaaaatctccccccagatctccgacaagtagagacgatccatccgccaaaacgcctgacaaagtcgaagccgactgcagttcttcttcacccatcagaacggaatctacagccgaaaggatagtttctaacagggcgactgcatcgggaacgagaggaggaaggagaaatcaacaaaggaggacagtatccattgctgcaaccgaaggatcatggaataaaccaggaggtggtggagttgcatctgatctctgggcatggcgtaaatatgggcagaaaccaattaaaggctcgccttatccaaggggttactacaggtgcagcagctgtaaaggatgcccagcaaggaagcaggttgagcgtagccacacagatcccactaagctcgtcatcacttacacggctgaacacaaccatgcttggcccacttctaaccccagaaacggacttgcactcacaggatcattgagttccacacaaaaagatatgatggcattggttggcccccatagccctcaaaagtcagatgtactgcctgctgctcaaggttcgaatcccgcggcctctcccactacggctaaaattgaacaagaaaagcccagatctccgccggccacggattgtttagatttcaatttaactgaggagaccacggattgtttggtggaggaccataaccaaacggccgggcttcatatgattagctctaatcacgtgaactacgacgatctatttgcaggtttagggcgaactg

SEQ ID NO: 12313 - DNA, 821 bp, Pinus taeda
  Predicted polypeptide sequence is orthologous to G197, G255, G664
gttcatggagagggttgctggcgctctctccccaaggccgcaggtctgcttcggtgtggcaaaagttgcagactgagatggataaattatcttcgccctgatctcaaacgagggtttttctccgaagacgaagatgatcttattctcaaactgcacgccctccttggaaataacaggtggtctttgatagctggccgtttgccaggacgaacagataacgagataaagaactactggaactcgcatctgaagcgaaaacttatcagcatgggaatagaccccctaacccatcgtccttttcaaaagacttctcaccatcatccctctcctccacagaatgttagagaggctgaaacaacaccttccattgggattgttcaagatttctttcgttgcccgtctgaacttagcaccaaatccgagcaaatttcagatgctgcaagcggactcgcgcaggatgagcaaccccacccgaacctgaacctgaacctgaacctggagctctcaatagctcgctcctcagtccatggagtagcagagaaggaggacgttgttaattcccagcaaggcgaaagcgatctgagtgagggaaagtgatatttatgtcattatggagactgccctccccctccaatgcaacactgagatgatataaatgtccctttcccgctcaccaaagccctacggggcaataacgaatacatgaaaaccgtttggctcatagcaagtctagttttcaacacttactattatttaaggaacgtaaaaagtctccagttcaattgatgtattttgtgacattttgctttgttagtcactta

SEQ ID NO: 12314 - DNA, 754 bp, Pinus taeda
  Predicted polypeptide sequence is orthologous to G197, G255, G664
atcaagagaaaatgtcgagtaaagggttcgatccgcatctgaagcggggtaactttcagaagaagaagatgagctaatcatcagactccattcgctcctgggaaacaagtggtctcttattgcggggagattgccggggcggtcaggcaacgagataaagaaccactggagcatacacatgaagagaaaattgtcgcgtagaggactccatgcgcagactcatcgctccttacgcccgcctcacaacagtaccactgccctcaactctccacccggtcccgatcaccagattctggcgttcgagagcaggagaagggcagagatagcagacttcttccaacttgaaggtttgaaatgctcgccgatcgagtcagcagcttctacagatgaagagcatccctgtcccgacattaatcttgatttgtgtatgggcttgccctctaattctgcccccgcctgacttagtggcacttgcagtgaatctatgaagcctatttaattgaattggattatcagtagatgtagagtgagtccagaatcgaagattcactgggatgtacaaatttcatcgatggttgacgtgaaacccaagtgctagtaacagtcgagtcttcaagaggtgaaagcctcctcgccgataaaaaaaatgaatgatattcgctctctactgttcctatcaaattggaggttgagattgggttcattagaggttgagattaggttcattagataatcatattgttagtttgagtgc

SEQ ID NO: 12315 - DNA, 744 bp, Pinus taeda
  Predicted polypeptide sequence is orthologous to G197, G255, G664
agatggggagaacgccctgctgttagaaggctcatactaacaaaggggcctggactcaagaagaagacgctcgccttgtcgcacacattcaagcacacggcgaaggcggctggcgctcccttcccaaggccgcagggttgctgcggtgcgggaaaagttgcaggctccgatggataaactacctgcgtcccgatttgaagcgtggaaacttctctgaacaagaagacgagctcatcatcaaattccactcccgcctcgggaacaaatggtctcttattgcacggattttgcccgggcggacggacaacgagataaagaaccactggaacacgcacatcaagaaaaaattggtgagaatgggactcgatcccaagtctcatctcccacttggcgaaccccgtgacagcaacactacctacaccgttctggcctctcccaagcacaaaatcccgccgttccagagcccgagaaccccggacatagcagatttttttcaatacgaccgctctggaagctcgacaatggagctcgtcgcttctaaagccgaagagcatccggaactgaatcttgatttgtctataagcttgccgtctcattcgacccccgccacaaccagagcttcgacagtccatagaaccgtagactcaaactctaattctggaagtggactttggtgtctcacagggatggaagcgatatcgtgaacaaaatgcgggtgtttctctcattacagggttatctcac

SEQ ID NO: 12316 - DNA, 916 bp, Pinus taeda
  Predicted polypeptide sequence is orthologous to G197, G255, G664
tccttcgttggcaataagtggtctttaattgcagtgagattgcccggacggacggacaacgagataaagaactactggaacacacacatcaaaagaaaattgctgagcaagggactcgacccccaaacccatcgtccactcggccagccaaacaatacccccgtcactcggcctgttcccgagcacgaaattccggcattccagaaccctgcaacgccggagatagcagacttgttacagcaccaccgaatggaaagctcgcctatcaaaccggcagcttcggatgcggaagagcatcccgacctcaatctgaatttgtgtatcagtttgccgtctaattcggccccggccgtaaacagagtatcgagcgtcgatacaacagtagattcaaattctaattctggcgtcgggctgtgctggcagtttctctgacggaggtcgtttcaataacagggtgtggattatcgcagcacgaccacgctaatgaacagtgccaaaggcacaaggactcgtggtggaaagatgtttatagtgcaaagatctccgacttgcttatagtggaattgaaataatgtgttggagggcgcagagacggtgggaaaaaggttttgtgtgttgcaggtctggagatatggtggggaagtgtatggataataggtatttctataatctgcaattctggtgcaattattcacaacagttagcatttatcaaggaaaaatatagttcgttttgtgttctcagtcgtaggagatataccagtaccagtacattatctgcttgcagggtaagttgaagttcattacattgcaatgccggtgccttatcgccctcatggccgtatttttaaagacaaatcccacgctgcttcagcctgcaacaagctatctttactctcattacactgatacatgcc

SEQ ID NO: 12317 - DNA, 888 bp, Pinus taeda
  Predicted polypeptide sequence is orthologous to G197, G255, G664
cgtacataaaaatccttgtgagagaaactgctatgatttttttcacaatattcggttctaataacctttgtcaaaatttatttgttggtgaagaaattatgtctagaatattttacagtcgtatcttgtaacccagatcaaatttcctaataatcaaacctcccaacctaaatataaacacaaaacagtccgcaacccaaagtaaaattcgaatccgtggttccatccacgctcaaagtctgttttcggcgcggggcgacattgatggcaagctcatacacaaatcaagattgaggtcaccatgctcttcattttcagaagcggcgggctcgatcggcgagctttccgactggtcttgttggaagaagtctgttatctctgccgttctcgggctctgcgaagccgagatttcgtggtcgtcagcgaacggagagctgagggtagtgctgccattgtcaggcagccatagggagcgatgggactgggggtcgagttccctgctcaattttcttttcttaatgtgggtatcccaatagttctttatctcgttttccgtccgccccggcaatcgacccgcgataagagaccacttatcgcccaagaggttgtggagtttgattatgagatcgtcttcttcttcagagaagtttccacgcttcagattaggacgcaggtaatttatccatcgcagcctgcaactctttccacatcgcagcagacctgcggccctgggaagggaatgccagccgccttcgccgtgggctcgaatgtaggcgatgagtcgggcatcttcttgttgggtccacgccccttggtttgtattacccttctcacagctcaatctcctcatcttcacagagagacgagtaaagtgcagggactagggat

SEQ ID NO: 12318 - DNA, 617 bp, Pinus taeda
  Predicted polypeptide sequence is orthologous to G197, G255, G664
aaagttgcaggctgttatggataaattatcttcgccctgatctcaaacgaggaggtttttctgaagacgaagacgatcttattgtcaaaatgcacgcactccttggaaataagtggtctttgatagctgggcgtttgccaggacgaacagataacgagataaaaaactactggaactcgcatctgaagagaaaaattatcaacatggggatcgatccactggcccgccgttcttttcaaaagtatcctcgccatcatccttcggctccagggaacgttgaagaacctgagacagcacgttcgaacgagaatgtccaagatttctttcattgctcatccgatttaagcgtcaaatccaagcaactttcagatgcggcaagcgtactcgcgcgcgatgataatcccgacctcaacctcaacctcaatctgcagctgtcgataacgtcaatccacgcggctgggaacaaggacgttgtaaattccgagcaatgcgaaaccaatgtcagtgaaggaaagggttatgtatctcgttatggagaccacgctccctctccctctcctgtgataatgtttcagatgagataaatgccgctttttcattcaaaaaaaaaaaaaaaa

SEQ ID NO: 12319 - DNA, 863 bp, Pinus taeda
  Predicted polypeptide sequence is orthologous to G197, G255, G664
atactagtaaccattaaaactaagtatataacgtgtgaaacctattaataaggaatttaccaatctataaaaccctgtatcggggaaaccgccacggtgcagaatatccgctctcgcagtacccgccatagtatacttgcagccctagtggataacacactgcgctgacagagacaaatttgaaaccacggttcgatggacgctcgaagctctgtttggggctgggggtaaattagacggcaaactgatacacaaattaagatcgaggtccggatgctcctctgtcgcagcttgctcgaaagttgagccttccgatcggtggtgttggaagaaatccgttatctccggcgctatacagttttgaaacgccggaatttcgtggcaaggagcaggccgagaggcgcaggtagtgttgctgttgtggggagggccagggcagagagggcgatgggacccggggtcgaatcccctgctcaccaattttctcttgatgtgggaattccagtagttcttgatctcgttgtccgtccgtccgggcaattttgctgcaatcagagaccacttgtttccgataagggaatgaagttggatgatgagctcatcttcttctgatgagaagtttccacgcttgatatccggacgcaagtaatttatccatcggagcctgcagctctttccacatcgcagcagccctgcggccgtgggaagcgaacgccaacagccttctccgtgggctcgaatgtgagcgatgaggcggtcgtcttcttctttggtccacgcccctttgtttgtatgagctttttcgcagcagggagatctccccatttgacacagagacagattaggaagctttcgctgccagg

SEQ ID NO: 12320 - DNA, 859 bp, Pinus taeda
  Predicted polypeptide sequence is orthologous to G197, G255, G664
gcctcgttgcctacattcaagcccacggcgagggcggctggcgttacctccccaaggccgcaggactgctgcgatgcggaaagagttgcaggctccgatggataaactacctgcgtccagatctgaagcgcggaaacttctctgaggaagaagacgagcttatcatcaaactccattcgcttctgggcaacaaatggtctcttattgcagcgagaatggccgggcggacggacaatgagataaagaattactggaacacccacatcaaaaggaaattgctgagcagaggactcgatccccaaacccatcgctccctgtgtccgccccacaacagcaacagtaccctaagctctccgtccgttcctgagcaggaaatttcgccgctgcagaacccgaggacggcggacatagcagacttcttccaacaggaccggtcggaacggtcaccggtcgaaaacaccgcttgtaaagaggaagagcatcccgacctgaatcttgatttgtgtatcagcttaccgtctaattcgaccctcgctgcaaacagagccatggatccaaattcaaattctggtctcggagtatggtgccacacaggtccgcaaataaactctgacccgcgctgtgagaacagatattgtgaaaggaattcatttacagagttggattctagcagcgggtcaattcatggcatattggatttgcaattaagtgctcttggtgtccagtaacgacgattatgaggggagagatgatcttgtttgctgttttggtataattttagtgttggtgctctgtatatatgtggctgaagacaacggccttgtgaagaattcgttgatgaggttggctataggtaaag

SEQ ID NO: 12321 - DNA, 830 bp, Pinus taeda
  Predicted polypeptide sequence is orthologous to G197, G255, G664
tgcaaattccaaaaatataaaaaacatcaaatttttatttcaattgtagatttcaaaaaaaaatcaaatctgttatcagactttcaggtcaatagcagattttctttatatcaattataaataacagattttctttctatccatagatttcactctttatgtccattacaaattccaagaatataaacaacatatcaaatctatataataaaattggccaaactgatattaatcagtgtccgaaactgtgcaggtggtctcttattgcagggagattggcagggcgaactgacaacgagataaagaactactggaacagtcacatcaagaagaaattgctaagcaagggactcgaccccaagacccactgtcccctcggccagccctacaactccaacaataccagcgtcacccggcttgctcctgaccatgaaattccggcattccaaaaccctagaacaccggagatagaagacttcttccaacgcgaccgatcggaaagctcgcctgtcgaactggctgcttcagatgtggaagaacattccgatttgaatctgaatttgtccataagcttgccgtctaattcggcccccgccggaaacagaccttcgaacttcgatagaaccatggtttcagatcacttctgtccgtggaccgttaactcgagaaatgtttggaaggccggagaaatgatgatgtaaacgataaggtatttccttaatctccaatcaggtttaattaatgtacaacggtaatacatgatcaaccggcacaaccacaaacattcaaatccatggcagttgcactgagtcaatgctatcatttaaatc

SEQ ID NO: 12322 - DNA, 894 bp, Pinus taeda
  Predicted polypeptide sequence is orthologous to G197, G255, G664
aggcgcctggaccaaagaagaagacgagcgtctcatagcacacattgaagcccacggcgagggctcatggcgttctcttcccaaggccgcagggctgctgcgatgtgggaagagctgcaggttgcgatggataaactacctgcgtcctgatctgaaacgcggaagcttttcagaagaagaagacgatctcatcatcaaactccactccctcctcggcaacaagtggtcgcttattgcagggagattgccagggcgaacggacaacgaaataaagaattactggaacacgcacatgaaaaggaaattgctgagcaggggactcgacccccagtcccatcgtcctcttggcctgccctgcaagactagtctcatctctcggcccgtccctgagcaggaaattcggacgtttcagagtcctgtaacggtggaggtagaagatttttttcaaaatgaccgccctgtgagctcagccatcgagctggctgattccgacgcgaaagagcgccccgacctcaatcttgatttgcgtatttggcacttgcagtgaatctcttgtcccaattacagctggagggagaggccaaatttgcctaaaggactgaaagtttaaatctcacatttgaaacgtacgtttcaagttccagcatcagcgtccacaaagtagtttcatttccccctgaaagttttttcagaaggaatccattaaaaattctttgatcctctgtaaatggtccaattatcgttggggactgcactgcaagcccatttttaatgtgcagatggttaagagatcttttacgagggtcgtagttcgaggtctcattgacctttctgtaaaaattgattgttcccaagatttaatacaattttgtagttgagcatgatgatatttgg

SEQ ID NO: 12323 - DNA, 873 bp, Pinus taeda
  Predicted polypeptide sequence is orthologous to G197, G255, G664
cttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgacctgatctgaaacgaggaggtttttctgaagatgaagacgatcttattctcaaactgcacgccctcctcggaaataagtggtctctgatagcgggtcgtttgcctggtcgaactgacaacgagatcaaaaactactggaactctcatctgaagagaaaactcatcagcatgggggtcgatcccctgacccgtcgtccatttcagaggaattctcgccatgatctttcgcttcccgagaaagttgaagtgcctgaaatagcaaggccgcgtgagattgtcgaaaatttctttcacagtccgtcagaattatgcggcgactcggagcaagtttcagatgctgcaagcgaatccctagcgcgcgatgagccctccacactaaatctcaacctggagctctcaataaactgggcttcaatgcacgtagctgtgaaggaggaacccattttaaaatccaaaccaggcgaagaagaaggcgcaggtggtcgctttgatgaaaagggatatctgtttcgatatgaagaatgcccggttgggaaaagtctactgagatgagatgaaaagttagatgcgcagtaatgtgatttatgcatgttgaacttattttgatggtagaaactggaaatgttttggaatccaaaggatagtaatgaggtcaattgtttgatcaccaaa

SEQ ID NO: 12324 - DNA, 826 bp, Pinus taeda
  Predicted polypeptide sequence is orthologous to G197, G255, G664
gacccttccggctaagctgcttcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcatcatcaaactccactccctgctcggcaacaagtggtctcttattgcaggcagattgcccgggcggacggacaacgagataaagaactactggaatactcacatcaagagaaaattgctaaacaggggactcgacccccagtcccatcgccccctcggccagccgcacaacagcaacacgacctgcccctctctgcccgccctcgagcacgaaattcttgtgttccagaggccaagaacgccggagatagcagatttctttcaatacgaacgctctgaaagctcgccgatggaaccggccacttctaaagacgcggaagagcatcccgacctcaatcttgatttgtgtatcagcttgccagttcattcgccccccgccacgagcagggcttcgagcgtcgatagaaccgtggattcaaaacctaattcggtttcttgtcacatggggttgcaagtaaattatggtgtgcaatgtgagaacagatattgtgaagagagtgcttccggtgtctcgagtttttacacgctcgtcttatagaatatttgagctttat

SEQ ID NO: 12325 - DNA, 887 bp, Pinus taeda
  misc_feature (845)..(845): n is a, c, g, or t
  Predicted polypeptide sequence is orthologous to G197, G255, G664
agatctccctgctgcgagaggctcataccaacaaaggggcctggacaaaagaagaagaccaccgcctcattgcttacattcgagccaacggcgaaggcagctggcgttcccttcccaaggctgcagggccgccgagatgcggaaagagctgtaggctgcgatggataaactacctgcgtcccgatctcaagcgtggaagcttcacagaagaagaagacgaactcatcatcaaactccactccgtcgtcggcaacaagtggtctcttattgcaggaagattgccggggcggacggacaacgagataaagaactactggaacactcacatcaagagaaaattgctgatcaagggaatcgacccccagtcccatcgtcctctcggccagccctacagcagcaacaatatccccgtctctcggcctatttctgacctcgaaattccggcattccagaaccctagaacgccggagatagcagacttcttcggacatgatcgatctgaaagctcgcgtgtcgagccggcggttttggacgcggaagagaacgcagacctcaacctcagtttgtgtattagcttaccgtctacccctgccgcaaacggcccttcgagcgtcgatggaaccgtggtttcaactcctacttctggcctctgactgttaaccgcagaaatgttggaggggtggtgatataatgagtgacagtatagataataagtgaccaattgtcaccaacacaggcattctggtcagtggcagtgaatatatcctaccattttaaatgaaattccatcctagatgacagggcgcagataaaggcaatggatatctatcaattggatggctaanatactcaagctacaagatctgagcagttgatggtggaatttc

SEQ ID NO: 12326 - DNA, 745 bp, Pinus taeda
  Predicted polypeptide sequence is orthologous to G197, G255, G664
gctgagatggatgaattatcttcgccctcagctgaaacgtgggaatttttctgaagacgaagacgatcttattctcaaactgcacgctcttcttggcaataagtggtccctgatagctggtcgtttgcccggtcgaacagacaacgagatcaagaattactggaactcgcatctgaagagaaagcttatcagcatgggcgttgatcccctgacgcaccgtccttttcaaaagatttctcgccatgaccagccgttttcggagaacgttagcgagcccgaaatagcaagttccggtaaattcgttcaagatttctttcactgcccgtccgaattaagcgtcgagtccgcgcagctttcaaatgcggcaggcggatcactagcgcgagatgggcagcccgacctcaacctaaacctcgacctggggctgacagtaacctgcccctcaatccactcagaagggaagcagaacgttgttaattctgagcaaggcgaaaacgatctcggtgagggaatgggatatttagcatatcattccggagagtgcgcccctccaatgctcctcctgagatgaaatgacaagtgccttttgcatttacacaaaccctaggcagcgtaacaaaatcatgaaaaccgtttcatttctgagacctggtctcttgttcaaaattttcgctaatgtttattatttgttgaacgtagaatgtctcattttcaatttatttatctagtgagcttttaacttgtt

SEQ ID NO: 12327 - DNA, 967 bp, Pinus taeda
  Predicted polypeptide sequence is orthologous to G207, G227, G230, G242
aacaatcatcacgagatgaaattcccttcagaatgggatttctgagattcgatccttgatctgttgctgcgatctgatcacattttattgggggtttagggtttaagttttctctgctaatggcatcgatgaaaggaaaatctccgggccacgatgagcccgatcggatcaaggggccttggagccccgaggaggacgcagcgctgcagcatttcgttcagaaatacgggccacgcaactggtccctgatcagcaaagcgattcccggccgatctggcaagtcctgcaggcttcgatggtgcaaccagctgagcccccaagtcgagcaccgccccttcactcctgaagaggacgccactatcgtgagagcccacgcccagcacggcaacaaatgggccacgattgcgcgcatgctcagcggcagaaccgacaacgctatcaagaaccactggaactccactctcaggaggcgttgccaaggtgggggcgccctcgtcatcgacgacgagatctccagcggcgccgacgggtttcgaaaacggaacctcagcgaagacgccgatgccagccggaaattcaagaagctcagcctcgggacgacgacaacgaccacgaccacggagcctagcacctcctcggcctcggatcggagcgactcaagtctggtatttggctcccctcatgtctacaaaccagtgcctcgtccagctcctctggccctgactagcgaacccaatttaaatctaaatcatcacgaggcctcctgttcgagcaccgacccaccgacttctctttgtctatcgttgccaggcactgacgcccctgcaagacctagcgttgtccccattgccctgccctcgcctgtcacttcttctcctgttgctcctccgggatacatcaaggctgaagaggccatggaatggatgaactctgccataaacaccacattgactcaggtgcttacccc

SEQ ID NO: 12328 - DNA, 941 bp, Pinus taeda
  Predicted polypeptide sequence is orthologous to G207, G227, G230, G242
ggtctgcagttcgaatccgattacgatcgtgttgtgctgaaacaatgggagttccaaaggacgaagcggcgatggcaatggcggtggcggagcggatcaaggggccatggagtcccgaggaggacgcatcgctgcacaagctggtggagaaatatgggccacggaactggtctcagattagcagaggaattccgggccgctcggggaaatcttgcaggctacggtggtgtaaccagctgagcccccaggtggagcaccgccctttcagcccacatgaagacgccaccatcatacaagcccatgcgcggcatggcaacaagtgggctacgattgcccgcctcctccccgggcgcaccgacaacgctatcaagaaccactggaactcgactctgcgacgtcgctatcatggcgagaaagaccagagcaacgggctagctgtgaacttggagtcggcagctgaggacaaagaaacgatgactccgatgacacctgtcacagccacggcaacggcaacggcaacggcaatgccagtggctttagtgttcccaacggctgcagacaacgtcaggaagcggagcaacagtagctgcagcgctaatgacaatccaggagatgccgaggtcgaatcctgtaggcttaagaggctcaatttttctgaatccccatctagctctgaaaatattaataataataataataatgaagaagctgttagtggccattgcaattcggccgctgccccgggttcgagtcccgggcaacagctgcatcgccctgttccgcgacaatctgcttttaattgctatgaagctgtgaaagtgcaggaggaagcgtctgcctctgtttctgcttctggttcggctggcgctttcgatcctccaacctccttaagcctgtcgctgcctggaagcgcttctacaagcgagaataacagcagtgga

SEQ ID NO: 12329 - DNA, 961 bp, Pinus taeda
  Predicted polypeptide sequence is orthologous to G207, G227, G242
cgaaaagggcatcgttgtccacctggacgacgaaatcagcagcttagacgccgctcgcaagcggagcagcgacggcttctcccacgatggcagcagtgcgctggaggacaacggatgtagcagctgggaagtggactccaagcggctgaagagactagaagaactgggaacagagcagggccccgaggttgaagccgaggtcgaggtttcggaccggagcgacgccaacccgggacgcgtgctgtacaggcccgtgccggtcgtgtcttttttcagttcattcgggaaaaccgttgcgaatctacaggaaacggcggccggcgcagtcggtgtcgatccgccgacctcgctgagcctgtcgctgcccggactcgatcccgcgatcccctctccgaagctgtccactcaaaaggactctcacaacaatagcacagttaataacaatattcctattccgccggtggtggaatacatgagagcagacgaggcggtggtggagcgactcagcaccgccgtcaaggccacggtggcaagcatgctaacgcctgttctgaactcgtcgccacgtggctacaacccaccggctgtgagcagcgaccttctggcgctgatgcgggatatggttgcgaaagaagtgcagaaatatatgtccagtcatcaccagcccggcatgtacacaccgctctccccccatcccgagttcttgggagccgctaatctggtgagaaatgttgttctcggcggcgccctgcatctcaacaaatgacaatctcgatttgcagtgacgagttcgagtctcgggcgcggccgaagggcgcgtgagaaatcagacctcccacaactttcaaccgaggactcgaaactcagaatcatgtcgtgtctatgcataataatttttggaatgagaaggtggctgagtgctgtatagagagaaaggcaacgcctacttgccatccacact

SEQ ID NO: 12330 - DNA, 707 bp, Pinus taeda
  Predicted polypeptide sequence is orthologous to G211
taatttaaggatatgatccattgagacctgtacaccgggatcaattggtttctggatcattgccagagagtagttgaaattagaaaatgggtcgggctccgtgttgttcccaagttggcttgctcagaggaccctggaccgccaaggaggacaatctccttaccagatatattgaatggcatggcgaaggtgactggagtaatctgccagagaaagcaggtctggggcggtgtggaaagagttgcaggctgcgatggctcaattacctgagacccactataaaacgaggaaacatttcccaggacgaagaagatctcataattcgcctgcatcggctccttggcaacaggtggtcgttgatagcaggcagattgccagggcgaacagacaacgaaataaagaatcactggaatagtcatctgagcaagcaactaagaaagcgagggatcgatcccctcacccacaaacctctcgaaccaaaccctgaaaatattgcagaccattatactcatgaaaatagcaaagccagcagcctccaagatggccatgcacaaattgggcaaaatcaagagaaacaagccacagaatcatcacccactgatcaccaaaacactgctactctattaatgcagcaacctgttcatttccccaaagcaaacagatatatatcattgccttcaggggctaataacaatagtgaccattct

SEQ ID NO: 12331 - DNA, 757 bp, Pinus taeda
  Predicted polypeptide sequence is orthologous to G217
ccatacgtgatagttttggtgctatcttgatgtttatttgctactatttccttttccagtgtatatgtacccttttacagtgtgtttcccttagcactttgtataaagattaactttctggattgaagcttttcatgcctttgtctattgcgaagctactagggattccatgttatagcggatatacaaagtgtttgccaaagcaaagcaaaggaatttccacaaagacgccggattttgtcgaggttgttttgggatcgaactttacatatttgtagtgagtatattattgatcgggaaactttgctaagagccaagttaatgaatatataaatattattcctaggtagggttctggataaaattgcggtaagatgaggattatgataaagggacgtgtttggaaaaaaaccaaagattaaactctgaaagcagttgttatgaaacatgagaaaaatcaatgggcacatatttcttctctgctcgtttggaaatcagcgaaacaatgcaaatctcagtggtatgaatggttggacccctccatcaaaaagtacctttttcgtggtaaccactatgatactactgcacacaagagcagacacgactgccactagctaactcaggtatgcatcttacacccatggtaggccttggctttttacttcccatggttttcaacaaaagtttctggctttaatactcctctccaggttggtggtatgtgcctacccttaaaggagtcttcttggttagtgag

SEQ ID NO: 12332 - DNA, 777 bp, Pinus taeda
  Predicted polypeptide sequence is orthologous to G234
tggtctcctgaggaggactctgaactcaagaaatacatagagaagtatggcactggaggcaactggattgctttacctcagaaaattggtttgaaaaggtgtgggaagagctgcaggcttagatggttaaactacctgaggccaaatataaagcatggagggttctcagaagaagaggataacatcatttgtaccctttatctcagtattggtagcaggtggtctatcattgcggcccagctgcctgggagaacagataacgatatcaaaaattactggaacacaaggctgaagaagaaactgctggggaaaaccaaggaacgccaatcccgtcgtcttgctggggcaaaagaagaaagcaaggacatgcaaagctatgctacgccagggacgagtacaaacccaaacatctatgcgccacagcaacaacctggagggttagataaacatacagatatcaatatgaatggtccttactctaatttgggctctggaataaaccctcagctctttgatcaaacaattaccgaacccagttcaagttcagggccagccacatttcagctgaattgtcaacatgtccagcttgatcaggaactgggtgatcataattcctgtctgacaaagctgctccaagggcttgaaggaactgtggttgatcatcacaattccagcaatatcactatgatgagtaccagctcctcaatgcaggcatctgactgcattaactcttcagaattaatgcattccattgcatataatcaatataattctgac

SEQ ID NO: 12333 - DNA, 609 bp, Pinus taeda
  misc_feature (391)..(391): n is a, c, g, or t
  misc_feature (405)..(405): n is a, c, g, or t
  misc_feature (465)..(465): n is a, c, g, or t
  misc_feature (509)..(509): n is a, c, g, or t
  misc_feature (521)..(521): n is a, c, g, or t
  misc_feature (524)..(524): n is a, c, g, or t
  misc_feature (527)..(527): n is a, c, g, or t
  misc_feature (533)..(533): n is a, c, g, or t
  misc_feature (536)..(536): n is a, c, g, or t
  misc_feature (564)..(564): n is a, c, g, or t
  misc_feature (575)..(575): n is a, c, g, or t
  misc_feature (580)..(581): n is a, c, g, or t
  misc_feature (603)..(605): n is a, c, g, or t
  Predicted polypeptide sequence is orthologous to G237
cttgtgggctgagtgtattaaatttattgatgctgagttacttcttttggcaagtcaagactcattttaggaagcatttctatttagaggccaaattcatggtgtaacctgagcttgagaaggccaaatatcctgtgcaaaacgaatcattatccagtccaaaaaattgctacaggaaggccgagttaattgttacaggagggccgagtcatccccaattgtgatttcactgtcaaaggaagctgagtctgttgctcttcaaaggttcaagtcattgctccaagcatactacatttgctctgattttttagggccgaattttctgtagcaaaagaccaccaattgttgggcttgtcatcagtttttgcagaaaaaaaccttgatacttcanaaaaatggtttcangttctaaaccctcctttttattccaatttcccatggtgaatataataaaattctgattgnctaattgacaaaaaaaaaaaaaaaaactccaaggggggcccgtncccattcccccnatnatnaatctnttncattccttggccgccttttacaactctnactgggaaaancctgnntttcccactttatccccttcannnatcc

SEQ ID NO: 12334 - DNA, 773 bp, Pinus taeda
  Predicted polypeptide sequence is orthologous to G242
atacatcatggtttaaaaggtttttttcagaaagaaaagtaatatattatattgaggcaatatatacatcatggtttaaaagatttggttcccatatcaatggtgacaaaactcataagactcctaggacaggtaagaaacagattttgacatataaaatgagaacactgagcaccaaagaaaaacatgtgatggtgcaaaaatcctcgacatcctcgaaaatggaatcctcatagaagaggaagaaatatataatgaaaacactgagcaccagataaatgagaacactgaccaccaaataaaaacatgtgatggtgcagacatcctcgacaatgggatcctcatagaggttggaatcatagacaatggaatcgggatagagatcatcgttgtgttcctcgtcggtatcctcttcttctgtggtagggccgaggctcagcagctttgctctgtaccccatttctcactttcagtgccacactcacaggaactgattttcccaccacagttaccattccctttttgatgtccacttctattgaagtaaagtctccaaaccctgcaacaacctcaacgatccttttctcgcttccctccttatcctcaatagcccgattcatgcgtccaaaccctccaacagcctccgctctctgcacacccaaataatggttgcttcccatgttctcagtatcgcatttcgaccccactttcttttcggctattgtcttcgacatatatactaccgttggggcttcaaacttctcctgcttcgc

SEQ ID NO: 12335 - DNA, 341 bp, Pinus taeda
  Predicted polypeptide sequence is orthologous to G263
tcgagcggccgcccgggcaggtacgcgggcaatcggattcctctactggtttaataataccaccatccaacatcttatccagttcttggtgcaccccatcacagtggccctgggcttccagatgttaccaagtttcccaggcgaggaaacaagacacaccctgtgtacaagatgcagtaacgatgatacaagttttatacaactattttgtaaattgcatgtgtctatatagatagaatagtaggaaggagagatctgtaaaaatctgtaaaaagaataaagcctttattgtactgtgcaaggacatttaatattattaatcatatatcactgatttctgt

SEQ ID NO: 12336 - DNA, 836 bp, Pinus taeda
  Predicted polypeptide sequence is orthologous to G263
cggccgggggtggagggtcatagatccataccagctcccttcctcatcaagacttatcaattagtcgatgattcgagcacagacgacattatttcttggaataaagaggggaacactttcatagtgtggcgacctgccgaattcgcccgggatttgctaccggattacttcaagcacaacaatttctccagcttcgtccggcagcttaatacatacggattccgcaagattgttccggaccgttgggagtttgctaatgattgtttccggaaaggagaaaagcagctgctctgcgaaattcatagaagaaaaagcgtccagcaatcttcagcagcccctgctagcagatgcgtttcgccggtcaattctgtggaagagcaggcattgtcttcgacctcctcccctgtttcttctcccgcagaggcggcgttagttaattgtggtcaaaatagcacatccgggctccatggtgaaaatgaaaaactcagaaaagataatttgcttctcatgtcagagctggcacaaatgaagaaacagtgcaacgatctcctcctgtttctgtcaaagtgtgtaaacattaccccggacaacctcagcaatatcctggtagccgcttctcaaacgaattgccgcgatgaaaacctgaaggcgttaccgctggacgcgtccacactggccaagttagccaataaaagtgttttctctgaaaatcacgagaaaagagccgcctaatcttttaacggagctctgtcgaagcatgttaaagactcagacacgctgtaagagcaccggtggaagagagcgaattcagacggtcacgaaacgataacaaacag

SEQ ID NO: 12337 - DNA, 791 bp, Pinus taeda
  Predicted polypeptide sequence is orthologous to G264
ggaaaaccttgcttccctgatatgcctgtctctttaggggtttcggatatttatacatcttcagctttgtcagatttgaactcctcgtctgggttgccagaaatgtctgtatctttgagatcacaagatatacaagcatcagcagggttagtagggtcccttcgatctgacattctatgtaacttgagtttgagtcctcactcttcttcgcttgaattaagtaaaatagatgacgcaacaaaagctatccagtcaggcagtcctgagaatagaagtcttataggatctaagacgggtagcaatgatgggaattcagaagccatagatatggaggtaagattgcgatatggtgcagcaaaaactactgtgcaggagggttcagttaatggtaaggccagagggacaggtaaaggcatgggtgctgagacaaccaggaagcggatcaatgatgtgttttgggaacagtttcttactgagagtccacagccaatagacacagaggggactgattcagagagtcaggagagtagtaaggatcaagacgatgttgtacctgaatatagcaatttctgtaatagaaaggagaatcttgatcaacttacactacagatggggcaactggcatcatcagtaaatctttgacatcagattaagcatgagtattgaagtgactgcggcactaacaacaggagaatataggaatgccagtaaagttaattgtttctgaagaacaccagcgggttctagcctgtaggtgtatcttatgttgctctgtttgatgcttctttcaa

SEQ ID NO: 12338 - DNA, 854 bp, Pinus taeda
  Predicted polypeptide sequence is orthologous to G268
cggccgggggaacgtggtgttccagctatggtagcagtgtttgcaacacatcggctcccatatccaagtcaggcttttgacctgattcattgttcacaatgtcatgttaactggactcgtgatgggggtattttattactggaggtcaataggatgctcagggctggaggttattttgcttggggtgcacagcaggataaacaaaaagagaacgtgcagcaagctttgaatgatatgaaggatcttgcaatccgtatctgttggaagcttgtgagtgaagatggccttgttgcaatttggcagaaacctttcaataataattgttatgtcagcaggcgtgttggggttgaacctccattgtgtgatgtgcatgatgaccctgatgatatatggtatgtgccattgaagacatgtatctcacgattacctgagaatggctccggaggaggttggaccaaatggcctcaacgcttgtatactcctcctgaccgattgcagggtgtagatatggaagcatacatatcaaaggatgaggtgtttactgcagaagcaggatattggaaaatgtttgtgaaaagcaatttacataggcttggctggaaagtacataatgttcggaacgttatggatatgaaagcaaattttggagggtttgcagctgctctaatagctgaagatgctgattgttgggtaatgaatgtggttcctctaagtggaccaaatacattgcctgtgatttatgaccgtggtctgattggagttgctcatgattggtgtgaaccatttgatacacatcctcggacctatgatcttctccatgcttctggcctgttctctattgagaagagaagatg

SEQ ID NO: 12339 - DNA, 789 bp, Pinus taeda
  Predicted polypeptide sequence is orthologous to G268
cggccgggcacagccagtatacaaacatgaggagaagctacaagaagcttggaaagatatggagaaccttaccgcaaggatgtgctggaggcttgttaaaaaggatgggtatattgcaatttggcggaagcctttgaataacagttgttatattaaccgagctgtgggagttgaacctccattatgtgatatacgtgacgacccagatgatgtttggtatgtgccactgaaggcttgtatcacccgattgcctgaaaatggctatggacaaaatttgacgaattggcctgagcgattgcatactccacctgagagattggagtctacacagatagatgcatatctagcaaaaaaagatatttttattgcagaaactggatactggaatatggttgtgaaaagctacttacgcgggctcggctggaggagacagaaatttcgaaatgtgatggacatgagggccggtcttggcggatatgctacggcactgctagaacagcaaattgactgctgggtaatgaatgtagttcctgtcagtggaccaaacacgttgcctgtgatttatgatcgtggactcattggggttcgtcatgattggtgtgaggcatttgatacatatccacggacctatgatcttcttcatgcttctggtctattctccagcgagcagaaaagatgtaacatatcagacattttgttagagatggacagaattttgcgtcctggtggatatgcatatattagagataacagagtagttgtttccgaaatagagccaattgcaaaggc

SEQ ID NO: 12340 - DNA, 748 bp, Pinus taeda
  Predicted polypeptide sequence is orthologous to G274
ggccagtctatgatattgcgtatatatgtctgatcctgtccattcacattattttcctttaatggactgcattccacccatgatttctgtttcctatttataagctcttatgcttcactgggtttctattatttcaagtgtccacggcacgctgcaccagaacataagttaggaagattttctgaactgctctccggcttcaaatttgagatacaagatgaggtcgaaaacaaattcagcagacagcaggaccaggagttctgtttctatctttattgttttgggattatgctgttttttctacatactgggtgcttggcagaagagtggctttggaaagggtgacaggattgcagaggaaatcaccaaactgacagactgtacaactttgtctctaaattttgagactcaccacaatgaaggagataacgttgaactttctgaatccaaagcaaagatatttgaaccttgtagtgccaaatacattgattacacgccttgtcatgaccaaaagcgagctatgacatttcctagagataatatgatatacagagagaggcattgcccaccagaggatgagaagctacattgcctcattcctgctccaagaggatacaaaaatccatttccatggccaaagagccgtgactatgtgccatatgctaatgttccctataaaagtcttacagttgagaaggctattcagaattgggttcaatttgaaggtgatgtgttcaagtttcctgga

SEQ ID NO: 12341 - DNA, 865 bp, Pinus taeda
  Predicted polypeptide sequence is orthologous to G275, G837
tgggaattgattggtctgctgttcggaatgttatggacatgaaagcagtttatggaggatttgcagcggctctagtatcacagccagtttgggttatgaatgttgtgccaattgatgctccaaacacgcttccagttatctatgagcgtggtctgtttggtatatatcatgactggtgtgagtcattcagtacttaccccagaacatacgatcttttgcatgccgatcacttgttctctaagctgaagaaaaggtgtagcctagtttctgtaatggcagaggttgatcgcattttaaggccagggggttcaatcatctttcgtgacacggtggagacgttgaatgaattggaaaacatgataaagtcactacagtggcaaatccgaatgacatactctcaagacaaggaagggatcctctgtgcacagaaaaccatgtggcggccacagcaagtagcttgaatgctttcattcattgtcactggcagcaacattcatgtgtacaaatggttcaaatcaatgcggaacctgctctactgtatgttagagcttgaatttcttccagaagagcaagttgttttttgattctttaattgtattgccagagtctgttcacctttactagattttattagctctctatagattcctccctatccccttcaaatgaaggaattcgtgtaagaacatgcatgttttatcgttcagctaatttctggatgacgcatgtttgtttaatgtttcagataattctggatgtagtatcatttgcttctactctggggctttaacaggggtttggtcacaatcatctgttatatgagttttatttaatttaaactgtgacaaattacaggcttttctct

SEQ ID NO: 12342 - DNA, 774 bp, Pinus taeda
  Predicted polypeptide sequence is orthologous to G275, G837
cggccgggattttaagacccgggggttattttgtatggtcagctactcctgtttacaaaaaaggtcaagaggatgttcagatctggaaagctatgtctgatttgacggcatcaatgtgttggaacctcgttgcaaagaaaaatgatagggtcaatgcagttggtgttgcgatttatcaaaaacctacatcaaattcatgttatgaattgagaaggaagcaagatcctcctatgtgtgatgagactgatgatcccaatgctgcatggtatattcccatgaagagctgcttgcataaggtgccaacttctgatggtgagcgtgggactgtgtggccagaagagtggcctctaaggctcgaaaaacctcccttctggttgtacaacatgcaagctggattatatggaaaacaagcagcaatagacttcacatcagacactgatcactggagacgtgttgtcaccaagtcttaccttactgggttcggaatcaactggtctactgttcggaatgttatggatatgaaagcagtttatggagggtttgctgcagctttagcaggacagcatgtttgggtaatgaatgttgtgccgatggattctcctgacacacttccaatcatctacgaccgtggcttatttggtatttatcatgattggtgtcagtctttcagtacataccccaggacatatgaccttttgcttgctgatcacctgttctctaagcttaagaaaaggtgccaattggaacctgtaatggcagaggttgatcggatat

SEQ ID NO: 12343 - DNA, 892 bp, Pinus taeda
  Predicted polypeptide sequence is orthologous to G291
cggccgggctcacatcctgggtatggttgctggctttctggtattgatgtgcatacacaggtttctaatcagcagtttcaggaacctttcttagcagtagtcatagatcccacaagaactgtatctgctggaaaagttgagattggtgcttttcgaacataccctgatggatacaaacctcctgatgagcctgcctctgagtatcaaacaatccctctgaataaaattgaggattttggtgttcactgcaagcggtattatgctctggatattacatacttcaagtcatcccttgattctcaccttttggacctcttatggaataaatattgggtgaatactctttcatcttcgccactcttagggaaccgagattatgttgcaggtcaaatttcagatcttgcggagaagctagagcaagcagaaagtcaattggcgcattcacgtgtaagctcatttctggcgcctccacaaaggaagaaggaggaggaatcacaacttgcaaagattacgaaggacagctcaaaaattactgttgagcaagtgcatggactgatgtcacaggttatcaaggacatcttgtttaattcagttcaccagtcaacaaaaaccgaaatcgcttttggtgagggatcaggacctgagcccatggttgagacctgatgcttgactgaaaaggcctagctaattgtgcaaagtcgtttgccaattgttgtcacatttttatctttcattgatctgctattttgccatcgcatcagtctcttgttctgaatgtgtaaatcattgccatcatttgctgggcggtggtaaaataccattagccaggcagcatctggatatttccgttctctgttgggtagagcaaaatttctagactaattagagtcag

SEQ ID NO: 12344 - DNA, 573 bp, Pinus taeda
  misc_feature (26)..(27): n is a, c, g, or t
  misc_feature (53)..(54): n is a, c, g, or t
  misc_feature (523)..(524): n is a, c, g, or t
  misc_feature (537)..(538): n is a, c, g, or t
  misc_feature (545)..(546): n is a, c, g, or t
  misc_feature (551)..(552): n is a, c, g, or t
  misc_feature (554)..(557): n is a, c, g, or t
  Predicted polypeptide sequence is orthologous to G307, G308, G309
ctggcaaacgctgggtatactgtaanngcctctgatttagcccatgttgcacnnaaggtggagcaactggatagcattatggggacggatcaagacccgggaatatctcacttggcttccgaggctgcgcattataacccgtccgatttagctggctggatcgaatcaatgttcggggagcttaatccaggcgcagacatgccagttccgtttggggacaggggatctctgatcgattcttcacaggttcataacccgattcatgatgatcccagtctttctgctatggacttggcactcattcatgaatatggcttgcagtttaatggaagccaagcatctaaccctcagggtttttccccggattctgatccctctgttagatgcaatattttctctggaccgcctctgcgttctggggattctaccacacacacgaactttcaggcgcggagctttagtgcccagtccagcgacgagggttcgagtctctctagtacccgcttgggaaccgcacaacagnncatagataatggnncgcaagnntcagnnannnncgtggtgcacttgctt

SEQ ID NO: 12345 - DNA, 911 bp, Pinus taeda
  Predicted polypeptide sequence is orthologous to G307, G308, G309
ggaaagacggtgaggggagttccactgtctgacctcagggttgctcaggggcctaccatggcggctaggcgaggctgattgctcgggtgggagtgaggtgtgaatagtttattgatgtttagttctgtgaatagtttattgatgtttagttttgtaaaaagtttaacagaagatcggatgctgcagggctgatacggttacggtttcgttacggctctttttagagccttaggcagcttttggggtgtttttttttctgtgagtggaattgaagtagaagttgaagctgaagctcccctggatgctccagaggcttcacagatatctcagtttctggaataggtggaagagattgaggttggttgtttgtatgtatgtacagtaggcttttgggtttttctttgggtttctggagtggctatatggatcatgaaggcaagaggatggcatcatttcccacttgtcgtcagaggctgtgcactataatccctcggacctcggtggatggattgaaagtatgctcagcgagcttcatgtccctattcttcctccaacagatcagccgtttcagttccctcaggcagcagcggatcaatcctctacggttcgggaagcgagcaattcggtgccggaatcttccacttcgacttcgaagggcaccagatctgtgcagaatgttgaacaggaccaacagtacaggttaaatgggtccggggccgggttgtttgagccgcctgaggtcctggatcgatcagaattccagcttcatggctatccgggccaagggggagtacgagataatgggattgatcgcatgttcggtaactatggcggccttttttctcaagtattagacgtctcggacctcctagtcgatgaccctgatgttctacaggaaccaccaccacagg

SEQ ID NO: 12346 - DNA, 676 bp, Pinus taeda
  Predicted polypeptide sequence is orthologous to G312
ttgttattatttagaatagaaaattctggctacataaggggtttcagggacattgcataaaacagagacttcgctttttaggtaatggaggctttgcaacacttgctctgcatatataattgaagagaaactaggaagaacccagaggggtgaaaaacaaggaagaatgagacgagaggctttttctcaatcccttcttttcctaagcccttgatttaatccagggttacagagttgtcatgcacccccggcaatggtagaggtcaatcatcccaccgttgcctgctgcctacaagaaataattggtctacccagctaaaaattgtttgccaagggatgcatgacatgtgctagaactaaaattactgaagcaaagagggaatagaaaaattacagacatattcacatgatcatgatataacctttatttacagtcacaatgtgtatgtatgtacacaaagcataatttgatttccatcctagatgcagcaaatgttctatgtatcctgaataatcaattggcactatacaagggattgccagattcttagagactagcaacagcaccaagctgagacggtgaggaggggccgattttgccatgccaaagagagataccccgaggattcatctagagaatacgcttcacaataattatagagaagaattcgagctt

SEQ ID NO: 12347 - DNA, 803 bp, Pinus taeda
  Predicted polypeptide sequence is orthologous to G324
ttggattagcagtggcagtccagcaagacctgttctaccagagtccacttatgtcagtaatgatgacaagccgccatcaagcgctgattttgaagctttaggggaaccaaaaaatgcatctgtgagttctccagtattgaatgagcggaagctgttttcacatgtcacacgacttggatttgctgctgggtatgattctccagctcttaaggaaggcctatctgaagagttgaccctggattcaatggatgctgcttcaaatagcattaatatgggaagagcaggtgtttctgcagatggtggtacaagcagttcgtcctctatgtcatttgcagatattataacagccccaaaacccagcgggcaagaatgtagtaggcagatatccaagtctcaaaattctgggaaaaagggcaagaaagctaccaaggttcttctctctacagcaggtggaagaaggtattgattcggtgtaaatttttaggacatgtataattagtgtccattacatcaaagtttggcttcttgatatttaaattcttcccttgcaactctcagtttttcacttccataaatttcttggtattagaatttaaatttatgccgttccgtgcacttgtgtgctcttaagatccttggagaacagaaccttgggattgaagtccacaacatttggtatatggttgtcaatgttgtacattttgttctgtaatttgcttatcgagagtaagatatctacgcattacacattattttccgaataaaaggtttcgaaaactgaaattctcatttggtatttagag

SEQ ID NO: 12348 - DNA, 740 bp, Pinus taeda
  Predicted polypeptide sequence is orthologous to G326, G1337
cacaaccaagctttgacagtgaagcattagcccaagcacgaggcaatgcaatgttgcggtacaaggaaaagaaaaagacaagaagatatgagaagcactttcgttatgaatctcgcaaagctcgagccgatgtaaggaagcgcgtgaagggtcgctttgtaaaagcagacaaagaatgtgatcaagatgcccttggaagtagcaattaaaggtttacctctgtagtaggaaatgttcaacctgcaaattattttgaatattttcaaatttggattgcctttaacatcaagggaaatgttctttgaaaacaacataccttgtttgtttggcagaatgtgtgcataatgctaaacaggaaatgatgctgtgaaggacagtaagttgaatctggtccataattggtggccagggcagcgtttgatgtaatcaatctaggtccatccatttcatcactcagggttgtctgttatctttgtattgtaataagtcttcaatataactttcctgatgaatgaagtcatgacattttggtttttcatcacagttcaatgcattcttcctgtgtctttctgaagatgtcaaaaccaaagtgtagacatacaacatatttgaggtcaccagccccacatgaaggtattgggaatgatattacagtgcattcccattatttttgtggggcaaattgatcttgtatgctattaatttgatacagtgaatttatatatcatttgtgtggctgt

SEQ ID NO: 12349 - DNA, 784 bp, Pinus taeda
  Predicted polypeptide sequence is orthologous to G343
aaatttgagtttcgattctgctcttggcaagaatagggtgtatttgtgaaaagagaaagaaatccttatagaaataggatttaggattcatgctctcggacatgggcatggacattgccagaaataattccagttttgtaggattccctggtttggaatgtcccatagagtggggcgaagcagccaagtccttcgacttcagttccattggagacgttttccgcattgaggacttgtctgagttctccaatgaggacattgccggacccatacccagtggctcgctttcttctctttcttctcccgggtcttctcagaacatggccaagcacactgtctgcgcctcttttctcaacgaaggagacttcatttgccctccttacgaagatggaattggtctagaatggctgtcggacttcgtggaggattcctttgcagctacaggaagttcgaattctggttccttggctgacttgtctaaggacaaaatcgacgacaacagggagaagaagaagcagaacccaaccgatgaagcgataatccctgaaataccgcctataaaggagactcccaggtcacagagggcggtgcccgggcgggctcgcagcaagcggcgcagaagctcaggagccccaattcgcggttggtctacttctgaagattacgcattgcagaatgagggcggcatgaaaattgtaacaggagcggacgctataaatcattaccagtcctcggcgccccagcagcagccaaggcgctgcacccattgtctcagccagcgaac

SEQ ID NO: 12350 - DNA, 865 bp, Pinus taeda
  Predicted polypeptide sequence is orthologous to G347
ccgagggcgagaggaggacgaagaagggcttcgtaacaaacgtggcgattgatcctaccttagcctgaaaatgctgtcaggaggctacgcaaccagatccgacactactactgtcaacaacggatccgctaatggcccaataggaagtgctcccccaagaattaactcgatacaaaataataatccaggagctgtcaggcctggctggggaaccatgccccttcacatgaatccttatcatccccaatcaatgcctcttccgccccccaatggtatgcagggtcagcttgtgtgcagtggatgtagaactcttcttgtttatccgcaaggtgcaccaaatgtttgctgtgcagtatgcaacacagtcactccagttccacctcctgggacagaaatggctcagctaatctgtggacgttgtcgtacattgctaatgtatgttcgtggagcaactagtgttcagtgctcttgttgcaacacagttaatctcgcaatggaagcaaatcaggttgcacatgtgagttgcgggagttgttttacaacacttatgtacccatatggagctccatctgtaaaatgtgctgtctgccattatgttacgaatgttggacaaataagcaatatgagaatgccacttcctgtacaaagacctccagcggcagctacaaccccagcttctagttctgcacttccaacacgatcacaaactcaaactgtggttgttgagaatccaatgacagtggatgaaagggggaaaatggtgagtaatgttgcggttggagttactacagagaagttatgacacataaaaatctactgccaatacttttttgttcatgtacttgggattgctgcagaattccta

SEQ ID NO: 12351 - DNA, 532 bp, Pinus taeda
  misc_feature (401)..(403): n is a, c, g, or t
  misc_feature (447)..(449): n is a, c, g, or t
  misc_feature (474)..(476): n is a, c, g, or t
  misc_feature (481)..(481): n is a, c, g, or t
  misc_feature (483)..(487): n is a, c, g, or t
  misc_feature (524)..(527): n is a, c, g, or t
  Predicted polypeptide sequence is orthologous to G361, G362, G370, G1995, G2826, G2838
cagcagcaccgtggaattaatcgcatagtaccgttggagttcttgccaggctctgtcaatgcgttatctcagcttccattcaacagatcacaatacgatcaattaaacgaacgatgcagaccttcaagtcgtgataattatggcgagacaatccggcgggagagacccataattaggatcttcggcatagaaatcaatggaaaaaccgaggacccagattcgtgcgccgatgttgtaccggaaaattccaaacaaataatcaaccatggactcatattgccggagatggggtcagtggacagcgggcgcgaaggcacgagagcaattttgtccgatgattgtgtgaaattcgaatgccgatattgttgtagggttttcccgacgtctcaggctctcggcgnnnaccagaacgcccataaacgagaacggcgccgggcaatgacgagnnntcagagatcgccctctgacagttcnnnctatncnnnnnaacagaatagtattgatctgtttagccgtgagagagnnnncgggt

SEQ ID NO: 12352 - DNA, 856 bp, Pinus taeda
  Predicted polypeptide sequence is orthologous to G361, G362, G370, G1995, G2826, G2838
gcagacgcggcatgagcagcggccacagcagcgcttctgctggcctgaatctgtgctcgctttgcctgctgccgttctttcttgtgcgcattttgatgcccacccaatgcttgagaattcgcaaattctctgcagcaatattgacattcgtactttctgctgtcggaagccgaattgctcccactttctgcagcctgtgctgcactcgatctgtcttctccctccacatcctcttcattaaccttgttgtcatcatcatgatgcgccgaccctgatgatcggttctcggcttcaaccgttttttgcctcagttcaaacccaaacaatttcatggatttctctcgcttacagcgcccctctgcagcttcatcggtgacctcttcgctacactgatctttctgctggtgataatctctttgggtggtactgaaactccgctgcaacggtttaggagttgttactgtcactgtctctttcttgttcttgatttccatggaagtggatccaagatgattgctgcattcttcttgggccacctcctctcccattgaggtctcagtggggtactgcagagaagccaaattctcatttgggtagccactattgagaaacagagcagcaccaatattctctttcttctctccttctttcaagatgcaggcccttgtgcttgtgcctgcatctctatcctgacatgcatcggtgtacagtggagaagcagatgcagaagcagaagcagccttgttgcagtggatcaatgcttctccttcaggcctttgtcgcttggacggcatggaagccgaggaggaatagcccaaaaaggagaaggtgttaataattccaaaattgggtgtct

SEQ ID NO: 12353 - DNA, 994 bp, Pinus taeda
  Predicted polypeptide sequence is orthologous to G361, G362, G370, G1995, G2826, G2838
atccactgagccagtggaggaagaactagtgattgaagccaaaaatggagattcagggaaattagaagatgtgggtagcccagtagaggctggagaaagtggtagcactagcaattgcctgggatcatctgctcaagaaaatcggaaatatgaatgccaatactgttgcagagagtttgcaaattcgcaggctctcgggggccatcaaaatgcgcacaaaaaagagagacagcaggccaaacgcgcgcacttgctggccaccaggagcgctgctgcgagtgccaacagaagtggcgccactgcatggtgcgggaacataaacggtaacctctaccacagaaatttccttttcaataattcctacttcacacgcatgcaggtgtttcaagaagatttcccgacctttcagaccccacaagctgttgcagctccatcaatcccgcattatatcttcagttaccagcagcagcagcaggcgcccgtgcagagctcgctgcctggattaatggtcagttcccaatgcgggcagttcggattaaacgaagtcagacaagtccctatttatggggacaatgtcaataactattccttcaaccccgccactgccctaccccaacctccagtgcccattccagcttctctccattcaagtggcctgtcaaggatcagacaagccagttggtcgattcggcctccttgcagatcgggcgactggcaatcagaccatgcagctcctgttgtcatgcccgtggaacgcaaatcttcttctgacaagtttggactggaattggatcttcaattaagaataggtcctaatgcgaatcccaacagtcactttgagtaagattttatgcttctttgggttatttttcctgtaagcttttcagacttttttcaatgaatgcagagagattaaaacctaaaacctaaagagatttcgctaagtgatcaggattttccattctctgtagatttcctgcttatgctggcagca

SEQ ID NO: 12354 - DNA, 781 bp, Pinus taeda
  Predicted polypeptide sequence is orthologous to G374
gcagcattgggatttctagctgattcagcttccaatgagcttgttagtactgaacaagttactgatcaaacttcttctcccggcaaagaaggaaccaggtacaggcctgctggaacaagaaaggagccacatgggtctgttggggcagcagcagcacatcgagctattgctcagggtaatagtgatgaagttgctgcagcattcttcaagtattcagcaccagaggaggtgatgacttttccagcagtttgtggagcatgtgcagcaaggtgtgaaactcggatgtatgccacaaacattccatacttcaaggaagtgatcgttatggcttcaacctgcgatctctgtggttatcgcaactctgagcttaagccaggtggtagtattcctgagaagggaaagaggataattgcccgaattctgagcaaaagtgaccttagtcgggatgtcataaagtcagacactgcaagtgttattgtaccagagttggatttggagcttgcacctggcactcttggtggtcttgttacaacagttgaggggctgatggttgcaattagtgaaagtctgaagagagtgcatggatttagtattggtgatagtgcagatgaatggaaacggagcaagtggcaagattttgattctcgcttgatgaagctgcttcaagttgaagtaccttggacattaattcttgatgatgcccttgcaaattcattcattgccccagcaactgagactattgaagatgatacacaattgaagtttgaagagtatgaaagat

SEQ ID NO: 12355 - DNA, 902 bp, Pinus taeda
  Predicted polypeptide sequence is orthologous to G380
gagacgggacctgtatcaaacagcatcgccaatcaggcacaggggaatttttggaacgagagatctggaaaagggcgtagacgaagggctgcagccgaacagagacgaattgaacaagaaaggtgggggagatggcctactactcctaatcatgatgcagccgaagatgaagatgaggagaatgcagaagtttatacgagcttgcaggctcccacaagatctgtcagaaggcgtaaccgtcgaaggaataaccggcaaaatgccgcccatcttgatcaattacaattggaggtcgatgactacattgaggacaatctgcattcgttcagcttcaatgcagaagaacgttcttggggttctaattctgaccattacgagattgaaattgctctggctgtttcactctcattagcccaatcggctgatggaagttcagatcataatatgaatcacagtggacgggagtatggctcggatctgtgatacgagagtctcgcacagctggaaaatgtaatgtgcgttgctccagcagttgttgtaaactcgttatcagtgaatgcatttgtgggaaataaagcttcgcatgaattggtcgaaccagccgaagtatgcgccatatgccaatgtgagtatgaaagtggggatacaatcatgtcattgccttgtgcccattctttccatcgcctgtgtgggtcagaatggcttctcaagtactcaaaactatgtcctatttgtaagctggatgttgttgagaaacatgaaggcgggtgattggaattagttgctcaaaattgtagccgaaactgtataataaataaattggtgaatctgtccataactcagccatctttacctgtaaatatcattcattcattgtgacaagcttcatattttctgaacac

SEQ ID NO: 12356 - DNA, 458 bp, Pinus taeda
  Predicted polypeptide sequence is orthologous to G384, G385
actccgataattacactgcaattcagacatctgcacagtgcaatgcagattttatctgctgcactgtattgcatatgagattattggtggttgtaacagagtctaaacccagcttggctgttggtaaatggctgacaagcacctgaaaggccacagtgagtaatgaacctcctctcgtgagcgggctatccaatccactgctgttgctactgttgctgctgctgttcgccccttcgaggagtgaactagtagaagatctattttgaccgtctggaagaatggcaaatccagaggggagaagggctatgtatgaaggatcctccccgctcatagcaatattgattgctgggacgtccacgggggcgtacactataacagacccagatgcatctgtgcaactctcctgcagtattagctctacgttttggcttgacctggcccccgggcggccgctcgaa

SEQ ID NO: 12357 - DNA, 747 bp, Pinus taeda
  Predicted polypeptide sequence is orthologous to G384, G385
ggtatagctgccaagtacgtgggcaagcccttgctttcattcgggccaccacctctcagttccctccctcgttcgaatcttgatctggcagtgggaagctatggtgtgcagccgaacttagggccagatatctatggatcgtcatcagggggagaaattggaaacaggtctcttgttggtcctacagaaggtgaaaaacctatggttgtagagttagctgttgcagccatggaagaattagtgagaatggcacaactgggggaacccctatggtcctcacgtccggaggatggcactgatattcttaatgaagaggaatatattcgcacctttcccagaggcataggtccaaggccctatggattaaaggccgaagcatctcgagagactgcggttgtaatcatgaatgctattaatatggttgagactctaatggatgtgaatcaatgggcaagcatgtttcctggcattgcatcacgaccagttaccgtggatgtgttttcaacaggcgttgcaggcaactacaatggtgctttgcaagtgatgcatgcagagtttcaagtaccctctccactagtgccaactcgggaaaattacttcgtgagatattgcaagcagcactcagacacaatatgggctgttgttgatgtctctctggacagtttacgagggaattcttcttcggtgataagatgccgaacgcgaccatctggttgtctcattcaagagatgccaaatagctattct

SEQ ID NO: 12358 - DNA, 800 bp, Pinus taeda
  Predicted polypeptide sequence is orthologous to G386, G707
gaattggaggcgcttttcaaggagtgcccacatcctgacgagaagcaaaggttagacatcagcaaacgcctgaaccttgaaactcgacaagtgaaattctggttccagaaccgtcgtacccagatgaaaactcaacttgagagacatgagaattctatcctaaggcaggaaaacgaaaagcttcggtcagagaacttgtcaatcagagatgccatgagaaatcccatctgcacaaactgtggaggacctgctgttctgggcgagatgtcctttgaagagcagcaacttcgcattgagaatgcccgcttaaaagaagagctggatcgattgtgtgcactagcagggaagttctttggcagacccattccttcaatgccatctgttccccttatgcctaaatcatccctagaccttggagtcggtggcatgcccacttcgttgccctcggctagtgcagacttgatgcatggacctgctggtggtcgaacaggaaacataataggtattgagaggtcgatgctggctgagcttgctttggcatccatggaagagttgttcaagatggctcaagcagatgaaaccctttggattccgaacctggatgctggtaaagaaactcttaactatgaagaatacatgcgccaattcccttccacaattacgccaaagcctataggccttgccactgaggcgactagagaaactggcatggtgatcacaaacagcttgaatcttgttgaaacactcgtggatgtggatcactggaaggaaatgttcccctgcatgatatccagggcagc

SEQ ID NO: 12359 - DNA, 823 bp, Pinus taeda
  Predicted polypeptide sequence is orthologous to G386, G707
cggccgggattctatcctaaggcaggaaaacgaaaagcttcggtcagagaacttgtcaatcagagatgccatgagaaatcccatctgcacaaactgtggaggacctgctgttctgggcgagatgtcctttgaagagcagcaacttcgcattgagaatgcccgcttaaaagaagagctggatcgattgtgtgcactagcagggaagttctttggcagacccattccttcaatgccatctgttccccttatgcctaaatcatccctagccatctatgtaaaaatccatttattacacccaaagttctatctttctatcgcttcaccaagagacagtccatacgtatacgctggtctggatttaatacaaatgcacataatattactggacgttcaagggctccaagatgcaatgtttcaattggcaaagttgagagcgtagcagatgggtcaatgggtttgcaaaccaggcctcccccagcagaaacttgtaggacactgatggagctgtccttagaaggcactctttgtacattaactcaagatgggtggcctttcggcgatgctgtcgagtttgcagttgatgctcaagggatgcctgtgctctgcttggatcctctgtcaatgcattctcagcatgtatcgcttcataaactctgtagtttgcatgtgaagttggagctgcctggatgtagaaagtcacaatgcactctgatgggcactctttcgaagccagaagacaggatactcaagcagaagctgcaatcaatatgggctaggagatttggtgaagtaaatgaagatcatttatatgtaatagctgtgg

SEQ ID NO: 12360 - DNA, 837 bp, Pinus taeda
  Predicted polypeptide sequence is orthologous to G386, G707
cggccgggtcagcgaatgacgactgacttctgtactagtctgagtccatcaatggttaacaactgggcaacgttatctggtgatgttgatgaggatattcgagtgtccacacggaagaacatggagaaccctgagttgcctggccgtgttgtgctctgtgctgccacttcagtctggcttcccgttactcctcagaaatcgttcgatttcctgcgagatctgaatcgtcgaagccagtgggatatgctctctaccggcgaaacaaagcaagaaatgacccgcattgtgagggggcaagatcgtcggaacagtattagcctcctcgcatcaaatggtatcaatatggatcagactgcattcattttacaggagtgctgtacagatgcttgggggtctattattgtttatgctccttttgacattgcctccatgcatacagtgatgcagggaggtgaatctgattatgtttctgttttgccatctggctttgtgattctcccagatggccttggtggtacactgactgaaactgaaagtagctcaagtagtatgcagaaaaggggatctattctgacagttgcattccaaatattgttagccaatatgacaacaccccggcctgccatggaagatgtgcaagcggtgcaacgattgatctcctacacagtacaaaaaatcagaacagcgttgattttggacgatgcttgacagaatctattctattcttactagttctcaattttgaagtgatccgtatttcattttttccttatttatctgttccaatctagactacctgcaaaggatcagccactacctgcaaacgatatcaaagat

SEQ ID NO: 12361 - DNA, 371 bp, Pinus taeda
  misc_feature (51)..(51): n is a, c, g, or t
  misc_feature (63)..(64): n is a, c, g, or t
  misc_feature (190)..(191): n is a, c, g, or t
  Predicted polypeptide sequence is orthologous to G390, G391, G438
agggctatgcttatctgccctctggaatatgcatttctagtatgggcaggnctgtttcatatnntcgagctatagcgtggaaggtacttaatgatgaagacgttattcattgcatagctttcatgttcttgaattggtcttttgtgtgaccagttttgggatgtaaattcaatagaaaagtcatgttggnntcttatcatccaaacaaatgggtttactgccttttgaagcgtttgtaactttaagttttatgccagctggacagaacaacccttctaaaagattttaaaagctctaatggatcatgtaagcagcatcttgtggatgcattttctttaattgaaggacagacgcttagttactgaggccta

SEQ ID NO: 12362 - DNA, 533 bp, Pinus taeda
  misc_feature (276)..(276): n is a, c, g, or t
  misc_feature (385)..(386): n is a, c, g, or t
  misc_feature (433)..(434): n is a, c, g, or t
  misc_feature (436)..(436): n is a, c, g, or t
  misc_feature (471)..(474): n is a, c, g, or t
  misc_feature (479)..(479): n is a, c, g, or t
  misc_feature (481)..(482): n is a, c, g, or t
  misc_feature (487)..(490): n is a, c, g, or t
  misc_feature (497)..(499): n is a, c, g, or t
  Predicted polypeptide sequence is orthologous to G390, G391, G438
gaatcatccactgtacttgcccaaaaggttacaatgtcggccttacgccatttgcgtcaaatagcacaagaggtatcttctgatgtggtccttggctggggaagacaacccgctgcattacggacatttagccagagattgtgcaagggtttcaatgaggcagttaatggcttcacagatgatggatggtctttgatgggtaacgacggaatggaggatgtaactattctcgtcaattcatctccaagcaaactgttcggtcaacagtttgcttcntccgatgggcttcctgctcttggtgggggcatcctatgtgccaaggcttctatgctattacagaatgttcctccagcattgcttgttcgtttcttgcgagaacatcgannagaatgggcagatagtaatattgatgcctattcagcagcctcttggnngncaagcccttgtactgttccatcctcacgaattggnnnntttgnanntggcnnnntcatccnnncattagcccatactgtggaacatgaagagttttt

SEQ ID NO: 12363 - DNA, 557 bp, Pinus taeda
  misc_feature (34)..(35): n is a, c, g, or t
  misc_feature (354)..(354): n is a, c, g, or t
  misc_feature (373)..(374): n is a, c, g, or t
  misc_feature (455)..(457): n is a, c, g, or t
  misc_feature (499)..(503): n is a, c, g, or t
  misc_feature (520)..(521): n is a, c, g, or t
  misc_feature (529)..(530): n is a, c, g, or t
  misc_feature (549)..(549): n is a, c, g, or t
  misc_feature (551)..(551): n is a, c, g, or t
  misc_feature (553)..(554): n is a, c, g, or t
  Predicted polypeptide sequence is orthologous to G390, G391, G438
ttcaaagctaaagagctgctgtcgattgggtccnnatgcctgggatgaagcctggtccggattcgattggtattgtagctatttcgaatacttgtaatggagtagctgcacgtgcttgcggtcttgtaggattagatcctacaaaggttgcagagattcttaaagatcgcccatcttggcttcgtgattgtcgttgccttgatgtcttgactgcgtttcctactggaaatggtggaacaatcgagcttttatacatgcagacatatgcggccactactttagcttctgctagagacttctggactctgagatacacaacagtgttggaagatggcagtcttgtggtttgtgaanggtccttgagtggtactcnnggtggtgcaagcataccgccagtgcaacattttgtgagagcagaaatgcttcccagtggatatttgatacaaccttgcgannntggtggttccataatccgaattgttgatcacatggatctagnnnnntggagtgtgccctgagnnttgcgacnnctatatgaatcgtccactntncnngcc

SEQ ID NO: 12364 - DNA, 859 bp, Pinus taeda
  misc_feature (737)..(737): n is a, c, g, or t
  Predicted polypeptide sequence is orthologous to G390, G391, G438
agggtccttggaagtgataaaattggagagcactggagaagttccaacattaaatcaaatgaaacatttatccttcagctatttaatggcataagtgggacaactgccagtgggtgggcacagcttgtgtttgcaccagttgatgcatcattatttgatgagcttcctttactcccatcaggttttcgtattataactatcaataattacaaggatcagtgctgtctctcccgaacattagatttgacctcacatttagagggtggatctgaaggctgtcgatttcatacagctggagatcctgatgttttatgttattcatcagtattaactgtagcatttcaattcaagtatgaggctcaaatacgggatcttgttatagtaaaggcacaccattacgctcaaagggttcttgaatttattagaaaatttttatttccaaccatgcctgcttgtgaaacttcacagaaagggagaaatccatctgtttgcagtttggaatctaaaatattggtttatcacattgtacagaaatatagaaatttctttggtatggacctgttcaaaacagagacagctgtaaatgctgatattttattcaaagccttctggaaccacaaggatgcaataatctgttgtacttccaagcatatcccggaatatgtttttgcaaatcaggcaggtctagacatgctggaaacaactgcggcatctttgccaggacttccatggctcanaacagttcccgaaaatgagaaacaggctgcttacaaagacttgcttcaagtcctgcaacaggaatactcctacatgccagcaggtattcggatctctagtaatggaagacctgttgcttatg

SEQ ID NO: 12365 - DNA, 840 bp, Pinus taeda
  Predicted polypeptide sequence is orthologous to G390, G391, G438
atggtgccaaagtagtttcagtacagactcactggcttcacaatcagctcgaaacaggtccacccctatgtggagtctgtagctctgacaaatccaacgggcaagagtaagtgcttctggagtcccaggaggtggccttgggccaacatgtgaattcagtcgagaaggagctattgccatggcaaccctctggacagatgctacaacactacgcacatattgacgagccatagctgccacattttctcgcaagtggctctcataagtaaactggaatgcaatagtcaacacagatctcagattcgagctggtgccagagtcaccagacgttctagttccagttgatccaacctcaagagcagaagccaagtccaatgtgcggttgggacccccagatccatctgttcttgattccaaaggaataaccctgaacccagaaggaagcaaaggagcatcatcagcaaaggattcatcaattggtgcaaaaacaagttcagcacatgctccagctgcattttcatcaattccgctgcaaagctgtaagagaaacatatctctggacaggacagcttcctcctgagtaaggccatgaccttccagcttaatgacctctaagaactcctcatgttccacagtatgtgctaagggaaggatgacttgactccctgaaaagccccctgctcttgatcctggaacactataaggacttgattttaaagcagctgcagaataggcatcaatgttggaatctgcccactctgatcggtgctcgcgcaagaaacgtacaagtaatgctggaggcacattctgtaagagcatggatgcctttgcacaaaggaa

SEQ ID NO: 12366 - DNA, 833 bp, Pinus taeda
  Predicted polypeptide sequence is orthologous to G390, G391, G438
gaaccatttacgggagaatgttgcatccatggctcgtcaatatgtgcgtggtgttgtagcatccgtgcagagggttgccatggccctagccccttctcgactgggttcacatcttgggccgaggctacctcctggcaccccagaagcacttacccttgcacgttgggtttgtcagagttacagattccatttgggagtagagcttcttagacctaattctgaggtcaatgaatctctgctgaaaacactttggcaccactctgatgccatcatgtgttgctccttgaagtcattgcctgttttcacctttgcgaatcaggcaggccttgacatgttagaaacaaccctggttgccttgcaagatatatcattagaaaagatacttgacgacaatggccgcaaaagcttttgctcagatattgctcaaattatgcaacagggatatgcctatctacctgctggagtgtgtgtttctagcatgggcaggcctgcttcctatgacagggctattgcttggaaggtcctcaatgatgaggaaaatccccattgcatagcattcatgtttatgaattggtcctttgtttgaccattatttttcattgtacaaattataccaagtccttgaagttaacttattgaacaaaatctctttctggtcaagccttgtgtgactggccaaagaaaaaatacagagggagagcatgtaagcagcatatttggttgctacatttttgcttttaatttgaaaaatgaattctgttggacaaggaagactccattttgttttcaaattttgataagagtagaagaaatgtctgttgagctcaaaagaa

SEQ ID NO: 12367 - DNA, 851 bp, Pinus taeda
  Predicted polypeptide sequence is orthologous to G394
gaggccattgataacatcatggctcccctgtgtattatcgatttcgtcaactggtttttacaatgagaacaaacccacagaaataacaagggaaaaaggtctgtaaaaagacgaccagatccgtccgtatgagctataacaatttttctcctaactatgattcccatccataagcatatacacatacttcactaaaacacaaacagcgctctctttctctctctatatatctctctgtaatcttcgatcccgcgacgtccgagtgcggattaatttactttagtttacagtcaaggcagatcctcaataaataaaccttgagggggcccctgagttgagtacagaacaccgatatacaattaattaattaacaggccgccgaagaatgcgtataagaatagaactgcggtttcgccaaagtgaaaggcggtggcctgctgttctccgccggaacaacccgttcacaggaggggcacatggtcagagttgccgctggcatctgcatatacagcggagacgccaatttcagagctcttaattcctgcaattctttctgcaatctcctgttctcgtctgttagcgattcgcagcatcttttcagaaattcgcagtccacttcagtttgcttcagctttgtccttgctcttctattctggaaccagacttcaacttgccgcgggcggagattcaaccttttggccaaggcttgcttttgcttaggattgagggagctgttctctttaaagctttcctccaaaagagccgattgctccttggacaatctgagtttcttcctggtgccgccctcctgatcagcttcttcatcgctaaccctagagcaagctctctcc

SEQ ID NO: 12368 - DNA, 728 bp, Pinus taeda
  Predicted polypeptide sequence is orthologous to G394
tgcagaagcataagtccgcgttggcatgcaagttaaacctgcaaccccgtcaagtggaagtgtggttccaaaatcggagagcaagaacaaagttgaaacgaaaggaagtggagtgcgataatctcaaacgctgttgcgagagcctgagggaggagaacagaagactgctgagagaagtacaggcactgagagcgatgaaaattgtgcaaggttcaggagaggaggatatatacgggcactcgccattggctgccaccaccctcacaatgtgtccgtcctgcgagcgccttgcgaccaagagcaagaccagcaccaccactgttgcctcgcagaccaaaacagtagctcctcgcctgatctctccatttccatgtaatcagtctgcggtttgctagggagaatacctgcgcctcatcttgttgttatccttctaatgtcatatcaatcaagctcgattttgcttttaattttgcttatcatcgaactgtggagctgtaaattatcgaaaatgaagagggtggtcatcggataagtatttaatgttttttaacagacagaagaattatggtttctatagttgagagtttccttatattaaaggaattaaattatttttttgtgaaactataggttatgtcatgacttccaacggctttgatgtaacagaatggtgttgtgtaaagtgtttcaaccatttatcaatataatttccattaagattgagaacc

SEQ ID NO: 12369 - DNA, 796 bp, Pinus taeda
  Predicted polypeptide sequence is orthologous to G409
ttttacaattcctttgaccaggaagaaactggagatgaagaccttgatgattgtatccatccaccggagaagaagagaaggctgactgctgaccaagtgcagttcctggaacgaagctttgaaatcgaaaacaagttggaacctgagcgcaagatacagctagccaaggagttgggcctccaacctaggcaagttgcagtctggtttcaaaaccggcgggcaaggtggaaaactaagcagttggaaagggattatgatattctgaaatcacgctatgagaatttgagagttgattatgatagcctgctcaaagaaaaggataaattaagggctgaggttaccttcctaacagacaagctacacgacagtgaccatgaagccctcacaaaggattctgagtctgctgacaagaaagtctatccccagcctgcctcccactctgactgtgttggggagcctgaaagaagtactgctgccaaggatacaccaccaggttgtaaacacgaagatcttctgagctctggaacagatagcagtggggtcctggatgaagatagtcctcaccatgttgactgtggtcattcatccttggaccatgtgaactctcatctttttgaagcagatcagtcagacctctcacatgctgaagaagaagaagaagaagaaggcatgagtgaaaaactgcttcctcagacatacgcatatcatctcctcaaaagtggaagacggtgcttacccagatgcttcaattgcgtacaatgacatgtttgttttggaggatcaagtacagcttccc

SEQ ID NO: 12370 - DNA, 783 bp, Pinus taeda
  Predicted polypeptide sequence is orthologous to G409
agcaactagtgagctatagcattgaagatcatcatagctcgggaacagatggaagtgctgtcgtagatgaggaaagccctcctcacattgatagtgggcattcttcggttgtactattgggctatagcactgaagaccctcttagctcgggaacagatggaagtgatgtcttagatgaggaaagccctcatcacattgatagtggacattcttcggttgtaggctatatcacctcaacccgtgtttcacacattgaaacagatcagtctgacttttctcatgttgatgaagaacgaggcatgagtgaaaagcttgtatttcctcaggactgtcataatctgaaaatggagtgtggacttttcccagaggcaccaacaacatcttgtaattatgtattttccatggatgattcatggtgggactggtcataagtagctaattttctatttagttcattttgtacgatctatctcatcacagcaaaatggtttaaacttaaagtagagatccactctccattacttgagaaagtagacttgacatggtaaggtttgtcctccaggttgtaaatgttctggagagtgggttctctgaagcttcctctatctatcaatggatttgccatgttgaacttgtttttggtttacatgttttgggaatagatatggcaaactattggagggacagcaactgaagggctgctctctttgatgaattttctaagacaaacagatctttgtactttttctgtaatgtaatctttgatcttctattaagttattt

SEQ ID NO: 12371 - DNA, 839 bp, Pinus taeda
  Predicted polypeptide sequence is orthologous to G409
gatggacaacaagcttgagccggagcgcaaaactcagttagctagagatttgggattgcagcctaggcaggttgcagtctggttccagaatcggcgtgccaggtggaagaccaagcaattggagagggaatacgacattctgaaatcaagctatgatactctcagggtggattatgataatttactcaaagaaaaagataaattgagatctgaggtcatttgcctgacagacaaactacatgccaaagagaaaggtttggaaatccaaacaaatgatttggagacaacttgtaaaaaagcattcatccaatccgattcccagtttgagagcttggagaaatctgggattgtttccgaaggcatgactgcttcttttgatcagcaactagtgagctatagcattgaagatcatcatagctcgggaacagatggaagtgctgtcgtagatgaggaaagccctcatcacattgatagtgggcattcttcggttgtactattgggctatagcactgaagaccctcttagctcgggaacagatggaagtgatgtcttagatgaggaaagccctcatcacattgatagtggacattcttcggttgtaggctatatcacctcaacccgtgtttcacacattgaaacagatcagtctgacttttctcatgttgatgaagaacgaggcatgagtgaaaagcttgtatttcctcaggactgtcataatctgaaaatggagtgtggacttttcccagaggcaccaacaacatcttgtaattatgtattttccatggatgattcatggtgggactggtcataagtagctaattttctatttagttcatttg

SEQ ID NO: 12372 - DNA, 724 bp, Pinus taeda
  Predicted polypeptide sequence is orthologous to G418
tccatcgtgattcaactcaattctctattgatcattgaaagggtgtacaagtcagtctcagtccattgtaattgaaattgtggaaaggatgtctgagaataaacaccagcaccaccatcatttcctccaccatcagaaggaggaggagagccagaacgccgccccagaagcgacgccgtacgagaaggcggtaaaggaggagaagcatcataaacaaatggagcatttaggggaactgggagcagtcgctgctggaacttttgcactgtacgagaaacataaagcaaagaaggatccagagaacgcgcacagacacaagattgaggaggagatcgcagcaacggctgcagtgggagcagggggctacgtcttccacgagcatcacaaaaagaaggaagccaaaaaggaagtgaaagatcaccacttctagccacgtaccaacgcaatttaaataatattcgttccttccctgaaagtaacgtgtcatgttgggcctgatttcagctttcttcgtttgttccaccgttctgtgatcctaataaaccctttgatgtgaataagtaataatacgatggagctgctgttattaatatatgaatggagcttctgattccaacagcaccatttaaaatgtacccattgttggggttaacgtgtagatcgtgtccggttccgctatggttgggatttgtataaattgtgggctttgtgtgttaataattgt

SEQ ID NO: 12373 - DNA, 879 bp, Pinus taeda
  Predicted polypeptide sequence is orthologous to G427
atacccactgagagtgaacgctctcttatggaacgggttagacaggagctcaaggtagacttgaagcagggatacagagccaaaattgcagatgtaagagaggagatcttgcgtaagcgcagagcgggaaagcttcctggtgacacaacttctcggttgaaggcttggtggcaatcacattctaaatggccttacccgactgaagatgagaaggcgagacttgtacaggaaacaggcctgcagctgaagcagatcaataactggtttatcaaccagcgcaaacgtaactggcagagtaatccttcctcatccaccactttaaaatcgaagcgcaagaggtgatgaggctttgataatacttacagtagtagatcaactcgttactcaccgtacaccatacgttattgcacaaacagttcactaactccgacttgagttaggcgccacgagtgcaaagatgtgtttgtgcttgttgtctaacagagtatttcttaaattaggagagaagcttatcagatttgcaagaggagagatggaagcatgggaaggcatagtcagtccaacagtgaaaattttgagttttagaacagagggctacagagcagaggagagaagttaaagttgagagtatctttacaccatatattaagttcactgcccacagaataatttggcaaatgccttgatggtcatcctcaatcataaagttactcgaagcgagctgctaaactaatgcatcctatacatagagcctgaagcttttaaggtccgacgcaacacatatgtttccctattttttttacatgcatatgtggaattgagagatgacccctaaaccaattccaacctttttctttatcaataagaaatgacagttcc

SEQ ID NO: 12374 - DNA, 750 bp, Pinus taeda
  Predicted polypeptide sequence is orthologous to G431
tcttccaacggttttccggcctctacccacttatggtctgccccctctcctcacatgagccgtccaaattccaatccggagagcgaacgtcattctgcgtcgaaatctgacgaccagctagacccatgggctttcccacagtactctcagtccagctcgctcactaatggaacgaagcattctgcgcccttgaatccctcctcttcacttcctacccctgctgctgccatggccgagcggccaaaaggaaaacggggaaaactgccgaaacccgtgacagactatctgaaggattggttacatcgtcattctgaccatccctatcccagcgaagacgagaaaaaacagttgtgtcaagcgactgggctcagtatgagccaggtgtccaattggatgatcaacgctcgccgtcgaattcttgcaccagcgcagcgcgcccaggctaacgcagccggttcctctagtctcttcaggtccccatcagcatcgaatccactcttatcggatccctcccttaatccgcaccatcgccatcacccaaacgcccaacaacatctccatccgtcttcctatcgccgagcttctgtccctgcctctgcgaccgatctccaaatctactaccccatgtccttacaatcgatacccactcctgcggcagccctccagatgtcacactcgctcccctcccaccaaaactcgtcgacgtcccaacccaggctttcttctgatatttccaacccttcatccggc

SEQ ID NO: 12375 - DNA, 848 bp, Pinus taeda
  misc_feature (114)..(114): n is a, c, g, or t
  Predicted polypeptide sequence is orthologous to G447
gaagttgcagtggctgtggaagcttgctgctgttgctgttgtggatagcttgcagcctgctgctggtaggctgcctggcttgcataatatgcagcccactgtgcttccagactntgctgtgtgttcccaacaacagctgtcgcttgtgcagtaccagatacaacttgagtggcattttgctgtggctgttgttgataataggctgtataagcttgttgctgagtaacatcctgtggctgcgctgttgaatagccagcaggattagttgcaggagctgcagcattcatcggcagttgtttctcctgggtctgctgctgttgagcgtaatggtccgtgtaggctggttgagaatactgactttgcacctgaggttgaggagtttgctggtactgctgaacgttgctttgagaagctgcctggttatatggctggctatactgttgtgacactggtgccccatattgttgaccatactgctgtgggtattgttgagcatagggatatggttgtggagcaattccctgttcctgttggatgggttgctgttgatagtatgaagttgtctgaggatactggccctgttgcagttgctgttgaggttgtacatagttttgtgctgtttgtgcataatactgtccatatggctgctgagaatgctgatactgtggttggagtgtagattgttgctgctgaggttgctgttgttgatatgattgttgtgtctgttgctgatatggttgctggtacccatactgtgaatccccttgcctgaacatgttatctgcagcctgctgaggctgatgctgataatattcctctgctcttgcctttgcttctcgtgcttttgc

SEQ ID NO: 12376 - DNA, 793 bp, Pinus taeda
  Predicted polypeptide sequence is orthologous to G447
cacctttcacaatctatttctgtttgtcaaatagagattgggcagatcaagataggttcccttgaggaatatggaggctttcaaagacagtctgcccaacagatgccatcaaatgcaaaggttgatgctcatcagcaggaaggaccctctttaccagcaaagcagcagcatgtgcagaaccattcttcccagcaactacatgtttttccacatcagtttgaacagaagaatcaaggtccaagtcataatgttgttaattcagagactgataataagtatcagcaacaatcgaagccaactaatgtagaaaaacaagcaattgagagagaacaactcaaggaagcctcaaattcttcatcgtatcagcagcaccgagtatcctcaggacagggccactggcaacaaactgcggccaactatggtgcaagtaatacaaggagaacagacagtcatgaacacccccgagccactgttgtccagagccgtaaacagcagggtactaccataccaagagcttcagagtcgtctcctggagctggacgacatgagagacaagatatgaacaatcagcaagcgccaatagagattccaaagagacacaatccacagggacattctcagccattctcaaatcaaaaacctcaggagttttatcaaccaaaggctggttcagtgtctggtgataatgaaaaacacgagataaggcataccactgcctcacgcagtggctcttcctggactggcgaccacagaaacaatcatcagtatcgtgatagagatcataatagtgaga

SEQ ID NO: 12377 - DNA, 1231 bp, Pinus taeda
  Predicted polypeptide sequence is orthologous to G450, G456
caatagagctgcgcagattaatcatgtcttgcagtgttggaggcatggagaaatcaagtacgggcgcacagcaggagaataaatgcagtttggatattttcgcagagaccgagctcaggctcggactcccaggggtagctgcaggagaacggcagaggatctgtggaaaaagaagtttttcggaggccatggaatccagaaattttagcattccacaggaggaggctcataaattccatgaacccaatttaggcacagaaaaacaaatggtccgtcctgccaatgatcctccaaaaatgggaccaactcctcccaaggcacagattgttggctggccacctgtcaaagatttcaggaaagtcagaacaattgctgcatccagctctctttatgtgaaagtgagcatggatggagctccctatctcagaaaggtggacctcaaaatgtacagcacctatcatgacctctcctctgcactcgagaacatgttcggctgcttaattaccatgggcaagtgtggatccagtgggatcaaggagagcaatttgatggatgtggtgaatggatcagaatatgtggctacttatgaagataaagatggagattggatgcttgtaggcgatgtcccatggcagatgtttgttgattcctgccaaagagtgcggatcatgaaggcttcagaagctattggtttagctcctcgggccatggaaaaatgaaaaaaccaggaattaacaggaattacagaccacccataacgatttagactctatccacatacatgattattggagttattgatttttgggaggctaaattgttctcaaactaattgtaacgtggtgcaatatgcacgtggtgagctggctgctcttaggttattgattgagatggaatatgattgttcatccacgatggctcaagatccgctgtatcagaaaactattttcagttattttttataaatggtccgattgttttaaatgttttcctataatcctttgacatagcgataaaggaaaaattctacatgcactttccaggatttgataattctcctgaaatattatttttgaaaggtctcacccctctctgtatatatgatttgtgtgatgagaaaaatgtttgacacccaaaagaattttaaattctataatgtagatcactgtgaaaaaattggaattgacgagccggaaattttgtgactccgcaaaattgaagcactgttttc

SEQ ID NO: 12378 - DNA, 1236 bp, Pinus taeda
  Predicted polypeptide sequence is orthologous to G450, G456
gcacgagatcttttacaagtattcttcctttttctcctcttttggggttgtttcaatcttgggctctgatatcttcagaggaaggactaggactttttcgttacaggttgtgcagaatcaacatgtcttgcagtgttggaaacatggccatggtcctggagaaatctggtgggaacgcgcagcatgagaagagagatagtttagatttcgcggagactgaactgaagcttggactcccaggagtagctgcaggggcacgccagaggatctgtggcaaaagaagcttctcggaggccatggagtccagaaattataccattccagatgaagacattacaaataccagcacacatgaggaccttgataaattcaagggacccatagtcaaagaaaaacaaatggccctttcagccaatgaccctccaagaatgggacctccacctccttccaaggcacaggttgttggatggccacctgtcagagatttcaggaaagtgagaacagttgctgcatccaattctctgtatgtgaaggtgagcatggatggagctccttatctcagaaaggtggacctcaaattgtacagcacctaccacgaactcacctctgcactagagaagatgttcagctgcttaattatcatgggcaagtgtggatcccttgcgttgaacgagagcaatttaatggatttgcccaatggatcagaatatgtgcctacttatgaagataaggatggagattggatgcttataggcgatgtcccatggcagatgtttgttgattcctgccaaagaatgcggatcatgacggcttcggaagctattggtttagcgccaaggaccatggaaaattgtaaaaacaggaatagagtccacccataatgttctttgttcagtgaatctggaacctgattattcatgatatttttttgacttttgaggagggcatattcaatcagcctctatctaacgcatgtgttagaaattacgatagtcgatccaataccctgcatgggatcggatggtcgctgactgttttaattggagaagttaccagcttgggggcgatcgcgcctccgtctgcggaatcccgactaatctatcctatggatttatagaactggcattttcagaagctatgtgtagtaaacaaatatggtggtcaggcaaatacagtttggaggacccagaaatttcactgtaaatgattattggaatgattgattatttagaatct

SEQ ID NO: 12379 - DNA, 1209 bp, Pinus taeda
  misc_feature (1129)..(1129): n is a, c, g, or t
  Predicted polypeptide sequence is orthologous to G450, G456
agattcattcagaggaaggactttacattacagttgtgcagattaatcatgtctgccagtgttggaggcatggagaaatctggtacgagcgcacagcaggagaataaccgcagtttggattttgcagagactgagctcaagcttgggctcccaggcgtagctacaggggaacgccagaggatctgtggaaaaagaagcttttcggaggccagggaatccagaaaatttagcattccacatgaggaggctcataaattccacgaacccaatttaggcacagaaaaacaaatggtccgtcctgccaatgatcctccaaaaatgggacctcctcctcctcgcaaggcacagattgttggctggccacctgtcaaagatttcaggaaagtcagaacaattgctgcatccagctctctgtatgtgaaagtgagcatggatggagccccctatctcagaaaggtggacctcaaaatgtatagcacctaccatgacctctcctctgcactcgagaacatgttcggctgcttaattaccatgggcaaatctggatcccatgcgctgaacgagagcaatttgttcgatgtgcggaatgggtcagaatatgtgcctacctatgaagacaaggatggagactggatgcttgtaggcgatgtcccctgggatatgtttgttgattcctgccaaagaatgaggataatgaaggcttgagaagctattggtttagctccaagggccatggaaaatgcaaaaacgggaattacattcagtgaatgtggaatctcacgagggttgaatggtagttctttgatgtgcgtggtcggcatatttgatcagccagttgctaaggcatggattagaaattacgatggtattggttggtccaatcggcggccgtggtatcggagggtctggtccgactgactgtttcaaacgaagaagttcgtgtaagggggacaacattactgataatatctcaattgtacaaaaaggtgaacacgctctctccaaaacatggatcaaatattttggttttaaagaatctgcccttctcctcaacttctgtgcagtatgtgtacaaatttatcaaatacaaagctaatgggtacgggaattccactgtgtaaatctgaanaatttttgacaaattttatgtcaaactaattgtaacctgttccgcaatatgtacgcgttgagcaacacgctaattttgtt

SEQ ID NO: 12380 - DNA, 772 bp, Pinus taeda
  Predicted polypeptide sequence is orthologous to G450, G456
aacaccgtcttcacgatgaatctgtaatcttatatacattacaattgagcaatgtttcgtatccatgacaagcagctcttgagctacagaaatgaatatacccaagtgtcattatgccaaatagcaaattacagttttacagttcaagggctaacgttgcctttcagaacgatagaatttaagagaagttaacatgttgaatccttaacccactgtcataagcctgcactgggatgaggctggtcttccattattcaatacttgttgagacagaaatccagatttttggtttgagattaataaatcaacaagtgaatcctacctaagaatgtatcagaaacagaaagattgccaggatggttcccaaatcttccagttcaatagcagatccattgtgtcttgcttatattgccttcgtttcagcgaaatcaccaatttctgaggttttcaaagtcacaagataaaaattttggacgccgtgattttccctaatgctccaatcttgtcagacgacgttctatttgaatcaatcgaaatgcaaagcagcttccagagaatgggtcatacgtgaaccctaaatcttgtttttacatttctccatggacctagctaaaccaatagcttccgagaccttcatgatacgcattcttttgcaggaatcaacaaacatctcccatggaacatcaccaagaagcatccaatctccatctttatcttcataggtaggaacatattctgacccattcagcagatccatcactttcttctcgtt

SEQ ID NO: 12381 - DNA, 876 bp, Pinus taeda
  Predicted polypeptide sequence is orthologous to G464
ggagattccatgtttgtgaaggtgaacatggatggtgtgcccattgggagaaagatcgatctcaaagcctatgatagctacgataaattgtcccaagctcttgaagaaatgttcaaacgtttcatcaatgtgcagggcagtgggcagagacaacctaccaatccatcgtctaaaaatgatcagcctactctattaagtggaaccgattatgttctcacttatgaagataatgaaggggatcgtatgctggttggagatgtaccttgggacatgtttgtgagtacagtgaagaggctgcgtatcatgaagagctcagaagcacggggattagcaccgaggcatcctctgaagccacagggtcaagtgacccagtgactaatgattgaaagctccagtaaagggatcccaaatggaggagatcccattagcagcactgaaggttggggtgggttaaagtgtgcgggaaggtaggcaagttttcatcaggaattgaagagttttttcttgatggtggggtgtaaaatacgatttgaatataatgtcagtaagagtatccagagaggtattctcttgcatgcatcatgacttaatggttgtgttgtattatttcggcagttttcttcaaaggcatacaagaaatgcctgtcttctcccttgggatgtgctggaggcattgccttgtgactccaagcacattccggatattgcgtggcttctttctctgaaacatgaacatagactaggtttttttcttcctttttctattttgttaactgacatggggaatgtttcccatctctgtactttgaggaactgacctcatgttgtttgtatatttatttgtatgaactattaaaatatggttgaagttcagaa

SEQ ID NO: 12382 - DNA, 857 bp, Pinus taeda
  Predicted polypeptide sequence is orthologous to G464
gactcaggagtccgatggaagcctgggagatgcagagctcaacttgggcttgagtctttcttacaagaaagagccccttaatgccgcagcaggcttcaatggctcagagaaagcctttcagaaatgggtttctcacgaggagtatcagaggcctcgtagcacaagtgggtctcagcagggtgtgcgggctaaggcgggattcgaacatcggatctctcaggagaaaggggcttcttcttcctctatgtttgcaggggttcaggtgttgaggagctgggaaggtgcaaggactcttactgcagaagatctgcaggctcctcttgctccccacactgctgttgttcatgacgttggtgagcgtgtcaggcctggttatgggttctctaactctggtagagttatcatgcctcctccaactgctgcccctgctgctatttctggaacaaagagaatacacaatgagtccgatggctctgatggaatccaggacagctctgaggtttcaaaaggtcaagcagtagtggggtggccaccgattgggacatacagatcaaaaacccgtgctactactcagcctcggtcccccttgtatgtcaagatgaacatggatggtgtgcctattggtagaaaagtcgatctgaatgctcatgacagttatgaaactcttgctctggccttggaagatatgtttcaacggcccaacaatggcaaaggccaaagtggatctcacataccgatggaaagagggcatgttggtgccaatgatcccaagcatccaagcttttggacagctcttcggactttgtattgacctacgaggacaaggagcgagattggatgcttgttggtgatgtccc

SEQ ID NO: 12383 - DNA, 903 bp, Pinus taeda
  Predicted polypeptide sequence is orthologous to G470
attttgaacctcgagtatggccaaaatggatatgccagcagcaattactgatgaagaaaaaagttctcaaaaatcatccaaagaaactcatagcagacctcaaactaactcgacaaggagttgcacaaaggtccacaaacagggtagtgctcttggtagggctgtggatcttactaaatttgaagggtatacggaactcattcgtgaactagaacagatgtttaacattgaaggagaacttgaggatccaagcaaaggttggcaggttgtatacactgacaatgaaggggatatgatgcttgttggagatgatccatggcaagagttctgtagcattgtgcggaaaatttacatttatacgcgtgaagaggttgaaaaaatgaccccacaaacccccagtgcgaagctcaagggatgttcagaagagcctgtcacaagagaaacttcccggagttctgatcgtcaagattcatcaattgctggggtcaccgctgaaaggagttctgatgcctgataccatttcaatctgcatgttggtcacttctgtcgggcctgctaaaggggcatcaaagggcatgttttagttggccgtttgatgcttgggaccagcagcgcagttgaatgagaaccttgtaagaatgtacttgatatgtaatgtattttcatttcatctgcttagtttcaacgtccagcctaaatgttgaaggcaatcgtggtgcagttagtaaggcttgttttacaatttgacaagcttataggattagacagtttagttatctgcaatttgccttgtgtacgagtttcattttcttaaatgcctagactgaaggatatattataatcccaattttggaggtcttgtcgttgatctggatcttaacagaaaatgtgtcaagcattttc

SEQ ID NO: 12384 - DNA, 596 bp, Pinus taeda
  Predicted polypeptide sequence is orthologous to G470
accttgaggcatctccactttgaattcggccagttcacaggatcagcatcacttattccaacaatggttccagtaaatctttgctctgggacttcttccccctcaaacttcatcttgaatctcattccaaccgagaaattgattttcattgactccatatattgatcataaggaattatgaactctgatgggcttgtccttggtttataatagacactaaacatggtcttcgttgtaactgcatgtgatgcagttgcaatgacaccaagatgcatgctgtgactggatataacagatgatggaacattgttttgctggcgcatggcacgcctaactcccacacgcagttcaccattttcacccctcaaaaagataaatgcatctcctgccacaagtcttttagagctaacaaagacactccagccagtggtaagcaaatgcctccttggctgaccgcgaaagatatgtcggaaccgccattcaactccatgcaagtccttggccaccagatcttgagatggaggttgctgactcatatccagaggtggaagacattcatcagcatgtctcctgagaacagaaaaccctccatgggt

SEQ ID NO: 12385 - DNA, 741 bp, Pinus taeda
  Predicted polypeptide sequence is orthologous to G470
agtgatgtcctaccgccgcggcatgccagctacatcgctggagggctgttgccacctatggtctgtaattatgatgtaccagagatctgtgatctaatgcccaattcggtatggtgcattcaatctctcaatttatgcagcgtttgccccgatattgagccaacccctctagtatttcaggaccttttgattcactgcattgggtatttgttctaggtctgtaactattctttgttttctcctgagggttcacgtgagcggtttgatgctgccatacctgaagcaaagaatggaagggcatacaaatcccaggaagcgccgcaagttaacgtcatcgtgggacgtccttccatcacagtttcagattttggtattagaagtacgacagagcgctctggttcagacaatagtcagtctacgtcttccaatataaagcccaaggaagagggctctcgcactggctcaccaccatggcaacaacgaaaagaatggcaactacatgttcgaacttggagagaatttgacgcctcgatatgtcagtgaatctcttctttatgaagagctatggcatgcatgtgctggtccacttgttactttgcctcgtattggggagagagcttttcactttcctcaaggctacatagagcaggttgatgcatcaacaaacccaaggggttgataagcatatgccactgtataatataccttctaagattctttgccatgtgatcgatgtgcaat

SEQ ID NO: 12386 - DNA, 792 bp, Pinus taeda
  Predicted polypeptide sequence is orthologous to G478
actgtttatggtttggatgaagaatctgttaatctggatgcaaatgtcaaagctgtgactggtgtatagtttcgccctctctagtcttcatctggaaatgcagaccagcagggggcataatcgtccatgtatgtcgtctcacaatacagatcggccaaaacctagaaatttaaggatgacctcagagtttgtagaaggatcacttgagtctgcctcttctcgaaattcttcagcacttttggattccccgagattatactggcaagatcagttcgttgatccttgttcaatgtggacccttgggtacagtagcgaccatacaacccttgagcaacccagcggagtaatagagaagagaggcaagctagtgcatggctgctacttcatgaaggaggagaagggtttgttcccggccagaatggagctgaactattctgggcctggatcaactgcatattccggcggcgcttcagaagggacctgccatggaaacacattttgcaggacagaaatttcatcattcacaggctcacagataccccagtgccagtccgagggttgcaaagcaaacttgagcagtgccaaacactaccatcgccgacataaagtttgcgaattccactctaaggcccctacggtcgttgttggcggtcagattcagcggttttgccaacagtgtagtagatttcatccgacatctgaatttgacggtggaaaacggagctgcagaaagcgccttgctgaccacaacagacgccggcggaaacctaaaccgagtcaatgtactacatc

SEQ ID NO: 12387 - DNA, 864 bp, Pinus taeda
  Predicted polypeptide sequence is orthologous to G483
cagcaatcctggaggcaacacatgtttgtgcaaaattgtggcgcaaatgcaacgttttttcagtctccgcagattctgcccaccatccctcatggaatgtttcagcagcctccgacttcttcgaatgctcatgcttctgctttatcattatccgcccatcataatcaattgggctaccaccaccagaagcagcagcagcaggaagttgagatttgctgggccaaccagctgcagggaattgaggaagctgttgaattcagaaatcacagcttccccctggcgagaatcaagaaaataatgaagtcagatgagcatgtgaggatgatatctgcggaggctccggtggtgtttgccaaggcgtgcgagatgttcatcaatgaacttactctcagggcctggagtcacactggagaaaccaagagacggaccctacagaagaacgatatagttgaggcaataaatggggctgacatgttcgattttctgatcgataattttcctagggacgacttgaaggaggatcaacttactaatcttgcaacccctgcatcttctatctcagttggaagttgcagttctaacgctggtggtgttaattctttcccctattattatttacccaaccatcattctgcacctcatggggtgattgttgggaaacccgtggatcctgctatttatatgcagcagtcaggggcttctgtgggctatgtgcagaatatgttgcagcggggatttatgtatacagaaaaatcgaggtcacccaattctggttaagagcatggcctgatcatgacttggttcgttgctgcatgttccgtttttctaaaatcataattggcagcttgatttgtagctgctagc

SEQ ID NO: 12388 - DNA, 976 bp, Pinus taeda
  Predicted polypeptide sequence is orthologous to G483
acaaagagatcagaattgaggtgagaagagcaggcaatctctgatcagaagaattgggtacttggaatcgatggatcagcagcagcccacaataccagcactacctcaagtgggttatggcacaaatccatatatagcccctccgattgggggtcctccacacccacaattagcatcataccatcaacagcttcaggccttctggggtaaccagatgagggaggttgagcaggcgcaggacttcaagacccacagcctgcctctggccagaattaagaagatcatgaaggcagacgaggatgtgaagatgatctctgcagaggcaccggtggtgtttgccaaggcatgcgagatgttcatactggaactgaccttgaggtcatggattcatacagaggagaacaagagaagaactttgcagaagaatgacatagctgcagccattggtaggaccgatatatttgatttccttgttgatattgtgcctagagatgaattcaaggatgaggggttggtgatccctagggctgcgggtgccgtgcccttcatgggtcctggggataacgtgccatcttattactatgttgcacagcaagctcccaacatggcggcttatgctcctcctactcagcaaatgaggtccaaagcacccgcacctcctcctcatggcagcagttgagggtcctttgaggacataactaggtactaacaaagcatcttcagtggggaactaccagagattgaagctttctagagtggatttcacgcgataaagttctgtgtttgttagtgccaatatcactggactgattaatatgaaatcaacaaggctatgagaaaatgtatgtgactttgtggtgcttttctgttatttctgcattgtaataaattaataatgcagattgtgagcttgaataaacagttttttctatgtatcgttgtatttaataccatagaggaatacttttgtgccaaa

SEQ ID NO: 12389 - DNA, 828 bp, Pinus taeda
  Predicted polypeptide sequence is orthologous to G483
ggccgaaaggccaaagatgctaatggtgctatctgtgcatttacgtgagtcaagagctagagcttctcccagtgctccaagatcattgaagattctatgaagccaccaaattttcggtctttactttctcgtgctaaacaaattttcacctccctcaattcagtcatttaacattggatccgatatcggagaaatatctgtaatattctccagttttaaaccaagatcccatgattcatgctgtaacctaatgcagtttaaagacccacaaaaaatccgtatgtgggatacaaagccctgttatttgctaagcccatctgaagtgcagaatttaacacccacaagaatccgtatgtgggatacaaatccctgttatttgctatacgctttctctatgtatgaagttctgtaggtcaggcacctacgtatgcacatattccattgtcatcgggtataaaatactgtgttgctgcccaaaatcggtctcattcatctcgaggaagaggtactaaggttaactgcatctgtaaggagcttttagggttgtgatatctatcgtttcacttcaatggaaggcaactacccacatcttcaaagctcagcaacaccacctgtttctcatggaccatcaagcttgatgcacaattcgctcttccagcaacagcagccacagatgcctctgcaacatcatcagcagcagctacagggggttaatgcagcctcatctccattacatgcagatccagaaacagcagctgcagatgttttggcaacagcagatgcaagagatggaacaagttgcagagtttaagcagcatcaacttcctc

SEQ ID NO: 12390 - DNA, 886 bp, Pinus taeda
  Predicted polypeptide sequence is orthologous to G484, G2631
cggccgggggcggttaaaagaagtcacgaactacaagcgatagtccactcgttttgatgtagtgccagagatcgactcagatagattccgatgttttgggtttctgtttttaaccttggaaggttcaattttacagtttctacgggaattctcatattcaatctgtttggcagattgaactaaagatttttgtccgggggatttttggattaaattcaaggtcgacgaacgtgaggtgctagggcttttagagtttggatggaacccatggacatcgttggcaagtccaaggatgacgtctcgcttcccaaagcaaccatgtttaaaattataaaagagatgctgcctccagatgttcgtgttgcaagagatgctcaggacctactggtcgagtgttgtgtggagtttatcaatctaatatcttcagaatccaatgaagtttgtggcagagaggaaaaacgaacaattgcacctgagcatgtgctgagagccttggaggtgttgggctttggggattatattgaagaggtctatgctgcatatgaacaacacagacttgaaacattggactctccaaaatctggccgatgggctagtggggcagaaatgactgaagaggaagcactcgctgaacaacaaaggatgtttgctgaggcccgtgcacgtatgaataatggcaatgcaaatccgcctaggcagtcagactcagattaaatagtttcagaccttgtcttctaacatcagtgaatggctattatagtcattgatgtattatattttagtcttggaagcaccacttgtattgtcatgcaatcaagattagttttactagctttttacatagagactaaaactaagatacaagatttactgattatgctattca

SEQ ID NO: 12391 - DNA, 891 bp, Pinus taeda
  Predicted polypeptide sequence is orthologous to G489, G714
ttatgggggttgtcagtggtccacctcagatgccctatggtacagctccttatcaaacagctcagttggttgcaccggttgctccagcctctgttgttggaactgttcagtctcctggccagcctgcatctgcatatcctgcaactgctgctcagctagctgcacaacatcagctggcttaccaacatcttcatcagcaacaacaacagcagcaacagcaacagctacagattttttgggccaatcagatgcatgatatagaacagacatcagacttcaagaaccatagtttgccgttggctagaatcaagaaaattatgaaggcagatgaagatgtgaggatgatttcagctgaggcgcctgtgatttttgcaaaagcttgtgaaatgttcattttggagcttaccctgcgctcatggattcatacagaagaaaataagcgacgcactttacagaagaatgacattgcagctgccataactagaacagatatctttgatttcctcgtggatattgtaccaagagatgagttgaaggaggagggtcttggcattcccagaggacctgtacctgttggaaccccagccgaagctataccatattattatgtccctcagcagcatccagcagcacaggttgcacctcctggaatgattgttggcaagccagtggatcctgcaatgtatgctcaacaaccccgccctcctgttgcttatatgccgcagcagatgtggccacaacaacaaatgccagagcagtccaggggcccatcctctagcagttaggtgctttgagttgttttctgttgccagcaacaggtagatggtaagaaggaaaattgacaaagccctattttgataatgttgaaaggcatttgctcaagttcactct

SEQ ID NO: 12392 - DNA, 891 bp, Pinus taeda
  Predicted polypeptide sequence is orthologous to G489, G714
gggcagcgcccttttggtgcttagcagcgatttgaaacacgaatttgccatttgttgaagagtcgaagagattttcgactggttggagttcctaagttttggaaaatatggataagcaatccacaatgcaacacatgccgattcggtacgatgtaacgccttatcaggctgcgcagaatctggcccctgttgctcgtggaacgtttccacagcaccagacttcttcatatgttcaagcagctcacgctttccctcagtctgcccatcataatcagttggcctaccagcaccaacttcaccaacaccaacagcagcaactccaccaccaccagaagcagcaggttgattttttctggggcaaccagatgcagggaatcgagcaatctgtggatttcagaaatcacagcctccctctggcgagaatcaagaagataatgaagtcagatgaggatgtcaggatgatatctgcagaagctccggtggtttttgccaaagcctgcgagatgttcatcaatgaacttactctcagggcctggtttcacactgaagaaaacaagagacggaccctgcagaagaacgatatagctgcggccatagctaggactgatattttcgattttctggtcgatattgtgccgagggatgagttgaaggaggatcaggttatcaatcttggaacccctacagcttctctctcagttggaagcagcagttctaacgctggtggtgctaattctttccctttttattatctacccaaccagcattctgcgccacgtggagtcgttgttgggaaacctatggatcccgctatttatatgcaacagccacggtctcctgtggcctatatgcacaatatgttgcagcggggatacatgcacacagacgaat

SEQ ID NO: 12393 - DNA, 893 bp, Pinus taeda
  Predicted polypeptide sequence is orthologous to G502, G519
gcatcaagaaggctcttgtcttctatgctggaaaagcacccaaacgttcaaagaccaattggatcatgcatgaataccgtcttgctgttgttagcaggcctgcaagaaagaaaggcagcttaagactggatgattgggttctctgtcgaatttacaacattttgacaagtgctgagaagttagcactagatcagaatgaaagctacatggatgtaccaatggaagccatcgatgaaattgagatggtgaatcaaccctcctcaacttcaatcgagcatagcggtattgaacagaacgggccatcttctgaccttttgaacaaatcgggaccatctccaacaagccacaacggggttccacctcgtgctctgcccatgaatactaataatatcagttcgccgaacctggacttcttccaaaagacaatcaccccttccagtgccggtacccctaaagctccagtgcagaatacagaattcaacccaatttcctcctccatcaaccagcaatggataaattacaattcaatagacttattgtcaggattgcatactgattccaacagttccaagccatcatcatcatcaaaccccattttagagaaagaagaagttcagagcagcttaagattggaaacttcttcaccagaggagcaaaagccattctttaatttcagtctggaaggtctagaataccccttctctcatctagaccaaataactcttcctgatccttatcaagactactttacaagttggaccggttcagacctaccaaggttttatgctaacgacatgcgcttctgttgagtagtttgaccagttcaaacctaccaagttttttccctaacaacatgcacttggtcatgaacttacagcaaggcttattggccc

SEQ ID NO: 12394 - DNA, 825 bp, Pinus taeda
  Predicted polypeptide sequence is orthologous to G502, G519
gatcagactgagattggttccaagaagaagagagtgaaatagagtgaaatatctctatcagaggttaggcagggtagaagcaaccggtcatcgaggtcaggaatagcagaagcagtagcaggtcagagaatccggagtattgagaagaaaacactggcataagcatgggaagaagagatgcagaggcggacttacaattgcctccgggattcagattcttccctacagaggaagaattgattgtgcattacttgtgcaggaaagcggccttgctgccactgcatgttcccataattgcagacgtggacctctacaaatatgatccatggcagcttccagagaaagccctgtttggagagaaggaatggtacttcttcactccccggaacagaaagtacccaaatggttcaaggcccaacagggcggctggctctggatactggaaagcgactggtgctgatatgcccatctcttctaccgcttctagaggagtaaagaagagagtgggcgccaaaaaggcccttgtcttctatgttgggaaagcacccagcggctcaaagaccaattggctcatgcatgaataccgtcttgccgatattaacaggcctgcaaggaagaaagacagcttaagattggatgattgggttctctgtagaatatacaacagaaaaatcggtgctgagaaattagcactagagccgaaggaaagcttcaatgatgtaccaatggaaaccattgacgaaaaggagatgaagatcagcccacctcaacttcaatcaatcatagcgccattgaacagagcaacccgtcctttgaccatttgag

SEQ ID NO: 12395 - DNA, 972 bp, Pinus taeda
  Predicted polypeptide sequence is orthologous to G502, G519
atgacacagaagggtggaacagaaggacagatagatttgcctccgggtttcagattttttcccacagatgaagaacttgtagtccattatctctgcaagaaagttgtgtctcatcctcttcccgcttttattataggagatgtggatctctacaagtatgatccatgggatcttccagaaaaagctttgtttggagaaaaggaatggtattttttcaccccacgggaccgtaagtatccaaacggttctcgccctaatcgggcggcagggtccgggtactggaaggccaccggcgcagataaacccatcacgacttgcggcgggaggaagcgagttggagtgaagaaggctctggttttttacaaagggaaggctcccaaaggatccaagaccaactggatcatgcatgagtatcgcatggcagaaatcaatatggcagccaggaagaaaaacactctacggttggatgattgggtgctgtgccgcatatacaacaagaagagcagtgctgagagactagaagagaagaaattggctgaagaaatggagtcctgccacgatatgcaggaaactgtgggaatccacgatatgcaggaaactgtagagcagcagaagaaaacgcagagtgtcccttcagagccatctcccactgatgcttcaactgtgtctgcagaagctggactcccatccacaaattcatccctttttaaccctcatcttcctgctcctcccatgaatcctatctgtcaacaccagagcaccaccacggatgaagtccagatgaacattaaactggcaaaccagctcattcagaagcagcagcagtcagggcagtgcttgaatttcaacttgggtctggacattgtgcagagccctttcttccagttggataattcagagccatcttctttgttcacccataccaggaattcatggacaactacagtatacagagatcttattagactctca

SEQ ID NO: 12396 - DNA, 858 bp, Pinus taeda
  Predicted polypeptide sequence is orthologous to G502, G519
cggccggggaaagaaattacatttgagaagcaggtcagagcatcaagtgtattaaaagaaattacagtagcagagaaagtcagagcatcaaaagaattagcagtagcagaagcaggtcagagcatcaggagtattgagaagaaaacacaaggataaacatagccatgggtatgagtagaagaaatgcagaggctgacttacagttgcctcctggattcagattcttccctacagatgaagagctggttgtgcattacttgtgcaagaaggcagcctctcagatgatccctgttcctataatagcagaagtggatctctacaaatatgatccatggcagcttccagagaaggccctttttggagagaaggaatggtattttttcactcccagggatagaaagtacccaaatggatcaaggcccaatagggctgccggttctggatactggaaagctacaggtgctgataagcccattactgctaaaggtggaaagaagcgagtgggcatcaagaaggctcttgtcttctatgctgggaaagcacccaaaggcacaaagacgaattggatcatgcacgaataccgtcttgctgatgttagcagacctgcaaggaagaaaggcagcttaagattggatgattgggttctctgtcgaatatacaacaaaaagatcagtgctgagaagttagcacaagggcagaaggaaatctcccatgatattgtaccaatggaagccatcgatgaaaaggatatggataatcaaccctcctcaacttcaattgagcacagtggaattgaacagaacaacccatcttctggccgtctgatgaaattggaaccttctccaacaagccacaacg

SEQ ID NO: 12397 - DNA, 903 bp, Pinus taeda
  Predicted polypeptide sequence is orthologous to G504, G1425
ggatttttatcagaaaaatgtcaaaaatatttatacgacgaccagatgtttcctgtaggctgtgcatagaccaattcattgacgagtcgctgccgctctccgatgaatttagcgggtgggggactacctgcggcgaggatgtggactccgcagaggacacggctgcgttgttggcatctgacgtggcatggctcggtaagttctccacagatggaccctcgttcagaggcaccctagaaaaggaacccaattttggaatcgctggtttttgtcggctacgctgcacgtcagtagctgatggcgacgggacctccagctgtgagcacgagagcatcccgggcgaatgattgagtctctgaaacaatcggcacagcacccaatcgtccaagggggcagatccgtttttctgggttggcagagtttcggcgaggtagtattcgtgcatgatccagttggtcatcacgccctcagcaggctttcctttgtaaaacaccagcgatttcttcacgcccacttttctcggtgacgagcttcccgacatactaacaatgggtatgtctgatcccgtggctttccagtagccagagccggcggctctgtttggccgcgctccgctgggatattcatggtccctccgactgaagaaataccattcgttctccccgaaaaatgctttcgcgggcaaatcccaggggtcgtgttggtatggatcaatgtctgcaataattggggcaggcagaggggaggaggataccttcttctccaggtaatgggtgatgagttcctcatcggtgggatgaaatctgaagcctacaagcagctctggcactgcctgctgctggaatgccactccctccatcgtcaacgattgattgcttgctgagagagcaagcaagcgatcgg

SEQ ID NO: 12398 - DNA, 1023 bp, Pinus taeda
  Predicted polypeptide sequence is orthologous to G504, G1425
ggcattccagcagcaggcggtgccagagctgcttgtaggcttcagatttcatcccaccgatgaggaactcatcacccattacctggagaagaaggtatcctcctccgctctgcctgcctcaattattgcagacgttgatccctaccaacacgacccctgggatttgcccgctaaagcacttttcggggagaatgaatggtatttcttcagtcggagggaccgggaatatccaagcggagcgaggccaaacagagccgccggctctggctactggaaagccacgggatcggacatacccattgttagtatgtcgggaagcacatcgccgagaaaagtgggcgtgaagaaatcggtagtattttacaaaggaaagggcggtgagggcgtgatgaccaactggatcatgcacgaatactgcctcgcccaaactctgccaacccagaaagagggatctgtccccttggatggttgtgtgctgtgccgattgtttcagagactcaatcattctcccgagatgctctcgtcctcacagctggaggtcccgtcgccatcagctactgatgtgcagcgcacccgacaaaaaccagcgatgccaaaattcagttccttttcgagggtgcttctgaacgaggttccatcaatggagaacttaccgagccatgccacgtcagatgccaacaacgcagccgtatcttctgcggagtctgcatcctcgccgcagttggacgattgggtgctgtgccgattgcttcaaactgactcattctccggggatggtctcgtgctcacagctggaggtcccgtcaccgtcagctactgacgtgcagcgcacctgacaaaaaccagcaatgccaaaattcggttcctttacgaggctgcttctgaacgaacgagagaccgtcttgggagaacttaccgatccatgccacgtcagatgccaacaacgcagccgtgtcttctgcggagtccgcatcctcgctccagctagttccccaccccgctaaattcatcggagagcagcag

SEQ ID NO: 12399 - DNA, 850 bp, Pinus taeda
  Predicted polypeptide sequence is orthologous to G504, G1425
cggccggggaacacctcttctccatttgcttcaatcatgaagcaatcgatgggcacgatgaaaatggagggatcggaatcgcagcaggaggtgctgccaccgttgcccccgggcttcagatttcatcccacagatgaggagctgctcatccattacctgaagaacaaggtctcctgttcgcctctccccgcttcaattatcgcagagattgacctgtacaagtacgatccctgggatctgcccgcgaaggcgtgtttcggggagcatgaatggtatttcttcagcccgagggaccggaaatatcccaacggagagtggccaaacagagccgccgggtccgggtactggaaagctaccggaacagataaacccatcgttattacgtccggaagcacgtcgtcgcagagggcgggcgtgaagaaatcgctggtgttttacaaaggaaggccgcttaagggcgtgaagacgaactggattatgcatgaataccgcctagctgaaaccctacctattaagaaaaagagatctttgcggttggacgattgggtgctgtgccgaatctacaagaaactgagtcattctccgagggtggcctcgtgcccagagctggagaccccgtcaccgtcagctgctgacgtgcagcgtgcccgacaaaagtcagcaatgcccaaattcggttccttctctaggctgcttctgggcgagggtacctctatggagacctttctcacccatgccacgtcagattccaatgcgtcccggtcttacgtggagccttcatctaatctccatctagtgcccagaagctaaattcctcggagacagaagccacctgtcaatgacgattggt

SEQ ID NO: 12400 - DNA, 818 bp, Pinus taeda
  Predicted polypeptide sequence is orthologous to G505
cggccgggaccgtcccgttctcccacatctcacaacacccgtataagaagtcaacacccacaccccgtctcccaccagttcttttcatcaatatcttgttattatctgcgtagggagggatttatcctctatcaattttcacagtcctgaatctcgaaaccagtggtggcagcattcagcagatttcagaaatggagggcttgaattttacgtatgcgcaggacaagggtgacacacagcttcccccagggttcaggtttcatcccactgacgaagagttgatcactcactatcttgttagaaaggtccttgacagcaacttctcaggccgcgccattgctgaggtcgacctcaacaagtgcgagccctgggatcttccagagaaagcgaagatgggtgagaaggaatggtactttttcagcctcagagatcgcaaatatccaacagggctgcgcaccaacagagccacagaagcgggctactggaaggccactggcaaggaccgagagattttcagtgcacgaggttcttccctcgttgggatgaagaaaaccctagtgttttacaaaggccgagctcccaagggagagaagagcaactgggtgatgcgcgagtatcgcctcgagggaaaattttcgtacaatcaacttcccaagacttccaaggatgaatgggtggtctgtcgtatatttcagaaaagtataggagcaaagaagagttcatctggattcaacagaagctcatatcttgacgttgggtctccttccttgccccattatcagcagtcaatgatgaaagtggatctctggagagtgaag

SEQ ID NO: 12401 - DNA, 812 bp, Pinus taeda
  Predicted polypeptide sequence is orthologous to G522, G1453
ttgcaacatggaaggacaccatggcaatgccaatccacagtcagcagctacccaagaagatcaacaaggtgttaacacatacaatgaggagcaggttactgactggagagtgctggataaatttgttgcttcacagttgagccaggaggacgtgtcaaaggatgctaggttttctaatgaaacaatgtaccccatacctgatatgactgtgcttctgcgacagtctaataaacatgagcagcaagcagattatgcctcaaattccaactgtgatgttgatctctggagctttgcaggaaaatgaacagccctctaccatccaacaattacatgaacaaatggtaactttaactggcttttcatgtacataataaattacatctaaaggcatcagatttgataggcagtttatggtcgatttattaaccctcagtccttgagggggtgctgaagacaattggaagaaatcagacaacagagttacatgggaacaatcaataaatatgtggtcagatcattaaggaagtcttgcagccctctgtaaaatgtagacaaatttgtacaccaataagctagctgggtgagctatcatattaacatgtagaatttcacagtgagtgggatatacctaagctggatacttatagccctgcagtacattaattgtgttaaaacttctatttatatccctttagttccatcatgcaacttttaatagaccagtacatgaactggtcgtctactgtatgctatgaccatagtcagaatgcaatgttattggattaccactatataattcactgctaaatttt

SEQ ID NO: 12402 - DNA, 893 bp, Pinus taeda
  Predicted polypeptide sequence is orthologous to G536
cggtctgcagggtaccatatccatccactgacaagtatggatccttccaaatgacatcaataacacttaaataacaattttaagtgtgccctccatggtatgattggagtacaaagcagtaccctgcaacaataaaatcttgcagggcagcagattttataggagaatttgctgaaagatcccccttagcacacaatcgtgcagaaaaccacaaaaacactctaaaacctctaatacaacatatttgaccatatctcatgaatctaacctacttgacagtcatttacggataaacattgacgttcatccccttcaccatcctaatcgatttcattcataaaaaagatgtccgcgtccatcaccttcagtgtccatcaccttcttctttcttcggcgcttctttgatttcatctcctccagtctcctcctgcatgtctgaagtccataacgtgaggttatcacgaaggagctgcatgatcaaagtgctatccttgtaagattcttcacctaacgtatcaagctctgcaattgcctcgtcaaaggcctgtttggcaagtgtacaggcacgatctggtgaattcaaaatctcataatagaatacagaaaagttaagggccagtcccagtctgatagggtgagttggagccaactctgtagtcgcaatgtcctgggctgccttgtatgcaagcaatgtactttcagcagcttccttcctctcagcaccagttttaaattctgcaagatatcgatggtaatcacccttcatcttaagataaaataccttggactcaccagatgtggatgacgggataagatgtgtatccagaagacgtagaatgccatcacaaatattactgagctcagactcaaccttgcctctgtattctcttatc

SEQ ID NO: 12403 - DNA, 771 bp, Pinus taeda
  Predicted polypeptide sequence is orthologous to G546
gtgaatacagaaaatttctgggaaggaagaagcaatgatagggataatagttttggcggtggtggttgcgctgctgtgtctctccgcggccatcggggtggcggtggtggcgtacttgtggctggtctcgtacgaatttttgcacgagacacgacggcaactgccattagaggataacgccaagcttcccaagcgtcagggcctttcggaggctgacctccagcggttgcccaccgtcgaattccatgaaaaagaagaaggagaagagcgcccatcggggtgcggcgacgccaagtgcgtggtgtgcctggagcctttccaaagcgggcaacggtgccgcgtgatcccggtatgcagacatgccttccatgtggagtgcgccgacgcgtggctctccaggcgctccgtctgtcccatttgcaggagaagtgcctattgcgagggcgacgagaaaaatggtgtgaatggtggcgctgcggcggcgttgcaagaagacgaggtgcgggatgaagagtcgaggtggagtcgcccgccgcctacggctgagagtgtcgttgtcgagatgccggttgcctaaatgcatacagaggttaaagacgctaccgcctcgacccgagatgcaccactgaacgatggttcgccggtcagtaagcatcgcaccgacacatcggctgttttaaatgattaatcttttcccaaatgttaaattccagatctattttgaagagatctatctattttaaaggaatatatgatgtaatctttttgctc

SEQ ID NO: 12404 - DNA, 890 bp, Pinus taeda
  Predicted polypeptide sequence is orthologous to G546
cggccgggggctctactgctacttatgagagcaactacgattcctgtctacattaccttgaacccttcatcatttttgtccgatccatatgttaaatcttccgaagatccgatcacaaacataggatactgagattcagcacaaatttctgttaagggctttcgatttttatctggaatctgagattcagcacaaatttctgtaaagggcttttggactagagtttatatataatacatggcattagcacagcctccattctcagtgatgcaggtgcagggcctcttccatattttggattctgcgaaagccaaattcgagcatttaacaatgggtatgctaaatggtgtccgcgtgttttctaaagtaaaccctgtgttggcgtcgattgcaatctatgcgctttgcacggctgcagggtttatcttgtgggttgcaatgtgtttcttggatttggccgtggggacttgtgtcttggaggccgccacagatgtgattgaggttttgaatgagcatgtcctccctgcattgcagcttctcaacggtgtgcttgctctgcttgtgggattcatcatactggtgggcaagattcatattaatatcaatgttaatagcaaccgctccagacataatcccaacaagatgagcactctgtcaaaccgctccaagatgatagcagcactgcccaaagccaagtacaggtgtttgggaagatcagatgatgcaaatagcaatgattcatcttcatcatcatgtgcagtttgtttggggtgtattggggaggaggatgaagtccgcgttcttcccaactgcagacactattttcacatttcttgcattgatcgtggcttctcatctactgtcatactcttcctgccctttgtgcagag

SEQ ID NO: 12405 - DNA, 802 bp, Pinus taeda
  misc_feature (761)..(762): n is a, c, g, or t
  Predicted polypeptide sequence is orthologous to G549
gttgccaatacatatacaatgtttcaaagaacggcatgacacaatgcatatcaaatctgatatgcaaagtcacagtgagaacacaaatgcccaataatcacggggttacacttgaagctgagcagcagctcaaattacacacattaatctcaatgaaactattggcactttttgcttctctctatgtgacacagctgcctaagttaaattacacacattaatctcaatgaaactattgacactctttgcttctctccatatgacacagttgtctaagttttgtgggaacataccaaatcttaagcttttcgttcctattaaaaatgccctcaatatcccaattattctctctggctatggctaccaggggatagtaacaggcctggcgccaggccccaacattttctcccctctccttgtatagtcttctgaggtgattggattgctcactgtccaagcaatgcagagcatagcaatgaacataatgtcgcattttaggtttgtttatgtagacagcaccattgtgcttggcatgacggaacacttgatttgtaacctttgttgggcatttttctcccttttctttagcaatcctttgtacttctaataaaaatttcccacactgctcatagagatcaaagagataatccagaccatttttcttccctctggccagttctcctggttccgtgacaatgaaaggatgctctctaggcctgtcctccccatcctctccaggctctttggaccgcctccttttnnctgctatcgtatcagctttcctttcatcgctctcactgct

SEQ ID NO: 12406 - DNA, 755 bp, Pinus taeda
  Predicted polypeptide sequence is orthologous to G550
ctttaaagtatgaagagttctccaacgggaaatcggaaaaggcctccgagagagccccaccaaagccgtcaaagccagtggcctgcccccgctgccacagttcagagacaaaattctgctacttcaacaattacaacgttaaccagccgcggcatttctgcaaaaactgcaggcgctactggacagcgggaggaaccatgcggaacatccccgtcggcgctggccggagaaagagtaagcatttcaccgcgtttcagcttcacagtggttcgaattccctcgatttgcaagagtccgaggtgaaatcggagaatttcgaagagccggtgaatgagacgagaattttcagcttcaacgatgaatcgaccagcgtttcttcggtgaccggcgtagcggggatcgacatgaaggttccgtacctggaagaaatggacgctgcgatctccgatggcttcgtcaattctttgactgtcaatggtttttctggcgcagggttttcgaatttaatggatcctggtctgaaaataaaagtgattagcaccgaaaattctcaatggattcctgaaatccagcaaaatggcaattcagctattcttgcagattgctgtgtattgtatggtaaacccatgatccccaactgcacacagcgacccgatgaataaggctttctcggaaagctatgtatatctcggccatattggattgcaggccatttccgcttattaaattgagctgagctattttagtctgaaatc

SEQ ID NO: 12407 - DNA, 874 bp, Pinus taeda
  Predicted polypeptide sequence is orthologous to G557
cagcttataaaacgcggaacgaaacgaaagtcgactgccgatagtgtttccccgaattctccatcactgcccaccacgaagggcaagcgttcgagggccgacaccacatcgtcgattaacagcagcgttatgcgggtcaccttgagcccagatatggatggacaggaagaagaggaggaggaagacgaaatcgaagagcctctgccgaagagaaattctctcaagtcaaatggaactgccaccacaaacggcgctggcggtcgctccaagatacctatgacagaagaggagaaacggaagaatttcttggagcgcaaccgacaagccgctcttaagtgtcggcagcgaaagaaggcgtggctcgctcaactccaggctaaagtagaatatttggaaaacgagaacgaacgtctgacaaacgcactcgtttcctctcgggaagagatctctcggttgtctgccatcgtcggcgcttcgggtgtatctaataacgtaccgaacccgcctccgccttccacgagtgtagtcgtgtccactgccggagcagcgccaaacgttcccgcacccacaggtgggcggggttatgggtattgattgctctcttttttccttggcgttttcgtgctcttgccctctttcgcatctgggatagagtttgtgaccttatctttccaccttctatctcctcggttagttctgcccctgttgtgctgttgtatcttacgttttccccacccgccacccttcgatccctcattctcgttctccagctccattcgatgacgcgtctcacggaaatgaacaatcttcgtatatgcgttgtcaattacatacacatccatatactcaggtataggaaattgtatatcctctc

SEQ ID NO: 12408 - DNA, 797 bp, Pinus taeda
  Predicted polypeptide sequence is orthologous to G558, G578, G629, G1198, G1806
agcaaagaaagtagactgagaaagaaggcttatgtccagcagttagagtccagccgcatgaagctcagtcagcttgagcaagatcttcaacgagcaagaacacagggtgttttccttggggcgggattcgttgctgatcaaggtcacccaggtttgagtccaggtgctgctatgttcgacatggaatattcacggtggctggaggaaaaccatggccgaatgtgtgagctgagggcagcattgcaggcccacataccggacaacgatctacgcccgctgctagacaactgcctgcgcctctatgacgaaatattccggttgaagagcattgcagccaagacagatgtgttccacctggtttcagggatgtggaaaacgcctgcagagcggtgtttcatgtggatgggaggattccgtccctcagaacttctcaagatcctggttccacagctggagcccttgaccgagccgcagtttgtgggcatttgtaacttacagcagtcttcacagcaagctgaggaggctcttctacaaggaatggagactctccaacagtctctgtctgaaaccataatatctggaactctgacctcaccttcaaacgccggtaattacatggaacaaatggccattgccatgggcaaactcgccaacctagagggctttgtgcgccaggcagacaatttgagactgcagacattgcaccaacttcaccgaatactcactattcgccaagctgcgagatgctttatcgccattggggaatactttagtcgacttcgagcattgagctccct

SEQ ID NO: 12409 - DNA, 895 bp, Pinus taeda
  Predicted polypeptide sequence is orthologous to G558, G578, G629, G1198, G1806
tctggtttcgggatgtggaagaccccagcagaacgctgtttcatgtggatgggaggcttccggccatcagaaattctcaagatcctcattccacagatagaaccattgacagaacaacagtaccaatgcatttatagtctgcagcagtcgtcactccaagccgaagaagccttttctcagggcatggaagagcttcaacacactatttccgagaccatagctgcaggatccctcagctcaccttcaaacatggccaactacatggggcaaatggctgtggccatgggaaaacttgccaatttagaaattttggtaagccaggctgatagtctgagacaccagacattgcaacaactacacagaatcctcaccacgcgccagtcagccaaatgcttgctttcaataggagaatacaactctcgacttcgtgcactaagctctctttggtcagccagacccagagaatgagtattaatcactttgcagatcatcatttggataattaattaggttgggtccatagttttttcatcataatttgtactgcatggctaatttcctaccatggaatcagctccaattttagaattagaattcatacaacattgtgcattattaattcgatttatgctctgagatcagagtctcctgctcatcacgttaactttcaccattgatgatcatgatctgtgacttttagacacctgcatgctactaatcaggcttgcagatagtgaattcttagtgatagttttagacacctgcatgctactaatcaggcttgcagatagtgaattcttagtgatggtttacacaaaaatagtttttgaaattactggttgaaacttgactactgcaaaaagcttgaaacaccgagatacttttgtacatattt

SEQ ID NO: 12410 - DNA, 844 bp, Pinus taeda
  Predicted polypeptide sequence is orthologous to G558, G578, G629, G1198, G1806
gaggcctcgtgccgaattcggtacgaggttttttttttccatgataaattatattatagctgcaatgcatagaattctgaagaaattacactcatataattcatataatgatcaacttactgttacaacctagagaagagtgtcaatctatccacagctctctatcaattccgaccaccagcacctcctttgtaaactgaatcagccacctaaattttacatgtaaagtccagatggtcatgtgtacaataaattactgaatgaagcagagttgcaactcttcaaaattcagagcagcaagtcactttctgcacatttctgctgaatatgttactataaagatatctgtcgcatcttctttcttcctcactcttacaggtcaatctcttcatgtcttaactgcaagtactttggaaaatataccatcggcttttgccaagcatgtccttcaaaccaagttcagcaggttcaaatcccttgctgaatcagctgaagattaacaataaaagataatcataactttacgctggttcacgaggacgtgctgcccagagagaactgagcgctcgaaggcggctaaaataatcccccatagcaagaagaccccttgcagcttgacgagttgtaagaatgcgagacatctgctgcagcgtctgctggcgtagattgtctgcctgatgcacaaagttctcgagcattcctagcttgcccatcgccattgccatatgccccatataattagccacattcgatgcacccagtgaacctgctgccaaagtctctgcaagtgactgctgaagcgcctccatgccttgtgacatgcatcctctgcctgctgtgatga

SEQ ID NO: 12411 - DNA, 803 bp, Pinus taeda
  Predicted polypeptide sequence is orthologous to G558, G578, G629, G1198, G1806
cggccggggattccctgtcgcgaaaatcggaaatctgaaatctctgttaaggcacagaagaaacacagaggcagggcaggatcaagatttcaagtgagggtagagggcgcatggcaattggcagaatatctgtacgctcttcttcacgcgcttattcagacgccttttccccgtctccagtattcatatttatgtacatgcatagccatcttgggttagcttctcatctgcaacacatatgaattcacagtacgcacagtatattgcttaaagtagcaaccagccagctcaccatctattcatcaactggatacctcgggtgattccttcaggacacaaaatagtccacaaactggaacctccaaaagtatggaagcagatgtgaaggtggataatatgtcagaagatgtaaatcagctaacgcttgcaagatcaaaaaggtctgaccaagaagcaaaccaacctaacaacaaggtcttgagacgacttgctcaaaaccgtgaagcagcaaggaaaagtcgtttgcgaaagaaggcttatgtacaacagcttgaatctagtcgaataaagctgaaacaaattgaacaagagcttgagcgagtgaagcaacagggaatttccatcaatggacatttgggcgatcataatggatcaggggctgctgcatttggtatggaatatgggcgttgggttgaagaacaaaacagacaagcccgtgagctcaggggcttctttacaagcacacctgacagatagcgaacttcgtgttctggtggataatgctatagctcattatgatgaac

SEQ ID NO: 12412 - DNA, 875 bp, Pinus taeda
  Predicted polypeptide sequence is orthologous to G559
tagtgattacaacatacgaagggcagcacactcatcatagtcctgcactgttgcgtgggtcatcgtctggaacttcagatcaattaacccactttggaggagcagcagaccatcatcgcaccgcatccccttttaacactgctcagtcacccagcttcaatatacagagcctgagaatggcggtgcaggtccctcagcgcactaattattatggtatgggcagtttacaggcacatgatccaatacaccggggcagcagcaccttacagcaccaacaacaaattataagatcaattcagcagcagcagcaacaacaacagcatgatcattctcagcaccagcagcagcatcagctaattcattcccagcaaatgcaacccccatcggtcgaccagggtttgctggaggacattgttccaccaggcatgcgcaaaaatccctagcagcttatttctaaacatatatacatagttatatatacatacttatcctgtttcgaagaacatcgccattactgactgccacagttcatgttggacgtgccatatgatctgcaactccacgtgaggtacgcccagaaattttatccttaatgcccatgatgtttcttgaaaacaattttatggccagcagctggatcttcccctctccatgcatatattgcaaccagatcccgtggaatgtttgcagacttcttaacagctaggccaattctcggttcggtgaaacgatgataattccggtcttagttctttgttgcttatcgctcttaattaaattccttttagaaagttgcagcaccatggattcatagtctattgacattatctaaacttttgactaggatcacaccagcacaaatttaattttatgaa

SEQ ID NO: 12413 - DNA, 851 bp, Pinus taeda
  Predicted polypeptide sequence is orthologous to G559
cggccggggtcatagcaattccatggatggttcatcttcctcgcaattaaatcaactgtcgtcagagtctttagagtccaagaaggcgatggcagcaaaaaaactccaagaacttgcacttattgatccaaaacgagccaagaggatattggcgaatcgacaatcagctgtacgatcaaaagaaagaaagatgcgttatatatcagagttagaacgaagagttcaaacactgcagacggaagcaactactctttcagctcagcttacattgttgcagagaggtacaacaggactaaccaccgagaacaatgaactgaaactgcgactgcaggctatggagcaacaagcacaacttcgggatgctttgaatgaggctttgagagaaaaagtacaaaggctgaagattgctactggccaactttcatcaaacaatacaaatgccttcaacatgtctgcaactgcacaacaattgccattgaatcgatcttttttccctccaacccaacattcacatcgtttgaatcaacaatttcagccatttcagcattctgcatctccaatgaataatcagccattgatggggcagtctcaggtgcatcagaactttccccagtatggtcctgcaggccaattgcaagtgcttgtgggcagtcaaggcgggcctgctgtagaatcagaagtgtcctctagttctgttaaccatcctggtagttctgcgttttagatggagagaatttgtggaagtgacacagtattaatcagtaagtgggagttctggctttatcagtggccaagattgctgttctcatgaaaatccttgtgcgtttacggtctttgttttgattgttaca

SEQ ID NO: 12414 - DNA, 922 bp, Pinus taeda
  Predicted polypeptide sequence is orthologous to G561, G562
ggaaggggtagtacagctggtatttcaacagcaatttttccagcaactgctcaacttatgccgtctggtcgcgattgtgttcctcccgagctatggatccaggatgagagggagctgaaacgacagaggcgaaagcaatctaatagggagtcagctagacgttcaaggttgcggaaacaggctgagtgtgaagaattggcaacaaaagttgagaccttgactgtagaaaacatggcacttagaaatgaactaaaccgaatggcagaggaatgcaaaaaactaaccgcagagaatgcttccataatggagcaactgaagttgaatggacaagatatgacgactattactcaagaaaatggttcaactaagatatcattgcagtcggtaaaacctgaaggcaatggccattttcatgatatatctaggggaatcaattcgaattctactgaaagaaatgaacaaaggcagagtgagacctgtgattcaaacgggaaggttcatacgttactagatgcgaatgctcgttccgatacaggttaaaatatgcctctaatgtgttttgatttaagttagttggcagatggaagttcgggagtccataccgttttgcttgttttgggctttctccaaacttttcatgcactaatatagtgaccgatgcttgttaatctagaaatttaattagcctggcttatgaccaagaccatttctgtaaaaaaaataacccacgataaacattagaagaggtgggttcagccataactacgatcatatcattatttggtacagctaacctgctatgagtagtttcttactcgggtcatgtaattcttctcaatggcccaattcagttctagtttctccgttacgagacaacagggtgtcaaaatcatgaacaaagatggcagttttcattattttg

SEQ ID NO: 12415 - DNA, 880 bp, Pinus taeda
  Predicted polypeptide sequence is orthologous to G562
tgctcaacagcctgattacatttcattatttcttgtctgtttcttctttcctgtagcttgcctgtctcggtctttataaattcgaagcaataagttgaatggggatactgcagtcctgcctcccattgctgcgctctgctcggcactccgggtttcatttcatggagatcacttattagattcgctgttatgcgcagagaggtatagaaacctttcaagtccgcaattttccattaaattagaacagcccccttacagagtttaattgatgcttggtggatgcgaggccgccctctgggcatctgctgcagccagctcgctgaccgattgtgattattatttctctggtgatggtctgttgcctaaggtccttctcccccacccactgttttttctgaaggctcagtattatagataccggagattgaggtgaactgagacaggggcgaccgcctgttgtcttgtgtggttagaattaaatattttatggagaaaaaggggaaagcatcggtgaacagaccgaatccaaccaatggatcactgcatagacatggtcacatgaacagctctgcgacagcaggatgtgttcatggacctactggcaatgtcaacctcaaacaacaagatgagcaaagcttgcgcagatctcggagcttctgtgggcgcccttttcaaacggaaaagtcaggggaagtttcatcttcatcagcaaaatctaaaaagaatgcaacaacgatgatgagaaggcctaagacacatccagagcttctcaatcgggatgctggggatgctgcccctcttttaatgagcaatacgaagatgaatactcctgcggaggcattgagtgtgaataagttgctggtgaatgtgacggttgaac

SEQ ID NO: 12416 - DNA, 758 bp, Pinus taeda
  Predicted polypeptide sequence is orthologous to G562
ttcaatgacccgacacagtcccaaggattgcagggcaatcatcacacgatcgtaccgttttggaacaactactcagcattctcgcctcaacaatacgcgagacgccatcccgagatccggcgtccatcggtaccccaactaatcccggtccctcctccatctccatccagctcctctgtcgccacgccagacgaggtttatcccattttcaagttccaatcatcggtcggctcatcgccaaatccatcagcagtggcctcagacatcatgagagcaaactcgaccttggtgacctcaacacagacttccgccaccgcaaatggggatacatcttgcgatgagttttccacgacccgctcggacgtcacgcgagacgagtttttgtctcccgctaatgatgtgtaccttgcggagttccattccatctcgccgcactcccccgtgacaccaatcccatacgtgcagcgagggttcggatatcgggaggagcgtgctcggggccgtgacggcaggcgccggagggtgagaacgaaacccgcccaccggcaaaaggaaagttccggatcttccctgacatgccttcttcaagctgcggagccccgtaaatccagtttcacctccgattcagatggtgcacctttgaaattaccacaagaaaactggcgagttattggcggtggcgttatgttaggcaccccaacgagcgcgacatcccggcggaaattaaagcgactgcagtcgtgcgcgtgcgtggtcga

SEQ ID NO: 12417 - DNA, 806 bp, Pinus taeda
  Predicted polypeptide sequence is orthologous to G562
cggccggggacattggaagtgtgtttgaagagtaagagcagtggaagcagaagagattttgaagccatgaagcaaagtaagattgggatttctgaggattctcagtttacagcggatgaaattgaagttgcagacgttatgacctgcttccgccattactggagattctttcttcgatggggggcaaagcgcaagcgatccgcctttcagagagatgaaagcagcgccactcacaactccaacctgagtccactcagtatccctgccagcgaaaaccagtatgaacttgaaaacggcggcatggctatggtccctccccaactaccagtccgccgcctacaacctatatctcgtcccaactcaaagaatgtgagaggaacgaatcggcccaggaaacgagtgaccaagaaaaagacgcatagggagctgacggaggcactggttgaattgagcttggaaaatgcaagattgataaaggagttagagcagatgaggaaaacaagtcaagacctgaaagattgcaatgttattatgaaatcacagttggcattgtgccctgagaaaaggcaagagcaaaacataccttacacaccttggtcgtcatcatctggtttagataccagacagaaaacagcaatagctgcctcatgtgatgattttcaaagatgtgatgagcatgaacaatttgagaaatgttccggtagttcagctttaggcttggcatatgacaagttccagaggcttggaggaccaatgtatccttgttcctctgaggcctcacttgggtttgagaagatgacgcaatt

SEQ ID NO: 12418 - DNA, 809 bp, Pinus taeda
  Predicted polypeptide sequence is orthologous to G567
gatttgcggctgggagattcacatttttctctgaaagcctttgctcatgattttcaataaactttgataatatgtaaattgttatgacctgtggtatatttaaggctataaacatcatctcgaatcctctttactggtgaggttccacctgcagttttttttgatagatgtgcacatctgctgatttaaatttgtcacaaagatttgcggctgggagattcacatttttctctgaaagcctttgctcatgattttcaatgaactttgataatatgtaaattgttatgacctgtggtatattcaaggctataaaacatcttctcgaatcctctttactggtgaggttcgtttttttaatagatgtgcacatctgctgatttaaatttgtcgcaagatttgcggctggggggttcacatttttctctgaaagcctttgctcatgattttcaataaactttgataatatgtaaattgttatgacctgtggtatatttaaggctgtaaccatcatctcgaatcctctttactggtgaggttccacttgcagtttttttgatagatgtgcacatctgctgatttaaatttgtcacaaagatttgtggctttttctgtccagatgccagagctttatacgttggagctgcgagcagcactgcttcgggaccaattggtattccagcacttcctccgcagcctaaaagcggaaatactcaagtgagaacaactagtggatcctcaagagagcagtcagatgatgatgaccaagaagtgggacccagtgaacaaagcatggatcccagtcatgtgaa

SEQ ID NO: 12419 - DNA, 761 bp, Pinus taeda
  Predicted polypeptide sequence is orthologous to G568
ttctacagctaccttgttgagcaaaatactgcgacgcaattgacgagtgctaggagaaaagttagactgtactttgctgctgcgatgtttaaaatttagcgagaagtctgagctgctcaaaggtgttatttggtgggatttgcgggatggcttcggcttcctcttcttattcatcctcctcacctcgcaggccgaaaccaaagccaaaagttgactggaacgctgcaaatcggtcgaaattaatgtcaccggatgttattatggaggaaattgagagtgcgattgcggccacggagtacgagcacgcctcccggcatttgaaagcagcggcctcctccgatgtcgaagccgccgaccgagctttcagatccgcccgcgctgctgttgcaaaaggggatttcgaattaggtatggagctctcaaagcttgcactgctcaattgtccttctcaaaaaactaacgccatctctaagatacagaacctcattgctcatattaagcaacaacgagctgcaagcacagaaaattagccctcaattccattgcttccggtcattttaggttttcacttgctgaagatttcaaacccttctatgtgaattaaaaataaatgatttaagatcacgctgcttctaatgtaatacttcctttgctgctttcaatttttttattatttaagtagacggggactggatgtgtgtattcgatcgatgttatctacattcatttcttccaacatttttatgaaattagtggttatg

SEQ ID NO: 12420 - DNA, 776 bp, Pinus taeda
  Predicted polypeptide sequence is orthologous to G583
gggtgatgccatttcttacattaatgagctccgaagcaaggtgcaggattctgaatctcataaaaaggacatgcaggctcaacttgaggccttgaagaaggaattggtagtcagagaatcggctgcttctggattttctggcagtaattttggtttactaaaaaacccggctgctgatccttcgaacctagatgtcaaaggctttggttctaaaaatcagtgtcctaatattgagcttgaagttcgaatcctcggtcgagaggccatggtcagagtacagtgtcctaagcagaaccatcctgttgcaagaatgatggttgcatttaaagagcttgaacttgaagttcatcatgccagtgtatccacagtgaaagagttgatgattcaaacggttattctgaatatgacaggtattgtatatgcgcaagaacagctacatgctgcattattaaggaaagtagcagatcctggccttagatagcacgccatgagcaatcttgactggtatttatctagaaagctgaagttcccttagaagctttaggaacttcaagatcagattactttaccagcccagaaggaattgtgcactgtaaaataatccaacttaatttactttgtaaattttttcacaagtaatgaagaactgctatagcagttacttgtaagcatggctgccctgttccataaaaatgaaatctgatggaaccacaaaaaccaattagtgaaaatggttctaactcaaaggactgcaaggaaaaggctaaaacagcata

SEQ ID NO: 12421 - DNA, 911 bp, Pinus taeda
  Predicted polypeptide sequence is orthologous to G585
tgttcccgccttcatagtagagacagggatgaaagctcacccaaattaagggaaggtgagaatggttgcagggtacggagaaacggtcaggacgacatcactgtaaatcatgtactcgcagagcgcagacgcagggagaaactgaacgagaggttcattattctgcgcacactggtgccattcgttactaagatggacaaggcttcaatcttgggtgatgcaatagagtatgtaaaacaattacgcagacgcatacaagacctagaagttcgcagcaaacagatggaggcagagataaaaaagagtgcagagcctcgcaagcagctgagtaccacttcacaggagaaaacggctagacaaaagagtggaggcactaccaataataataataataataatgtagaccaggagctagtaagcagctgcagaaactttagtgatcattctgatcaacagcaatacaagatctcaagattcgaaaagagaaagattcgtgtgttggagagatcagagccattgacgatcatagacgattgcagcacagatgtacaggtttctataattgagcacgaagctttggtggagttacagtgcccttggagagaaggcctgttgcttgatattatgcaaacactcagcaatctgctatttgaaactcattctgttcagtcttctgtggtgaatagtactttcgtagccaaaatcagagccaaggtgaaagcggcatcgattggggaaaaaccaaccataactaaagtgaagaatgctgttctggaatgcattcccagtcgaagctgaagctgagatctctttccatgtaagatttctgctgtattgatgggctacttcccatgttaatgtgatttgagatatctgctgaaagcagtgggaggaaattttagtgatgtgag

SEQ ID NO: 12422 - DNA, 606 bp, Pinus taeda
  Predicted polypeptide sequence is orthologous to G590
ggtgctaatgggaaccaaggatattgagtgccagagtcagaaggcgcgagaagattctggtgaaaattttaaacagtgttctactgggacatcttcttcaaaaagaagccgggcagctgaagttcacaatttatcagaaaagaggcggaggaatagaatcaacgaaaaaatgaaagcccttcagaatctcattccgaactctaataagactgacaaagcctccatgcttgacgaagcaatcgagtaccttaagaagcttcaattacaagtgcagatgctttccgcgaggagtggaattgatctttcatccatgcgctggttggcgcagatgccacacttgcagatacagcaaatgccaaaagcatgcatggccatagatcagcacgctggagttcccataagcatgcctgtgggatcagggcttataaacaccaaccagggtagcgaaaagaggcctttgcctttgcatgatctatataattctggagccctttgtaataccgccattcctataaacttgtcatcagtcaggattgatgatcatcactcctgcaaaatggatcatcctcaaggccactttactttgcctcaactaccaacaactac

SEQ ID NO: 12423 - DNA, 307 bp, Pinus taeda
  Predicted polypeptide sequence is orthologous to G592
tcgagcggccgcccgggcaggtaccgattgcttgtggttccttgatcgtgcagcttagtgctctgaaatctcaaacggttgcctgcgcaataagcagaagttgcatttctgcaagattttctcatatgtcatgttggtgcagcatagttacggtcatacagataaaccttccgaagtctacaacgtgaagcaaaagccttaatcctgtatagccctctgaagcacagtggtttccactctggagtccggacacattgcttttctctgtcttcgaggccccccgcgtacctcggccgcgaccacgcta

SEQ ID NO: 12424 - DNA, 720 bp, Pinus taeda
  Predicted polypeptide sequence is orthologous to G597
gaatatctacagcctttacacctgatctaagaatctttcattgttttttgttagcttgcaagagcctggaaaagttaacttattttggcaagattcaaaatgtgctgataataacaatcatagcacggctaatggcccttggttgttagcctgtttaaactaaaaaatgcggacaacaaataatctagccatgaaaaggttccagccatcatacaactatccacaaggcaaagatatattaacatttgtagtatgcctttgctctcccatagagtgggaacctcgccaacccattggctgaaaagcaggcatgttctgagttgattgttgaccaacactattaataccagaagccccagagcttgagttgaatggaggaccacccggaccgccatgtttagctcccaaatgtccagaagcagctacatgtggcaaacctaatgaagataaaggattctcgggcttgccttgaacctttttcccatccaaaataaagctccctgcaatcacctgaactggactggcagccattaacattccagctaccactccaccaacaacacgaccatcagggccagccaatgaaatactcagcccacctgttctactgcgtgccccattattctctgttaacaagaacgagcctgacaaggagacaatatcaaagcggcccgaagtagaatctggaagaaaatcaaacctcatatgtcactgtacccc

SEQ ID NO: 12425 - DNA, 825 bp, Pinus taeda
  Predicted polypeptide sequence is orthologous to G597
gaacggaatccactgccgccattgttggatggttgcattatctggctcttttgtactaaatgaagctggaggaaagcaaacacgaactggtaagctgactgtagctctggctgggacggatggcagtgttgttggtggtgaagtggcaggtcttcttatagctgcaagtcctgtacaggtagttgttggtactttccaagctgatgcgaagaagggctttggacgaactgaaaatagcgagccttccggtgccactttgccagcgtctatatcagggcatccgccttccccagtaggtttacagtcaaggaccgagggttttggtggcctgagaacagatgaaggaagctattctgaacatgctactggaggaggtggttttagtctgaattctgagatcatgcataatatgaatatgcagtccatggactgggggcctcagtttgacgctgaggcaaggagtaatgctgaagcaacaatgacaggtgggtcttgactaaatgtttgtggtcagttgtgatcttgggcattttttttaggacaattacggtaggtttctttgacaagtttgatcttaaccacagatgatgtcttaatggcatgtgcatgtatattcttgaaacatctcctagaaggggtgtaatctctgcaattgttatttccaacattaccaaatattactctcccacttcaaatttctcgggtgttgagagggttttaatatctcattcaaaatgcaaatttataactttggtagggttatatcaggaacaataaattttgggtttctttatttaatgacattcatgtgctcttttcatggtg

SEQ ID NO: 12426 - DNA, 875 bp, Pinus taeda
  Predicted polypeptide sequence is orthologous to G597
cggccgggggagtgggattcactccacatgtgatcacgatagcatcaggggaggatgtagcgtcaaaaataatgtcgttttcacagcaaggacctagggcagtatgcatcctctcggcaaatggtgcaatatctaatgtgacccttcgccaggctgccacgtctggtggcactgtgacatatgagggccgctttgaaatactttccatgtcaggttcatttttgctcacagaaaatggtggaacccgcagtagaactggtggtcttagtgtttcactggcaagccctgatggtcgtgttcttggtggaggagtggctggattgttaatggcagccagtcctgtacaggttgttgtagggagcttcattgcaaatggtcgaaaacctcggccagccaatcctgattcttctgctggactagcacaagcaactgcttctggaggagctgcgactgctagtcctgtttctcggggaactatgagcgagtcctctggaggtccaggtagtccaatgaatcaaagcattggagattttaatagtacaccttcacagccagtccagaacatggcctcctaccagtcagtgggttggcaaggctctcagtctatgggagagcctaggcgtaacacggatattaacatgtctttgcccggtggataattatagaagccttaggatctttccctgtggctgaatattgaccacatttatcagttaattggcactgactaccaacaggttttaagatgggctgcaattgttttcaaactaacagatggaaatttataggtttctcagaacagatgcaacttctccgttagttgtcacctgttttattttaagaactaagacccgacgttatatttcatgcttggc

SEQ ID NO: 12427 - DNA, 849 bp, Pinus taeda
  Predicted polypeptide sequence is orthologous to G597
cggccggggaccttaaagaggaagaggggaaggcctagaaagtatggcacagatgttgatggatttggtaatgtgggtttgggcttatcatccccatcatcaccattttcagataaaaaagcgcgtgggtctggcaaaaaagctcagatggttgcacttgggtgtgcagggcatggattcattccacatgtcatcactattgcagcaggggaagatgtctgtaagaaaataatggcttttatgcaacatgggccatgggcagtttgtgtactttctgctaatggggctatttcaaatgtgactcttcgccaaccagccatgtcgggtggcactgtaacatatgaggggcggtttgagattttgtcattgtcaggttcctttctactcaatgatgctggaggaactccaacaagaaccggtggccttagtgtttcactagctgggtctgatggtcgtgttattgggggtggtgtgggaggccttctcatggcagcaagccctgtacaggtagtagttggtaccttcctagttgacaacaagaaggatcttgggcgggttggaaatggtgaaccttccatcggcacattatcaggatccgtttcaggggggtctccttcaccttccgttgctgcacaatctcgggcagaagcttctgctgctactaatctgagaaaaggagctgaaggtgagcaaagtactggaggtagtagctataatatgcaacctcaagggttaagaatgatgtccatacaggactgggcaggtactcagtttgggactgaaacaaagagtgacacagagacagccttgacggacagagcaaaaccaagggaccgagatgatggatct

SEQ ID NO: 12428 - DNA, 865 bp, Pinus taeda
  Predicted polypeptide sequence is orthologous to G598
tgaggatgccggggatcgaaacgagggcgatgggaataatggtagaagggataacatggctctggtacctaccagtaccacgactacggaaggaaatcgagagcagagaaattcaggtagagattacttcgcgcttgttcccgtggatggagcccctgaatcaacaggttccacttcagatagggacgctccaacaagctcttgggacgcccagcataacgagggagccattgtggaaagtggaaatgctaatgccgaaaacactgcaaacaacagaggatttggctcctctgcttcctcgctgagaagtggtaatgagaaccctgtgcccactccaaagcaactcgctctacagaaagaggtcactttacagaaggtcaagaaagacaaagtagaagccaaggccctcgcttgggaagaagcgaagatggccaaagttgataacagattcaagagggaggaaacaattatcgaggcttgggagaacgagcagaaagtgaaagctaacatcaaaatgaaaaaagtggagagaaaattggaggaaaggagggccaaggcacttgaggaaatgcagaatgagatcgctatagctcataggaaagcagagaacaggagagctgtcgccgaggctagaagaggtgctgcaaaagccaagatatcagaaattgctgacaaaatacgctcgattggaaagctccccagaaaatttctcttcttgtagaaatccattgctataaaaattctcttcttctagaaatttactaatagtacagcattcaattctatgctacattattcaacatttataggctgagtattgtttatttggaacgtttactaatagtaaagcattcaattctatgct

SEQ ID NO: 12429 - DNA, 738 bp, Pinus taeda
  Predicted polypeptide sequence is orthologous to G600, G2768
tcccgccaccaaacgtttcggcgataagcaggccattatcgccggcatggcggccgacgcgctgggctacgtcttgctggcgttcgcgacgcgaggctggatggccttccccattatgattcggcacgagggattttcacaacgatgataacatggcaccaacaaagcgaaaaatgagattgatgccatcacaagcaactagcctggcaagggaggacaggggaacaagtactgaacgttatcatgattctgaacaatcacaattatctcctagagctctggggaagagaaaatctgatagggacgaagctcagacaagggatggccgattccctatggatatcaaattagattcccaagtgattactgatgatgaagtgaataaatcaaacaaatgcatctctggaaggccagataaaaaaccaaagggtagtgtgttttcgaggataagttttccagagcgcagagaaactgatgatgtccataccgctcaaggaaagaaaaggaatgtgagttctcatgattctctaaatggcttcagggaacatgagagcacggttaggcttctgaatggtagcaaggtacattatgatgatgccaagcccgtaaaaaggattgcaaatggcaggagatccatgtacgatgacgatcttcatctgagtgacaatgaacagaatttcaaacggaagtcatctcatcgacgagaaataagtagtgattgggatgatgataaatatc

SEQ ID NO: 12430 - DNA, 824 bp, Pinus taeda
  Predicted polypeptide sequence is orthologous to G605, G1944
gtcctcccgcggtggtggacggttcgagcccccgcggcggctctcagtattcgaaacgttacaaatccggtggccgcagcagctaagatcaagatcagcttcttttcacactaaaatttactcttattcagatctggaatctctgctgctttcagtaatgctctagaaaacacacaagaaattccatataactacactgagatttataaagaaattcaagcctataagctgaattaagcagagtacagtagagtatttatgaatgaaaggagagatttccccggccttcatacttcagggccgacttcattcttacacccaggattccaacagcatcaccacctccacggctccacgaatctcaatgctgctgctgctaataacaatgctatttctaatgtcaatccattctacatcccacagggaggcattgccagtaacgctacactgcgcttcatgtccagtcctccttcatctttagcaattggcaatgccaatccaaataattctcctccagaagggcctgctgcttcaccgggtcctcataatccattacctcctagaatgggaatgaatatggggtttcgttcagagcctttgaagagaaagagaggaagacccaggaaatacagtagtgatggagtaggtttgggattatctccattgactcccagctctcagtcattatccgaaaaacgagcccgcggctccggctccggcgccgggtccaacaagaaagttcagttggctgcacttgggagttcgggtcatgggatttactccacacatcatcacaattgaagacggggagggatgtgtcgaag

SEQ ID NO: 12431 - DNA, 426 bp, Pinus taeda
  Predicted polypeptide sequence is orthologous to G611
actcatgtttgttcactggattctttagaaatgcaccccatccagcaacatcagactttccaagcagcactcgttgctgctgcctcagaagcagcttcatgtttttgcagtcaccacccaaatttttatccccgcaaccaacccaacagttcctacacacatctaggtcgcattcacgcccagctgcaaagcaggggcactgtcggctccggcattgactcttagcacaatgacaacctctgaaacggttcttgcaactctttgagcacccacaatatttttcacagcaagtcccatttcggaggcaagggcattgctttccacatgtcagttgacaaccacatggtgtatattgtctacatggctgtccttttccatctttaattcttttcctgattgatggatgaccagcagacttgcatgtgt

SEQ ID NO: 12432 - DNA, 850 bp, Pinus taeda
  Predicted polypeptide sequence is orthologous to G611
cggccggggaatcgtttccgaggatgtcactgtgcaaagagtcaatgtcgaagtcgacaatgcccgtgctttgctgctggacgtgaatgcgatccagatgtttgtcggaattgctgggttggttgtggagatggcactttgggcggtccaccacagagaggtgataactatgaatgcagaaatatgaaacttctcctaaagcagcagcagcgagtactgcttggaaggtcagatgtttctggatggggagcatttttaaagaaccctgttaataagcatgattaccttggggagtatactggagagttgatttcacatcgggaagctgataagcgaggaaagatttatgatcgagaagactcctccttccttttcaacttgaacgatcagtatgttcttgatgcataccggaagggggataagttgaaatttgcaaatcattcaccgactccaaattgctatgcaaaggtgattatggttgctggtgatcatagagtgggtatttttgcaaaggaacgcattgcagccggtgaggagcttttttatgattatcgttatgagccagatagggcaccagcatgggcaagaaaacctgaaggtttgaatccaaagagggatgaaatatcaacgtctcatcgccgggctcaaaaagttgcttgataattctttccaatgataagattcattggaccttattgtagaagagcatataaaaatgcctcgcattcttttcacaaaggttatataccttttctaattgtaacattcccctctgtgggttcatcatttgaattttgtaactgaattttgtaatctttcaccctgaatatggggatgattgaatgatatc

SEQ ID NO: 12433 - DNA, 902 bp, Pinus taeda
  Predicted polypeptide sequence is orthologous to G616
atgagcgccacctactctcttctagtttttgcatccctagctgcaatcagctgtacgtgtttattatgctcgtttgcacagtagattcgtcgtaatattcaattgaaaagcctttggatgttctatgttttgaaagataaggtttcccaagtgacgcagaagtaattgtgtcattgtaacaaaatttgtaagagtagcgggctctccaagccaagacgagggaaggaataactttcgagaaaaccaggatttcgtcgggaagaggtgttcaacttcattgcagacatggcgacccatgttcctggtgcgaggaaagtagataacggttttagagttaaaaggaccagacgtgactttgatgcatcaccgatttctccatcttcaggaagcaagcatcagcatgctatgctacatgactcacatagaccaagacaccaaagaatggaattatctgtacgaaccgctatgaagttttatttccttcaagatatgcttggcttcgaccaaccgagtcaagctgtcgaatggctcattgaaaaggccgatgctgcaattcgggagttacctcaaccctcttccaaccctacttacggagcgcaatttgtgaattcgaacagaggtgctgttacttcatcgtgtgttcaaactggagatctgaaaacatactcacaggaaaatacattcaccgacagcgagcatcgtcctgagaatctccgtgaacaaattttagcagcaagcaacaacataggccaaaagtcgtctagagcaaagactcgggaaagcgacagcatagactccattggtcagggcgaaaagagagaacagagatccgtggtaatgaggtcagtgccttcgaactgtagaacaagagaaacggataatggtgtacctccaaaggagtt

SEQ ID NO: 12434 - DNA, 911 bp, Pinus taeda
  Predicted polypeptide sequence is orthologous to G620, G1821
tggagctcgatcttcggtcttcatcgatatcataatctctacctctatctccatcggggcttcgttgcctctgtatgtttgtaggtatgatgtccgaagttggcagcccaacaagccaggacagccgcaactctgaggatggagaaagggagaactgtgctgtgagagagcaagataggttcatgcccattgctaatgtcattaggataatgaggaaagttctacccacccatgcaaagatttctgatgatgcaaaggagaccattcaagaatgtgtgtctgagtacataagcttcatcaccagtgaagcgaacgatcgttgccagaaggagcagagaaaaactatcactgctgaagatgttctctgggctatgagcaagttgggttttgatgattatgtggagccattaactatttacctccagaaatacagagatgctgaaggcgatcacagaggctcaatcaggggtgaaccccttccaaagaaagagatgagtggtctagctaatttgtctgctggttttcagatgggtcatcctcctctttatggcacctcaggaatgggctattacaaggattcaatcacaggttctaatatcaattatgatccctatgctcagtataaatgatcaaagttgaattgatttcccaatgatgattctgttcctatgagattatgaaggtttttctcaagtcaagaggtcctctatctaaggtggtaatgattttggttcgtttccacctacagattttctgcgttattctcctttaattcatgtgacagtgagttactctctttattctctacccagtgataaactgttgagaatagactgatggatgcgattctatgtttctagggttttattaatttaaaagactgcctatcttaaatatatctatgaacgttt

SEQ ID NO: 12435 - DNA, 761 bp, Pinus taeda
  Predicted polypeptide sequence is orthologous to G622
cggccggggagtacagctcgtgcatggccgttaaatgcaaggtagcgtgagcagcgagacgaatttcgaagcaagcgaggtcgggttttgaagaatacgaacgtctggcgacagcctttctcggagccgcgggcgtaaatggcggtgaacggatcatgaatggtcgtgaacagcgcagaaacggcccccgaaacgataaaaacgacacaagacaccgcagggacgagcggagccgataatttggcgttattcagcccctggcgccgctgaaatggtggatgcttggagtctagacgtcgccatgtcgaggaaaacccagaatagataatttagtggaagttacctgataaacactcaaaaacgaggagtaaggcggaaggcaactggatgtagtgttgagcagctgagaatcgtttgaatttactctcttttccggttccttttccttaaatttcagcaattttgttgaaggaattgtaatcgggtttgattttcctcgggatcgaaccagcgaccgttgcggccgaggtttcgtgaagctttaagagaaatcgtgcaaaatcgacgtggattagggtggattttgtgctatggagaaactctgctggaattccaagcgccgggccgtggcttcggccgtgtggaggacaggatggattttacgttcgggatgctttgccgatctctgtgactcctgcgggtatgaataaattaagctttctctcacgcttttacgtcgttcatggcggtttcgtggctta

SEQ ID NO: 12436 - DNA, 635 bp, Pinus taeda
  Predicted polypeptide sequence is orthologous to G634
accccagcagtttggtttgccgcagcaccagtccgactcgatgcttcctcaatttctcgcttctctgactaaagaatctcctcatttccagacttcgcaaacatatgagaatgagtcccagcagtccagggatcaaaccccgctccaaccgaccaccgcagacaccaagccgaaggacattggtgaattttcgtcggatttaccccacctggtagcctcgcctatttccagcaggccgcctgcggtgactggaaccgatgtcgtttttaaacaggcgatacacggccccgacgagaacaacaacaacaataacgcggcggaccttggagacgatgacgcttttggcggatccggagggagccgatggccgaggcaagaaaccctcgcccttctcaaaattcgatcagaaatggacgccgctttccgcgatgcatccctcaaagctcctctctgggacgaagtttcaaggaagctcgcggagttagggtttcatagaagtgcaaaaaaatgcaaagaaaaattcgaaaatgtgaacaagtattacaagaggactaaggcgggaaggtccggccgacaagacgggaaaacctataagttcttcaaccagctggaggccttatatggcaacaccgacg

SEQ ID NO: 12437 - DNA, 794 bp, Pinus taeda
  Predicted polypeptide sequence is orthologous to G634
gatagtttcgtactagtggacgtggcagtggtactgcttccgccgtttgagaatcccagagctccctgacggtagagtgaatcaagttgttgaaaataagggcaggtcttcgaattctcaggcctctttctgttactgtccttggcttttctgaaatatttgtttatgttctcccacttttccttgcatctcttggcactacggtcgtatcctagacgagacatgtttgaggcgatctcttcccagagggggcccttggcgccggcttcttgaaacctgcgttccatgttcgtacgcaggcggattaagctcataatttcaggtttcggccatcgtttgttgttcggatcgtaagtttctttttctctgttaaccaagtcctgctgatcctgagcttcaggattcatggtattctgaggaggcggcagtgtgaatatttccgggagctgtagattttgcccggtgattttctgcagagcggaaataaatgccgcatcgcaggtcgccgcacgggctcgttcgttggaccagagctggtgctcgcgttccaaccgagccgcttcttgacgtctccatgcttcttctctgctaactctttcttgctctctttgttctaatgtatctagaactttctcgagccaggcttcttgcctgtccatgaatttcttcatctgcgcgtcgaagtacatcttcatcttcgatttccagctcttccgtttcctttttcctcggctaattatgtgattctcctgtatatcgtgactgtactcgtcatccgaagaagaatccgaaga

SEQ ID NO: 12438 - DNA, 937 bp, Pinus taeda
  Predicted polypeptide sequence is orthologous to G634
ccaagcctgaagttcatgcactgataaagctgagaaccggactggagcccagataccaagacgccgggcccaaaggcccgctgtgggaagaaatctccgctggaatggcccgcctcggctacagccgcagctccaagaggtgcaaggagaaatgggaaaatatcaacaaatactacaagaaagttaaagaaagcaacaagaaacggccggaagatgcaaagacttgtccttattttcaccagctggaacaattatacaagaaaaagatcttcggtaatgcagccaagcaagaacacccgaaccaggaggacgcccgcatcgagcaattacccggcggaaacaacaacaatagcgacagaaacgagcgccaaagcacagacggcatcctggtcattgtgccgcctccaggatcgtcatcggacgcaaagaacagcaatgcaaaccctaacaataacggtccaccgattccttcgagcagcggagcaatgcaggcaacgttctttacaagcccggagaatggaaccggcgccgatcagcgagctctgaagaagccagaaggccttgtgatggacgtgatggacatggacgacatgcggtccgcgccgcagcatcaacagcaatccgttgtagacgattacgatgatgataaaatggacacagaagaagaagaagaagacagcgacaataacagcgagcaagaacatcataatattattcctattcctactatagccactactcacgacaggcagccgacgacggtggtcgatcatctgccgtttgccgagtttgttcacgagagccgaacgagcactacagccgccgccacagctgccagttccttcatggccatggtccaccgcttcgctacaaccgaagctcccgagttcaaaacctctaaagcataaaccgccgcctaagattataaattatcatc

SEQ ID NO: 12439 - DNA, 783 bp, Pinus taeda
  Predicted polypeptide sequence is orthologous to G636
agcttgaagctctttatagcaacagccatggcggttctcgttctgccaatcgtactactggccaagaagttacaggcattgcagggcctgaaaaaaccagcaatgcagcatcactaaacttgtcatctgataacacctcagaggatgatcactgtaataataccccgctgcaaaaccctagccctcccaaaacccttgaacaggttaacaggaagaagagaaagaggaagcatttggcatcgataacagcgttcttcgagagcttggtcaagcaggtaacggggcatcaggaggaactgcacagaaaattcctagaagcaatagatcgccgagagcaagagagattgaaaagagaagaaacctggaagcgtcaggaaatggcccgtttaaacagagaaactgaacttcgtgcacaggagcatgcccttgcatcgagtcgtgaagcagccattgttgcatttctgcagaaaatcacaggacagaatctgaatctccccacttcagtcccaccaccctcggtaccaactgaaccaccaactgaaacacaacaagacccggacaacttagccacagatgcagctatgccggaccctaactgcaaaaggtggcctaagcctgaagtacagtccttgataaggctacgcagtaacatggatgtcagattccgagaggcaggactcaaaggaccgctgtgggaagaaatttcttctggaatggctagccttggattccagagaagtgctaagagatgcaaagaaaagtgggagaatatcaacaaatatt

SEQ ID NO: 12440 - DNA, 780 bp, Pinus taeda
  Predicted polypeptide sequence is orthologous to G638
gttttgcggtcgcgacccagggttttgcggggctgaagaatttaaacccaaaccagccaccgggggttctgaccagactgatcacgacggtggcgtaattgttcccaatgttggcggcggtggcggagggccaaagaagaggtcaaagaattggaagcgagcggaggttctacggttaattaagtttagggctgagatggagtcgagatttgccaagtccgctcggcgggcggcgctgtgggaagagcttgctgagcttttgggggcggagggtattaagcgggatgggaagcagtgcagagagaaatgggacaagcttatggcagagttcaaagatgtgagcgatggcaagagggaccggagcgagagcccttattacgcagaactcaccgctaccgttggcactggtcgctctgctgaagcagggtgaaatttctaggattaagcgtggggtgaagctctgcaacttctctattggcctaagtaaattctaatataatttctttctgtcagatcatgtatcaaaaaggccaggccaggccaggccatttaaagactatagttgggtagttaagctactgctttgtacatataaatgaatgatttgcttctgttacatatgaaggaatgatttgctgttatcttcaaaaggaggatttaggtcatcaagatatgtagttcaaggcagtgttctggcgactatggggcttctgtgtatgctgccttcagtgcctgtgaagccagctgctgtgtattttatctggcctgttcagaaacttc

SEQ ID NO: 12441 - DNA, 973 bp, Pinus taeda
  Predicted polypeptide sequence is orthologous to G652, G1335
tgtctgagggcaagagatccggaaaggttaagtggttcgattcgactaagggttatggtttcataacccctgatgatggcagcgaggacctgtttgtgcatcaggcttcgattcactccaacgggtttcgatcgctggccgagggagaggccgtcgagtacacggtcgagcgtgataatggcggaagaaccaaggccctagatgttacagggcctgatggagccttcgtccagggtaacagtggaggcggtggtggaggccgaggccgaggcgccggtagaggcggaggcggcgatggctacggcggcggtggttacggcggcggtggatatggcggtggcggtggcggtggcggtgggtggaacggaggtggtggtcgtggaggaggtagaggaggaggcggaggcggcggaagctgttacaagtgcggagagtctggccactttgcgagagactgcaccagcgatggcggtggtggcggcggcggcggcggaagctgttacaagtgcggagagtctggccactttgcgagagactgcaccaacggtggcggttctggtggtggtggcggcggcagctgttatcagtgcggtgatacgggtcattttgcccgagattgccctaaccgtgaaggttgagcatatcggaagcctgcccttcctctcttctcgatttccttcagcgttttgaatgttgtgcccgctgccgctactcacgccttccctaagatttcgtggtttctggcttttgttgttgtaagcctgttccagttttggggagttttggggaagcgaataagcccgctgatcttctatccagggggcagtggctgacacaggaattcagaagagatggtgcatttttccagttcttcactcttcggaatgattcacaagatcattcctttttatttatgctttttgtttatcacagctccggatacataatggactatgtttaatgcactatgttt

SEQ ID NO: 12442 - DNA, 880 bp, Pinus taeda
  Predicted polypeptide sequence is orthologous to G653
ctgaaacaagacttgtggtaggataagttttccacagtgaccttctcaagagggtatgctgtttttccacaggtagcacatttgtcttgagttccagagaacatcattgacactttactaggagatcttgtcatttcaggagaaagaccgtcaattcctttgcttgatctttgggactgaaagttcttgttgaagttgccgctctctctgaaaagctggtcaaagtgaggcttgcaatatagcactccctccattgacgagtaattactcagcttaagcgttcccttacaatggttgcatctgaagcaagccttgtggtaagaaactccatccgcggacagttgatccacaaaataaaccgttttgtcacaagctttgcacttctgctgcgttccggtgaaggccatagccacgatccgagaaattttattgcaaaataatggtccttaagccctcggtttctaaatggccgtggaaatctttctcgccccagtgtttgccttagaatacaagatctggcagctcctatggggattcagacaggctcttgccttttctacagcgaatagtcaatctaatacttctaaaactccattccaacccgttctgctgccggtgccagctaaagggcagaaggttgctttatatcgcaattccctcggtctatgagcctcaaaactgtaaatgctggaattttaatacttttcttcgttgaaaaaaaaaattaaaaccatacaactagcaagtcgtcctcggaaattaacgaaatttgaccgaaaacgatcaatttttgggcacctgaactgagtgctctggacgcggagaaaacacaagaacggactcgaacccgtgatctcccgataaaaggggccacaaaagt

SEQ ID NO: 12443 - DNA, 748 bp, Pinus taeda
  Predicted polypeptide sequence is orthologous to G669
acagctttcgcttgcttccattgatactcgagattaaagattgttctgttcaagcatgaggcgaacaaagggtttgtcaaaaccctcagatggagtgctccatcgaggttcttggacaccagaggaagacaggattttgaagacgtacatagaagctaatggtgtgggacgctggagtactctgccccaaaatgcaggtctgatgcgacgtggaaagagttgcagattgcgttggatgaaccatctccgcccaaatgttaaacgtggtcacatttcagcagatgaagaagagcttattataagactccataatctgctgggtaacagatggtcattgatcgccggaagagtgccaggaagaacagacaacgaggtaaagaactactggaatactcgtttgagcaagaagctgggcagcactggcgacaaccttgcacggtcactggctcggaggcagattgctaaggcaagtccacgaatcggcatggacaacgacgctgcagtacatctcaactctgaatctcccaatttcaagtttactccaagcctcagatcgccaacgggttccaccattgtccctgaagaaactcgctcagatattcagttaccgtcaccggaaagcaacaacgacggcgaccgaagaaccacagttcagaaagacgacacaccgcatttagaaccgctggatattgctcagacaaactcctgtggagtacctccgccggaagaaattgggcagtgcagtgca

SEQ ID NO: 12444 - DNA, 764 bp, Pinus taeda
  misc_feature (661)..(664): n is a, c, g, or t
  misc_feature (666)..(667): n is a, c, g, or t
  misc_feature (671)..(672): n is a, c, g, or t
  misc_feature (686)..(686): n is a, c, g, or t
  misc_feature (698)..(700): n is a, c, g, or t
  misc_feature (707)..(709): n is a, c, g, or t
  misc_feature (711)..(713): n is a, c, g, or t
  misc_feature (722)..(722): n is a, c, g, or t
  misc_feature (728)..(729): n is a, c, g, or t
  misc_feature (731)..(731): n is a, c, g, or t
  misc_feature (737)..(740): n is a, c, g, or t
  misc_feature (742)..(742): n is a, c, g, or t
  misc_feature (755)..(756): n is a, c, g, or t
  misc_feature (759)..(759): n is a, c, g, or t
  Predicted polypeptide sequence is orthologous to G670
cccaactcgtactggctgcacgcaccacgacgagttcagtttaaaccggtatacggacgagaaaagaactctagccagttgatgttgttagatggattattgctcgacctctgggcctagttactatctctgatccctaatccccttcggccacaaacgagaaactccgcccagttggtgacttacagcctctgtacctagtctaaaaaggcggcccagtccatagctttctttcagagtacggggatttaataattctctgaattgttagctgtatataataagctgagaatcgaagagtggggagatacgaagagtaatggggcgccactcgtgctgctacaaacagaaactcaggaagggtttgtggtctccggaagaggatgagaagctggtgcgccatattaccaaatacggccatggatgctggagtgcagtgccaaagcaagctggcctccagcgttgcgggaagagttgcaggcttcggtggatcaactacttgagaccagatctgaagcgaggcacattctctccgcaggaagaaaatctcattgttgaactgcattcagtcctcgggaacaggtggtctcaaatagcaacacacctgcccggaagaactgataacgagatcaagaacctctggaactcgtgcattaaaaannnncnnaggnnacgaggcatagatnctaacacgcacnnncctctcnnngnnntgaatgccngagcanngnattctnnnnangataacagcaatnnaanagtcg

SEQ ID NO: 12445 - DNA, 992 bp, Pinus taeda
  Predicted polypeptide sequence is orthologous to G715, G1646
ggacaggagagggcaggcagccatggaccaccacaaccaccaccaacatcatccatcttcttcttccggcggagcggcgccgcaaggcatgtctcagggctatccgggcggggcagctgcacagccctcgcctgtgggcatgcagggacaggccgggcagatagtgcagactggtcttcaccagagcggagggcagcaggccttccaccaccaccacatgcagcaacaacagcagcagcaacagcagctccatatgttctgggcttttcaaatgcaagaaatcgagcaggtgagcgacttcaagaaccaccagctccccctcgcccgaatcaagaaaatcatgaaggccgacgaggatgttcgcatgatatcggcggaggcccccgttctgttcgccaaggcctgcgagatgttcattctggagctcaccatgcgctcatggatacacgccgaagaaaacaaacggagaacgttgcagaagaacgacattgcggctgccattaccagaactgacatattcgatttcctggtggacattgtgcccagggacgacctcaaggaggagggtttgggtttagggtttgccagaggtggcgtaacccccgagggttctttctattaccctcctccttccatgccccaatcgccacatcagcagggaatgatgggctcctcttccatcatgatgggcaggcctgttccacttcagatggacccatcggccatgtatatgcaccaacagcagcagccccgtccctatggaatgccaactcatcctcaccagcccatgtggcagcaccctcatcatcctcatcagcagcagcaacagcaacaaatgccggacggacaaagttatggacatccacatcagcagcagcagcagcacatgccggatggccagccttatgggcaacagcagatgacagatgaacattcttatggaacttcccctcgttctgccaactgagaagacaagtgtatttttcacccac

SEQ ID NO: 12446 - DNA, 763 bp, Pinus taeda
  Predicted polypeptide sequence is orthologous to G718
ccccgttcttctagcgcgaacatccgccccccggaacagatacggattcgaccagctcagcggtctatgacacccaactcagccggtcacatgagttcgaggtccccccaaggacaccacccccggacctcatccgtcctggcacccagtccacgtcaggcgtataaccatggttcccctgataccccacatcatgatgattgggtcaggaagtacggtccccctcagccgatcatgttctccaactctgttcctccttcgaaattcgacatgccctcgcgcgactactccgccaacggctaccgctctcactcgtcgtcaaggccctcgagaccgtctgtcatcggatctccctcttcacagatgtcgctgttgactaaggaaaacacgatcgccaacagtcatagccgagcgttttcgcgggggcccatcgaggataactggtccgtgattgatgaagacgaagaatgggaaaaggagcaacaacgtgcagcttaccgacgtggacgcacttcttctcaatcgtccaactctcctcccctcacccactcccgctcccgcaccacctcctcatcgagcggttactatcctccaaggtcttcaggcccagaaaagatgggacctccccccgcccattccactggggctggctcaatgaagcgtcattttttcagccgctggttcagaaacgacagcgataaggacctccgcactgtcactgctcctcctcaaaatcgcctccgtcgacactctttcggcagct

SEQ ID NO: 12447 - DNA, 881 bp, Pinus taeda
  Predicted polypeptide sequence is orthologous to G735
gcaaggcgttccagaagaagaaaacaagcacatttgagtgaccttgagatgcaggttgcacagttaagagtagaaaatgcttctttattcaaacgcctcactgagatgagtcagaagtatagtgaagctgctgttgataatcgagtactcagagcagacgtggaggcattgagagcaaaggtgaagatggcggaagatatggtagccagggcaactggtgtaaatcattcaattcaaaacccaacccagatttcacaagcttctggcatgcgatatatgggtggtccagtagaatcacctgtaacttctggtccgcaggattcgagtcgatactcacatcctggacagccagtctcaactcaaggaatgacttgcgatgtatcaaatataaatgatcggagtaaagaggtattgccacataatgttggaaccaaaatggggcggacaccctccatgcaacgggttgcgagtttagaacatttacagaagcgaattcgcgggggagttgcctgtggatccacgccatggagtggaggctgggatattgaaggctcacctcggattgagaatggtggacagtaagctactggtcaatctaatctttcattagcagtagatgttcccagaattatatttgtattgccatccaatgtggagtgtaaaggtcaacgtgccatccgggtacaaactattgtagaaaaaatggcaaagttaggtctgaaaatatccatttggcctgctctagttgtacagtacatgattttgcactcgcacaacaatggactataattattttcctggcaagtttaaattcattgattcccagaaacaagaaagctgcatgtgtaaattacaaatgaaatttagggaagtcattacat

SEQ ID NO: 12448 - DNA, 917 bp, Pinus taeda
  Predicted polypeptide sequence is orthologous to G744
ccttgacaggatccatttatgttttacagcggctaaaggcatggaaacagactccttggaggaaaatcaaagttatatacacaagattcaaacattattcaatgacagaatttttcaccaataagaggggcattaacgatctcacttgttctaactctactgtgtacagagtattaaatatcttgcctgcagacagggcaagatccatgcctaatgagccatttgtctacacaggacatgtgaaacatgtgatgacattgaggcaagctcctagcaatttctccttgttgaagatcctgcaaacatatagtgcaacaaatgttctccccagaagcatctttcttattttgtttcgtgatgagatgtgaaggaagtttcgctagagaagccccagacaatccttgtgttccaacttctccaaagatgtcaaaaatctcttcatgactcatctctgcaatattaacctgccagcgatatgcagttaacattgctgggccaacctgttcttgcacaaatcttccattcagcagctcttcaatgaaatctgccattgatgaggaatttctggatccagaccgctctgagtaccagtaagcacgagaagcttccaatacctcaacagaaagaacagccccagcaaccgctcctaaaccagctccacgaatgagaccactgtcagaggctcgtcctgctattgccccagtgacagctcctgtaaaagctcctgctaaagcaaacatgccagttaaagctccagacagagcgcctgacaggagacctggaacgcagaaacgagatccaccctcattagcccctcttccaccattcctagcagatgtgaccctgttgtggggctgaaattgaatcaccggcctgagattcccgcacatggtgcacgcgttcaggttcccatcgtt

SEQ ID NO: 12449 - DNA, 870 bp, Pinus taeda
  Predicted polypeptide sequence is orthologous to G748, G1900
tcaattacaacgggtggcatttttaaagcattccagcccaagacagaagagaaggattcagtgaaagcttctacacaggggttgcgctcaaatcctgcagcattttcaagatctatggcttttcaagaaagcacttagaacttttctcttttcaccttcatttctttcagggaaggctttaagccattttacgaaagctctcataacacccaagaagatgttattgggaaatttcagtgtacattgtaaagtatttggtttcttactttggttagcagtccatattttctggttggcaagtctagtcagattttggagttgtatcaaagagtgtaaaagtttgtgtcatttgccttcttatccaagcattttttacaaatttgcttgtgctgtgaagaagtggcattgatggtcacgagctgtaaattgctagaaaacatgataaatgagggtataataaagcggcaagagcttggatgactcaagaagcaagaaactatctgacagtcaaaagtggttattggcgttatcacaagagaaagagagtttcctgacatatttggagggatgttcatcgagagcagttttatatcctagccctttttcttcttcgcattcttgaattagtcaggagcatctttatttggtggagcaagacagagccacggttgaatattagaacattgtataatctttcattgtcagagatgagagtgtagatgctagtgtcttcaggtaggctttacgttacgttgacattacagccaaagaatcagtctggctagtttatgtgatcacgaaccatgaagctgatctgtttcttttgtctcatgaaaatggcatcatgcctttgtgggtggatatggaaaa

SEQ ID NO: 12450 - DNA, 866 bp, Pinus taeda
  Predicted polypeptide sequence is orthologous to G748, G1900
tatgggtggaattttccaaacccagcatggaatggcgctgctgctgctcttacccctggttggcccggtttgtcttggcccatggttcctggatcctactttcctccgcctcctcctcctcctgccggatgggggcctgcaccatgggtttctggaccctgggccgccgccgctgccaccactgcttctaatagtcccgctgttgcggattctgggtctccaactctgggtaagaggccacagtctgaagatgggtgtttgtgggttcccaagacactgaggattgatgatccaggggaggccgcaaagagctcaatttggacaacattaggcctaggggacaagccggagtctgccatcactagtggggggatttttaaggccttccaacccaagacacagggcgctaaagattcaagaaaggcttcgcaagctctgcaagcaaatcctgctgccttttcaagatcgttatccttccatgagagcagctaatttcattcaaacagcccaatccagcaaaatgatgagtttgtgcagaaatactggttttgattataagagcagggttcagacatatatccatgttcttaccgtggcttgggaggtccatactcggacttataattgagagagccctaatagattgcctctccctccctttcatgctccggggaaggtgttagcagaacaaaatcatagagagagcctatatgaagagagattgcctgttaatgctgttcaatctaccctttacagtattttcttcctgattgctcacaagagctgattgggagatatacaatctgtatatgattacaatttttgcttccttttgggagtctatgcttaacttttctattttggaa

SEQ ID NO: 12451 - DNA, 786 bp, Pinus taeda
  Predicted polypeptide sequence is orthologous to G748, G1900
gagaggattcaggatttccgggcttttgaaaagaaagttagatttattgatggaagtggggagattgagtttcggaattccgtgtagaacggggtgagttgcgaggagatttgcagtttggggattgggttttttcgagaggggcgatttgattttcccatttacgatgtcgaaggattgcgtggtggtttgtttgagtggcaacgacagaattcatggtcatgcggacgagaagggattcgatcccgggttcaagctcttcgggaagactatcccggtgcgcgcagcggaggaaataaagcaggaggaacctgtttctgggcagcagcctggatctcacaaggaacagagcctggaaggcgaggaggaagttcagcaggagactggtagcagcagcgaggatgggaaggacgagagtatgaacgagggaaaaagcggggggcagaagacggtgttgaagaaaccagacaagcttctgccgtgcccaagatgccagagcatggataccaaattttgttattacaataactataacgtgaatcagccgcgtcatttctgcaagaattgccagagatattggacggccggggggacgctcaggaacgtgccggtgggtgccgggcgccggaagaacaagcattccgtagcggcgtccacggtatcctcgcattaccgtcaggtaatctcggcggcttccgagtgtggccttggggttcgaaccgatgaccaggactctggcgtcgaccaggttatgatcccctgtgccgcgctgcctgcatcctgtgt

SEQ ID NO: 12452 - DNA, 676 bp, Pinus taeda
  Predicted polypeptide sequence is orthologous to G748, G1900
atggtggctgtaaatgctgaaataatgcccaaattcgaagggaagtctgcgaaatccctggattcaacattcaagctgttcggcagaacgattgttgtgaaaaatccctgtgatagcagcagcaatggtattcatgtcgatgggattccagctgaagcagtgaattcagcagtccccaaggcttctgaaacgcatcatcatgatgagaaacagaagcagaatgaggattcagagaaggtgggtaaaaagcccacaaagcttgtgccctgccctcgctgcgagagcatggataccaaattttgctatttcaataactataatgtcaaccagcctcggcattattgcaggagatgccagagatactggactactggtgggtctctgaggaatgtgccggttggggctggtagaaggaaaaacaagccctgcttcggaattaatcacaggcagatcatggatgacactgaaactggttggaatgatgtgcagggccaggcttctcgtgggaattctgataaattggtcaaggttgagccattttatcctgaattcgagaagtttagagagggcttgaatgaagcggcaacgccgaaagaaggtaactctaaaccccaatccataatccaatcccaatttgacgattattcacatcctagtacagtgaatttggctagag

SEQ ID NO: 12453 - DNA, 835 bp, Pinus taeda
  Predicted polypeptide sequence is orthologous to G748, G1900
cggccggggaattttacccatatggctaaagagctagaaagtgttcagaaacccagctgttcaagtgagaaaacccagacaagtgccaccaaggcagattcggctgagcccgtggatgacctgacctctgattcaaatctcaaatcagaacccaaaaatatgagtccagacgggtcttcttcgtcttcttcttctatgaattatacagggagtccttggcctgtgtattacaatggatgctggggaagctttcctccaggtgtcgagggctctgagaaaaatagggtgccctggtacacaccaagtacaggatttttgccaacaggtttgaactggcctgtgccttctggagtaatgtggggcttgccttggatggcagggaatgataattctgaatcaaaaacattaggcaagcaccagagggaggaaacaccacaggcagtacctgaaaacaagaatagatctctttgggcgcctaaaactttgaggatggatgaccctgaagaggctgcaagaagttcgtttttgacaaacttggggttggaaaataagaaggaaggatccatcaagtctggggaaattctcaaaggatttcaattgaagatggacaacaaagatgacaaaaggacgacttctgtgcaggttttgtgtgcaaatcctgcagcactctcaatatcgtcttcttttcttgaaagcagttgatgtatgcttaaactgctttccaatatgatttggatatgttgttcgtagatgggaaaacgttgttcacgcatttaagatcatacgatactttgttcctgagagtgactagttagatcactgcatctacagcttt

SEQ ID NO: 12454 - DNA, 882 bp, Pinus taeda
  Predicted polypeptide sequence is orthologous to G760
cttacagttacatcattttcatttccttctgaggaatcttccattttgtggagttgcatacaaactcctcttgcagctgtaccctcaaatgaaaatccttgcttatgactctgcaaaactggactacgagagcatatctggattccagttccctcacaatcaaatgagggattagggacctcccataaacaagaatcatgattctccacctcccctatggaaggtattagattcttgacttttatataacctccattcaaaatatcagcacagctatctccaagggaagtatgatatgctttagaattagcatagtcctgtgaggccacggacaacatttccgctagcattctttcttcttcaaaatatgcatccaaacgtccatttggaactctgtactgagaaaagcttatattaagtggaatttttgggaactcactttcgacagatggaagacatgcagattcacattgcatccttggagtgtctggcatagcatcaacctgtgtgtgaattgtgtccttaacagctactacacttgaagagtttgaactagtgtcatccagcaatatgtctaaccatttcttaagtggcgcactatctccagctgtatcaattaaaatctttgatgatatttttgatggtaaatgtaaatttgcatcaatcccctccactggctttgacagatcttctgattgcacttcaatttcaccagagcaaccaggggagggatttttctttgtaggagataaatcacccttctcaagtggtgatgtgtactgttctccactttttgcaccaagtccactcttcttgaaaacacgacataagacaaaagcattctgcaaacgaagccctgcctcacatccatttcctcgagaa

SEQ ID NO: 12455 - DNA, 514 bp, Pinus taeda
  Predicted polypeptide sequence is orthologous to G760
atatataaagaaccaagtccaagctattccatgcagagatattactccatgttcactattaatcgttgaaaattttaccgggaagatcccaaggctcaaacttgtatacatcaacctccgctattgcatcaagcttcagtggtctattacacacttttctcttcagataatataggataagctcctcatccgttgggtggaagcgaaaaccgggcggtaaagaaactcgctcctttttagtccgaaccatatttacagaagctgtacaagatagtgtatatactctgcactgtcccgtacaatcccacaactctgctaacgttgatcacaaagcactcttctacacctatccaaatgtccaaaatctgtgaaaccacgttactgtatgcaaatgttgaccaagtagacaatccaattctgaaaatttaaaccctcaattgatttgcttgataagccaaacaaaaccttgcaaaaatttataataaacaagattctggccaaaaaaataactcct

SEQ ID NO: 12456 - DNA, 922 bp, Pinus taeda
  Predicted polypeptide sequence is orthologous to G760
cggccagggatgaagaagactctggtgttccacagagggcgctcgtctcgcgcggagcgtactagctgggtcatgcacgagtacaggcttgttcatggcgaggctggggagtcttctttgttggaaaaggatcattttgttctctgtcgagtattcctgaaaagtggctctggtgcaaaaacttgcgaacagcatggagtttctctttcaagagaagattcaagatcaacagataatcagtctgcacttgtgacagaaaacaaacaatatgatgatgttatactcccatcttcaggggagggtgaggtagaagagacatattcactgctgaagccccttactgccacttcagaggaaaacaccattccctgggatggagatcatctttccaagttcttgctggaatgtcttaaagagccagataatgatcaggctgcttgtgattcactgcaagttccagttggggctgatgaatggtctggtttaattaatgatccttttcctgaagtggagggagtcaacactcttgctgatgaagtggacattttgatcagaaatgatacacatgaacaaagttcaactgatcaaaatttacatacagaaaggaatgttcacagggttgattatattgatgaagcaaacattactgagcaatcaaatttcgaggaattattttctccagcttatttaggtggagactttttggagttgaatgatctaatttcaccacttgattcagatttccttctctaggtcaatatctatgatatacaaggctaccacattagtagcctaaatatgggttggaagtgataagtatgcttggttactgttgacaaaatccatgtgtcaacagcaattaaaaacaaatcccagaacatatacatttgcaacgactatttcaagagttggctacatggca

SEQ ID NO: 12457 - DNA, 802 bp, Pinus taeda
  Predicted polypeptide sequence is orthologous to G778
atccagcggggcactctgttctaattcagatgaatcttacccttccagttgtcgtgccagtacactgtcatctaagaaccaacctcctgctctaaacatggttagggtatattcgaagcccgtgcccacctctgagactagtgcttctgaccatgattgtataactgccaaagcagttgaagaccagaagcaagggaacaataacagcatgagtgaaagtgctactattgcgaaagagagaaccatttcagaaaactgtgagggcgtggaggttaccttgacttctacatctgcaggttcccctaataatagcatgacgcaaaagagcgggaaggagcctagcggtacgagatggaagagaaaatttagtggagaagaagattcaggttgccaaagtgaggacccagatgataatgagtctgcccaagcaaaaaaacgacagactgggagacggtctggctctagtaaccggagtagagctgcagctgttcataacctatctgaaaggaggcgtcgagatagaataaatgaaaggatgagggctttgcaaaaattaatacccaattcaagcaagactgacaaggcctctatgctggatgaggcaattgagtacttgaaacatctccaagcacaactgcagatgatgattctaagaaatggaatgaacatccctcccatgatgatgcccctgggtatgcagcagctgcagatgtctcttttggcatctttaggacctacaggattaggcatggggatgactggtgttggtcttggtatgggggatgggatgatggacatgaat

SEQ ID NO: 12458 - DNA, 480 bp, Pinus taeda
  Predicted polypeptide sequence is orthologous to G779
acttgcaatttcctgcaagccaataacggcatgctttatcctttttctgaatctgtcctctcctgcacctgctattattccttttgtccatgatttcttcatatctctttggagctacaacccttttggagttgtggctgcttttcttacttcctcttgctggttctggtttgtctgatgagatgatacccatgtcgatgtccatggctacggattcggatttttctgagatgatgtccatgtcgatctccatcgctacgggtttgatttccatggctctgccagtgaggaaaaaaaagaagatgaaacaaacaaattacgtgctctgctctgcttacttgaaccgccaaattatttagctcattcaattccccacagtcctccatcaaattcaaatttataaccttcaattcctccatcgttcagttcctcgaactatacctttcgaccacttcaactaatatttttagttacacaggt

SEQ ID NO: 12459 - DNA, 903 bp, Pinus taeda
  Predicted polypeptide sequence is orthologous to G791
agtgttcgagcgatctccagttcaagacatgtcatgaccatgaacaaaggattaataattgttctgcaaagctccagtgtaatttttcataatacagcagttaatccatttcatcatcaggatgaattgtaattaatcctcaattattctatggcacaatataaaaaaaattagaatattgaactgatgcaatggcacctagcatctaaaacttggataccaaagaaactaaggtcgtttcgagggccaaagaaatagtagcaccagtttggaatataaaataagagcctgcttcaagcaacaggaggccttagcacgtgatcctgggaagtatcaaccacagctggaggcatccattgccacattgccattccaggatatcctggaacaggcatagttttgtttgctgctgcttgactttgggctgcaaaagcagcagccgcatgaaatgctgcaggatgcggcacaaagcctgtgggcaaagccattgctttgacttgttgctccaatttttccttttctgctttcattctcagcttttcatcacgaagttcatttttctctgccttcagatctttaatggcttcctgcagtcgttcattctcagctttcaggttctgcgcctcagttcgtagctgggtcataacacgtgcagcatcagacaaaattgtggctttgtctgccgtcttgggaggcctacccggttctaacacagagcttagctccatgaacctatcattaagtctgtccctccgcatcttctcacggcaagctttggacccaggtccaccactagattcttcccgtgacctctttctaggacataatttatcttgctcgtccatgtccttattggggccatcaatttctacactaccacttacgtcgggctgatcatttatg

SEQ ID NO: 12460 - DNA, 797 bp, Pinus taeda
  Predicted polypeptide sequence is orthologous to G802
gggaatgtctatgtcaatgccggcggcggccatgtgggcggtagcacctgcgccgcccgggatgtcgaacagtgggcacgggggtttctggatgttgcagcccgtgagcgcggggtcgaacagtaatcctccgcctttaatggccgcagggccacaatcggagcccatctggacattcccacccacgggctccacggggtatcgtatgcccgctggaacctcaattcagctcggagctgctgctggctcgggttcgagcttgggtagatcgagcaacaatggcaataataacaacaataatggcaatcaatcgcggatttcttcatcaactggtctgccgtttatgccaagaatgaatctgcctatgggagggagctgccatgaagtatcaggttctggatcgacgcgtttgggatcaggcgctgttcctttcagttccatgttattgcagcagggatcgagcactggatccatgggggcagcaacaggagagagtcatctgggaatgctggctgccctaagtgcgtacaacaaccgttccatgagttctgaacatcaatcattgcaggaatctgtgaatcaacaatctggcgtggatagatcaggagaagacggccacagccaccagaatcatgctaattctcaatagaccgcccccccatcccccccaacaaccaaaagaaagatcggaatctggattacattttaacattatagactgacattggtgcaatattattgcggatgaattttcagtttatggatatatatataattctttcatagctatggaatcc

SEQ ID NO: 12461 - DNA, 836 bp, Pinus taeda
  Predicted polypeptide sequence is orthologous to G802
cccaagtggtcctttggaccaacaaataacactacctcaagcagctctagaagctgagagatctatggaaaagaagaatgagaaataagaaaagacatgtactaaggaaaccgagtttgtttctgagagtctcagactccatgtaaacaaacaggatggtgatgacctgcaaagttgtgttagaactccagccgaataagggatccacaattaatatgtaatcctgtgtgcatcagattgaatgaaacctatgttgcagaaggaattgcagttatcctggggttacaagaggatgataatcagattcgtttcttgtcctgtatctagtgtttctggagttcattcacagctcagcatccatcctaaattcaagaatatggggtaatagaatactccaataaccaatgttgcagatgtctgcagctggtccaggctggggacttagaaccactaataaggtcatcaataaggtcatgatcaatcatgtaactcctgagcagctaaaaatcaaacccaaactaaatcaaataccttcatatttttttggtcctctgttatgtaggtctactgagagttggccgggtggtcatcgccgctgtctgcaccttgctgctgctgatggactgaatccatagattgatggtctgaattcatggagcggttattgtaggcattgaaagcagccaacatacctagatgggtttccccgccaccgagacctagtccggctcctggtaactgatgggagctatgctgctgctgctgctgctgctgtagcaacatggaacctagggggacatgactcaagcggccacctggaactcaagccccattcc

SEQ ID NO: 12462 - DNA, 814 bp, Pinus taeda
  Predicted polypeptide sequence is orthologous to G807
cggccggggggatcataaactgtaaccttttccagaatttaacagatcaaaggattggaattttacttcattgcgtgtgtttttagtttccactctgcaaaagcataccttcatccattccccacggcattagattcaatctattctattaggccctttaagcgaagtcgtgggttcaaacccggtcgaatgatacgaatttgataccgtttggtgtagaattccgattgatttcgtgctgcggaggttcacagaacggaagcagcaatgggacgccccctttcttaacgaagacgtatgatatggtggacgacccgaccacgaattctatggtgtccactgtcatggagccccggaagcaactattttattgtgtagaattccactgaattctcccgtgctctcctcctcacttactttaagcacagcttctccagtttcgtcaggcagttgaatacatatatatgatttgttgccaattctgttcaacacttcaggcagcaacatactaacaagtttattcattattcattatgaaatcatcaaaaaaagctgattcgcaccaggtggttgtactagacaaagcattaaaactggctgaaggatgggtgaagcaaatgaatacggggccagacactgctgaagacgatgtaggtgaagaagaaatccagaatcgtcctgcaaggttggggttaggagcaaagtttgttcctcactcaaagtttgcagccaccttgaatccggttgagaagaaactgcgtgcaaaacttaatgctgcaaaaagacagtctgatctaggcactgaggaggcagg

SEQ ID NO: 12463 - DNA, 418 bp, Pinus taeda
  Predicted polypeptide sequence is orthologous to G811
cggccattatggccggggtgaaggtttggaagcatgaacctatgaagtcccgtgtaactgttgacttcagttaaagtcttttggacaaacatgcacacgttcattcttctttggccttaacaatgtgattcataataataatttgtgggatagttatttgtgtattgtattgtggtgtaggatctctcagagctaataatgtctgggagaattttattaatctactgtgttttatacactatctaaagcaagtaggttcctgttgtacgtgatcaagatgaaaagttgttatggcgagccttcacgggtacgatacgatggtttggctgggctaatttgccagtgtgaaagagttctgtgacatatcatattgtgatagtcatgcatttatatatttttacacgggttgattcatttc

SEQ ID NO: 12464 - DNA, 843 bp, Pinus taeda
  misc_feature (763)..(763): n is a, c, g, or t
  Predicted polypeptide sequence is orthologous to G839, G1196
gccaggtagcctggttcttaagcttttgctaagatacataggttaaatgctgcagcagtctatttgagaaagaatcttacgagtttgtaatattttcctttgatgataaaagttacgcgtttatcttgttggctgtcttcttatataagaagtgatctctgtatttgctttgctgataaaccgtgagtagccttcccttgctgatttaccgtaccaagccctatagtccacttaaggtgaagaagtccgttgatgccgaggtcaggcgagtaaggacgtgaagtagctgaggacgtagcaggtggtcgttggaagctgtatctggggagctcgtgagcgctaccagctttatctgagttaaatacacgtaccccttgttgtatgggtatcagagccataaaagagatagttgagcagttattctccctgttcagattttacagtctttaaatattgattctcctccttcttggtcgatttggttcaaagcattttcatgaaatagagtctgaagaaactttaagatctggattagaacaattgtgtagcaattcagataaagatatgaatgctgcatgtcttaatattgaagaaactaatggcagagtcgtctggcggttgccaaaagtttctccttcaggtgtatattctggagtttctctatttcatttcaaagcccgcagccaaatcaaaattaaagaaaaatcaataaagaccaaactcaatttaaatgctatgatgactatccctttcctcgaatcanaggatattcaggctgctatcaagtctggatacgagtatgtacatttaggaatggtgcttattgggattaatgacgtgcat

SEQ ID NO: 12465 - DNA, 813 bp, Pinus taeda
  Predicted polypeptide sequence is orthologous to G852, G2633
tctagatgctacaattccaagggatagtagagatcgtatgaatgttgaaaaacagtgccttgcccgagacatagtgaacataattgcttgtgagggggaagaaaggattgagaggtatgaagtcgcaggaaaatggagagctagaatgaccatggcaggctttagtgtgtatcctctcagtgctaatgttaaggacacagttaaatctttgctccaccaatcatactgcaatagctacaagaccaaggaagaaggaggagctatgtattttggatggttggacagaattctcattgcagcatctgcttggcattgagaagcaaggactgtaagaaggttcttgtacaagaatttcttacaatttgtcgataccattgcagaaactacatctgactttcatgtgtgtcagggaagagttcagaaacctgacacaataactttttataggggtaaaggttgaaatgaatttaaggaaacagtggtttttacctgtcctgttcaaccaggtatagtagtcatagttattcgtttgtattttgcttccttatgcaggtagagaggaaaatgctgaggcttgctaaaatcagtgatatgcctgcctgcacagtgggcaactggatagagacagttaccatgtaactttcaggaatttatgcttgactagctgaaaagtattggaatttttttactttttggttgtgaccttgagtacaatgtctcataatcaactggatgaaaaatcaagtctatctttcaaatgtttcaaccaggactatatcactgatattacagcaataaaagtggtgaaatctg

SEQ ID NO: 12466 - DNA, 764 bp, Pinus taeda
  Predicted polypeptide sequence is orthologous to G852
actcttgaatttgccatggacttgtgcatgggaatgggagggttggaggatcaagggaggggactgagcaatagcctcgattataatggttataatcatgctgctcccctttacgctgcatctgcgggtgtgaagcctgcaaatccatacgagcttcccatggatgcgattagtctgcttcgagaagatcttgtagcggaaaataacaattcatgcttaccttggcatgagattgttgataattctgctgctctcgtgctctgccaaagtgcagtctaaaggaggaatgtctgctccattgtcaacctttgaagagcgtcaagccgctctggtcgcggaggttctcggcagaggaatgtcttgtaacgggaatgagactgtgcaggacgagcaggggcaagagccagtgcatgtgcagcgtccacttgaagacggtcataaatatttgtcagctgttgcgcacgggataaaccttcaaggggaaagtatcaagacggagcctgaggaggaagcaattggtacttatggcaattctttgcacttcggccatcgttttggcccctcagtacatgacttctcgtctgtcaggctctcgtcgagctccgtaatggcgcagcagaatggagagaaagatcgaagagcggttttgtcatcgggttcatgcggtgcggagggcggcgggtggcaatgtgccattactaaccagatccttgattatgattctttgccggacatcagcattcgcaacggcgaccagttcccga

SEQ ID NO: 12467 - DNA, 860 bp, Pinus taeda
  Predicted polypeptide sequence is orthologous to G861, G1140
tggcggatttttgtttttgtttttgcccttgctgtctacgatttgtatgttaatcgcgcgagatctttcctgttgttgtaaatctcagtttggagtgacatggcccgcgagaaaatagaaattaagagaatagctaacgcgcccgccaggcaggtcacgttttcgaagagaaggagggggttgtttaaaaaagctcaagagctgtcgattctatgtgaagccgatgtagccctcgtcgttttttcttccaccgggaagctctacgactattccagttcaagcatgaagatgattttggacaagtatagtttatatccaactacgaatcaaaaggaaggacagccgaatcttgagcctgaaactcaagatatccgaaggataaaacaacaaattgaagagattactcagacattgagaaatatgcatggcgaggaacttgaagaattatctctaaatgagttgcaacaactcgaagaacaacttgaaatggggttaagtcacgtccgatcaaaaaagggtgaaaatattgttaaagaaataaatgcacttcaacaaaagggaatacgaatcatagaggagaatacgaaactccgtcgagagctaaaggaaggatatctcaggcatgtagaaaataatgatgcagaggagtctctcttaattgaaccattggaaaatcaggatcctcagtcatctgaatcaataactacttatgcttttaatttcaaattacataaatcggccatgaaagactatgaggattctgacacctccttgcagctggggttatcttcgcagtctaaattttgagactctcgcaacgtcatcttgagtgattatatttcaaaaggtccttcatattt

SEQ ID NO: 12468 - DNA, 832 bp, Pinus taeda
  Predicted polypeptide sequence is orthologous to G865
cggccgggggcatcttctgcagtctcaaatgtgcccaaccatactcgagctgccttcttaggatcacgaatctctgcggcccattttccccacggtctttgccttacccctctacaacgtttcttttttggtggattctgtggctgtgggagttcatcatctctcttccagctaattccctcttgtgaaggagaacgttcctggtgctgatgttggtgtggcatggttatgcttggtacttctacataacatcaacaatgcggtgagacccattaacatatatttattctagaatctatctctacatatcaaagagctcaataatcatcctagaaagtcgtagattttgcaaattcccatttctatttccccattatttagcaaaattgtactttagagaattcagcgcatgcttgaagaattcgcaggctatagattttggatccttttcgaacacagggatgtcttggagaaataatctcagtgaacgatatcaatgaacttagtgttatcaagattgtggatgaaagaacttgtgtttgtcatgagtgctctatagataagtacaatctcctgaaaaagggttccatcatccatgaggaggttgtagaagagagaaaacctgacaaggaatccaccataaaaaaagtaacagatttacgaatcggtagaaggtcaagtacattgaaaatcgggaatcctgttatacccatctatcatcttcacttttttttcctaacgttattgtcattctttctgtctaaagcatatgcccttattgaaaccggaaccgaatattgatttatttaaatctgttgtattattgcccctc

SEQ ID NO: 12469 - DNA, 756 bp, Pinus taeda
  Predicted polypeptide sequence is orthologous to G866, G883
tctcgcggctcccggatccgtgtaggtttgaaacgggagggactcgaggcttttctgtttttcgtatttcagtttttaccatccatggcggtagagatgctggactacaggggaagttttcggaaggaagaagacctgaaggaggccgcctcggcgggcctcgagagcatggaccgcctcatcaggctcctggctcagcagcagcagcagaaggaaagttatagcagcaatcctcctgatgctatggatgtggattgctgcgccattgccgatgtagcagtgaacaagctcaaaaaagtggtgtccttgctgagcaggacgggtcacgcacggttcaggagaggtgccagcgtcgattctcgcagaccctcttcagtttccttacagaatttcagcgacccacatgaaagaagcttcagtaacaacaacaatcctgataacaatgctgaaaatgctaatgctaacggtaccaatagcgctgctctgttatgtcccatggcacaacagccacttttgccccggcctcaagcccaatctcaatccctatcccaatcccaaacccaaactcagtcccactctccccatcctttcattaagaggagctcaagcaaacctgatgcatatttccctatgaattcatctaatcctattgcagcagatttctcaatgaattcatttaagcctgttgcatcagatttctctttgaattcatctaagccggtttcctctataaagccagcgaaggaccttactttc

SEQ ID NO: 12470 - DNA, 394 bp, Pinus taeda
  misc_feature (306)..(307): n is a, c, g, or t
  Predicted polypeptide sequence is orthologous to G872
cgcaattcctagtctcatttcagtgattcactcactgaaattattgttagaatcactgttttggccccagagcttctgcgtcgccaaatatggagatacgcctccagcaggaaaacgaccaggacattgctccgccacacgaagatcgcgagtcccgccaatttaaaggagtccgaccgcgtaaatgggggatatgggtatcggaaatccggatgccgagatctcgacagaaaatatggctgggctcatacaaaaagcccgagcaggccgcccgcgcctacgacgccgcagtgtattgtctgaganngccgaacgccaagttcaatttccccaattctgtgcccgacattccgtctgcgtcttctctttcccgccagcagattcaactcgctgc

SEQ ID NO: 12471 - DNA, 546 bp, Pinus taeda
  misc_feature (523)..(523): n is a, c, g, or t
  misc_feature (525)..(525): n is a, c, g, or t
  misc_feature (527)..(528): n is a, c, g, or t
  Predicted polypeptide sequence is orthologous to G872
tagaagcaccttaatccgcccgaacctcaaaccctctcacctcgttttaaagagtgcaacctgcgtaagcatttcgtgagttcgactcaacaacatccagcgacacgacatggctaaaccctcgcaataccagaaccaccacaacggacgccaaaagcgctcactcaagtcgcggcagttcaagggaattcgaatgagaaaatgggggaaatgggtgtcggaaattcgaatgccccattctactcgcagaatttggctgggctcctacgacacccctgaaagggctgcccgcgcctacgattttgccgcgtattgcctgagaggatcgaaagcgaagctcaatttccccctttccccgccggaaatcccctgcgcctctgctctttcgccgcctcaaattcaagccactgccgccaaattcgccacagaggaattgcagctgtcttctgaagcagcgttttcatcttctgcttccacagcggaacaccgcaatgagcgccaagagatttgggcggagaagagncngnnattttgggattgggtact

SEQ ID NO: 12472 - DNA, 521 bp, Pinus taeda
  misc_feature (436)..(438): n is a, c, g, or t
  Predicted polypeptide sequence is orthologous to G872
acgatataaaactttaccggcacttcctcagtgcgactcccctgtaaaatcttgcaatgactaaaccctcgcaaaacccgagctgcagcatcagtcccaaaagcttatcactgaagtcgcggcagttcaagggaatccgcatgagaaaatgggggaaatgggtgtcggaagttcgaattcccaattccagtggcagaatttggttgggctcctacgacacccctgaaaaagctgcccgtgcatatgactttgccgtgtactgcctcagaggatccacggccaagctcaattttccccactcaccgcccaaaatttcctgcgcttcgtttcaatcgccgccgcaaattcaagcagcggcggcgaagttcgctgcagaagaatttcacggcgcggcatcatcatcagccaatttggaaacggaatgtgacattgacgnnnaacggtttatttcgcagccgagtacgatatttggggattccgttccacttgagcgtacggacagtggcgggttgctaaacgta

SEQ ID NO: 12473 - DNA, 808 bp, Pinus taeda
  Predicted polypeptide sequence is orthologous to G872
gatttgtatttaaactcactaactctcggcgagctccaactacggcagagcttcttctggttcaccaaatatggaaaaacactcccctcaagagcatgaccaagcccatgttatcgaagacaaagatcgcgggcaaaatttgcagcaatttaagggagtcagattgcgaaaatggcggagttgggtatcagaaattcgaatgcccaaatctcgagagaagttatggttcggttcataccccactaccaagcaggttgccgcgcctaccacgccgcagtgtattgtctgagagggcccaactccaaattcactttccccaattttgtgcccgacattccctctgcgtcttccatttcccggcaagagattcaggttgccgccgccaaatatgccatgcatcaactccctctgagtccacccccttcaaataatatcgaatacggcgatggaggagaccaaattgacgtcaatgtcggctgcagattcagaaacagaggtgtcgagggacagtcatcaaatattggaggaacataataagttcaatttctgggaaagtttgttcgaggaatcggatggcatcgatggcggcctcggcctgaatttggagagaatgccatcaattgacgatgcatgggctttggatcttaatccccctacttggcgagaggagcagatggacaaaatcttcgacacccgcgatttctggaacttttgaatatttgttgataataatgtggaaagatatccgggtcgtgaatgtgacaattcgatcctgtttgtaatacacagcagtgcaaagtaagaagtg

SEQ ID NO: 12474 - DNA, 618 bp, Pinus taeda
  misc_feature (524)..(524): n is a, c, g, or t
  misc_feature (590)..(590): n is a, c, g, or t
  misc_feature (593)..(593): n is a, c, g, or t
  Predicted polypeptide sequence is orthologous to G878, G884
ggaagatggttttcgctggcggaaatatggacagaaagtggttaagggaaacccttacccgaggagttactacaagtgtaccagcttgaaatgcgctgtccgcaaacatgtggaaagggcatctgatgatccgaaagctgttataacaacttatgagggaaagcacaaccatgatccacctttggcaagaaacagcaaccaagatgctgcaggcattagttcccccggtctgagtggaaatggtgctaatgcagcacaagacaaacagattcaaaacaggctgacttcttttgcaaaagtttcacagggtgcagctgaaggagaagataaaatgcatgctggagaagttagaggtgtaaagctgatgagaaataacaggcaaagtgatgttgaagatattgaaagggagggctcttggcagtgatgataattttgctgtttgcaaaacaactgcaatgctttgggagtgatgcaaaaggaagatcatgaaatgactcatagaataactagttatgtcaaagcanttgccaaaagttatgaaatgttttataatcaaagtcattggataatcaattccggaagattcaaantcnccgttaatgttctaagaagccttcc

SEQ ID NO: 12475 - DNA, 933 bp, Pinus taeda
  Predicted polypeptide sequence is orthologous to G878, G884
agccataaataaataagaaacagaattccaccttctgccattggaaacttgaatgccttctgccaacaagaggacatatgatccaggaagcaataatacaactactaaccccacaaagaaaacaaaggtagcactttcatttcgacatggcattgactttatttgtccgaacactaaagcctgagcacttcatggctgtagaattcttggcggaaatcctagaactgggccatgcagcatgtttatagtctctgcagtcataaacggacatcatttggtgaacccaaagtaatggtaatacagtttaactccatgtggaaactttcaagtacgccaccaaatacacattggaaccatatcatttgtgcccatactttggctcaaacccacaaattcttaaaaagggttattgttcttcctttggtctaatagtccccaacacttgcactgtttctgaaagaggtacattaacaccaccaccaaaagaccctcctgtatttgtgtatgtcaataatggcacacttgttgaaacaggggcagtagtcttcatattttcactatggctcttgtcacaaatggctagcacaggttctccactttctttattggcatcattcctcccttcaggagtgctctctgaaatcctgctgaaggcagactgtttgttccccatctgttggctcatcaatacatttgctccaacactatgatttacggtctgaacctgtgaaacagctcctgctacatcatggctgctatgtcttgcagctggcacatcatgattgtgttttccctcgtaggtcgtaataacagctttggcatcagttgatgctctttcaacatgtttacgcacaggacatccaagattggtacacttgtaataactccgagggtgaggatttcccttaacaaccttctgtccatattgcgcca

SEQ ID NO: 12476 - DNA, 449 bp, Pinus taeda
  Predicted polypeptide sequence is orthologous to G896
ttttttaatataatatttttttgtatttcacttcaatgaaaacatagatggtgtagctggacgttaatcaccatatacgattaaattctgtacatcatatacaattaacttctgtacagcattcagagctctccacatccaaatctgaatccacatccacatcatgaacactaatagcttcccacttcctggtctcacaaaacatcaataggtgatgaaacccaactatgtacttgcccagtcatcctttgaatgcagtgccaggatgcagatcaatatggatagggaataaaattgaagaaatctgcaaactcacccatcgtgtctatcgggacaaattcaggggatggcaaagaactgtgagggattgcatacatcttctggtcaataaaatcttgacagacatttacagtatcaaaggtacaagaatatggatggccattttcctc

SEQ ID NO: 12477 - DNA, 521 bp, Pinus taeda
  misc_feature (102)..(102): n is a, c, g, or t
  Predicted polypeptide sequence is orthologous to G896
gcggaaaggaacaatgggaggtgaagccatatcttttagcggatgtgatgatgaccagacctctgcagataccaaggcgctttcaaagattacctcaacagngagccatgacttacagttttataagggcaattgagaaaggagaagggaaaacttatgggagtttgttaagctctatgagtgatactgttcgtgaagcacgccgtaagcaaggcgacagttataaagcaggcaaagtccaggccagaatgccttcgactcttacaagtatgcttctcgaaggtggcagttataaaccaggcaaatttcaggagccacaattgtcgtcttcttatccatttgatgtcaatgagacaccattttatttgtgatggaagattccttatctgtatctctatatgtataagggattgaagatgttcataactttgtattcttgcagagttgtaagagttaagtttgtattttcaagaaattgtaagtgagagataaaacatattaataaataatattataatttt

SEQ ID NO: 12478 - DNA, 777 bp, Pinus taeda
  Predicted polypeptide sequence is orthologous to G896
ctggtgggttgtcccaattgcagagttgaggtgtggcttcatccccaagttgctggttttcgctgtcattactgcggtgtttatgtcgggattcgccaaccagaaccctactaccggccgaatcccgtcgggagacgaccgatgatgccaggtcttcgaaattttgataaacccaacaaatattttaacaaacccgtacaggagcccattattattaatcccccactggttcgagtctccggtaataaaagagccgttctctgcgggatttgttacaagaatacgccatacgagctgaaaggctgcatcaacgatgtgaactgtatgaaatatctgctcacaaccagattcaacttcccggaagactctatagttaccctcacagaggaagagaaggattccaaaagaatccctacaaaacgaaacatccagaggtggatgcgttggctggtgcagaattgccaacctggggattctttagtgtttcattattctgggcatggctctcaacaaaaagattacactggccacgaagttgatggctacgacgaaacgctgttgcctcttgactttcagacagaggggatgattgtggacaatgagatcaacgatacgctggtaaaaccccttccttctggagctcgactgcatgcaatcatcgatgcttgccatagtggcactgttctagatttgccctacgtctgcctcatcaaccccagtggaggaaaatgtacgtgggaggaccatacacctcaaaatggtatgcggaaaggaaca

SEQ ID NO: 12479 - DNA, 957 bp, Pinus taeda
  Predicted polypeptide sequence is orthologous to G896
catatcgcagcatcccgcggcagtgctccgcctcaaggttaccagcaacaccactaccagccatcggctcctcccgcctccgcggccagtccccaacgctattcgcctgcgccgcccccttcccacggcaggaagaaggcggtcatctgcggcatttcttacaaatactcccggcacgaattgaagggctgtctgaacgatgccaactgtatgaagtacttgttaatcaataaattcaaattcccagaagccagtattctcatgctcaatgaagagcaaagagatcctcttagaataccaacaaagcacaatatgcgaatggctttattttggcttgtgcaaggttgtcagcctggagattcattagtgttccattattctggacatggttcacaacaaaggaaccttactggagatgaagttgatggatatgatgaaactcttcttcctcttgactttgaaacacagggaatgattgtagatgatgaaatcaatgcaacaattgtcaggcctcttcctcgtggtgttagacttcatgcaataattgatgcctgccatagtggcacagtattagatttgccgtttttatgccgactaaacaggagtggacagtatgtttgggaggatcaccgtccacgatcaggtacatggaaaggaacaaatggtggggaagccatctcctttagtggatgtgacgataaccaaacttctgcagatacttcggctctctcaaggatcacatcaaccggagccatgacatattgttttattcaagcaattgagaagggatttggaacaacttatggaagtctattgaattctatgcgtaatactatccgtgaaacacgggcaggcactggtggtggtcctgtcacttctctcatcactatgcttttaactggaggcagttacagtggtgggcttacccaggagcctcagctgacatctacagaacct

SEQ ID NO: 12480 - DNA, 873 bp, Pinus taeda
  Predicted polypeptide sequence is orthologous to G896
attgccgaaacgggatatggcttcctccagggtttgatggttttcgctgtgactactgcggtgttcatgtcggggttcgtctaccagaaccatattactggccgaatcccactgggagacgaccgataatgccaggtgctcgaaattttaataaacccagatatttcaataaacccgtacaggagccgactattgttagtcctccactggttcgaatctctggtaacaaaagagccgttctctgcgggatttcttaccgaaatacgccatacgagctgaagggctgcatcaacgatgtgaattgtatgaaatatctgctcacaaccagattcaaattcccggaagactctatagttactctcacagaggacgaggaagactccaaaagaatcccaacaaggcaaaacatgctgaggtggatgcgttggttggttgaggattgccgagccggggactctctggtatttcattattctggccatggctgtcaggaagaagattataaaggcgaagaagtagacgggtacaacgaaacgcttttgcccctcgactttgaggaggcagggatgattgtggacgatgaaatcaatgagacactagtaagacccattccacctggagctcgactgcatgcaatcatcgacgcctgccacagtggcactgttctagatctgccctatgtctgtgttttcaaacccagtcggggcatatgtgagtgggaggaccacacacctcgaagcggtgcacccaaaggaacaagtggaggtgaagccatatcttttagtggttgtggtgatgaccaaacctctgcagacagtaaggctctttcaaagattacatcaaccggggccatgacatttagttttattaaag

SEQ ID NO: 12481 - DNA, 601 bp, Pinus taeda
  Predicted polypeptide sequence is orthologous to G896
acgacacgcatcaatacacaacctatttatatacatatacacatgctaccccatacccccacacactacacgcacagcaacacgctgctactgcgcgggctccgaggacgcagcgaatccacgctacacgccctcttctcacgccacggcacgatcaaactactgcgcgtgattgcacggtgcaatgtggccctggtggtgtatggctgcgagggggaggcacggactgcgagggaggcgtgcacggaggaggatctcgtgtacaccaagccagtggatgacgacacattgcagcaccacatcttgtcagtgccgcagttggaacgtaatttcttgttgtcaccaccgccctcacctccggaagactggcagcccactgaagaggacatcaatcatgtaccacatctcgatctgcagccgcagcgcttggacggcaagacagtgctattagagggcagtgcgactacaccgagcattataggagattggtgatatactacagcgctctagtctcacttcttctcatgtacataacaccggatcggatctgttcaatttcgattgttagttgtaaataaagcgaatattacactaaagaagt

SEQ ID NO: 12482 - DNA, 908 bp, Pinus taeda
  Predicted polypeptide sequence is orthologous to G898
tcatcattcaagttgtaaatatcatcgtcagtgctttggcagatgtttctaaaaacattttaacgtgcagataaagaacaagtgcgagaaatgtctcttttgacattctcttatgtcacacataaggaagtacaatcacatagcttctcctacgaactagcagaatttggcaacaagtacaacgatgaatagctaaccagtgctgctagaaatatagatacggtggatgttgttgattgcaagttttttcctgcaagttgggcatctcttccatcgatgtatagcatttgtaatgcattttttacagaagatgtgcccacatatagttgatgtctcctcctccatcgtggatatacaaattgcacatgtgagcttaacttcctttgattcatcagattgaacatcactgcttaattgctgtccagtcctcctcttcttggaagaactttgatcagcttctccagcatcatcacaaagaacaattggcttatttggaggaactctaccatgcctgcgacggggattgtgctctgctgatgtccttcctgtaactgccagtccaagtcgaagctccaagtcttcttcatttactattggtatgcgactacttcgttgagacactgaactccttgctagagcaaatgaccttggagatgacaccactacatcatcatcatcctcaactactattggggcattcgtgcccctgctccgattagacgccaatgttgcttctttttctggttctgattgtcctagccttaattccaaaatatgattgcgctttgacctcaacctgttcatgacagtgccactatttgatccttgcagcacttaatgcaatcgaccgatcacggcatggcattgtagaagaggatgattccttagtctagcagagatgcaaagaa

SEQ ID NO: 12483 - DNA, 734 bp, Pinus taeda
  misc_feature (634)..(634): n is a, c, g, or t
  misc_feature (636)..(637): n is a, c, g, or t
  misc_feature (647)..(647): n is a, c, g, or t
  misc_feature (673)..(679): n is a, c, g, or t
  misc_feature (701)..(704): n is a, c, g, or t
  misc_feature (710)..(713): n is a, c, g, or t
  misc_feature (722)..(723): n is a, c, g, or t
  misc_feature (726)..(726): n is a, c, g, or t
  misc_feature (729)..(733): n is a, c, g, or t
  Predicted polypeptide sequence is orthologous to G911, G1113
gtattgtttgtttcaatgacttcgtgtcgcgagatcgagtgcgcccgctagctaaatgtggccatgttttccatatggagtgtttggataagtggatcgactatgagaactacagttgccctctgtgtagatctcccctcttctagacacaggttggaatcgtcatcaatgattagaagtctactgattgctgttaattgttaatgtaagtctagcaggattggttctcgtttcttctttctttagttttttatggacattttgctgggcaaatggaaaatgtctttttaataaaatgtattgtggatttcctgacctcttaatctttgttctggactttggtgacaaagcaatttgctatctagagaaagtcattatcttttatttattttcagaaatctttttataaacaaagattgtgcaattaggctacttatctagacgattagttttattgggcaagattaggctgcgaatttgtggtagatatgtgacagtttatcacaattagctcaggttcaaatctcctcccttattccagtatataagctttatcaggtcgagtcttaggagctgtggttttttccgtcaagtggaatctgatttccttatctagaaactttcatcttcaaangnnatgaatatgntcccgtgttaaagatgtatatcaagnnnnnnntcggctcgaaactgctcacgcnnnntccggnnnntcccctgtnnttnctnnnnng

SEQ ID NO: 12484 - DNA, 773 bp, Pinus taeda
  Predicted polypeptide sequence is orthologous to G911, G1113
cggccgggaggagtccctcaattagtgctcaaccttgtgtttgtcttggaattgagcaggcttctggccaactggcttctgtcccctttctggctatcagatcatcaatatggcgttcctctggatcagcccctcgccaattggcccatcactcctttaactaatcctgctagtcttcgttattccggcctcatcttctccgcttctcttgcgccttctgcccctgtttcccccaaccctgcataccctgaccagcagagcgttcgtgagaatttgcccgccgtcttcgactatgggagtctcagtgctgatcgccaggaggtggttgtctgtattgtttgtttcaatgacttcgtgtcgcgggatcgagtgcgccggctagctaaatgtggccatgttttccatatggagtgtttggataagtggatcgactatgagaactacagttgccctctgtgtagatctcccctcttctagccggctagctaaatgtggccatgttttccatatggagtgtttggatgagtggattgactatgagaactacagttgccctctgtgtagatctcccctcttctagccggctagctaaatgtggccatgttttccatatggagtgtttggatgagtggatcgactatgagaactacagttgccctctgtgtagatctcccctcttctagacacaggttggaatcatcattatcaatgattagaagtttactgattgccgttagttgttaatttaagtctagcatgatagattctatgtg

SEQ ID NO: 12485 - DNA, 703 bp, Pinus taeda
  Predicted polypeptide sequence is orthologous to G921
ggcttgaagcgattctttctccgcaaatcttcaatctctgagacttccgaatacccagatgtgatggaaggtcgcaacaacaagaaagcgatacttgtggctgagataagtcgcatcaatgacgagaataagaacctcaactctttgttgaagcaaatgagtacgagctataacgacttgcagaagcatatcacgtctctgctctgcagaaaacaacagcgatcctgtgttgatcgaagccagatattcaatccagatgatgtaagagaagaaaaatccaatttgagaatattttctcccggacctgatgatgtccactccggcagtccagtttcccaccattcttatacttcttcagattgtcctgaacgaatttgtgaaaaggagggtaagaaggccaaattaatggaagatcagcagctgccatcaaagaaacgaaagataaattacatccagtttgaccagattcagaatgggatgattaattcgtctatggttgatggcctacctgaactttccctaaaatcttacaattcttcgattttttctcaacaagtgaaaaaggaggggaagaacgccagagttatggacgatcagcagcttccttcaaagaaaaggaagataaattacttccagttgggccagactcagactgggacgactgtaaaatcgtgtctggatgatacccagatctgtgaagagc

SEQ ID NO: 12486 - DNA, 891 bp, Pinus taeda
  Predicted polypeptide sequence is orthologous to G929, G2344
gatcttgctaccagggaccagcaaagtccagcagaggcggtcaaagcttcatagctgttggcagtgactgtcacatgtgtatagtggagcatggatgaaaggaaatagtctgatttcttttgggttcgctctcctgaaagctggagaacatttggtgactttctggtgcttttaaaatctgagtaatcaactttatattctctgaagaaaaaggcgtgtacaaaaaagtttttaaaacaatggagaacacgcctacacatactggcattgatggcagtgctccagacgagcagcaacctcaggctgatcctgtgcaacaggaggctccgccacctggcatgataccgccacctgccatgactttgctacctcctgaatttgtgatgccacacactcaactcgaactaggacaaacaatggtgagagctgcatatccttatccagatccctactttggaggcattgttgcagcatatggtccacaagctgtgattcatccccatatgttaggggttccccatgctggtgttccattgccatcagatgcaattgaggagcctgtttatgtcaatgcaaagcaatataatggaattttgcgacgtcgacaatctcgagcaaaggcagagtccgagaacaaactgataaagaacagaaagccttatcttcatgaatctcgacatttacatgcactaaagcgagcgaggggatgcggaggtcggtttctcaatgccaaaaaaccagatgaggtgtcacaggaaaataattcgaatggtagtattgtacttgtatcaagtgttgataaacctgctgcagaaaagaaaaactcttcacagcagaacacagattcctagagttcaaagcaacaatactgtagtatggctaggatatgtt

SEQ ID NO: 12487 - DNA, 847 bp, Pinus taeda
  Predicted polypeptide sequence is orthologous to G929, G2344
cggccggggaaactcggccctgaaagcagtcaaatagatgaacagcagaaaccaccaattcaacaacagcaggtaccgtcgactggcatattgtctgcacatgcagagtctgtgatgcggcaagctcaacttgagttaggacctacaggcaatgctttttggcaagctcaagctgcatacccatatccagagcccttctacggaagctatgttgcaacatatggggcacaagctatgattcctcctcatatgtttggagtgcagcaagctggtcttccattaccaccatcagacatggtcgaggaacctccagtgtatgtaaatgcaaaacaatatcgtggaattttgcgacgacgacaatctcgggcaaaagcagagtctgagaacaagctgataaaaagtagaaagccgtatcttcatgaatctcgacaccgccatgccttaagacgagcagggggttgtggtggtcggtttcttaacaccaaaaatgatggaagcaatgagaaagatgtgtcaggggataatgattctcatgattctacaggtcaaagtaataaggtgctaaatcctgattcaggaaaggatggtacctcacatgatttgaatgggattcaacacataggtaatttagcaccaattggcaatggcatcagtgctcattctggaacagtctctcctggtcaagttggagtgggtgaaagtgtgtcaaatggatcacattacacatataatcaaaggcgaggatttcattcatctgcatttcatcctctttcagtcagcactacagagagtggccaagttggaggcgtggtttccagtggaggccaccatacagcagtagcaaccc

SEQ ID NO: 12488 - DNA, 855 bp, Pinus taeda
  Predicted polypeptide sequence is orthologous to G958
gcacggtagggtttacgaaacccctgtaatgcctatgcgcaattactcaatttctgctgtattttaccacggcggagcttggatgccttctccttgttaaatagtcattgatttcccccagatttgaacggtgaatttgatacattttctggtctttatttttattgtttcattttttctttctttagtgtgttccgaacctccgctcgtgcctttcaatcgaaattggaggttggacattattcaggattttatttgaattcgagcaaaggttttattccttgtagaaagattcgccagaattgatttttacgatagacgtcgaagtgtaaatttgtagatttgtttcaattcgatggcaccaatttcgttgcctcctggctttggtttccacccaacagatgaagaactcgttgcttattacttgaagaagaaagtacacggccataagattgagcgtgacattattcctgaggtggacctttataagtgcgaaccatgggatttgcctgataaaatttgccttcaaagcaaaaatctacagtggcatttctttagtccgcgcgatagaaagtatccaaatggctcacgtactaacagggccactgaggctggttactggaaagcaactggtaaggaccgaaaagttacatctcagcggagcacaattggaacaaaaaagacactagtattctacatgggtcgtgctccatttggagaaaggacagattgggttatgcatgagtatcacctcgatgagaaggagtgccaagcagcaggtttacaggattcttttgtcttatgtcgtgtggtcaagaaaaatggattaggaacaaaaagtgatgaccagtctgt

SEQ ID NO: 12489 - DNA, 860 bp, Pinus taeda
  Predicted polypeptide sequence is orthologous to G964
cggccggggattgaggagtcaggccggactctagatccatcgcccattctcaatacctttctgcttgcttcgatcatttcgactctatcgaaaccttaggcaaaacaaagggttatggatcagaattgcattgcagacctttctttgcatttgggtatcggtggtgggacagccatcagagaaaatgatggaatatatgtttcacaaagaaatgtgaatgggcctcctctgcagttagatctgtttccagtggcccctgactctggccgagaaaatgatggaatatatgtttcacaaagaaatgtgaatgggcctcctctgcagttagatctgtttccagtggcccctgactctggccgcgacactttgccatgggagaatacctcagcatcaattggaaccgatggtgtcggtaaggtgagatcagagagacaagcgaaggatccgatccatgaggtagctgtgtcatggcgatccgatgccaacaaattccctgcgtcatgtttctccaacgatgatgcacgtgccattaatgtgtcgtcatccaatagcaccgtggattccaacgcgactaaccctaggaacgggtgtgccgagatcaagcgaaaacagggtgatggcgaggagtcggagaatgaccgagtttggtcgagggtgctcggcgatgtagaagaagagggctcttccacgaagaagcttagactctccagagagcaatgtgctcgtttggaagaaaccttcagaaagaacacggtacccgaacctaacgaaaacaaacgttagccttacagttaaatctccgtcttcgacaagttgaggtttggttccagaatagacgagcaagacgaagctagcaacag

SEQ ID NO: 12490 - DNA, 702 bp, Pinus taeda
  Predicted polypeptide sequence is orthologous to G977
gaatcaaattgggttatgaagttggagttggatcatgatcagcatggaaacagtacgctgaaacgggagacagatgatgatattgctcaaatgattgaggaattacttgactgtggatccttggagatctgctctcccatggcttctgctgattctagtatcagtaatgcagagtcgatgcttaattagcctttccagtgaatgttaagtctaatggccagcatgaaattttgcatgaatcctattagattctggatgtgcaggagaaattcttactcatgatctgcaaatttgctcagtcaaagacttgcaaggtgcaatttatgtgaggccatggaagttggaagggttgatctatcagagaagttttataatctcaatcgtgatcttccacacctatattatagtagcctagcccgattttgttaaagggttgtagagatataggatatcatctctctgatctctttgtgcgctcctgggagacatttataatcaagtttctatataaatagccctttggcgtagtcttgtagctgttggcttcttttgttgaagcttgtggctaatatacttcacttaatgtatatctacaaaaattacagtcagtccgcgctccagtgatgatggtgagtgaccatggctcctgatggtagaacagatgtttgtggggaaaatataaggaataaaatattttactat

SEQ ID NO: 12491 - DNA, 678 bp, Pinus taeda
  Predicted polypeptide sequence is orthologous to G977
gattcttgtcttcccccagctgaggctttctgagaccaaggtgagattcagccagtagtaagctatagattgatagttcagagaaaagactgaaaggcaaaacttatatagacataacaacggagagagcagcaaaggaaccaggttgcataatggctaggcctcaaagatacagaggagtccgtcagaggcactggggatcatgggtctctgaaatccgccatcccttattgaagaccagaatatggctaggaacatttgaaacagcagaggatgcagcacgagcatatgatgaagctgcaaggatgatgtgtgggccgagctagaaccaacttcccattcaatcccaatgcacctccatctccatcttcaaaggttttgtcctccacgctcactgccaaactacaccgctgttatctggcctcgatacaaggaccgagatcgggctcatcgaagaagtatgccatgacaagagctgataaaaataacaatatacatagcagcaatcagtccctcacttgcttaagattggataacgaaagatccaacaacattggtatttggcagaagaaagctgggtctaagcaatctgaatcaaattgggttatgaagttggagttggatcatgatcagcatggaaacagtacgctgaaacgggagacagatgatgatattgct

SEQ ID NO: 12492 - DNA, 877 bp, Pinus taeda
  Predicted polypeptide sequence is orthologous to G1033
gagagttctttactcgggcagaggcagcgagcaaaactttcaataccagtgttacacgcctcggctactgccttctcagatcttgttcatatattgtgaagatgaagggtacaaaggccaaggttgaacagaagcaagtggcagagaagaaagctgcaaagcggaagcctgcgaccgaggcccaagctaaacggcaaatgaagaaggacaagaaagcgaagaaggacccaaacaagccaaaaaggcctcccagtgctttctttgtattcttagatgagttccgaaaggaatacaagaaatcaaaccctaacgcgaattcagtttccgccgtcgggaaagcaggaggagaaaaatggagggcaatgagcgatggggataaggctccatatgtggctaaagctgaaaagaagaaggctgaatatgaaaagtcaatgtcttcatataataagcaaaaggatgccagccctgaagaagtagctgaagagtctgacaaatcaaagtcagaagtcaatgatgaagaagaggatgaaagtggagaggaggatgatgaagatgatgatgatgagtgataaaatggtgttgactaactcgcaactcgctagactaggcatgtaatattataggatgatcttctgatcaacttaacttctgaattagattgttattgcctttttgacactcctagttttgcacaatttgggagtagtctgatcaatgtttggcagattaattctgttatctttttagcaggattttcgttaatcgtgttatgaaacgtttcataccaaaggatacattttgtaggtcatctgttatgttaatgggaaaggaacatttgtatattttctatcccatctatttttgtattggacatgtc

SEQ ID NO: 12493 - DNA, 909 bp, Pinus taeda
  Predicted polypeptide sequence is orthologous to G1033
acgcggggactcgcttctttgttattatctcaacattgttcgcttgtttttctatcgaggaaaattgcgaggcgagatttgtgtagctgcgttttactctgttacagacgatcgtctgaggctccaaactcacgcgttgctaaagcaagtgctttcttcaatgaagggagctaaagcaaaaaacgaagcgtctagcacgctgaagaaaattgaagacaagcctattggaaagcgaaaagctgcaaccaaggaagtgaagccaactagtaagaaggagaaaaaggggggcaaggctgccaaggatcccaacaagccaaagagacctgcgagtgccttcttcgtatttatggaagagtttaggaaaacctacaaggaaaagaatcctaatgtcaaatctgtatcagttgttggaaaagctggaggtgacaaatggaagtcaatgtcagaagccgataaggctccatatgttgccaaggctgcaaaaaggaaaacagagtatgaaaagaacatggcagcatataacaacaaacaaaccagcactgcaggtgacagtgctgaagagtcagataagtccaagtccgaggtaaatgacgaggatgatgatgaaagtggagaggatgacgatcaagagtagatatttcgaagccttggttgcccgaaatggtcctgtatcagttctgggctgacttggaaaaaaattgtaacctgactaattagctactggtagatgattttgttatttcctaccttcttttatagcgggcatacatgaaagggatttggtcactcaagtgtatgtcttgagtatctccatgtgtagttattcatgaacatgctattgacagctgtggtcatgttattgatgtctttaaaaacatgatcatgtaatcgtagataaagtgtttttgt

SEQ ID NO: 12494 - DNA, 812 bp, Pinus taeda
  Predicted polypeptide sequence is orthologous to G1033
cggccgggggtatgcagacaatacatgattagctgatcggggatcagaaggttcccatgtctgtaggaaaggtcgaattctgagagcccaagcacatgccagaagtgaagaagaacgaagataagcagacaggcaaagggaaagggaaaatcaagggcaaaggcaaaggcaatgacaaaagcaaaggcaaaggcaggcagaaacagcagcataaagagagagagaagaaaaccaaaacggaaaaggaccccaacctacccaagaagccagccactgccttcttctattatatggaggaatttcggaaaacctaccaaaaggagaatcccggagtcacaggaatgagagaaattggtattgcttgtggcatcaaatggaaagaactgacatatgaggagaaggccccatattatgatatagcaacacaaaagcgagcagagtatgagaaaattctggcagcatacagaaagaagaaggaggctggtgaggaagttgaggcacatgaggcgctgggcaaaacaaattcagtgataaatgatggcaaggaaggtggagaggaggtaggcgaggaagttgaggctcatcagggaccagacaaaacaaattcagagataaatgatgacaaggaaggtggaaaggaagctggtgaggaagttgaggtacatggagagcaggaggatatggaatgatactacatgcctgaggtgcacttttcatatggaacttgtagagtcagataggggcacataatcgatgctggagagagtcctggctaaaaattcttgagaatacctttaatgaatagctacagt

SEQ ID NO: 12495 - DNA, 926 bp, Pinus taeda
  Predicted polypeptide sequence is orthologous to G1033
cggccggggggtcatccatcttgctcatttctacttccgcctcctcttctcttccctcgtctagtgttttctttgcgttgtgtagtgtaatgtttgctgttgcttcatatcaatagtggtggaattttccttcactgcgagcagattttctaaggagaagccgacacaggaggaggaggagcaaagttcgtctgcatccaatttccagaacgatgaaggatgcaaaggctaagaggactgcagccaaggagactaagaataaaaatgttgaagccaagaagaagcttctcagtgtcaaagagaaaccaaacaagaagcaggccaaacccaaagcagtaaaggacccaaatcaacctaagaggccaccaactgccttttttgtatatctggaggagttccgtaaaactttcaaacaaaagcatcctgatgtcaaaggagttacagctgttggcaaagcttgtggtgacaaatggaaagaattgagcgaagctgaaaaggctccatacattgctaaagctgcacaaaagcgagctgaatacgatgtaaccatgaaagcatacaagaagaaacaggaaggtgtccaaagtgccacacctgaggaatctgaaaaatcaaagtctgagctcaatgaagatgatgaggacgacgaaagtggggaggacgatgatgaataaccgaacactctgttgaagaactgaattttgcgtggggaattatggttttcaagctttgacaagagttttgttttagtttgagatcagaagatttaccagcagatatataccaaatatttcattgctcattttgtatagcagatgatatcaagaagtttattgagctcattttgttgcagaagttgctgctaaagcttattgttattatactgttattttgtcttttaatttaatcctttcaactcatcacgc

SEQ ID NO: 12496 - DNA, 810 bp, Pinus taeda
  Predicted polypeptide sequence is orthologous to G1049
caataacaactattacatgttgtatcctcctcccactctcagtaacagcggcaacaatagcagcagcagcccggaggcctgcaaacccctgcccaagggttgttacattcgtcaagattccgccgggtccagcagccattcggctcaaaccgcctgcaattctgcgtcggacgaagctgaggagcagcagcatacaataattgacgagcggagggagaggcggatgttgtccaatagggaatccgcccggcggtcccgcatgagaaaacagaaacatctggaagagctccgcgctcaggtggcgcacatgagagctgagaacaggcaaattctcagcagtttcgacatactcagtcagcgttacagccagattttggaagagaatcgtgtcttgaagacccaaactatggaattgtcccaacagcttcaccagtttcagcaagccctcacggcttctcagtgagcagaggactgtagagtcctaatttaaagcttcgtcggtgaccagttgaaaaaccccatatgtacagttttcaattcaggatgatccccaaatcaatatccacagaatcccttgcactgttagcaaggcacccagtttgtacattcctggtcagcttaatttagcagaaaatatagcacagtagtgtaggaagatatataggtataatcgtgaaaacctgctaattgtatcaagtattgttgaggtcaggttatagtgcgatatgatcacatgagtccatgatgttatgtcacttctaagtcgaagaggcattttaagttttaatggtaaaggttacttcatatgct

SEQ ID NO: 12497 - DNA, 806 bp, Pinus taeda
  Predicted polypeptide sequence is orthologous to G1049
cggccggggaatctctgaggcgaggaggaatcagtgcgagcattagggattggattgattgattcgacttggtgagcgctggcaagccaggttatgcttcctctgctgtctggttcttctcagaggccattaatagcttcatctgcacccctgcaaggctttggtgtcagaaacataaacatgaatggtgttgtacccattttgaagaccagtcagcagccatcctcatcttcctgcttccatcctcctacagcaggtttaacaaatctgcaaacatgggagaataatactagattgaaactgaatccagctccaccctcaaggccagcagcagaaattagttcaaaatccatggctcctccaccatcaaccaaattaaaccttccaccatgcacaacaaattccacaggatcttccagcagcatgacttatgggtcttgtcctccaagctcctcccactcgggttctgaagaagaggagcaacagcggcaggggcagcagaaggagaagaaaaagaatgtaattgatgagagaaaacagaggagaatgttgtccaacagagaatctgcaaggaggtccagaatgagaaaacaacagcacttggatgagctcagagcgcagatagtccaactgagggcagaaaacaatcatattctcagcaaattcaatcttacctcgcagcattatttgcagtggaggagcaaaatcgtattctcagatctcaagccattgatttgtatcagaagcttcagctgtgacctccatgctgcagcagcagcatctctgggtaactttgatgatttgga

SEQ ID NO: 12498 - DNA, 431 bp, Pinus taeda
  misc_feature (412)..(421): n is a, c, g, or t
  misc_feature (424)..(429): n is a, c, g, or t
  Predicted polypeptide sequence is orthologous to G1050
acattgtccgcacaacttacccttttgcagagagattcgatggggctcactaatgaaaataatgagctcaagcttcggctgcaagccatggaccagcaagcccaacttcgagatgcattaaatgaggctctcagtgaggaggttcagcgactaaaattagcgacaggacagtcaatctccatgaattcacatttgtttcagcttcagcagcagggcccccatgttgcagttcatcaattacagcaacagcagcaacaacaacatcaacaacaagtcacaaattcacagcagtctgctggccagcaaacaaaccaaaatgaagtcctacagaacacatatggtgcttttccgggttcactaagcccttttctcaaatcggatggctcaaacattcctgctagccaagggagcnnnnnnnnnnttnnnnnnga

SEQ ID NO: 12499 - DNA, 800 bp, Pinus taeda
  Predicted polypeptide sequence is orthologous to G1050
aattcaggggttggatatgaagataacaaaagaagtggggggcaaggtgatggcaatcagtacaggtcacgtcactctcggagcatctccatggatagcattatgagtaagatgcataccttcagtgaagacttggaacaggaaccgtctcaaggtcggaatgtcagacactcccatagcaattcgatggatggaagtacaaatttcaatgtggaattcgggaatggggaattcagtgcatctgagatgaagaagatcatggccagtgagaaactggcagagcttgcaacggtggacccaaaacgtgtcaaaaggatattggctaatcgccagtcggctgcacgctccaaggaaagaaagatgcgctatatctcagagctggaacgcaaagtccagaccttgcaaactgaggcaacaactttgtccgcacagctgactcttttgcagagggattcagctggactgggcagtcagaaccacgagctcaagttacgtctacaggccatggaacaacaagcgcaacttcgtgatgcattgaatgaggcactttggggaggaggtccaacggttgaaattggccacaggacagctaggtgctggtcaatctggcagcctggctcagcaaatgtccatgaattcatcattatttcaacttcaacagcagggtccacatcatcctctttatcaaatgcagcaacagcagcaacagcaccaagtccaatacagtcaacaacctccagggaaacaaactaatcgaaatgaagttctccaaacctcatacacttctcttcctgggtccc

SEQ ID NO: 12500 - DNA, 688 bp, Pinus taeda
  Predicted polypeptide sequence is orthologous to G1051, G1052
gatcatcaacgagtcttgttgaatgtagacaacggtagcttaaaacaaagaattgcagcccttgcacaagacaaacttttcaaggatgctcattgtgaagcattgaaaaaggaagttcaaaggctaagacaattatatcaggaacagcagcaacaaaatatgcagaaagaagtagcagcaccctcaacaggatcatatgacttgcaacagcagcagtttggcaagcttgagcacaattcatccccacagatgatggaacaaaagactgatcatgtttctgattcttcatcaaatcttctgaaaagtggtccaggtatctcagaccatagagaaaacaatgctgccaacaaccataccagttctggttctcaaatgttgaagggaataatgacttcgagctgccttatgggtgatggtaacaagtgtttggaagaaagaatgatgggaggaatgtcttctgattacatggttcacaacacttaagtgcaacactactgcaggtttttattttgggatgcttgtggttatggagtatgaactaagtattcttaccattttttcttctgtgttttgtttgacccctctcagccctgtattggaattgtttctgaataacttttgcttagacacattttttgtagcagagggccgctacccttctgaataaaatagatttaatcatttatct

SEQ ID NO: 12501 - DNA, 795 bp, Pinus taeda
  Predicted polypeptide sequence is orthologous to G1053
tttgtcttccatgctgttttgatttccttcccagctagttcccgatattttgattgaattttgcccttttcatagcttggtagagatgcagtcagaacaggtcctgctgccctccggtcccatggtctccaatggcagcttccacatgggtactgttgatacaagagggggccaggattttctaagcagagaatgctatgaatccctcctgaatttcaataatttcatgctgtatcctcctcccactctcaataccaatagcagccctgaggtctgcaaaccctccccgaaggggcgttacattcgtcaagattccattgcttccaccagccaatctgctcagacggcctgcaattctgcctctgatgaagccgaggagcagcagactgtgatgatagacgagcggaagaagaggcgcatgttgtccaatagggaatccgcccggcgctcccgcatgagaaaacagaaacacctggacgagctccgcgctcaggttgcgcacatgaggtctgagaacaggcaaattctcagcagtttcgacatcctgactcagcgctatagccaggccttggaagataatcgcctcttgaaggtccaggccatggaattgtcccaacagcttcaccagttccagcaagccatagcagcatctcagtcatcggcagctccaaactttgcactcaacgccttgcaggcttctcatcgtcataataataacaataacattattagcatagatgatgcagtggataacaacacaaacagtttaactcagtgccctgacatcctgctctg

SEQ ID NO: 12502 - DNA, 810 bp, Pinus taeda
  Predicted polypeptide sequence is orthologous to G1062
ctgtgcattcatagaataaatattctacaggctgcactgtaatttaggcgagaaatcgaataaaatatacatttgtttgtttacgatggagttggcagatgagcattccatcctccgctataagaaacccaagctctccaagaatgtcgtttccgagcgccgccgaaggcagaaaatgaacaagcttctctacactctgagggctctggttcccaatatttccaagatggacaaggcatcgattttagcggacgccatcgaatatgtggagaagctgaagcaacaggtggagagagctgagtctgacgttcaatccaccaacgtctcggcgctatcggcagatccccgggttgaggaaaccgattctttagcagtgagtttagacgctgccaacagatatggatccgatcgcaagtaccatgtccaggttgaggtccgcctggaagaaagcattgtggaggttcgaatccggtgcaagcaggaacacggaattcttttccatcttactcgggctctggaaacgctcccttttcagctcaaaaacttcaccttcagcactttgaacgaataccttcttctcctcaacgttgtgttgcaggtcgatcacggattccctgctatgagcgattacggactgaagcaatcaattgaggacagttttgggaagcagggcctcattctcacttcaggaaattccaacggccatttgtggcaggagttgaaataaacaaccctaatactggatacttcaaaattcactggttacagctgcctgggacctcttttatcgtatcagccaataagctggta

SEQ ID NO: 12503 - DNA, 772 bp, Pinus taeda
  Predicted polypeptide sequence is orthologous to G1062
tgatgggtgggtcgaagtcggcaggcaaaattaattatcttcaggctgcatccaagaatttgtatactgaaagaaagcgaaggaagaaattgaacgacactctttatacactgcgttctgtggttcctaagatcagcaagatggacaaacagtctataataggggacgctatcagctacgtgttagatctgcaaaagacgatccgagagattgagagtgaaatcgaaggtctgcgcagctcaagcaagggtgcccatactcaaacgattccacagactgtcaaccatctagcaaatgctgagttggtaaaacggtccgtcgaatccagtgataccaagaaatcgatggataaattgaaacatgcaaaagtactgcaagttgaaatttgcaacggaggggaaggtggaatatatcatgtgcgaatagagggcaaaaaagagactggtggtttggtgaagctcacgcgcgccctagaatctctacctctgcagatcatgaattcaaacatctgctgcttcgatgaagccattcactactccctcactgtcaacgtgaagtcattgggaaatgtaaacacggccaaattggaggacatgattcgaaaaacgacaaccagtgattgcttcgaataaatcaagtcaaattcgtgttgtatgggaggatcgggagattagggtttatgataatttttagtatagagtcctgtgtttccagatgtgccgacccgtatcgcaatatagctttttgacatgaaaatactttttgtaaagtt

SEQ ID NO: 12504 - DNA, 919 bp, Pinus taeda
  Predicted polypeptide sequence is orthologous to G1064
aaacgatttaatgagcgacagaacggggtgaggggcctgacagtgggggagttatgtgggcggcgatgattattttagttgaacggacccatgttgatgtatagagcactgagcaatcaattgtggggaatctattaggcccccttcggagaagtagaatggaatcgggaggaggagaccatggaaggccgccattaaagttaagcagcagctctcaagagcctaccatggcctcggcctcggcctcagcatatgagggccgaggagggcttgtaggttcatttgtgcctacttccagttcttctagagtagactctcacatgaatattgcatccacacagcctgtggatgcatccttggccatgagtatgtcttctgcaactacttcaaacaatgaaactcaaatatccacttcacaacaacagcaggagactgtagctctggacccaaacaagaaggccccagctaagcgttcatcaacaaaggacaggcatactaaagtagatggcaggggaagaagaatacgtatgcctgcaacatgtgctgctagagttttccagctcactagagaactgggtcacaaatcggatggagaaacaatagaatggctgctacaacatgctgagccagccattatagctgccacagggaccgggacaatccctgctaattattcaacactgaatgtatcacttcgtagttcaaattctagcatttcagcttctcatcataccaaagcactgcccctggcctttcatgggaccttagggctaggacccaatgtggacatgggtgctagattggaccaccaactgcgtgctaggaatgagtgggaaagggctgagaataggacttcaatggaactagcagtagcatcgaacagcaatcagaggatagacgctgcagattggtggtggtg

SEQ ID NO: 12505 - DNA, 890 bp, Pinus taeda
  Predicted polypeptide sequence is orthologous to G1064
actttacacaaaaccgttgggcctttacataaaccattgtaaatgcattgctccccgagtccctttattactcttctctgttttttctaggtctatgcaatattcaatgtttgaattcgaattttcaactacccaatcctaattgacacaatttccagaaactaataaatggacatctgctttgatcgacttttatttacaaatatacgggttttctggtattccccatgaaaccatatgagcactcgtgaatccccagtttatttgccttttgtttacagctcattacaagcatgtaatctcattataatgggctgcagataagcataggttgaacccgagaatttgtaaccaaagggggaaacttgcgggttcgttctataaaaggggtgcatgcataatacaaattagggctccgggttctgcaatttttacaggctttatttctatcagaatactgggattacccatttttgtatacagttgagattgcagagattgtaactggaaatgagttccgaagaagtgccaaaccaggctgagcagaggatagtactagcggatccccagagcaatgatccagcaaggaaggcattggtggccaagagatcctctaccaaagacaggcacacgaaggtgaatgggcgaggcaggagggttagaatacctgcagccagtgcagcgaggatatttcagctaacgcgtgagttgggtcacaagtcagatggagaaacaattcaatggcttctgaacaaagcggagccagcgatcatggcagcaacaggtgacacttaaaatggatgatttctactgtcgttacaattatgcagctctttgccataaacaaatgttataatagtttaatactcatgttacgcatagcaaatgaa

SEQ ID NO: 12506 - DNA, 496 bp, Pinus taeda
  Predicted polypeptide sequence is orthologous to G1067
agcgtggtcgcggccgaggtacgcggggttcattgctctggtctccgagagcggctccttcctccggtgtccgccatagacctttctggttcattcttccgccgttgttacagctaccgtcacgcaacctgctgatggtggagagcttgttggtgtcttccttcggcgcgttcattaacaggttgttgctggcaggtacaggcgagtttcatgacgatcgagggtgcaaagatggtgcggagtttttctgccacacttgacctaaccaggaatattgctaaacctattgtcgaaggcgtatgacagagttctccttttgctacatgatttaccctgggacctgatgtttagttacggctcttagggttataggttattctgagggttagtttcatgagccgagctggatctcgtgcaactctgattctgttatgattgttcaatcttcagttgacttgtatataatggaatcggtcacaatgattacagtttgatt

SEQ ID NO: 12507 - DNA, 816 bp, Pinus taeda
  Predicted polypeptide sequence is orthologous to G1069, G2153
cgtagcggagaacttggcaacattcgcacgcaggtcacagcgaggaattttcattctcagcgggagcgggactgttgccaatgtgaccctgcggcagccggccgctcctagctcggtcctgaccttgcacgggaggtttgagatcttatccctgtccggggcttttctgcccacgcctacgcctaccggggctacaggcctcacaatctatctcgcccgcggacagggacaagtcgtgggaggaaacgtcgtgggcgctctggtggccactggccctgtcgtggtcatggtttcgacatttcgtaatgccccgtacgaacggctgcccctagatgatgacgacgggccgacaacgatgcagcttcaaccgcccggaggactccccagttcatctgcactcccaatggctcagcagcagcagatgcccgattcctctgccatgccgatctataatgttccgcccaatctgctcaacggcagccaactgcctcatgacgtcttcgcctgggcacagcatgcccgtcctcccttttagaacaaggtaactgagacttgggttgcgtgttgacatcggtcctgatcatgatggctacgctcgaagaagatgaaggagaaaaacagtggagcatctcaggtctagcgaaacagattttcttttgttttctaaatttgattgccttgtataatttcttacaagaaaaagttgtgctttactccaacattgcttctctcggttggccactgtgaatttgactttagtctactgttaaaatatctgatgtttttcctaaataattttaagaaacacagccacgg

SEQ ID NO: 12508 - DNA, 884 bp, Pinus taeda
  Predicted polypeptide sequence is orthologous to G1069, G2153
gaaaccaacgtgatctttagatcgatcgggtaaacgtcgggtttctgtaaatcacacctccgactcagagcagagacagtttgaagtgaaaacaggagggcacaaattatggctgaggggttctgggaggatgccaaaatactcgacgatttgtccaaagaggaagactcgtctcgggaattaggttttcatcttccaactggagattttatccctggttcggaagacaacatcgccaacagtggagcgaacgaaagagcctggggtgagggcggtaacattgacgccgacaaggctgatgaggagctctcagcagagggcggacctccagtcactcggaggccacgcggcaggcctctgggttccaggaacaaacccaaaggtcctctgcatggaatacgtgagataacagaaacagcgaaatgtctgatactggagatcccgagtggcttgaacgtgacagatattgtggaatcgttcatgggtagttccaatctcggagtagtcgttataggtgggagagggaatgtcaccaacatcaaccttagtgaggcattccatgtaggggacatggtagataataaagggccatttgaaattatatcccggacaggagcattcccgcgcggcgttgatacacggggaggtacaggactcaaagtcactctaacagacgcccaaggtaatcacgttggaggcaatgtggtaagcctcatagcgtacgggaccgtcttggttactcttaacacagtcatgaacatcaacagggacgtgctaaatgaggagcatccgggactcgtgccttctccagctgtagttcctgcgcagcagcactttcaatcaccgaatatgatgacaatgcagcaacaaattggcatccagtc

SEQ ID NO: 12509 - DNA, 1036 bp, Pinus taeda
  Predicted polypeptide sequence is orthologous to G1069, G2153
caacagttccctcgttcatattttagctgctgttcttcgaagctgcaagtgcagggatcgattcccactgctatcctggtagaggcaagtattctactatagtgtgccattggaattgcaggcacggttgaagaatcgggtattaggggtgactaggcattggaaaaaattaccaaattggtagagatatattggagtcctggcaggcaggtggtgggcaggtaatgtatcgagcaccatggcggagacggtggatccaggagttcaggcgggtcaccagcccctgcacacttcggaggaggacgagaacagcgggaatagcgggctggggaaaaggagatccagagaacaccatgaggaagcccaagaagcgcttccaccgggtgtggaaggaggtggaataggggatgaaattggccccaggagaccgaggggcagacctgctggttccagaaacaagccgaagccccccattattataagccaagagagcccccatgctctccgcgcccatgtgatcgagatcgccaatggctgcgatgtgggagaaaatgtggctacctttgcccggagaagacagcgcggaatctgtgttttaagcggcagcggtattgtgaacaatgtcaccctccgccaacctgcggcgccgggcgcggtcgtttcgcttcacggtcgcttcgagattctttcattatcgggcgcctttctgccgcctccagccccgccctccgcgacgggcctcacgatttatttagccggcgggcagggacaggtcgtggggggcagcgttgtgggtgcgcttgtagcctctggtcctgtggtcatcgtcgcggcttcttttatgaatgcgagttatgaacgcctgccgctggatgaagaggagccgagccctctgcagttagagaccgagtcgccgccactcactgcgccgccacagcagagcgattcatcgactatacccatcatgtataacgtgcctccaaatcttctcaacaactgcgtgcctggtgatcatccatatacgtcatgggtttct

SEQ ID NO: 12510 - DNA, 576 bp, Pinus taeda
  Predicted polypeptide sequence is orthologous to G1075, G1076
cagtcatcggcacagacgcccccagacagctataagatatcgaaccgtggaaccgtccatccaaggacacgactgcgctagccgtgggcggccgtcgcggggaaaccttgctcacagttccgcttccgccgaaaatgcagattcctcgctgccgctgacgagcgaatatcgccatgctttcccctacgctgcaccagtgggcgatctgatacttgctacgccaaaatctctcaacccttcgccgatcctaacatttactttcaaaatctttgccgcctcaagttacgccttactagttctatctccgagcctgatcgagccgcccaatcgaatcggtttcgtattcgattctggcatagcataaaggtggtcaaaattaccttcccggtcgctgcagatctttctcagaaacagaaaagaagatccccaagagctagaaatcaaccctagttaaaaagaacggacgggacaaaaccagtgcgtcgatggccatgtgggtggatgagaaagccacattctatggcggcttttcaaaggcagtctctgtttgtgagagtgggtttggaaaccaactaa

SEQ ID NO: 12511 - DNA, 926 bp, Pinus taeda
  Predicted polypeptide sequence is orthologous to G1075, G1076
tggacggcgagatgagtcggaggcctcgcgggaggccgccggggtccaagaacaagccgaaaccccccacaattgtccaccaggagagccccaacgccctcagagctcacgttctggagatcgccaacggctgcgacgtcgcggagagcttggcgaatttcgcgcgcaggcggcagcggggaatctgcattctcagcggaagtgggactgtgaacaacgttaccctgcgtcaaccgggcgcggctaacgcagtcgcgacgttgcacggaaggttcgaaatcttgtcactgtgtgggtcgtttctgcccaccactgagctctccggggctacggttcttacgatttatgttgcggttggacagggacaagtggtgggagggagcgtcgtgggcgccctggtggcctccggccctatcgtggtcatcgctgccacattccgtaactgcccttacgagcgactgcccctagatgaggacgaggaaccgttgcctatgccgctccaccctcccggagggccactttcccagccatcaaccctaacggcggcgcagcagcagcagttaccagatccgccaagcatgcccatcttcaacattcccccaaatctgctccctaacggtcagctccctcctgatctctacccctggccacagcatacccgtacccaatattaacaaaagtaaacctttcttccgctttgtgccagggccacttgctcactgcccctccagcagatcagctcattcataaatttcgtacaatatcatgtgtacaaatgatacacagacttgtaaagtgttttattctgtttagggagagttagatcccatttgtgggattgcttctgctcatcttcgttcactttcatcatcaaggagaagaaaaacaatggagcatttcaggtctgctgtaatagacttgtaaag

SEQ ID NO: 12512 - DNA, 917 bp, Pinus taeda
  Predicted polypeptide sequence is orthologous to G1075, G1076
gttattaaatagttgtaaaggagttcgctgctggagctctaatggagatttgagagatttgaggatacggatatatatatagatgggtccagccagttattttgagagataaaataccatttgttgagtgtcgcttgacagggagagacaggggttttgttttgttttttatttatataattttataaggctgatgctgtgatggctgaatttgaagcagcagggggaggagttacaggaggaatttcttctcatgcacactttcagcgagaatgccagacttctgaagaagaggaaagccgcagcagtgatttaggcggtggaggagtgggccgagggagatcacagacacagatcattcagtcctcctctggtggtggcggtggtggaggagccgagggaggttccgggactgtggaggttgcccggaagccgaggggtcgcccgcctggttcaaagaataagccgaagcctcccattatcataacccgggacaacgaaaatgctatgagacctcacgtcctggagatcaccgcgggctgcgatgtggcggagagtgttctgcagtttgtgcggcggaagcagatcgggctctgcgtcatgagcggaagcggcacggtcgcctccgtgacccttcggcaacccaccgtgcccggcgcgccgctaactttccgcggccggttggagatattgtccctctccggcatgtatgtgccggctcccgcggcttcttcttcgtccccgagctctctgtccgggggactgactataagcctcgccggggcacaggggcaggtcgtcggaggaagtgtggccggcgagcttaccgcggccggaccggttaccatcattgcctcttcttttacgaatccctcatatcaccgcctgcccgcagaactggacgaagaaaacgccgg

SEQ ID NO: 12513 - DNA, 827 bp, Pinus taeda
  Predicted polypeptide sequence is orthologous to G1075, G1076
caggccgccgggatcaaagaacaaagtgaaacaccccatgattgtccacaaggagagtgccagctgcctcaaagctcacatactggagattgccaacgggtgcgatgtagcggagagcttggcaacattcgcacgcaggcgacaaagggcagtctgcattctcagcgggagcggaacggtgcacaacgtcacgctgcggcaaccgggcacggcgggcacgatcgtgaatttggagggacgcttcgagatgttatccctgtcggggtcattcctgccaacggtcgagccctccggttctacggggcttacaatttatctcgtgggcggacagggacaagtggtgggagggagtgtcgtgggcgccctgatggcctccggccctatcgtggtaattgctgccatattctgtgacgccccttttgagcagctgcccctagacaacgacgaggagctgatgtcgctgcagctccaccctccccaaggactttcccaatcatcaactctggcgccggcgggggcgcagcagatgcccgatccatctaccatggccctcttcagcattcccccaaatctgctctccaacggtcaactgcctcatgacctctacgcctgggcgcaggatacccgtatgccatattaaagaaagtaccctttcttcttgtttgtcccaaggtcactgtcctcagctttatccataattttgtgtacaaattgtattgatcagagtttcaggtatacaaattatactcggagatgtaagcgaataattttttcactttaagttagacctgatattggcctcgagccgaattcggcacgaggcctcg

SEQ ID NO: 12514 - DNA, 855 bp, Pinus taeda
  Predicted polypeptide sequence is orthologous to G1089
cttgcatacattttgaacaactgcaaaaagaaatgtgctggtaagcatacttgcaacaaaatctatatctagagtcgcttgaaaaagtctatgatcttcttgaagatatcaaagatcgacacttgagaattgtccttggttgcagaatttgaatttccatagtggctgcctgtataagacgagccagagtggctgcctgtataagacgaaccagagtggctgcctatataagatgaaccaggccgagatactccttgagatggccatgaacctgctgaaggaaaagaagaataacgaggaacaggatcagggtcaggatgatgggtgttccaggaagaagagttgctcgtagattcgcgacccaagaaagatttacaaggggaaggtggtgaaacagtagtggggaacctagcagtattaaatatgctacttctcaccctccctctcacgcgagggtaatagagagggctgcaatagtctcgctccaattgggcatccaaattcatgaaaaacattcgagacctctctgagtaactagaacttacaatgttcactgtaacttgctggactctggctctcctgaatacccagagacgcctgttgtctaagctccagagggtaccattgtgtctcacaacgttcatggggggaaacacagtggctgcaaggagtcccttctgtaattgttccactgcatcatctattctcagaaaatcatacggttgtctgaacttaatggctatggagtcctgagtaaatctcagatcatctgggcttgcaatgagcgccaacatccttacaacttccaagtcttcttcaacaccagggcctcgtgccgaattcggcacgaaggaa

SEQ ID NO: 12515 - DNA, 953 bp, Pinus taeda
  Predicted polypeptide sequence is orthologous to G1089
tcttatttccctctgtatctatgaatcttattgttatatgttcttctggtgctacaggatgaaccctgtaacatgcatttatagtgctctgtagtgttctccaaccggtcggcttttctttaaagtgatagacacagtagttgttgttgtttgtggggttgagaagttacaagagaaaaatatgatgatgaatagcttcgatctgggggggtgctgcctcgcgcgctatggggctgcaacttcctatttcgcttccaagacggagcagatactgtccaaatatcgcccaatcgcgcccaagcctgtcgttcagaacactgctgggcttccggacgcagtgcaaaaccaacagccgcaaccctgcccgtcgtcgtttcgagcctctgcccgctcccgtaagagaaattgggaagccgcctccgcctccggagctgctgtaccttcgccgccgccgccgccaccgcgaccgcataagagagctgccaggggccgcgccggtgccccggacgtgcatttcgacggagggcacaaccgtctggagcgaagcagtgctaagagtaccgttatatcgccggctctgcgccactctgatacgagcgaggaagccgtttcgccgcgcggtgaaatctctgactccgcggccagcaagtgcttcgcctacacggcggccccgtcattcgggtattcttcttcctcggctgcctcctcttcttctttcgactcggcttttacgcagaaaagcaatggctctctcgagaaaggcacggatgctgccttcatggagcgggccgctgccagtgcgtctccgagtgttaatcttagcctccgagagcggaagtcgcccacgcagatcgccgttgcttctgaaagcatgcagccatgaccatggttggccgagagccctttgccagtgctgtgttagattccccgttgctcataatccccgaagcaga

SEQ ID NO: 12516 - DNA, 942 bp, Pinus taeda
  Predicted polypeptide sequence is orthologous to G1089
gccgcagaatagttcctgggatttcttcgacgacatgctctcgtacaccaaccccgaaccccaaccctccgttgaagaaccggagcaccacgaccacgatcacaaccacgatcacggccgcgaccgcgaccgcgctcacgtttacgccgacatcaagaaaaaccagcaaaaccaccacagagacgatgagaccgccaccgataccgacaccgacacccctcaagccgggatggctgaagattctcccgtcaagatgccggaaaagtctgccgcggccatggaaaacaaaatttccgacagaaaggccaaccacatgcagctgtcagtccctcccgacagagggggagctaaaggcggtggaaaggaactcttgaaggtcttagctgaacttgatgatcacttcctttcggcttccgagagcggttatgaggtctcaaagatgctggaagccaatcgcttgcattatcactcaaatttcgcagataataaaggtacaattaatcattcagaacaggtaatgcgcgttataacatggaacagctcatttaaaggcccatatggctcagaagatgggaatgatgatgtgcagggtaaggagaaggagacccatgcctctgtattggacaaactattagcatgggaaaacaaactttatgatgaagtgaaggccggtgaacttatgaaaatagagtatcagaaaaagattgcatcgctgaataaacaaaagaagagagggaggaattcagaagcactagaaaaaactaaagctgctgtaaagtatctccacacaagatacatggttgactttcaagctatggactcaacatcttcagaaatacagaggcttcgtgatgaacaattatacccaaatcttgtggaacttgttgaggggatggaaaaaatgtggaaaagcatgtacgattgccattgttaccaggagaa

SEQ ID NO: 12517 - DNA, 660 bp, Pinus taeda
  Predicted polypeptide sequence is orthologous to G1095
ggagaaggattaaaattttgaaatccaaaaacttttaacatgaggaaaactttctctacagcgtttcattaagtaaaattgactaacgtcccagccacgtggacacttcaaagctttttcctcggaaaatctgtagacaatccgttcaaaaagccaaaactcttccaatgcgctgtgcctcgaccctaagcagtaacagtggccgtggcgtcctcaacctctacagtcagccggcgttaagcaattggaatttcagcgcagacactttcagcaggcggctgaggacgatgccccaattcttgatcgtgctcccgcacctctttttgcggcaacgttgccgcggcgccaccattcttttccccgctctcgcaagcgacgctcgtcctgcaaaggggacagacggaatgctttgtgagccacgcatcggcgcactgcacatgaaaggcgtggcagcatgccgggatcacgcggcaccggtcaccaatccggaatggctcgaggcataccgcgcactcgccctccccgcctctgctctgaggtgtccgctcttcccgtaattctttcccgcactcgacggtgggtagccgctggaggtcaacctcggaaagaccctgctgcttgggaagctgggcgttctcctctaatcgtctatggccgtgc

SEQ ID NO: 12518 - DNA, 774 bp, Pinus taeda
  Predicted polypeptide sequence is orthologous to G1100
agttgccattagtggacaacgccaaccgcaaccctcccaagcacgaggggctctcggaggctgaccttaaccggctacctatcatcgaatgttctaaagaaaaagaagggactccgggactcggcaacacggagtgcgcggtgtgcctcgaggctttcaagggcggggagcggtgccgcgttatcccggtgtgcagccacgtctttcatgtgcagtgcgcggatgcgtggctctcaaggcgctccgtctgtccgatgtgcaggaggagcgctcgcgagaacgaggaagagaaaggcgttaatggtggcgctgcggtggtgtcgcaggaagccgaggggcgtgaggaagagcccgggcgtggtcggcctccggctgatagtgtcgtggtcgagatgtccattgccttaacgccaagaggttaaagtggccactgccgctgcgtgtactgaacgagattcggcctgtcggaaccgttaaaagttgccacggccgctgcgtgtattgaacgggattctgccagtcggaaccgttttcgccacgatacgcgggatttatttttcacatctgcatacttttacaaaatacagtcgtaatcatcattggtcattctgtatgtagatattatataatttggtgaatttctgtggagattaaagttgcgagagaatttcctggttctcacctttgaccagagtgtggaaaatggacgatcgccatatactatgagaagccattcacatttattaaaagtgggagtgagtttaatggctaaaa

SEQ ID NO: 12519 - DNA, 493 bp, Pinus taeda
  misc_feature (430)..(430): n is a, c, g, or t
  misc_feature (442)..(442): n is a, c, g, or t
  Predicted polypeptide sequence is orthologous to G1108, G2394
tgcctcacaagatacaaagacaatgagcttctgaaggagcttccttgtacacacctattccatgtgggttgtgttgatcagtggttgaagatcaattcttcctgccctctatgcaaacgccaacttaatggatcaatgattatggctgatcatacttcttctgcatcaagatatgagatttttttctgatcataatttggggaaactacaaaatatttcttttttaatacctgaggctaattaattccaatacaaaactagcccattcatcggcatttatatgaagatgatcgatctcataaactgtactgccactgcaatctgtggacctaatcatctgtatggacaatgaaaaaactctggtaaatagttgaggtatggtccgccattaatactgcaggcatattccagctttgggcgtgtttcctcntttgcaaagcanaagctcaagtcagtttatactctatctatctgcaagatgattccgggatca

SEQ ID NO: 12520 - DNA, 581 bp, Pinus taeda
  misc_feature (447)..(448): n is a, c, g, or t
  misc_feature (459)..(460): n is a, c, g, or t
  misc_feature (518)..(521): n is a, c, g, or t
  misc_feature (523)..(525): n is a, c, g, or t
  misc_feature (536)..(539): n is a, c, g, or t
  misc_feature (544)..(544): n is a, c, g, or t
  misc_feature (552)..(553): n is a, c, g, or t
  misc_feature (557)..(557): n is a, c, g, or t
  misc_feature (559)..(561): n is a, c, g, or t
  Predicted polypeptide sequence is orthologous to G1108, G2394
cccaggcaaaggaaagaggagcttccacttatgacattgcatctctacccactcatagattcaagtccatgtcggatgttaagagaaagaaagaacaaattacagactcagatcaggagaatgatccaaattatgttggtggtggatatataatattggacacagtaggaaggaagagatctgtttcagccgaggatgcagaatgctgcatttgcctcacaagatacaaagacaatgagcttctgaaggagcttccttgtacacacctattccatgtgggttgtgttgatcagtggttgaagatcaattcttcctgccctctatgcaaacgccaacttaatggatcaatgattatggctgatcatacttcttctgcatcaagatatgagatttttttctgatcataatttggggaaactacaaaatatttcttttttaatacctgannctaattaattnnaatacaaaactagcccattcatcggcatttatatgaagatgatcgatctcataaactnnnntnnnactgcaatctnnnnacctnatcatctnnatgnannntgaaaaaactctggcaaata

SEQ ID NO: 12521 - DNA, 693 bp, Pinus taeda
  Predicted polypeptide sequence is orthologous to G1108, G2394
gtgtatacggaggtggggatggcatggataaacaacacagagggcctcaaagacgtgctgaaacgtcaccatccagagttggtagagaaatggatcctcgtgccgaattcggcacgaggtttttttttttttttttttttttttttaagagatctgatttaattataatgttagtcaatacaactcatgtacagtatgcaacacacaaagttcatgtgctttagctaaaggtcacaaagattccagcagtggaatttcctgattcacactccctcattacgagaacctctctctctctgttcttctgtttcatgaacagattcagcttctacttcactagaatcaccaatctcaagcttgcagagaggacaagatgcattaattttcagccatttgtcaacacactctacatggaaatggtgcgtgcaaggaagctccctcagctctacatcatctttgtatttaccaaggcaaatgcaacaaatcgcatcttcagcagaaacagatctttcattctctgtaccagctgctacaaagccaccctcgcatggactgtctgagtcagattcattgtcatctttaggatcaatactttcacgttcaacttttcccttgaacttgtatgttggcagggaattaatgacttctgatgaagcaccttttgtctgcgtctggtcttctcgaaaaccaaga

SEQ ID NO: 12522 - DNA, 862 bp, Pinus taeda
  Predicted polypeptide sequence is orthologous to G1133, G1137
gagatttatgtgactgtctgcatctaagtgcactattctttgtacttccctcagtcagcatgctaacagcactcaatgcacggatattcttgttattacattcattctcctcggtatttttgcaattcttggtttggatgtccacttcctgggtcagagtgaccagaagagagtcatcaaacaaaaaacagttgtcatttatgctagactcgccaactgattcttcaataatagcaggtccaaagtctgctacctcttctttatgtccctgttgattgctacctgttttcttggctgatatcccagcaatagtatcatccctaacttttgtacatgcctttttatttccactatattcacctggtgagtgaccagtgctactctcctgaccattgctgctctcctcttcatcagaactcaacagagcatctaaatctgcagtgttttcatgtagctgagtctgagaatctccagagtttcctttgcttaatacatcacagctcacacgaattgcaccttcattttcaacgacaggacaatcaataaactcacccccatagctgtccagggctgtcatgcacaattgactcattcccatatttggcatagttgtaaaagatgagggaatactgtccctgtaccatggcaaattaacatcccagaggcctgatgttcctgcagccagtacttcagaaattgtgtttttctccatggccatgttttcagggttagtctctttatttaccttgccattgccgggcaacatctccgaaaagctctgtactagtgcagggtgaaaagtaaacccacatctgttcatattatagtcacacatgaacatatttttgtaataatcaggtgc

SEQ ID NO: 12523 - DNA, 685 bp, Pinus taeda
  Predicted polypeptide sequence is orthologous to G1145
ggcaagaaagcaggcatacacaaatgagctagagaatgaagtgatgcagcttaaagaggagaatgagaggctaaaaaaacagcagttcttggagaaattgctgccttctgtacctccaccaccaaccaaagcacacccttcgaaggactggttcagctcctttttgaagtggagttgtagacaatcatgcttctaattttgaagaggttttgtggcacagtttcgctaatctatctgtaattttgtatctctattccaaactgataagctagatagtttagtgtattggaagatgaggtttttaacttatgatgacttaggaggggcgtagctgcttctatattgaagacaattgtggagacatacagtttaggatagcacatccaaagaaagctatacgttgtcagttttcatcaagtaagaggagcctttggttttgaagccatgaagtatatagctacgaaggccttgcgtgacactgtaaatttgttttcgggtctgctgtggtccagaatgacctacattggggtaattcagcgtgacgtttcaggaaattttgtggccacaaattgatcagtcatggctctttttatgtttttatgaaaactaaataaagtcgtttgtaagcacacattattgtgtgtactttgtagcattttgaatggttcgacttccgtttgttgtg

SEQ ID NO: 12524 - DNA, 849 bp, Pinus taeda
  Predicted polypeptide sequence is orthologous to G1145
tttaacccgtttctgctttcattagggaagagagagaggcaccgcaaggtgtttcagttacaggtttaggaagaagttggatttagtccaacaatcagacatatggggtcccaggcagtgctcgctccttctgaattcaggttcttgcaacccctggaaaggcgggtagagaagcttcacggtgatggcgatgcaggaaatagtaacatggaggatggccttctcagctccccaccttgtgccatgcagcgccaggtaagcgttgcaggcgggggaagtcttgatcaagtctggagagacattcacaggcctaattttcagactactcaggccgcggcggtggagaattttcttgcacagacgggccttggacagcgggaagatgaagaggaagaagaggaggaggatggcctgaaccggggcaacaatggcagcttgaccatatttgcaatggattctgttcttgcaggtcaaaacctgcagcaaccggaatggctgcaatttcaacaccaacaccaacaatttggggaattatcggctcaggcgaacagtaatattgatatccctgtcgtagccgcatcgtcgggctctgaacaccctgtctggaagaaacgaggttgtgagtctataacagatcacaccgtggagcggcgccagaagcgtatgatcaaaaatcgagaatctgctgctcgttcaagagcaaggaggcaggcttacacaaatgagctggagattgaagtgaataagctcatagaggaaaacgccaggctgaggaaggagcaggaagctgcaaacctgctgcattcaatacaacctggacaaacaaaacatccacttcgaaggactacg

SEQ ID NO: 12525 - DNA, 844 bp, Pinus taeda
  Predicted polypeptide sequence is orthologous to G1146
tgttaacacccaaaaacgaggttcagagatttttgacgatctgtattgggaaaaagatgatgaacagggccgcaaacaaacaggaggcattttcaaggagttattgtcttcatttcaagagcgatgtaacacaaagccagagcgaattttatattacagggatggtgtcagtgatggccaatttgaaatggttttgaacaatgaattgggagcattgaaaaaggccattgaagctcttggctggactgatcaatcccaaacatcacaagctgaggaaccctcgcagaagagggttagaataggcaagtcaccgaaggttacattcattgtggtgcaaaagcgtcaccacacacgcttttttccaaatactgagaagagatgtccaactcttaaaaatggaaaccttctaccgggaactgttgtagactcggtcatatgccaacctaaaatatttgacttttatctctgtagccatgctggaataaagggcactagtaagccagctcactacaatgtactccaggatgagaatggcttcaccccaaatgatattcaacgattgactaatgacctgtgcttcacgtatgcaaggtgcacccggtctgtatcaattgtgcctgcatgttattacgcccacttagctgcaaaacgtgctcgtgtgtggcttgattcggggattagttctgagagtgggtctttccatggtagaagcgtatctggcatgagtactggctcaggaactcaaattctgtcagggacatttacgaagccattgcctcctgtacatggccgcattaagaactctatgtttttatataatcgggcattatttctatgactaggg

SEQ ID NO: 12526 - DNA, 900 bp, Pinus taeda
  Predicted polypeptide sequence is orthologous to G1146
tttacagagatggagtaagcgagggccagttttatcaagttctgttgtatgagttagatgctattcgaaaggcctgtgcatctctagaaccaaattatcaacctccagttacttttgtggtggttcaaaaacgtcaccatactagactctttgcaaacaaccatcaagatcgaaatgcgacagacaggagtggaaacatattgccaggcactgtagtggattccaaaatttgccatccaacagaatttgacttttacctctgcagccatgctggtattcagggaactagtaggcctgcccattatcatgttctttgggatgaaaacaaattcacagctgatggattgcagtccttaactaacaatctctgttacacatatgcgaggtgcacacggtcagtttctatagtacccccagcgtattatgcccatctggctgcatttcgggctcggttttatatggagccagaaacatcagatagtggttccttatctagtggtgttcctggtagtcgcatgactgcagctagttcaggttctcggagcactcgtgtacctgcaggaacgagtgttcggcccttgccagctttgaaagaaaatgtcaagagagttatgttttactgttagatttgatacatagatgtttgacatttttaagttctatatatgccatccctttgttgggtaggcattgagtgacgggccaggtgcatcactacgatgctttcaaattgcaaagttctagatttccaaaacttaagatcacactcaatcattacgatgctttcaaattgcaaagttctagatttccaaaacttaagaacacactcaatcacttccttttcacctcttgtactgtttgacattttttaattggctgcgggcatttagatgaagagac

SEQ ID NO: 12527 - DNA, 894 bp, Pinus taeda
  Predicted polypeptide sequence is orthologous to G1146
attagcaatgtaatcaggcctgcattttttgacatggtctgccaagcaacactgggtccaaacaccaaactccaactcgcataacctctttacagtagcataaaggtgcttgttctcttgttggggcattatgcagaggataagctcaagagggttaccattccgctccgctgagtctatcacatgttttacaactccctcaacattcccattgatctctgttgccggtggtgctgccaaatcagggttcatacgcacaccatatgtattgcacaattctggaagtttgctagaaaaagtttgaactgcttgaggtggaacatatttagaaaaatttatcactgcccaggaacttattttggcacccctccatatgacctttcctctcatattccatgaaccttctcttggattttcttcataagccttgtacattatctttggtggaggtaagaccctcccggggacttctgtcatcaacgtgttgatttgaatgccaaattcggcagcatctttggcagttgaatctctcaattgtcctccaatcactttagttctctcccttcggtcttggggatgtaaacaagttagatttaataaaccacttcgttgttgttcggttagaactttgatataaggctgatccatttgaatccgacaaagctcgatgggaatatatttctttttctctttagtaccggcttcgatcgccggaaagccccgcaatcggagagtcagcttgtactgttgttggaaatagtcgacaatagagagttgctctccattgctatcaaaacttaaaacctccaaaggcctatcagtcaaacctttaattcgataactatgcctgatatgaatagtttcgacacgaagacctttaagcaacctttcaac

SEQ ID NO: 12528 - DNA, 717 bp, Pinus taeda
  Predicted polypeptide sequence is orthologous to G1146
gcacgaggcggagaaatcgcttgttcattggattggacttgtctcactctcatgctggaccatcggctcaaagcggcaaaccaattccgtcagttattggcatgtcttacactgtcgatgagaaattgtctatgaccggtcactacttcttccgcactccaaacaagacgatcattactgatttggctgaagagtttgagactcccattttggagtacaaagagcgctcaaagtcgaagcaatggccatctcacatcttcatctatcgatctggcgtttctgaaggcgagtactcccaagttgctcgtgttgaaaaaactgctttgttgaagtgttttgatggacttgcaagcaaacattctgatttcaagaaacctggtttcacttttgtcatcgctcaacgtaacagtggcttcaagttgactcctactcaagctccagcaccgaatccacgtggcaagatcaatgatgccgaccgcaatttgaaacccggaactcttgtcagcaaaggtgttgttaatccgtctttggaacagttcatcttgatcgctcatcgtacaattcagggaactgctcgtccgattctttacactgttgttgctgatgaagacagtcaaggaagtggaaagcgaattccggctgatgagttgaaatacttgacttttgccctctgccacttgcacaacaatgtcttgggaactgtcaatgttccatccg

SEQ ID NO: 12529 - DNA, 841 bp, Pinus taeda
  Predicted polypeptide sequence is orthologous to G1150
cggccgggtagaaaacatcattaagaacttcacatcttccttggtgagaaggcgtggagagataggagtggccatgaatccgtctcctttcatttcggaatctaagcccatggtccagttcaatgatatgaaggcccttcaacaaactttgttgggtgtgcaggtaaaagccaaaggggagttacaaattttaataattgctatggaggagaaacatccagggtataatactctgaagcttattgcagaaacagatgtcgaattggtgacgcagtgttgtttgtttgatcatgtcaaaaaatgctcagatcgggcaacacaatctcaggcatcacaatatctggctaatttggcattgaagataaatgccaaagtggggggaagtaacgcggcgcttcttcatagcttgtctcgccagttaccgagatttggcagcgaccatgtcatgtacattggcgcagatgtaaatcatcctggatcgggggatagtacgagtccttccattgctgcagtggttggaagcatcaactggccctggtgcaatcgctatagtgcgagagtcagctatcagagtcacagggtggaacacatccaacaactcgaggagatgtctaaggaattactggacgattatttcaaagcaaacaagaagctgcctgataggatactcttcttcagagatggtgtgagtgagagtcaattcgatatggttctcaaccaagaattagaagccctcagagaagcagtagcccacttcaaaaactacaatcctcctgtttccttcatagtagctcagaagagacatcacaccagactgtttctttggtgatggagagcaacg

SEQ ID NO: 12530 - DNA, 908 bp, Pinus taeda
  Predicted polypeptide sequence is orthologous to G1190
cggccggggaacactctttatggtggttttgctgcagcactgataaatgatcctctgtgggtcatgaatgtggtttcctcttatggtctaaattccttgaatgttgtttatgaccgaggacttattggtacatataatgactggtgtgaggcattttcaacctatccaagaacatatgatctcctacatgttgatggtcttttcagcgcagaaagtcacagatgtgagatgaaatatgtgttgttggaaatggaccgtatattaagacctgctggctatgtcataatgcgtgaatcaccccattttgtgaatagtgtcaagaatctagccacaggcatgagatggaattgccaccagagggacactgaggatgctaagaatggggatcaaaaacttctcatttgtcagaaaaaggattggaggtcttcaaaagctgcttctgaatgataaataaaaccttaaaatttcaaggcccctattcctattttatgccaatcaatctggcatcagagtgagtgcctggctgtgaaggtatctgttgataggtgcatttgccagccggtatatatcatgtcagtgaaattcagtgatccgtttcattttcccaggatgccaagttatttattcccctggcatttgggaggcctaatactgaatattagaactactctattgaatcaaatccattctttttatcttgaagctgtaaggtgggtagttaggtgttatttatatttgcagttttcatgagggagggattttgtaatgccaaaacccttcacgctgcgatgttttagaactcttttattacttccattgcttatgtcttatccgaagtggcctcaaatgatgtccgctatcagtacttatgtattactttatcatttattaattttaaagtttgaatg

SEQ ID NO: 12531 - DNA, 741 bp, Pinus taeda
  Predicted polypeptide sequence is orthologous to G1190
cgtgtggaaagctctggagagctgctccaacccccgtttcatctacaggcttgttctgcctggttccagagcttggttcgctgagatgatggtgcatggaggttatgaagccttgtttggtcatcgagatgcattaccaggtgtttccagccaacctggttgcagttagtgcgggatggtgaagccaacttcagtcaaaatgctcactcagaaaatcgccaatatgcaacaaatatattttgcttgctggagctatttactgttagaaatacataggctgtctgaacctggatctttccttgatgcttcgatttcgtggctcacatggcccactgtggtgacccagttagggtctcggcgttcattcctacaaagactgtttaccatgtgtattgtttactatgtaacaaaaccctaagagagaggtggctatgaattcctcattttgtctttattaagccattcggccgagtatgtaaattttctgtcggttcccgtaggcccctttcaaggaacccctgggcggcctcttagcatattgtatatttctatatttttttctttctgtacaacattttacaagatttgttgtccatgagttgtttggctcagactaggctatgtttggcaaacctatttggatagaacttgctgttaacaccatacgtttcttaaatggtttatgttctactctcattcctcagttcttaatgttgtgaccgcatcctttgtaatatagca

SEQ ID NO: 12532 - DNA, 766 bp, Pinus taeda
  Predicted polypeptide sequence is orthologous to G1190
cggccgggctccctgcacagacccaaagagatggaaaatatatgatcaccatcgatttgcatttctagaacgccactgtccttcaccatccaaaagagttgaatgtttaatccctcctccagagggctataagatacccatcagatggcctcgcagcagggatgagtgttggtacaggaatgtcccctatgaatggattaatactgtaaaatcaaatcaaaactggctaaagaagaaaggggaaaagttcctttttccaggtggagggacaatgtttcccaggggtgttaatgaataccttgatttaatggaagaacttattcctggaatgaaagatggcagtgttagaacagcgcttgatactggatgtggggttgcaagctggggtggctacctactggatcgtggaatcttatccatgtctctggcacccagagataaccatgaagctcaagtgcaatttgcccttgaacgtggaattcctgcaatgttgggcatcatagctacacagaggttgccttacccctccagtgcattcgacatggctcactgttcacggtgtcttattccttggacagattttggtggagtttacctattggaaattgatagagtattgagaccaggaggattctgggtgttatctggcccaccaataaattatgaaaaccgttggcgaggttggaacacaaccatagaagagcagaaggccagttttgattccctccaaaatcttctgaccaatatgtgttacaagctgtacaag

SEQ ID NO: 12533 - DNA, 765 bp, Pinus taeda
  Predicted polypeptide sequence is orthologous to G1246
catgggatatcgtcactctacagacttgggtgcaggtcgtcatgaacctaagcatcatcaccgcctcgttgccatccctcggtaaagtcatgtgggatctatgggcgttcggctcgagtcttcgagcaagtcgatccgtcaaaagcagcaaaacctccaaggattttggacacgagctcggcttcgagacaagcccgccacagtacgagcaccatgaaaagggaggtctcaatcaacccggccccgtcatctatgcacccgagaaggacgccgacgacgacagctggagcgagcaaatccttcataaagtccgcgagataggcagcgtcgagtcttacgatgcagtcattgaccattacgagaagtcacagcatcacaacgacgagaaacagcagctgcaggagcaagaacaacaacaacaacatcaccaatttcgatatggtcctcccccaccatcatcctcacattctttatcccgcgctcctgcaccagcatacaccccgtccggaagacggtaccaccactaccgccgaccagacgtattgtcgcccgtgattgagcgatcgccgtacattgacggtacgccgacaccgaagatgccctcttcaccttcgcagcattggggaattttccaacaccaacatcaacaacaacagcagcaacagcagcaacaccaacaacatcacgacgacgacctcctaaaaccccatactctcctcgcttggactcgcccaaaacgccctcatacgccgctagttcgcacta

SEQ ID NO: 12534 - DNA, 839 bp, Pinus taeda
  Predicted polypeptide sequence is orthologous to G1246
cggccgggggacttacgggtgagcgattcatgtgatgtgaagctcctcctcaatttcgtgcagctaaactagattcattccaagttctgtgtaaattatttattggttgtgacatcaaatacgcggagaactagttcatagctcccaagcgatggatgtggctggaaataggatttccgcgcggtccgattggaggatttcttgaaagatacggtctcttcagtcggagacggatatggcgacagacgttgtgttcacatgttgaatccctgctgattcggctacagatttcattctttggctttgcatttgcagtcttatggttttacaggaaaacggttgagtgtattggggtatcttggcgtatgacattgcttctttaaagtgtttgagttggagttccatcggaaggacatataaatatttctttgaagtatccgcagttggaaatccatagaagagacacactgttctttttttggagttaaagctacataggagagataaatcttcagagtatacttaaagacagaagggatgtatttttcagtgttgttttgactggtccaaactgaaaagaactcgatccatggtttttttcatctttgatgacttaaactatagtttatcgcatgtttttggagttttgacaaaaagccttctgcaagtatttcgttatcaaagtataaatttactgcacgactgtgttgaaatctttcgttatcctgaacagttacgtcgggatggtgatgtttagggataattgaaaagtcgtcatttattgatcttcaatgaagttgtgacagccttcaatacaccgacggactgtattcttctta

SEQ ID NO: 12535 - DNA, 804 bp, Pinus taeda
  Predicted polypeptide sequence is orthologous to G1272
tttgactgttcaatctgactggggcttccatttccaataggccttcttgaactcctttcgtcatcaataacaacaatgcattcaatgttgttacttttaataggcccaacggtaaacaaactcttctctccatcataagcaaaatctttgctacccagttcagtctcaccatatatttctttgactttatccataatcctcctgcacaagatcttactgacaacctctttttcgttactgttaccgttgaccccattaaccccacgttcaccagtgattttaacatcgtagtgaaatgagtcttggagatttgaaaagcctactctgaagtgattgcagagtaacttgacaggtctaccagctcgaccttgtccaggtcgtttagttagaacacgaggagcctctgggggcttctgtgccatctggggaggcagtgggggtgggggtggcagaacttcaacgggctcagtggagaaaggcccagattgtgttgccatttggggaggatttgggggaggcggtggcagaacttccccgggctgactagaaggccctggcagaacttccccgggctgactagaagaaggccctgctccatcgcccatgcctaacatatcctcggaatccattacgaaacctcaaagccagagaacagcagtatcactcctcagagccgaagacgagcgttcctccaacctcagagccagggaagagcgttcctccaaccccagagagaacactacagcaactgcaaacactgtaaccactggaaacgggatactgaagctaagtgttgaataacag

SEQ ID NO: 12536 - DNA, 865 bp, Pinus taeda
  Predicted polypeptide sequence is orthologous to G1276
ggttgctcggtggatgcctgattcaactgaccctgccaatgaatggtcccatgacaacactggattctttggttttaaatcagttcctcatgattttggtaaattgccccgatggacagatatggaagttgagggaagaaaggctgcaactcctggggagtttatgtcaaggaatggacggagattcaaatatgaagaaggctctactggtccaatgccttatcgaatgggtacctgggaatcccctataagaactctaggcttcggagattgggaaattgactctggcagtggtggacagtattcaaagccattgcatacaccaaatagttcacataattctcgtggacaccacaataaatattctgcctcaaagtccaggaaaagagatagttggaggaagtcgaattatgattgaagtttctggaaatgtgaggttcattatttggaacttttgtatcaaattttgaagactgaaatcctgtcatgtatacagcataatgtggcatttcacaactcacctagtgcgaggagcaactcttaaaatcttgaagttggggcaagcatattaatgtggaatggctgctttcagctttgacaatttctgtcaactcaacgttcctgatagcagatcaagctttgaatggtgtcgtggcagcttgtatgtgtctgtttgtttgcttctccatgattgtgctgcaaatgcacatacctgagttttgaggtaagaaagctagatctgttgaatacacgagttcctgttgatgttcgatattgtaaacattgagattgttggcaatttgcaatcaacccaagaaccaaattggtcaacccacattgattgcaaattaagctggcaaattat

SEQ ID NO: 12537 - DNA, 935 bp, Pinus taeda
  Predicted polypeptide sequence is orthologous to G1324, G2893
actacctccgacctgatctcaagcgcagcaagatcactcctcaagaagaacgtttgatcattaaactacatcgccgttgggggaacagtttcaaatggtcaggtggtctagcattgcgcagaatttaccggggagaacggacaacgaaatcaagaatcactggagaactcgtatcaagaaaagactgaatctgaatctgcaagctgagagtggcagcaacaggatggatgcagacagtggcgtacagattgcagaatcaaagagttctgaattcctcgcaacttcatctgagagactgcctggcctagatagtctggagtcttccactagaatcacaagccaaattaccgaggaaatagcggttcaaccaaaggaaaccccatatctacaaagtcatagttctccaagtagcagagaagattgcgataatggattgcagggagaaattcgagaggattctcaaatcaatgaagatgcgcaacatggcgcagctttgcagggacatttggaaggatcagaggagctgtttgagaacgcggggttaccttatattttttcagtgggttctctggcaactctgctatcctctgatttatttgtagatgatggcgtgactctagatttttcctatatggtaccttcaccagatagcttcccagagatcgggagttacctgaatggttattctgatgtattatggaatgttctggatgaataaacatgaccgttccattcgcatcagctttacgcgtgtcgggatggctacgaatgtggccaggaacgatgaagtaaacgatgtaacgtaccagatcagcagcggttcctcgctttgtgtacacgcagattacgtcatgttttttctttcttttaatagtggtctaaaaaggcgatgttccaggtctgagacgaatggaaaatttggcactatttgaaag

SEQ ID NO: 12538 - DNA, 622 bp, Pinus taeda
  Predicted polypeptide sequence is orthologous to G1335
ttttttttttttttttttttttttgaaatgagaaaaactctcatgtttctcaagtactttctacttatttcctataatcgtgaccaacaactcgagcaccctgcctggtctcccccgggtacctcacgtcaattaataatcatagtgaagtaccaccgccgttgagcgattgcgtgggcgccccttgaggtcctttacacccccaactgccggtataagtgttgcaggttgtttccatgaagagcgttgagactccttcaccagccagcgattttgaatatcttcctccacccggcaggaacaccttgtgcctccgagtcgacagccgtcggtaaaccggtccacatgtaatcgactctgggtggcgagcctatctcgacgtcgtttccgcaacctggtaccagagacaagatcatggtaggaaaatcaaaaccccagagtcccggtcgtggacgaattggatgagtgtggggacatgggccagggaagtggaatcgacgtagaaattggactgagtagactctacagcttcaccattatgaatcggattgcggtatgatgtagagatgtggatgccagggcctgcaaaaccgccgctaccctttcacgttttttactcgcg

SEQ ID NO: 12539 - DNA, 864 bp, Pinus taeda
  Predicted polypeptide sequence is orthologous to G1340
cggccggggatatgaattgaacatatgagatttatttatttttattattgtacctctattgcccccggcatagaattgttctgttcatggataaataccttggagaaaccaaaacaagtcctaaatttagggaagggctcgtgaggaggagctgagcagacttttatgtcatcgagcagcatcggcatgcaattgagtatttccatttcactttaacccacagatctgaatgccttctctctcagtttcccacacgaaatctatgcaaattcgtgaagatggtatcaggatcatattgcacatggttctgtcattgcccaattcgtggcggcctttcacaaggcagtaaacattcagatgatttgtcgagtctacttttggtgtaatggacaaacatttatattgtccaagcacagaaactctgtacctaggacctgaaggattcccattggaggatacctcacaccattgaagacatacagcccctagacgacgaaatgttatctgattcttttcctgatgtcatttgtacacaagttggctctcaaggtgcatatgctctgagcattccccataacgaggtaactgtaggagaggtgcatgatgctttgcccctgggtgaggtggaaagaacaataacacaaaagaaacaaccaaagggaagagttcggtggactgtttcagaaacccttacccttatcaatgccaaacaggttgagaagaatctgccatccccgggtggtttcatgaaacagactaaatcggctattgagaaatggaaatgcacttctgctcaatgtcattcaaatggcctcaatcgcactgccactcagtgtcgagacaggtgggatcatattcagccag

SEQ ID NO: 12540 - DNA, 859 bp, Pinus taeda
  Predicted polypeptide sequence is orthologous to G1341
ccaggctccacggagtaatttcagcataaattactctcaaattcacaattcagataaattgccgccccggcagcatgccaaaccactttctgcgagcactaaatcgaagcagaaaaaggcggtgaatagcaccgccaggccaccgccaccgccgccagctcccagcagcagcaaatcgtctctaaaatggcagtttttcactctagggttgatcaaaaccccgccaatgaaactggaagacatgcgccaaagacaagccgggaggcctagcaattacagtgcggctgataattccatcttgagacggtctgcctcctgcaatttctacaacgaagaaatcccaaagcctgcggaaagggagccgagattggcagactttaagaagaaatccaagtccgtcaaggagaatgtaaatctatggacagaggccgagacgcccagatcaaaaggggtaggttggagaatgctgaagccactggttgctttgaatggcggttgcagagcttccaccaattccgtcattcagtgctccaccaagaagttctcacacgacagtttggcagagcccaccaaggcaagcaacagaagtctaaatgtatctctgtatgacgatcagaattctccccgctgctcctccaaattagcggctcctgccaaaattggaggagatcgtgtaatagcatgacatcgggattacgaggtcgggatgggtgtgggatacggtacactcgttgcagggtatttattatattaatttgtttataaatagaatcatcattcaatgtaattaacatggatcaagcgatgtaatgcaattataatggtttttattaatacttgaatgcgaatgaagatttta

SEQ ID NO: 12541 - DNA, 868 bp, Pinus taeda
  Predicted polypeptide sequence is orthologous to G1380
ttggatctgcatacaaagaagtccatttcaggggtgtcagaaagaggccatggggaaggtttgctgcagaaatcagagatccaatgaagaaaacccgtgtatggctcgggacatttgacacagcagaggaagcagccagagcatatgatagtgcagccagagcactcagaggacccaaggcaaaaactaattttgcgttggttcctccctgtgatgataggagtactagtcttagcagcactgtagagtcttggagcagtcccaagaataacactaataataatacaaggaaaaacctatcgttgaataaagcagatggcataacacataagattgatctgaacattgcgcaagaggaatttggcaggaagggttctgtaccatatttagaagataagatcctcaatatattaaagaaacagaaaaccttcaaaaggagctgtgcaccagacagggccgcggaggcctacaattggtccagacagcagtatccacaaatgggttttgacccaaatgcctgtcatagtgattgtgattcatcttcatctgttgttgatgatgatgaagtgggtacttctagcttgaggcctcagggagtcaggttattaccagatttgaatcttccaccttgcgatgacgaagaggatttcagcagcatgttattgcatctttgaatgcgctcttcttttttagtgccctgcaaaggccacgggtattattgccaatccaatgaggtccctattttcttctctctgccattgaatcaaccatttttgacttcagtgcataggtatagcaagcattagttctttgtaatcctggccttgatatgaaggaacttatctgctatattttactagatttaatt

SEQ ID NO: 12542 - DNA, 961 bp, Pinus taeda
  Predicted polypeptide sequence is orthologous to G1380
gacgggatatccagagtccgatcgccatggccgtagacaccatacagatggcgagagtgggtgtaaaaatgaagatcggaggaggcggctgcgaggaagaggcgtcctcggctgtgaaggaaacgcatttcagaggagtgaggaaaaggccgtgggggagattcgctgccgagatccgagatcccttgaagaaaaccagagtctggctgggcacttttgacactgcagaggaggccgcccgagcctacgataacgctgctagaaatctccgcggggccaaggcgaaaactaattttcttctgtctccccacaatgacatcagcaccaagggcagcagcagcgccgccctgtcgagcaatagcaccaccagcgccgcctctggtcaaatccaaaaccaatggcccctgcggccatatttctattcgaatcaaggtccagccatagtttcattttcttgcgctcctgccgcgtcgctttcacccaccgacaacaatcaatgcggcggttctagttgcgttaccaggggatccgcttcacgaaattcggcggaagagaatcagacggtctacaataaaaggggaaaatttttgttcggtatcgatctcatgatatcttgtgattcccagcagcaggaggatgatgcagagatctgcagctcggcacggcagaaggcgccgtttttgctggatcttaatctgcccccggccgcaaacgatgtcgagtaacttaactgacaaatttgtaaatttccggaggcaggaggaaggagtaacaacttctctctaaatgagacctgcgcactgcttggtctaagcctatgccctgtatacccaactaagccaatttttgagtcctttctcctagtattcatttcatttcatgtacagtttggtatcctatcattatctgaaagttttcagccattttagagcagcgtttttatgtatatacattctggtaa

SEQ ID NO: 12543 - DNA, 849 bp, Pinus taeda
  Predicted polypeptide sequence is orthologous to G1380
gagatttattttcttgtgtttagagtttttgcagtgcgtgtaaatggcggtagaaaccatgcggatgtcgagggtgagactaggaagttgcgaggacgaatcccgggccgtcaaagaaacccatttcaggggcgtgcgaaaacggccgtgggggagattcgcagcggaaatcagagatccatggaagaagactcgagtgtggctgggcacattcgacactgccgaggaagccgcccgtgcttacgatactgccgccaggagattgcgcggccacaaagctaagaccaatttttctgtcaccgccgatgatcacaataacgctggtgcgcccgcactttcctggactcaggcgctgcatcctcagcagccggatctgaacgccgcagcttttgctttcgtatcaaacaagagacgtgaagtttcctctggaagcgaccggctcgagttcgaatctcccaacaattctctccacgctgcagcctctgagcaggcggcctcttcgtccccgcggagggccccgttcttgctggatcttaattttcctcccaccgctgatcaggaaaacgaaagcgcggccccgtggaattaatgggaacgaacttcttgagggttttagggttttctgtttcgtggtcttctgtgcagtgtatttctacacagcatttcgtaacattttaaccagcatctgcaagatatatgtagagatttccagcttaaagtttgagattctcatttttccatgatttttctacgtctgctttatttttttggctccctatatcaacgatggcagatatcagaaattcttaaacaacattggtttgttccataaataaagttatcggtttc

SEQ ID NO: 12544 - DNA, 921 bp, Pinus taeda
  Predicted polypeptide sequence is orthologous to G1380
cgtatcttgaatcgatcttgcctgcttgtgccggagcgcgcacactgtgtggtttgttctcgtttttcatcttaaagcggcggttgcaggaattgattgtgtgaggggacgagatgtgtgcagaggtaagtcagagtgccatggccgtgcacactatgcagatggcgagaatggaaatgaagcgtgaaataggagtctgtgagcaggaagcttcgtcggccgtgaaggaaacgcatttcagaggcgtgaggaaaaggccgtgggggcgattcgcagcggaaattagagatcccttgaagaaaaccagagtctggctaggcacttttgacactgccgaagaagctgcccgagcctatgataatgctgcccggaatctccgcggcaccaaggcgaagaccaattttggcccctccccactgcacgacggtaagcccctgttcaacaatggcttctctgctcagaaacgagactctctacggcggcctggtttgtgtcccaagcaagagccggccgttccagttcttccgtcccctgatgttcaggcttctacttgcgttaatatcgggaacctttcgccaaatccggcagtcgagaaacagacggtttctaataaaaaaccgatggttttgttcggtacccatctctcggtatcgcctcgcaatttgctgctgcagcagcaacagaaagaagaaatttgtaggtcgccagggggcggcgccaagcgcccctgtggctggaccttaatctgcccccggttgcaaacgatctggaattacttatatgaggaacttgtaattttcttaagacaagaagaaaggaacaacttttctgatctaaactatataagctgagatgtaggcacgccacagaacttggtctctgccatttgtatatctcgagccagtttggcgtattgcctcc

SEQ ID NO: 12545 - DNA, 874 bp, Pinus taeda
  Predicted polypeptide sequence is orthologous to G1380
gactgttctgttactcttcggatttgcatttgttcggcacctttaaaatttttgcggtggtacaggctccatcgagtgagaagcgttagatctctatattaagaagaggatagtgatctcagatcaccatggctgtggacaccatgcagatggccagagccggtctgaagatggaaattggaggcgtcggcgtcggcggcggctgcgacgaaacggcggtgtcagctgtgaaggaaacgcatttcagaggcgtgaggaagaggccgtgggggagattcgctgcggaaatcagagatccctggaagaagacgagactctggctcggcacttttgacacagccgaagaggccgcccgcgcctatgataatgccgccaaaaatctacgcggccccaaggccaaaaccaatttcgctatccacgacgatagcgccgccctgttcagcagtggcggcggacgcgccgtccctagtcagcgacaagaatggccgtcgcggccgaccttctgttccaagcaagaaccctctgagatttccaacctttctgctattcctgctgatccgtccgttccaggcaatgatcaagtttccagtcgcgttatggagaatcgggcggcctccacgaaaagacagaagcttttgttcggcattcatcttctagaatcatctcataatctacagcaggaggaggatgcagtgatctatagctcctcgaggcggcagccgcctttcttgctggatcttaatctgcccccagctgctaacgatgtcgactaacaaattgtaaatcttataggacagttgggctagggttagaacttttttatcctttaaactaacctgagacgtgtgcaaagcttggtctatgccctctgtaa

SEQ ID NO: 12546 - DNA, 904 bp, Pinus taeda
  Predicted polypeptide sequence is orthologous to G1380
agtttactttcagactctggatatggctgtggagaccatgcggagagcgagggtggggatcggaggtcacgagaacgaatcgcgggtcctcaaagaaacccatttcaggggcgtaagaaagcggccctgggggagattcgcagcggagatcagagatccatggaagaaagctcgagtgtggctcggcacattcgacactgccgaggatgccgcccgcgcctacgatgatgccgccagggccttgcgcggcgcaaaagcgaagaccaattttgctctcgccgccgacgacaatgcctctgctgcgctcgctctggcgcgcaacccccgctgggttcgaacgctgcaccctcagcagaagtggcctcatgatctcaaggcctcggctttggcttcttttccttccgtgccgactttggaatcaagcaagagacgtaaagccggcttggcaagcaactgccggcccgagttcgaatctcgtaacaattctccctgctctgcgctttctgagcagaaaacctcttcttccccgcggaggaagaccccttttctgctggatcttaactttcccccttcggctgagcaggacaacgagaacgagagcgcggctctgtaaatttaatggaatctatttatcaaaagttggcccctagctattttgtaaaatttcggcgtgccaaatcacacctttaaaactattgtacagcttcacaaaattaaattttcaggcttctcttctggttattttcatcgttctgttactcagatgatttggacattgtttgacggaagttttgctctgtcagccactgcctcctaattttgcctaacttggcctaaatgaattacgcagctgtaacggaaattctttccacgtgtaacaatgaatacaatttttgcttttaac

SEQ ID NO: 12547 - DNA, 726 bp, Pinus taeda
  Predicted polypeptide sequence is orthologous to G1380
ttggcacccggcaggcgatggctcccagcaacaacagaagagacgacatggagcacgaggagttcacttcaggggcgtcaggaagaggccctggggtcgatacgcggcggagattagggatccatggaaaaaagttcgtctttggctcggcacctttgacacggccgaggaagccgcccgggcttatgacactgccgctatctccctcagaggtccgaaggcgaaaacgaattttgcatactcctcgccgtcctcctcatcatctctgcacaataatcagagcagtagccaaaacagcagcacggtggagtcctggccctctgcggcccctgtgactcgatccggagacctcgagcttcccgcttcttttctccctcgcctcggagtttccaccgggcggcgggttttaaatggtggaaacccccggtccgggcgccggcggagtctttcggagaaaaacagcggcagaaaagctgaaggcgccgaggcgcgaaccaccctaagcgattctgattcttcttcttctgcggttctagacggtgaaacacaggctcttcctcctcctcctcctcctgctgcgaagaagccttttcttctggacctaaatcttccaccgccgctcgacgatgacgaggagcctcagcagatcggttcttgaccgcaatttctttaaattgtttttcgtctaaaaatttttcccgctttcaccgtttcagctgctgcagc

SEQ ID NO: 12548 - DNA, 779 bp, Pinus taeda
  Predicted polypeptide sequence is orthologous to G1384
gaaagcatggaaaggcgagatcagagtccggttgcagcccgccaccccatgagaaaacactacagaggagttcggcagaggcaatggggcaaatgggtagccgagattcgcctccctcagaatcgaacccggctctggctcggcacctttgacaccgcagaagcagcagctctagcatatgaccgagctgcttacagatggcggggtgagtgcgctcggcttaatttcccccatttgttctcaaaaaagtatcagaattcctctcccagctccaccaatggcaggattcctcgcctttcttgtgaaaaatctgatcagaaatatgcatataatggtgacccagttcatacgaatgtatataagggtcccccaattcggataactgcatacaacggcgacccagttcctatagatgtatataggagtgacccagttcgggtaagtgcatataatggtgacccagttcggataagtgcttatagtggtgatccagttggcaataccgttactttagcggaatccgagcttgaaagctcctgcagccatgaatccccaaataccaaagttgagagatttatatgggaggaagaggaggatgagaattggttgaacaatctgccggttttggaggcagacatgacatgggatgttctcagtggatgttcagatattgacactgaagtcagtcagactcgaacgtgtcacctctggtaagtttgaatttcaaagtgtctggctggattattgctacgaatgaataaaatatacagtcctattgc

SEQ ID NO: 12549 - DNA, 834 bp, Pinus taeda
  Predicted polypeptide sequence is orthologous to G1417
cggccggggagggaagtgatggctgccagtggcgaaagtatgggcaaaagatgacaaggaacaatccacttccaagatcctattacaaatgtgcgtgggcgcccgcttgcccagtgaaaaaacaggttcagagatgtgcacaagatccgaccattgtaataacaacctacgaaggcgaacacactcattctgtgagtcctctggctatggctgttatgcacgctggctcgtccaaccagctcattggtgaggggatgaatacagaaaatgtagttgcagacaaccaatgtataccctgcattgccccagtatcgacctccagcacgtttcccacaatcacgctcgacctcacagacgaccgccccagtagaccaagtttacagttgcagcctccacatttgacagcaggcagattccaacagtcgagtccattgtctagcgatatgggccaggtatcagatcataatgaaaggggtaattattcttcaatgatgcaggattatttggcttctataaaggcagatcccaactttactgcagccctatctgtagccatagctggttgtctgctcgagatgggtgatccagccaggggaatgatgcccaaattccctccttcaaggcaatgcgccaatggttcaactcacaaggcatttgcttagactgatcgtgtgctctgcaattgttgtgtggggaatctctcgtaaattgggttgtattgtagacccatgccatgggtcaaaatggttcttcggattgttaaaagaatgcaactggagggacatgaaaaccagcaattggggtccaagccgaaccaatgaagctaccgactgt

SEQ ID NO: 12550 - DNA, 870 bp, Pinus taeda
  Predicted polypeptide sequence is orthologous to G1444
tgccgaattcggcacgagggtttcttttataaatggaaaatgaaaaggatcttacacagtcattgcaccagtctaatgtaattaacaatacactagcaaatataactgcagcatatatttagcccatgacggctaactctattctgttggaagcatatttgagaattaaattgggaaaaggaattcgagtttcacagtgccaccgtgcaatggatagcgaatcatcgtggaaaattaacggtacatacaaaactgcaacagcagagtgtcttatctatgaattgtacgacatttcctctctgaattcttacaagttaggaacattacaagatcaagaagagtctatgaggcgcaattctttgagcttgcatgtacccaccttgttattcacgataactctattagcgtttttattattgctgtttatactcctaagtctgcccttgcccagatagtattcgcatagagagtaccctacaagagtccgctgagaacaccgccaccctcgcccattcctccgcctgcattgggaaccttctacttcgttactattgttagaacgtttatcaggcatcgatttctcatccacttttagcccaacttcctgctgtatatcagtctcctccctcatttttttggtggtatttttccattcgttaatatgcccagtcacatttttgcttctttttcgcttgactccgtgcacacttaagttcttctgctgcctccacagagtccccatacctgattttggcaacttccattcctcatcatggcctcccgtggtctctttctcggagctgcttgaagtgttttccttggggagggcttcttgagttcctttctgcctcgtgccgaattcggcaccag

SEQ ID NO: 12551 - DNA, 841 bp, Pinus taeda
  Predicted polypeptide sequence is orthologous to G1444
ctgccatggacgcccagcaacccgaggaggatgatcaggtagatggcacaggagcacttgcaattgctgggacggggacggggattgttgggcgccgtgccggccacaaatggagggacatattgctcagacatggcgctgggaatgctgaaagctgcgaggctataaaggtaggttcgtggggaggtgaaaaaaccaaatttaaaggaaacaatattatgagaaataaaaggcataaaatcggattccttggaaacgaaggaaaaaatcgagcagtacttgaagatgaaaacacgtcaaacagctgttgcgaggaatctgggtcagcgagtaattacagagaatgcgattcggcaaaatcaggccggcttgcgaacgacttcatgtccgagaagcttgaacaggaggttgggcattttgtgaaaaccggaaacagcttgcacaccatcaacatcaacaaacggaggaggtcaaagaagaaccgagagcctataaatgcatggagatcaggtgataaaaccagactgataattggcggggaggaagaggaagctgtcataaagaaagataaagcaagagcgcttgacaagcccatgcaacccgccttcagtaataataatgataatagtcatttgggttctcagtgcaggcgcaggaacggaaggggttggaggtgttcgcagcgaactctggtaggatattccttgtgtgagcaccatcttggcaagggcaggttgaagagtattaatactgagaatggcaaagtttttctgaataataataagaaggggagcaaattcaaagaattgcgcctgttagatgattcatcttcagtaaaagt

SEQ ID NO: 12552 - DNA, 836 bp, Pinus taeda
  Predicted polypeptide sequence is orthologous to G1444
cggccgggggctttattcgcagcggatagggccaccagctctacctctacttcccttatcgccattaacagtggtgatgggaacggaggcgaggagtttcttcttccgctggttgcagctgtcatggacatccagcgggctgaggacaaagagggtgaaggagatcatgggatccattcgcgtccggtccacaactggaggaatgctttgcatctccagcgcagcggcgaagggaacagtgaaagtcaggttcttaaggacggcgtggagggcaagaaagcagactggagatggaacggcagtataagaaatcaatgggacaacagactgtttaaaaaagaaaaaggaactcaaggagctctccttataaaggaagacacatcaaacaacgctgagaaagatataatcggtgaccgtggtgagaatgggaagttgccaaagtcaggcctgcttgacatggggaatttgcggaggcagcagaagaacttaactgtacatggcgctaatggggaaagaagcaaagatgagattgggtatttcaagggctggaaggatgaggaaacaaaaaccagtaaaaagttgaggccggagacctatatcgaccaggaagatgagcgaaaagtggatgagaaagccatgaccagtaaacgttaccataataataataacagcgaagttgaagggtctcaatgcaggcgcaggaacgggcgaggggtggaggtgttctcagcggactcttgtagggtactccctatgcgaacaccatctgggcaaaggcaggcttaggagcgtaaacagcaataataacagtaaaagtacaggtatcgtgatacaaa

SEQ ID NO: 12553 - DNA, 895 bp, Pinus taeda
  Predicted polypeptide sequence is orthologous to G1451
ctcttgcagtttcaacagcagcatcatttgcatcttcaacagtttcaatgtaggtcgagtccacagttacagatgtatatttttcagcaacaacaggcgccacaacaaaatattcttcagcagcaagctcagaacttacaggaacaatccccacaaaatcatcttcttcagcatcagttacagcaaaactcatctcagcatcatcttttacagcaacaactgcagcattgttttagtgatcagcagcaaccattgtctgagcaacaacaatgccaacaaccatttcaagttccaaatgttggtggtgccttgtcccaaatcccttcatcccaatctcagccagcaataacattgccatcatccatgtgtccaaaaccattatttgcagattcgaatggaaatctttcttcagctatgacgattccaactatatctactcttcaaaatatattaggctcttcgtctggaggagaaaattccaactatttgaacttgcccagcactagctctgtagtccatcagcctgtgggaatgttaacaggacatggtattccccgtgattgccaaatttcctctacttcatgggttcaaaagcttttatcaaataatttggtcccctgtcatccaggtggacaagttgaacatcttccttcaggaggtcaatgtgttgtgccccaaacagaatctcttggccagtctaatattccatcatcatccatgccaatgtcattacctcaatttgcatcaagagaatgccctccggagcaggaaggaattcactctgattctcagagccaccttctttttggtgtcaacatagattcctcgtctttgattggtcctaatacagtatcaaacatgaggagtattggcagcagtactgatgcagtcatgc

SEQ ID NO: 12554 - DNA, 810 bp, Pinus taeda
  Predicted polypeptide sequence is orthologous to G1451
ggagttcagtctgattcccgagcaatcttctttttggtgttaatatagataacccaactttggctatttctgatacagtttctagtgcaaggaatgtgggcaatggtgcttatgtagccagttcattttctgttacggacttactgaatgtgcctccttgtgctcctgtctctgggttctctatgaattctaacatgggtgtgtctggaggtctagatgaaagtgggttttcacagcctccaccaaattttgcaaagatgaatgctcccacgagaacattcactaaggtttacaagctaggttctgttgggaggtcagtggatgtaacacgtttcaggggctatccagatctgcgtgccgagcttgaccgtatgtttggtctagaaggccagctggagaacccaagatcaagctggcagcttgtatttgttgacaaggagaaggatgttcttctccttggggatgatccttgggaggagtttgtcaataatgttcgatttattaagatactctctcctccagaagtgcagcagatgagtcaggaagatatggagttttggagttccattccaactcagcagcagacaagcagtagttcagaagactgtgtagctagaaattcttctcgcaacatcagttcagttctcacatcgactggatcactggagtattaagtgtagttcaattgtactatatcaccagttgtgttgtgtctttaaaggggggtcgtaaaaaatgagatgtacttcagttcataactcttaggtatgccccataatatgttcgtccaggatatctaaatgatgaagt

SEQ ID NO: 12555 - DNA, 817 bp, Pinus taeda
  Predicted polypeptide sequence is orthologous to G1468
cggccgggggacttgcagcaataagggcgctctaccggtttcaatctccattccgatctcagcgcatggaggttcaacaatttgggagcaatatgagctccaaaagatctaagcgtgctaggcacgcagcaatttcttctctgctggtcaccaaattggatgatcatgaaccaggctttttggttgagtctgatatagagctggctgccaattctctcatgatgtttgctagggatggaaccctgctctcagatagaccagatatggcggccttggagattgaggaacccagcaactcatttaaactggacagacgcaagaagagggtcagaaccaagaaagtcttggatgcccactttgattcctgtgtggatcaagaaatgaagtacaagtgcaagacatgcacaagaaaattctcttcatttcaagctctgggtggtcacagggcaagctgccgcaacaagttcaagtcctcctgtgatgattccaacaacatgtgtgaagaaattgaggatcttactgaggagatcagtcactatgaggatgatcttcagtcttttaacaggctgccgtctctggagaataagcggtcacttcacattgagaagggcaatgaaggttggggtaatatggctaagcctggtcatgaatgccccatttgttacagagttttttcaagtgggcaagctttgggtggccacaaaagatgccattcaacaccccctgctcctccttcaactccccctgctgctgctcctgttggattagatgattgtccttgcctgtccaccattgaagagtataggtctgtgaaata

SEQ ID NO: 12556 - DNA, 773 bp, Pinus taeda
  Predicted polypeptide sequence is orthologous to G1468
cggccggggggcggccacagggcaagctgccactacaagtccaaatccctctttcccgcactgcaaactgatgagggtttcaaagaagaggcagttcactggtctatcaatgggccatctgttgagtcttataagcagagtttgtgcactgagattaagaaagttagggtgcatgaatgccctgtgtgtcacagaagttttccatctggccaagctttgggcggtcacaagaggactcattccactccccctgctactaatatgcacacttatacaagccattcaacgactgagcagcagcaattttcacctccaagcagaaccgagacgttggatctgaacgtgcctgctgaagatgcaaatgattgtactcaattgcagcacagttctgcagtttctgtcaatttaggggcagattctaccagttggcctccatatgaccaccaacttgtagcttacaattcctctcaaccatggtgggtggagagccatcagcctggtcttgtggttagagaggatgaagcagatagtaaattggggagcaacagtggattggtcagaggcccagaccagggatgcaagggagccggtgcttagagagtatgaagcacatgataaattggggagcaacagtagatctgttaaaggccaagatctgggctacaagcaagccagtctgctcttcattattattctaacttagacgtgttcttgaagaagcccgtcattcaaggaattttttttttctttgctttcttttgcattttatttta

SEQ ID NO: 12557 - DNA, 591 bp, Pinus taeda
  Predicted polypeptide sequence is orthologous to G1474
acagtctacgaaggtgaagtggtgaaaatgcattagacattctacaaatgttgcacaaaggagattacatttgtagtgtttgggagggtcgagtggagaagctattttaggcaaataagatgcaacagagaggatgggaataggaaaagaaggcagcaaggagagaggatgaaagagaaaagttggagtttatcattcataaatgaagtgagtgatcacaattgtatagtctatgaaggtcaagatgaagataccgtagacattctaccaacacagcttggacgtgagtgactatggttgcagtgtctgggatggtgtagcgtttgttttcttgctccacatcacatgcacacccccacacaatgtgccttgtaaaagaggtgggtaaggtcgagcatgcaagaatattgacccttaaaccaatcaaccatcgtgctaaaatacaacgctactgccttggagaccctaagattttgggtgttcaatatgtttagatatgcttagattcctttttctgaaaaatttacattttatgaaaacattgtttctattactcgtaatagaagtacctggcccgggcggccgctcgaa

SEQ ID NO: 12558 - DNA, 995 bp, Pinus taeda
  Predicted polypeptide sequence is orthologous to G1480
gcccaagccctgcaacgtgtgcaggatcgcgagcgcttcgctctattgcagggccgacgctgcttatctctgctccggctgcgacgtcaaagttcacggcgccaacaagctggcgtcgcgccacgagagggtgtggctctgcgaggtctgcgaacaggcgcccgctgccgttacctgcaaggccgacgcggcctcgctctgcgtttcttgcgacgccgacattcattcggcaaaccccttggcgcgcaggcacgagagggttcccatcgtgcctttctacgagtgcgtttccgtggccaaagcgttcctccccccactgccgcaaacttcgtcgcttcaggactccgacgcgccgggtaccctggactacgatgatgacgacgaggacgacgagatctacgctgcggaggccgcatcgtggctgttgcccaatcctaaagcgtcggccgagggtaccaagaattgtgacgacggggtaagctgcttcggcgtcgacgcgggtcctaacaaggcagccgggggctatttcagcgttgtcgatttgttctctgacgtggatccctacttggatctggactacgcctcgtcgtttgaggccaccggcgggaccgacagcgttgttcccgtgcagagcaacggtagcagccacgatggcgcggtgtctacaccctcggattgctttgaaaccgataaggccgtttacagctataccaccaccacgtccttcagccacagcgtatcttcgtcctctctggatgtcggtgtggtccccgacgccatgcttagcgacatctcgaggcctcttaacggaggggcggcgctcgagctggccaaccccggcgctgtccacgtaggcgtccagtacgtccaggcggaccgcgaagccagggtcctgagatacaaggagaaaagaaagaaccgcacgtttgagagacgatcaggtatgcttccaggaaggcctacgcagagaccagggccgcggatcaaaggtcgct

SEQ ID NO: 12559 - DNA, 651 bp, Pinus taeda
  Predicted polypeptide sequence is orthologous to G1480
cggccggggacagtctgaacataaaataggccaccactaaaaagcccacatgaacctagttgagcgcctccagaattagctgagatatcagtaccgtcataataaatggcataataacagacccaccatctaggaacttctttgagagatttaggggttgttgcagaggagaatggtgaaggaagaagacaaggattggcacaatgttgaagggtgggatagagggtctcatgttgatcacaaagagtttctcagagggattggagggtggagaatgagtatgccaaagctctgtgatgtttgtcaggtatcaagctctgtaatatattgcagagctcatactgcacagctttgcttagtctgtgatgctaaaattcatggtggtagcaaggcttcgttgtgtcatgaaagagtttgggtttgtgaagtatgtgagcaggccccagctgtggttacatgcaaggcagatgcagcagctttatgtgtagcctgtgatactgatattcattctgccaatcctcttgcaagtaggcatgaaagagcacctgtgattccattttatgagtgccctaatatgcccactaataatacagttacacatgccaataatgataacttggactgcaatgttttgctgaatgaagatggtgg

SEQ ID NO: 12560 - DNA, 865 bp, Pinus taeda
  Predicted polypeptide sequence is orthologous to G1481
tttgatccatccagctccagctgcaagttgggtgtttcagtttggatttccggtgagaatttttgctcgagcaagaaattgggtgttcagcttggatttcctgtgagaattagtagtggggaattttgcctgaggagttggagttgtgttgtggggaaataacttggtgatggggaaggggaagggacccaagtgtgagctttgctgcaacgatgcagcattgcactgcgaagcagattctgcaagtctgtgttacaaatgcgatgctaatgtccatggagttaatttcttggtggcaagacatgttagggttgttttgtgctccggatgttatcatcacactgaaagaaatgtgtctggggcgaccccaaatgctgatcagtccttttgctgtgcctgttgcaagtcacaggacatcgaacagacctctctctgtaattccacagcagaatctgcctttgctgggcctctttctgctgtatcttctgagcatagtaagggacttgatgtgggtattgattgtagccttttccatggttccagatttggagaaggaaacctgaaggcttgttccagggaaggggataatcagaggactggggctgctgagaggtctgaggtttctatgaatgcctggtcttacaatgatggagtaagcactaccagcagcttgggtaatagccagacagttgacaacaaaccccaagtggaaagccacaacaaagaaacgggcttactccatagaagatctggaccgcgcgtgttgaatgcagagatgaaagttgaaatagttttcagaaaatggttcagacatctgaatctcagaaacccttctacggtgcccttggccatggacttgatggaa

SEQ ID NO: 12561 - DNA, 981 bp, Pinus taeda
  Predicted polypeptide sequence is orthologous to G1481
attcggtctgagaagaaatctggtgttggtttgtcctaggtgatttgcggatctctcagggatctgaaaatggctaaaacaatgaaggaatgtgagctctgtgaattgtctgccagattgtattgcgagtcggacgaagcgagtctctgttgggactgcgatgccaaagttcacagcgcaaattttctcgtggcgcggcattgtcgaagcttgctgtgccagatttgtcaatctgtgaccgcatggcgggcctccggtgcgaagcccggtccgaccgtctccgtctgcgagagatgcgctggcggaggccgctcaaagagtgatggtgacgacaatgaggaaaataatgacgaaaaccaggtagtaccgctcgcctccggctactcgggaccgcctctcagttgttcttctacagatgaagaagaggaatcgtccggcgacgaccggcactgcgctgaaagccccctttcgaatgcccctctcaatgccgcccccaacaaacgtctccatgaaagcttggctctgaacacttccgagggcgattgtggttgctcttcttcttctggggttaacaacagcaataacaatatgagtggcggtgaagacgaagcaacctcctcggccattcgcggtttgaagaaaagaaaagtgaatcagggtttcaaagatgatttggtcaaaactctcgaggtaatccggcgggaggatcatgatgattcggctatattggccatttgtaaactttgcagagattctcatcccagggagcttgtttctgtagattgtcctagcaataactccccttacgctgggtagtattttaccgtggacctcattactgtttgatataacacctagatgacatataggctgacatttgccttattgattgtaaggttagggcttctggattttgggcagaactgatgaacggcaagtcaagattttcactcttgcattttcccattgtaaatagaaata

SEQ ID NO: 12562 - DNA, 864 bp, Pinus taeda
  Predicted polypeptide sequence is orthologous to G1482, G1888
cggccggggaactccactcctaccatattttcattggtattcacgtgggttttgcaatcccatcacgcggccacagccctcgttagcgctctccccgcccctcttctagctctttgaccatgatttaataccagtggctagtggcttctgcagatatgcaggagattcagcgcccctagaaagataatactgaaatatacaatatactgttgtgggaaggctggatcagtaatcctgaatttgttgtggattcggaaaaaagatgaaggttcagtgcgacgcgtgccagagcgcggaggcatctgtgttttgctgcgcagacgaagctgccctttgtatgaaatgtgattccaaagtccatgatgccaacaagctcgccagcaagcaccgcagactctctctcctcgagcccagttcatcatcctcctcggattctcttatatgtgatatatgtcaggaacgaagggcgttcttcttctgtcaagcagatcgggccgtcttatgcagagattgcgacttgtctatccattctgccaacgaattgactgcaaaacacaacagatttctggttcccggcaccagagtttctctgaaaccaatagagactttggctgcccctgagaaagctgtggccacggccgctgtcaccaaggcacttatcccgcctgtccaaaagatgccggatcatgcccagccatcaatggatctgcctgtagaaaccgtgactgcaagtaccagtaacagcgagttctcacagtacttgagcgaggttgagcaattcctaacctcggcttcccctgagcgtctagactggggtgatcagctgagctcacgctattggaaagtatatggagtcggcttggg

SEQ ID NO: 12563 - DNA, 860 bp, Pinus taeda
  misc_feature (4)..(5): n is a, c, g, or t
  misc_feature (11)..(12): n is a, c, g, or t
  misc_feature (37)..(37): n is a, c, g, or t
  misc_feature (155)..(155): n is a, c, g, or t
  misc_feature (529)..(529): n is a, c, g, or t
  misc_feature (567)..(567): n is a, c, g, or t
  misc_feature (589)..(589): n is a, c, g, or t
  misc_feature (617)..(617): n is a, c, g, or t
  misc_feature (622)..(622): n is a, c, g, or t
  misc_feature (704)..(704): n is a, c, g, or t
  misc_feature (736)..(736): n is a, c, g, or t
  misc_feature (740)..(740): n is a, c, g, or t
  misc_feature (754)..(754): n is a, c, g, or t
  misc_feature (758)..(758): n is a, c, g, or t
  misc_feature (762)..(762): n is a, c, g, or t
  misc_feature (775)..(775): n is a, c, g, or t
  misc_feature (795)..(795): n is a, c, g, or t
  misc_feature (804)..(804): n is a, c, g, or t
  misc_feature (819)..(819): n is a, c, g, or t
  misc_feature (838)..(838): n is a, c, g, or t
  misc_feature (844)..(844): n is a, c, g, or t
  Predicted polypeptide sequence is orthologous to G1483
tttnnttcccnngccccctaaatgtattggccccggnaattcggacattaaggccgggggaccacaaaattgagggaacttaatcacaaaaatctttataatccaacggttgaaaaaatgtccactgaatcttgttaacaacgactttgatttgntaacattaatgacttaagcccaccagagatacttagagcccaagccaatcccttgtatagtgtcaaaacatagtagaacagataccagggtctagctatagcaaacagatatcagggtgttgtacagaaatagatgaagatgaaggtccagtgtgatgtctgtgaaaaagcagaggccactttcctgtgttgtgctgatgaggctgctctctgttcagcctgtgacaataatgtccacgctgccaacaaattagctagcaaacatcagagagtatccctcatcaacccttcttctcagtcgcccaaatgtgacatttgccgggagaagacgggatattttttctgtctggaagaacgagctcctccttgccggnaatgcgatgtttcaaaacaatctcctaacaatcctgtngctgcccaacaaagaattctantgacaaggggtaaaggtgggccttgaancctcnaacaacaattctccctccacaaaaacttctacacaagtcgtctgatatcaacaacaaaaaaacaaaaaccttgagaaatggnccaacgggagtcccgcatcgttgcatcaaggngtanaaaaggggaatagngggngggnggatatccccaanagggacgggttccgaagtanttttcgggnggccaccgccccggngaaagggaggaattccaanttgccngaaattgggaaagggt

SEQ ID NO: 12564 - DNA, 865 bp, Pinus taeda
  Predicted polypeptide sequence is orthologous to G1488
cactgtgacacaacaaagacacctcaatggagaacaggccccatgggacccaaaacattgtgcaatgcatgtggtgtgaggtacaaatcaggcaggcttgtgcctgaatacaggcctgctgcaagtccaacatttgtggtctctaaacactctaattctcacagaaaggtcattgagatgagaaggcagaaggaaatgcaggacgccctacagcaggcctccaaactgtacccaaatgacaaggaagggaatgaagatggggatgaatatgaggaggatgaggatggatcagatggtcaataccctcattttggctcggatgatgatacttacttagtccatacaaatcaggattacaggcatttcatatgatgcaacaattcaacagcaaattccctaccatctgtacaatttttaatactaacaaagcagcagggagggaggcaagcactcaagggggtcttattcacccatcacagcagtacattccagtgtgttcactgggggtaattggtagcacaaatatctgtctttcaagtatacaggatgatgatcaacaagcgagggaaatgatgactggcttgttgctggaaggaaggaagaggggatttcagaaccaatgcatttgcatttattctttaattttgtagattattggatcatctgtttcttcttcttctatgaaacgttgattatcttttgaaattagagacatttccaatggctgaattagggtgagatcattaaacttaaaacatacatgaagtccagttagtttatatatctattaatggcgaggcctgctagcctttactgatcatattcgaattcaatgtgatcattgtagtcatttatatctccacca

SEQ ID NO: 12565 - DNA, 897 bp, Pinus taeda
  Predicted polypeptide sequence is orthologous to G1488
ggtctcgcgcccggcgtctacgtggtcgaagccgacggcagtggctgtgcgtgcccgtttccgggcgagctctgcgtgccagacgacgccttggaggaactggaatggttgtcgagcttcgttgcggacgaatcgctcgctacggtgccagagttcgttgccccggtggagtccgtggcaacggtttgctcgccggccgagcgcgaggagagccaacgaaagcagagcaacgctttgctcgccggcgcgggacggacgtgggtgctggggcgtgctcggagtaagaggtcacgcaacgctaatcccacagctttcgtgagcgttgctattaagagctacgaaccccgaaccggacgcaagccggcggtgaagggctcggtctacgcagcgccgccggccgcggtcaaaaagaggaaaaagttgttccacaagaaaggcggaggcgggggcggtggcggcggcggggggcaggagagccggaggtgcagccactgtttagtccaaaaaaccccgcagtggagagcaggcccgttgggcccaaagacgctctgcaacgcttgcggtgtgaggttcattcaaattgccacagaagagtagttgaaataaggcggcagaagatagaccaacaacagttgccctcaccgcaggaaacttcaaccataacagacaattccatggcatacaacagctagcgaaccatttaacggactagtttctctttaatcattactaaagattcgacaccatggtcagcgcaattctattcattggtgtctaaccattctcaactgtactctgtacaaaaatttaggttttgaaattttatgtcatgagaaacctatgcagtaacatgtgctgttctgcacaacgtacttctcattctttaaaactgttatg

SEQ ID NO: 12566 - DNA, 838 bp, Pinus taeda
  Predicted polypeptide sequence is orthologous to G1488
tcgatgacctgctggatttctcaaacgaagaaatttcagcaccaattggagagaaatgcagtgatgccaacggagctgattcctccacaataaaagaaaccgcccatatggcaggaacaatgctaatatgcaacaacgattccttgcttgataagagaagtagttcccaaatttcaattgctgtaagcacagatattaaaggtcacaattctccaggagacatttgcgtttcagtaagtcatgatgcttcctcttctaccgcattcgatggactacttccatttttgttatttagttttccatgagcaaccctaaggtaaaaaatcaaataacaatcttacccctagtgtctgtctatttccatccctacaacgtgtagaagatgagttccttattaagttaatctccattgttgttttacagtgtgatgatttggcagaactggaatggctttcaaactttgtggaagactctttctccaccggtaacgtgcctacagagataactcatcatgttcttgactctgataagggctcatctagctgtactttagaaatatggcccgtgcctagccgagctcgaagcaaaaggtcaaggacacctgtttgtaattgggtttctcgcgtactgaattctccaagttcctctgcaagtatagtatatcaaaatggctctacttcagaatcgtctgaacaagccgatggagaagagtctctatctacaaatagagataaacttagcaagaccgagaccagccacgttacatcgaataagaaaggtgtggtgcaggtggatcatcatggcacacaagtcagaaaatgcagtcattgtgccaccc

SEQ ID NO: 12567 - DNA, 794 bp, Pinus taeda
  Predicted polypeptide sequence is orthologous to G1488
cggccgggggctgacactgtttgcttcttcgcaaagctgattgttgccttcgtattcactactctttttttgggtttcccttttgcccacaagcagttcgcaaggaaagaccagaggcagaatgaagtctgaggcagtgacaaagttcgaaacagttatcacgggggacttttttgaccaatttgatgacctgctggacttttccaatgaagaaattggagcacccattggagaaagcagtatcaactgtcccaaggatggcattttaggaggcagctcttcgacagaagctgtgagttccaatttcagagtagatgagagcgactctggaaaactgtgtattcctagcgatgatttggcagagctagaatggctttcaagctttgacccattcctagaaactgtaccggcatgtccttatgaacctgattttggagttgaagtcaaggaaaaatatgaagaagggcagaattctgataagttcagaagcccgagtcctacatcggtactggggcagaattctgataagttcagaagcctgagtcctacatcggttctagaaagcagctctgggaaaatttcaacttttagtccggaaatcactgtaccaggaaaagcaagaagcaagaggtctagagccccagtttgcaaatgggcttctgggattatttcccctgcatcctcagatgggttattggagaatggcccaactctttcagcagtgattcagacacttcgttaccaagccagtggaacctgaacccctgagaaatcatcagacaaaccactgggat

SEQ ID NO: 12568 - DNA, 771 bp, Pinus taeda
  misc_feature (708)..(708): n is a, c, g, or t
  Predicted polypeptide sequence is orthologous to G1493
tcaattctcgtgtaatctcggtcaccaggggaaattaactgcaaaaaggcgcgggttgtgagctgggagatgttaggacgatgcatttgtttgccgttgttgcaagggtgaaatatcgaccacagaatgaagatgcggaactcgggagtcgggtgatgccttcgtgcgccgtggtacacttgttttctttcttttgttcttccgttctttcaggtacacacaagctttccgtggttctgagaacggtgaagtgagttatgtgcactttaaaggtaataatatagtaaaatatgttacaaagtcgatcaacagtttcgtttccacttgtgtaaaagcttagcatccgtcggtctgtctaacgatcgggagattctttgtcgtaaataataataacgaggacttggctgcctacttgcctgtctgccttccttgtcggtgttagtggcactggcctccgttgtatgccttgtccatatagagatagaggttttttggccaagggcggcaatggcgaagtgtaattaaaagggagcagcctactgccaaaggtggagaccgcgatgaggccccgcgtcaggctcgccgaggagtcgagatgcatgaaacaaattgagaatttctctccaagaggcatggaggttctggtggtggatgatgaccctctctgtctcatggtgctcgaaagaatgctccagcaatgcgattacnacggtcagtccgtccagtattccttttttcccctcttcttctgtcaaaggggctattgctttt

SEQ ID NO: 12569 - DNA, 605 bp, Pinus taeda
  Predicted polypeptide sequence is orthologous to G1493
gagggaggagtcgagatgcatgaaacaaattgagaatttctctccagaggcatggaggttctggtggtggatgatgaccctctctgtctcatggtgctcgaaagaatgctccagcaatgcgattacaacgtgacgacctgtagccgtgtttcagaagcaatctccatggttagggaacggaaagatcgttttgatctggtaatgagcgatgtgtatatgccaaacgaggacggcttcaaattgctcgaattcattggtctgacgctcgatttgccagtaatcatgatgtcggctaatggagaaacaagtatggtaatgaagggaataactcatggagcatgcgattatttggttaaacctgtgcgaatggaagagctgcggaacatatggcagcatgtcgtccgcagaagaggaagagagtaccttagagaggaatctggggacagcgagaatgagactagtaaactagtcgagagctcagaatcgtcatccaaaaagagaaaggattcccaaaatttggaccattccagtgaaatcatagacgacataagtagcctgaagaagaccaggattcactggactgtgcaactccatcaacaattcgt

SEQ ID NO: 12570 - DNA, 859 bp, Pinus taeda
  Predicted polypeptide sequence is orthologous to G1493
tacattggactgctcaactccatcagcggtttgttaaagctatcaatcaaaccggactcgacaatgcagctcctaagaggattctagaaatcatgaacgttccaggacttacacgagagaacgttgcaagccatttgcagaagtacagactctacttgaagcgtttgagtggaagtatcccggagccacgcccagtcgcttcgttccaggctgccagagatagcaaattcggcggcaccatgcaaatccgaaagcgcggtaaacctactccttcatcttcatcgtcatcaagctcatcctctgctctaaaaacatccccttcccctttgagtttagaattatcaagaaacctcgaccatgccactctcaagtcacttgaacaattccaagcctacgagcggaaactggtcgctaaccgggtgcaaatgctacggggcgtcgccaccgccgctgccgatgaatccgcacctcagagcttcaaagtcgactttgcgaagttggccgagacaaagccccttaccaggattttcgggctttctacccatcaaccccaattccaaaaccctgcacccactaccgaaagcctagaagaaagcgatgtccacaaggaagaggccaagagattaatagatgaaactcagactattgatcaggaagaattgcttttcaataattttgtggcagagaattttccccatgtgcagatcccctctgatcatgaccagatgccaaccctaattgcttcagctggggatctatcagaagaatactttatgctgggggaagcttttctcccacggcctggggacaaagaagaaatcgcacaagtacatattccataacaccaagctacttgtca

SEQ ID NO: 12571 - DNA, 621 bp, Pinus taeda
  Predicted polypeptide sequence is orthologous to G1493
actccaattggtcttaaggttttggttgtggatgacgatccactttgccttctggtgcttgaaagaatgcctcgccagtgtaattacaacgtgacaacatgcagccgagttacccaagcaatatcgatggttaaggaaaacagagaccgtttcgatctgattatgagcgaggtgtatttgccagacgaggacgggttcaggctacttgaaattgtcggattgggacttgatttgcctgtaataatgatgtcaacaaatggagatactagtgttgtgatgaaaggcatcactcatggagcctgcgattacttcatcaagcctataaggatagaggagttaagaaacatttggcaacatgtaatgcgcagacgaggcagagaatctctcaaggatgacttgggagaatgcgaggatcgtgaagtaagtgattcaccagacacgtcctccaaaaagaggaaggataccagtagtggggactattctgatgaggttatagatgacattagcagtctcaagagggcacgagttcactggaccgtgcaacttcatcaacaatttgttattgcagtgaatcagttgggaatagagaaagcagtacctggccccgggcggccgctcgaa

SEQ ID NO: 12572 - DNA, 978 bp, Pinus taeda
  Predicted polypeptide sequence is orthologous to G1493
cccgcgtgaattggactctggaactgcatcagcaatttctgaatgcggtcaatcaattaggagcccataaagtagttccgaagataatactagaaatcatggacgttccgggccttacacgagacaatgttgctagccatttgcagaaataccgactctacttgaagcgtttgcgtgggattattccggagccacgcccagtcgcctcgttccaggctagggggcagggaaaatccggtggcactatggaaatccgacaaggcaaatccagtggcactatggaaatcccacaaggcggtaaaactagtgctgtatcaccatcgtcgtcatcagggccgtcttcttgtcgaaaagaaattcatatgcgccgcctagaattagctggaagaaacctggatcaggccactatggagtctcttgagcaattccgatcgcaagagcaggagcagaaactggccgcctctaactcgtggcaagtcctaccacaagttgttgttgccggcgcggcagatcacgggtctgacggcggttccgaagtgcgaggaatgcgaccgagtttccatgtgggatgcataagaaaaaatatgcacagggccttcgcccttagcgcgaatccagttgaagatttagcagctcggagctttaatcccaatcccaatcccaaccttgtcgaggatttggccaataccaaaaaccctccagagattatggaccttcccatacatctatctaaactccaaaacccttcaaccacttatgaaatccttaaactagacgccgcccacaatgttgaagaggcctggccgagggatgaacttaataagatgtatgtagaagacttaacattcaataattttgttgaaaaagacacggacttctcggctgctgcttcgcttctgtcacaattagaatatggtgcgatggttaacgcagataatttattgtgtgagcctagcgttgatcaatcacgatgagaga

SEQ ID NO: 12573 - DNA, 800 bp, Pinus taeda
  Predicted polypeptide sequence is orthologous to G1506
aaacatgccactcacaaagcattcatgagctctccaggtcaactgtccagccaagttattacaggatcagaaaagtctacaagaaacactgacaacatgcaaataggtgggcctaatacagtgcatcctgtcacgcctgcttgggcaagttgtaacatggaaggtatatgccatgaaagcatagacacagggagtacttccaaggatgctgccggatttgaaataaaaccaaagggtagtccttcacttggtgctagcagcctgttttcttcaccctcaaaaagatgctcgtcatttgtatttgactctctaggagattttgcagatgaagactctgattcagttttgctttttgatgtcccttcaaacctgtcctttccacaggcagaacttttgcacacccctgttttgaaatgtaaagcccccaaggacattgttagtgatgccagcaaccttgagaattcaaacagtggtggaccagttgtcaactcagaggaaagtcccgattggggtagccttctatggaactcttcatttattggatctggccaaacactatctgttggaactgtactgaacccggataaaacacacctctgaatagttcgatcaatcggtgttgcaagtgatatgctatagtgtctattttgaagttcttgtttctttctgagagagccctcaaaccccaatttggctatatagaggggtaaatgtttcatcgagttgtggtcaagagtgtatgatagctagttcggatccttgtgcaactgtgtttgttgagttgaaagtatacctgtgat

SEQ ID NO: 12574 - DNA, 772 bp, Pinus taeda
  Predicted polypeptide sequence is orthologous to G1506
cggccggggcagaaaccttccacgggaaagatcttatttccaaaaccctactgttgcggtgtttcatattgctaaagccctaaatccagtgaagttttggtcttttgatcgcatgaagtactgagggccagaccaatgtggattgtctggtgcctaatctcgattgcgaacagtaaaaagggatttccgctttgcaacttaagcttcccggctttgccagggtttttttttcttctgttgcctgtttaatctcaacagccgcatacacggattgaatgtagaacaataaactaactacatagttggccaccctttaatggcggcggttcattgttgaaaaatcgttagcagaaatatcgatagtctgtatgtaaattggagtgcacgtggctaggatgacccagtgtcagcaaaatcttgtgggctttgtgattgatgtgattcaagtctgagttgtgttaaggtagcagcatttatcctgaattaagcaggggtactgataatgccagctttttgtggccgaggctagttctgagtttgatgcgacagatccacccgagttttggctttgtagccaaaggttttggttatggttttgaagccgaaggtctcagttgcagcttggtaaagggaggtcttctggaagtatgctgatattcttggtggtatgcactatcttcagtataaggtgtttctggattttccgaacgaaaacgctttttcatttgttttgataacattgactgtgtacagttgttatgataatgtatag

SEQ ID NO: 12575 - DNA, 673 bp, Pinus taeda
  Predicted polypeptide sequence is orthologous to G1521
ttgacggctggttttcgacatacagggacccggaagttacagggaaaagcgtctgttgcccttggcagaggcacccgagccgtctgttaacggaaatggtcagagggaaatggattctcagagatcactgcaatatgcgagaggccggattttggacaatcagaggcgcacgaggccactgccacggcgacgtttttttgggcattccagatttgtttcggctgcagagaaacgcaggcttgaagaggcgggtgctgccgaaaaggccctgacatggcgagccagcatatacagaaagggcctaagagctattccacctcgtcttcaaaatagaactaatctgaagcagaacatcacagatgaattgaatgaaagggctagaatagaacgccgattggaaccttggattcgtcgggaactggaggccatccttggggaccaagatctggcagtccttgttcacctcgtgctttctctttggttctccagactcaggaaacaagaagggacacggaatttgatcccctcaagcaatgaagatgagtttatgcaacagttggagccatttttaagtgacaaggcaaatgctttctggcatgaactgaggtgctttgcagaatctccgttcacaatgagtgcatatgattctatagtagagtatcaaagacctctg

SEQ ID NO: 12576 - DNA, 741 bp, Pinus taeda
  Predicted polypeptide sequence is orthologous to G1526
ctcagatttcaggttacaatatacataaatggggatacaatttcacggcatcctgaacagctcagtgcacccaactcagctgtggatgaccacctatgtcatcgttcaccatttaaattacaaaaatattttgagaattctgtaaaaatctcaaatgaatacccatacgaatttaacccgttccccatttaaattacaaaaatactctgagaattccgcgtaaaattctcaaaggaatgcccagacgaatttaacctgttttcccaagttgaaaagaatgtttgtagcttcttatcctaagcaccgggattaatggtgaaagatgagaaagtccaacaactaaaggtttatctgaagagcattttgagttcctcaatccgagcactgcggacctctccatcagtcagagctcctgccacgatacgctgcttgcgcgcctgcacctgttgcatccgttcttccacggttcccttgacaatgaagcgcctgatggtaacttttttagtctgaccgatgcgatgaatccgcattatagcttgttcctcaaccgcagggttccaccagggatccatgatgaaagcatgagatgcagcggttaaatttattcccactcctcccgctttcaaagaaattaacattaccaaaacgcctgggttttgcctgaattcatttatcacattctccctctggtgttgactcagagtcccatccaagcgcacaaaatcatatttcatccttcta

SEQ ID NO: 12577 - DNA, 853 bp, Pinus taeda
  Predicted polypeptide sequence is orthologous to G1554
acagaaatttcgcctgcatactagaaggcccagtccttcaccaccgacctcaaatcctcaagcacctcagctggtggttgttgggggaatttgggtacctcctgaatatgcagcacatgcagctgctgcagcccagcaagggcagggtgggctttacaatccaatacctacaactgtttcttgcccacctctgtcacattactgtcagccctccatttcccaaggccatgagtattattgccagataaatccagcagcttcaaagtcgcagcttcaccactcagtctcactttactgtgaccaacaacaagaacaacgacagcagacgccgtcacaatctcaaaactccccacaagggccctttcagtgtaatgggcaatcctcgggggctaggggaacctctgcagatgctgggagagaggaaagtgtagggaaagatgcagagtcagatagttccagttggaaggcagaagactatgttgaaactacagaggtgatgaacatgggaaggggtttgtctctcagaaaacaacctcacaaattcttggatgaagatgatggagatgcagcagacaacagagctagagatcaaacgggaaagcaagcactagtagggagataagactttttcaaaacagtaacctcggctctattatgtgtatggaaaatagataatgaagatggagaatcagttatattctcaaattagcttttcagcattttttgctcgtttggactctggagacttcagccaagcttgttggcaaaatgaattgctttatgaaaccataactattttgctagtctaacaccaagttgagtcctctccttggttttgctctttctctccttg

SEQ ID NO: 12578 - DNA, 898 bp, Pinus taeda
  Predicted polypeptide sequence is orthologous to G1585
cggccgggggtaaccccttatcgatatagtcaaaatcatggattctttggttctgtgtcctccatgaattaagaatcctgaaattctgatttaaatgacgtattttgaccggtgcaattggaatttaactgtgacttgcaggaggagaaccagcggcagctgatttacctgaagaagtgctttacattcttgcgatttgaagcaagtattcacgtctgaattttgatcgacagtggaaggcattttcctgcacaaagatcatccttctactttcagtcaagatgaatcctgggaagcattggccaagtatgttcatactgaagccctcaacatcacggaatcaatggcaagaaacctcaaattcttccgtcggtcagaagtcagcttatgaaggtacatcattacaaagtgaagaggaaagtccgcctggaccaaagccacgatggaatccaaaccagaacagattcggatcttggaagccgtattcaattctggcttagtgaaccctcccatagatgaaataaaaagaatcaccactcaattacaagagttcggacaggttggggaggccaatgtcttctactggttccagaataggaagtccagaaccaaacaaaggctacgccatcttcaggctgcagagaagtgtaaatccagcgcatcgaggacaatcccgaacgtttctagcaccacatctaattccttacacaacaatggcgaatcgtcctcttctgctgtgccagcggcctcattttacacgcagcagacaaccagtataatcctgtaccagtgaacgaagcaatgaatattgatcaatccagtcacgtgcaagcaccaggacacgaaagcaataacgattcaatctatggttgctcgataactgtattcataaatgaca

SEQ ID NO: 12579 - DNA, 833 bp, Pinus taeda
  Predicted polypeptide sequence is orthologous to G1585
cggccggggacgccacaacgttatgttcagttttgagttgtcctttaaaaaccaaggagcgtaattgtaacctaattggggactcttcggcttctcttcgccttttggagtaattctggcacggttttgccatctttcctcttactgtgttcaaatgagttcgaataaaagttgggtgggaaagttcattcgaaacccctcagattcttccagacagaggacacctcaggaaggaacgggccacgattcgaactacggcatatcgataactatattagtcaataacagggaaattgaagttccagcaggaccgatcaacgtgagggctgtgttcggaggaaataaagttttggtacactccttgggccagccggtgctagtaaatgaatgcggattcacgttgcaaggcctgcaacatggtgctacgtattacttggtgtgattatgctttttttcgattatgatttgaaattgcgtacagctgcccggagatttcaacttccacgatggatcctatttcggtttataattatatttgataatttgtgttaatattctctgtcccttagttttaatggtcttgagctccagctagagaaccataccggaacgacagaatttcattctgcacacattataaatatgcaaggttgttttgtatgccttagaaatgcataacgacatcagagtgacagaatttcattctgcaccaattataaatatgcaaggttgtttgtatatcttaaaaacacctgttttagttatatatgtcaaaaatgctttgctttcagctatttgaatataggttcataacttttctttcaatttttttc

SEQ ID NO: 12580 - DNA, 773 bp, Pinus taeda
  misc_feature (383)..(383): n is a, c, g, or t
  Predicted polypeptide sequence is orthologous to G1645
tcacatggacgctgttaaggagtgttgtaaaaagcttgaaaacgtccataaaatttatgtctgtaatgaaaatatgattcattacatttatgttgttggatttgttcgcgcccacttgtttctggttaaatatttgcaagattctcggaccagatccatatctttaaatttacttattccttgtttggctaaatattgcaagattcctctctggctttaacttatgcgttcctgtcctctgcaaaacccaagaaattcgggcgctcagtggtcttcatggattcgacctccaggccgggggacctcccccttcttcccttcgagatttgggcgctcagtagtcttcatggatttgacctagggaaggggcggcctcccccttnacccctctgagattcgggcgccccgtggtcttcttggattcgatctctagacgtccggtagcggcctcccgcttccccctctgatattgatggattctgtgctctggtttcttcactgtgtaaagtctgtttttgtcggagatgtggactcagggttttggaatcgagtcctctatggaggtggagttggaggttaaaagtggttaaaattataaaaatattttaaattttttttgtagatgcagtgtttgaattatgtttttgatcgtggaaatagattcaaagcaatcaaaaacatctaaaacctctaaaattataaaatttgacaatttttcatttagatatacaaaaattcttaccagaatttaactcattttaatttttttttgt

SEQ ID NO: 12581 - DNA, 814 bp, Pinus taeda
  Predicted polypeptide sequence is orthologous to G1655
gaaattttcttttatgcttgccatggaagggaagtgcagcaacatgtcccgagttcgaatctacttgacccattttctccctgagctgcagaagatcaagcggagacgctcaagcctaccgcagcgccagcgagccattcgtttcgcagctgatatgtgcttggctcgcactgccaacaagggctctgcctggactcgagctctgaacctccgtctcatgcgcaaaaaaaagaccatcaccatgatgaagaagaagaaatcctccatcataacgctggggagaaaaacgaaatcggcatctttccatcgaaaatgttgtaataatgttgatgttgaaacaggcggccatgatcatggcgccattgacagaagactgcggactctggagaagattgttcccggcggcaagaaaatggaagttcatacgcttttccaggagaccgccgactatattttgaatcttcaaatgcaagttcaaggtttggaagctcttgcagatttctacactgcgaattctgcaggtcgtgtggtcgagtgcgccccgctacaggaccgatcagcatcctgcgctgcacaggtctgatatggtatatacgcgagcttgcttgctctgtataattttaactatgcagtgtatatatgaaggcagcgaggatgtagctggttgttacctcggaatgtttctcactgtatggtatggctgtataaggccgataaatttactctctgtaaaggtactgctcctcccttaacgaggcttggcgtagtatcctgatttgtgtaaagttttcgagaaatatatcaaaatctttcc

SEQ ID NO: 12582 - DNA, 833 bp, Pinus taeda
  Predicted polypeptide sequence is orthologous to G1666
agagcggcaacaggccagcaatttgacagagtccacgggctttatcagtacaaaacttggaaaggattggcgctcacgacattcaaaacaaggtagtggtttcatacattggaagaacaatggtaattgtgttgttggcatcaaagcagtggcatccccgcagaggatattgaagaaggtcttgtttaaccttgctcgcctccacaacaaatgcaaagaagacccaggttactcccctaaactgggagaagaagaaattggcagcaagttggtgggtcgcaaaattgggcaggaagatctcagtgttagccatgtactggcagagcgcaagcgaagggaaaaattgaatgagaagtttatcgtgcttcgttctctcgttccttttgttaccaagatggacaaggcatcaatcctgggagacgccatagagtatctcaagcaacttcagaggcgcgtagaggagttagaagcatccagcaaactcatggaggcggaaattaagaagacccagaatcgaaacttaccaaagcgatcaggctctacagaaaacatgagaatgtccagacatggagtaaatcacgtggatagttgcctgcagtcttcttgtcttgatggggaactcggttggacgttgacagacacgaaacagccaccctcgaaaatgccccggttggaatctaagcgaaagctgaacgacttccataagaaaggatcatgcacactggcagcagcagcggcagatttggatgtttcagtttcagtcatcgaagacgatgctgttttggtagaaatacaatgcccctgcaaacatggcgtgcttctcgatataatgc

SEQ ID NO: 12583 - DNA, 834 bp, Pinus taeda
  Predicted polypeptide sequence is orthologous to G1672, G2802
aagaagatcttggttctgtataccaactttgggaagcacaggaaacctgagaaaacaaattgggtgatgcatcagtaccacttgggggtgcatgaagaagagaaagaaggggagcttgtggtgtccaaggtgttttaccagacacaaccaaggcaatgcaattgggaaaggaccagttctgatattgctggcagtgccatcaccagaaatcaaagtcaagaaatgactccaattcatccaggagatgcaagtttcaaaaattatccagctgctgtcatggtgggaaaagcaatgacagacattaatcccggaccatcctgtacttataacgtcgatggagtacaacaagcgagtgcagaccaatttacatttgcatcatgccctaggagcttggatgaaggaatctcagacagtactactggtaaaggatcagaaagctcccactgtactccgcattcgtgcgacgaacacgaagaacacgagcacgatcagcacaacgcaattaacgatgctctgaagcgcgggttccccatgtccgcaggcggaggcggccatgaaattatcgccttgcgcttcaacagaagatccgatggcgtaaacgtggagctcaagtcctccggtcgccatcgtgggcaatcgtccaatgcagatgtgacgtgcatggccggggaatcccaagaaccggatcatgacggcgacttggacgctgtggaaggaagcctgtccagaccccaagtactcatacctcatgaaaagatccagaatgttgcaggcaaatcatttccccagaagctgtcattcgaagaagatatattcatgtaccctactggaatg

SEQ ID NO: 12584 - DNA, 806 bp, Pinus taeda
  Predicted polypeptide sequence is orthologous to G1672, G2802
attctttcacttatcctttatcagattcatttgtatttcacctgacagtgattccagttttttttccttactgggagcatctgatttttcatggttctatatgaaagctttggatttcaaattatttaggctaatacgtgtgttctattttgcaatccagcttctaattcttttattctttaaaatataaaaaattataaatgagtacatttagcaagggtttccatttttctaaacctcaactcttgtgagctagctccactctgtgtttgggacgagcagcagcataaaatggtttgttaatggcgggaaagaatagaaactccacagggagttctcagttgattgatgccaaacttgaagagtatcgaattaaacaatgtcctgcatgtggtcatcaaattgaacgccaggaggctcttcaagattggcctgggcttccttgtggagtaaaatttgaccctacagatcaggagcttatagaacatctacaaggaaaggttggcttagataattccgcccctcatcctttgattgacgagttcattccaacaattggaggggaagatgggatctgttattcacatccagaaaaacttccaggaacatctcgtgatggcatgatatttctactaagactgagtttatcttttggttacaggaatatctcgtgatggcctgataaggcattttttccaccgaccttcgaaagcatacacgacaggcaccagaaaaaggagaaagatacaaacagcctgcgatgagagcagtgaaggcgaaacaagatggcacaagactggtaaacc

SEQ ID NO: 12585 - DNA, 650 bp, Pinus taeda
  misc_feature (544)..(546): n is a, c, g, or t
  misc_feature (548)..(548): n is a, c, g, or t
  misc_feature (550)..(550): n is a, c, g, or t
  misc_feature (553)..(554): n is a, c, g, or t
  misc_feature (557)..(557): n is a, c, g, or t
  misc_feature (559)..(559): n is a, c, g, or t
  misc_feature (612)..(613): n is a, c, g, or t
  misc_feature (627)..(628): n is a, c, g, or t
  misc_feature (635)..(636): n is a, c, g, or t
  misc_feature (638)..(641): n is a, c, g, or t
  misc_feature (643)..(649): n is a, c, g, or t
  Predicted polypeptide sequence is orthologous to G1743
gggaacccctctgcattatatcactcttcctaaatttctgctgcatgctgcctttttaattggatatgtagggcgctcgatctaccgtgttctagggattttcaaggaaactgttgaagttgtctggccagatgaagatgcaatgtcaagccctcattttatggctgaggaggatcagaaccaagtgctgcgcctggaaacgtttggtgtgatacaaaaggaactgggagatgagcttaaaaacgatgacgccatctgtgctgtttgcttgaacgagtttgcgatagatgagaaggtactgctgctcattaattgttgtcatgtttatcatgaaatttgtttgaggaaatggcttgatgtccaacagaagagctgtcctctctgtagatctcctttaaccacagcagattgaaagaaagaaagaaaagagagtcctatgtttgtgttggccatatacagttttactccattttcagattaggttaagaaattacttgagctgggagaagtttgatttctattattccgggactggtatttctcnnnantntcnnacntngaagtcccccaaactgacacttatcagcgcacatctaaaagattctcatatannaataaacagtttcnnggacttnntnnnntnnnnnnna

SEQ ID NO: 12586 - DNA, 655 bp, Pinus taeda
  Predicted polypeptide sequence is orthologous to G1743
attgatccggagtgcctatgttcagaagagcctttatttccgccatgggatttccagttgggtgttcacagatcattattccgaagctgctccttaacgttgtctatgttttgatatgtattacaagtgcgttttattgcttccttcggttcctggggttcagtgagtttctcgaacccgggacctcccggccagatgaaacgaaccaagggttgaagtccgtgagctcttccgtatctgcgcagcggattcgtgagcggttaccggttgttcggtccggcgttttagcagaagcgtccggcgatgaagattttatgtgtgctgtttgcttaaataacatggagagacatgaggagatacgaaggctaacgaattgcagtcatatctttcacagagagtgtgtggacaaatggcttgatcatggccagaacgcttgtccactttgtaggtcgcccttcctttcagacgatattggaacataactggaagaagaaccgaagatgctagatcagggttcgaatctctttggcaatttctcagcaattagtatcgtcttcagagtagagatttcactcccactgtaattattatgtaaacacaaaggcattaatagactggactttgaaatttgaattaaaaaaaaaaaaaaaaaaaa

SEQ ID NO: 12587 - DNA, 715 bp, Pinus taeda
  Predicted polypeptide sequence is orthologous to G1743
aattatgtgacttcaacttgcatgccttgtctaaaaaaatcatatatttttcggcaactgggtctccttgactctgctctattcgtccttgcagcgctataaatcgctggctttggttgcaacagccacggttgtggtgcctcctttgaatttctaggcaaaaattcactgatttcaacattttgtttcactgattgaggccttgccttgcttttccttgcaccatgggatttcctgttggatattcagaactcctcgtccctaggctggtccttaatgtagcctatctgttgggatctatcagaagcaccgtctgctggcttcttcatcttgtgggtcttggagagtttctcgaaactgagacctcctactgggaagatcaaaccaatccatggttcgacgcgaactcttcagtttctgcacagaagattcgtgacctgttgccggttgtagagttcggtgttttggcagaaggagcagaggatggcgatgttatgtgcgcggtctgcttaaacaacatggaaaaatttgaagaaatccgaaggctgacaaattgcagacatatctttcacagaggttgtttggacaaatggcttgatcatgaccagaggacttgtcctctctgtaggtctcctttgcttccagacgagattgaaagagaaataaatgtggaactcagaacgttagaccccggttcgaatctctttacggatgc

SEQ ID NO: 12588 - DNA, 872 bp, Pinus taeda
  Predicted polypeptide sequence is orthologous to G1743
gacatttacgtaatgggattcccggcagaatattcaggatttattatctccaaaatactattcaatgcagtttttttgctgtcaacaatcagaaatggcatatgttggttcctcagatctatagggttggctgatttactggagtccgacgtgacatgggctgatctgccagaaaattcagtggatgctgcttccagcgtttctgcagagatgatcagaaagtgccttcctgttatagaatatagcatgttagcagacagatttggggaatctgatgccgttacttgtgccgtttgtctcaacgagtttgagaactcagatgagattcgccaattgacgaactgctgccacatctttcacaagaattgcttggacaaatggcttgaacacgaccagaaaacttgccctctgtgcagatcttgtttaatgtcggaggttgttgaggaggaggtaacggaagagtcctgggctgtggaacggttgttatacttgtttggggaggacttagtgtttcaatcatagcattcagtctttaataaacacactcatttggtcatttttactgtaaaagagttaaaagctagttatggcatagctaggtcgcagaaaaatttgactagtatggccattttaactgtaaatacatcatagactctggtagttgtatatacacatcaggtatatgtagcatccgggccggggaatggggattggtgttaaatatggtgcctttttgaggcttggggttcataatggactgcaagttttggcaccatagaggaatatgtttaaggtttagtgtagggatcacgctgttttacactagcatctgtaatattgtactttgggagaaatttcaacacatgtaaatg

SEQ ID NO: 12589 - DNA, 755 bp, Pinus taeda
  misc_feature (612)..(616): n is a, c, g, or t
  misc_feature (650)..(652): n is a, c, g, or t
  misc_feature (666)..(666): n is a, c, g, or t
  misc_feature (685)..(686): n is a, c, g, or t
  misc_feature (690)..(693): n is a, c, g, or t
  misc_feature (701)..(704): n is a, c, g, or t
  misc_feature (721)..(721): n is a, c, g, or t
  misc_feature (723)..(723): n is a, c, g, or t
  misc_feature (726)..(730): n is a, c, g, or t
  misc_feature (749)..(751): n is a, c, g, or t
  Predicted polypeptide sequence is orthologous to G1749
aaatcctcctccagttgcttgatgagcctcatcattaggtaattatatgggccttaattggcattatttcacctcctagcttagtcaaaccaactattctcacaacttattgcatacttttgattatattttgtttatgagatgagttagagttggatatgtttctttgtggtctaatttgcatgtattgcaggattaaaggataaaagcaagtaaaaatgcatgaataaacaaataaagggtaaaagcaaggaactatggcaaagaccttggtaaaatcttgaatgggacaagggatagtatttataggaggtaaatcctcctcatttactacccctccattcgaatattcctccatcagctcggagtgcaaacaaccatcactttgaagactagaagacaaccaagcaagtgaatgtgacaggaaccagtttatcttgagtggggaccctagcctccataattggatggaagtcattggagacttcaaatgtataaatagagaggcttgggaccttagtaggattcatactttcattgtaaaactctaatttatttatgagctacaagacttgtgacagtctgttctgtaatccatggttttcataatgnnnnngagttatgttttaagccatctctaagttaactcnnnaggctgaatctctngggttagggcccaactcgnncagnnnnatctcctnnnnactgtacatgtatgctngnatnnnnncttggttttcattgttcannngctt

SEQ ID NO: 12590 - DNA, 789 bp, Pinus taeda
  Predicted polypeptide sequence is orthologous to G1752, G2512
ctccccctggttccgtgactactggctccgtgaatgccatgtagacaatgccgatggcctcagcgacatgttccccgaacttcctgacgacatcgacgaattcgccgaacttgaactccagctagaagaaaccgtccttcgaggccttcctgaaattgaagagggtgatcagcagaatgaagaaaacaggggaaaatatttcacagagaagaatgaaggtaatcgagcaacgggactttaaccagtttggtatggaatgtttttgtattgctaatgctgttatggtcctgactgattggttttcaatttccatcaggtaatgaacctaaagaaccgaacgcgaaattagccgcagaaaggacactgggcctgaagaacagtgctcatcggcaggaacctcaaagttataattagtattttggatgagggtttggttctatgtacaaggactggagatttgatcacttcatttgtctactctactccaagtagaacaattgtgacgttgttgctggttcctcagcgtcgttgttttgttgtgagacactgtacttttcttcttgttacagttgcagaaaattggatgcatgtgaccgaggaggggagtatagattcagcattcgatgtttatattcaattgtaaagctcagtggaatgtgggttggttatagaatattggggaggatgatgataatgactgtattcatatatgtttgaaaatggtaaatttaagaggatggtaaaaaataattttgcaaattataactttatgatatggtataaatttgt

SEQ ID NO: 12591 - DNA, 819 bp, Pinus taeda
  Predicted polypeptide sequence is orthologous to G1752, G2512
gaaaggccctggggaaaatacgcggcggagatccgagattccacgaggcacggagttcgagtctggttggggacttttgaaacgggcgaggaggcggccatggcttatgatcaggctgccttcgccatgagaggctccaacgcgattctcaatttcccccttgaagttgtttgcggctccttcaagcgccgccaggtccttcctgcttccagcgtcaaattctccggcggtacctctgaaatttcctccggcgtgaccacctccagtacgcagctttccgactgccacagccggatccagccgctcgacgaatatcactccagcacagccacctcggcgcctgcgaggcccgctgctgttaggcttgattcatgcagaaaaagacgccggctggccccacctccggcagataggttggcaaccaatatatctgatgaaagccacagcgtcgataaatctagcggagtgttactaatggcggagccaaagcgtgaggaaacgcagtcaatattggagttggaggctctggatgtggattacttggaggagcttctgctgtcctcgcaagaagatgctgctaccgcatttgaattttgatatttgtttctccaattccgtgtttcatctgatgtactgtttctgcatattgttatagtcatctgtagataactgagctgggattctcggaccaaagggccaattttcttggtaacggcatcaattctaaatgtaatataatgaattttcatttattttgtgattactttcgcacggagatataagtaattttaattatttggctgatagtttattaattta

SEQ ID NO: 12592 - DNA, 802 bp, Pinus taeda
  misc_feature (745)..(745): n is a, c, g, or t
  Predicted polypeptide sequence is orthologous to G1767
ctgctgaaaaacatactcatttgattccacaagaaaaatgatcttgaaattccaggaatcaagcccatggacaacctttggtcatgttgctgccaatggagcaatcctggagtcctttgagggagaaatgaagctgcacatagttgacctgagcaacactttttgcacacagtggcctactttgttagaggccttggccaccagaagtgatgacacccctcatcttaggttgactactgtggtcaccagcaaggaagccacagccatgaaggtcatgaaggaaatagggcaaagaatggagaaatttgcacggctcatgggggttccatttgaattcagtgttattcatcaacaccatctccacaagctcaacgttggtgcccttaaaatcagaccagatgaagctctggccatcaactgcatccacagcctgcaacgtgttaacaagaatggaagggattccatattgtccacgttctacagcatgaaccccaagatagttactgttgtagaggacgaagtagacctgactcatgaagattttggtgattgttttagtgaatgccttcgttttttttccttgttttttgattctctagaggagagcttctccagaaccagcaacgagagattaatgcttgaaagaaccagtgcaaggagcattgtgaacatattggcctgtgaggattctgaagtttatgagcgcagggaaaagggtgcacagtgggcttggaggctcaaggangcaggatttatacatgctgcattcagtgatgatgttgttgatgatgttagggctctt

SEQ ID NO: 12593 - DNA, 606 bp, Pinus taeda
  misc_feature (394)..(395): n is a, c, g, or t
  misc_feature (400)..(402): n is a, c, g, or t
  misc_feature (404)..(404): n is a, c, g, or t
  misc_feature (472)..(473): n is a, c, g, or t
  misc_feature (495)..(496): n is a, c, g, or t
  misc_feature (542)..(542): n is a, c, g, or t
  misc_feature (544)..(547): n is a, c, g, or t
  misc_feature (564)..(566): n is a, c, g, or t
  misc_feature (569)..(571): n is a, c, g, or t
  misc_feature (588)..(590): n is a, c, g, or t
  Predicted polypeptide sequence is orthologous to G1781
attttccgctgtttccaatccatctgcaagcatattgccaccatcagtaggtcaacaaccatttgatggaaggaagagtgaacttattcaaaatagttccatcaactcagatgatataccctctgctaccacattgggattgggtgataattgtcagccatgcattcttcatgtgaaaccattcagacacatagcgggaagttcatcatttagtccaaggttagattcatctcgacttctgaatgggcaagctaagcaaaaagatcaggaaaaacctggtgtcagtcccattcgaagtcggatattgaacgatgactttgagtctgggaaatctttgcacgagaatgaatcttctgagcaacattattttccgtcaaattacacaccctcgcannaagannntnatgtggagaaagatgttgcttatagaattcaatcaaagggtttattctcagattcgtctactgagacnnggggacttgaagtattaattannacacagaatggaagtggaagttctaaacaaaatggacattccattncnnnngctgtttcacttgtgannnatnnngaacaggggagccttgnnnatggtgttcatatacg

SEQ ID NO: 12594 - DNA, 864 bp, Pinus taeda
  Predicted polypeptide sequence is orthologous to G1781
aggatgattacagcatgagaatagaggccagcaataaaaatacttacatccatatatcattacatatggacttaacctatccaacaaagttactcactaacttaggacaaaactgaccttaaagctgctgcttcaatatacaagggccaccaacaataagatttttgatgatcatcttatgaattctaggtatgtttagaagattaaaacagaaggaaagactaaaagaaaaatcagcaggctttgattattattagattgatcagatcactttataatacctagaagggacggcgaccatgtcctgttgctgctgggtctgcccccgaaggtcccctgccatgcataggcataggcaagggcatcttgtaagtcattaccattgggcggttgtgggcactaggattacatgcctgatattgcaggtccggctgaggttgatctacttgaagctgcttgctcatggaaagtttctcgccctccagttctctatacttgtccagataaaccttgaggggctcagcgtagacttcgaatccgagagtggtcatggcccatagtatgtcatcgccgttgatggtcttgcgcttttccttgtgacacttgtcggatgcttctccagtaacaaagctaatgaactcggagacgcattcttgcatgatttccttggcctccttggagatcttggcgttggttgggagggttttcttcatgatgcgccccacattggctatgggaagcagccggtcttgctctcgtatgatggattgtgaggaagaagaagatccattattgtggatgccggtagactctatgtcagaatgagggctgctctctccaccactgtggtctcccatttacgaa

SEQ ID NO: 12595 - DNA, 897 bp, Pinus taeda
  Predicted polypeptide sequence is orthologous to G1793
accgcacgcagaaaatcgagattggcgactgaaaagtctgggaaaccttcatggatgcatggattcggaatcagatgtgcaatcagagcagatgatgaagtcggacctgtcgatactagccgggggcgggggtagcagtgagcagatgtctgcatccattgggcggcacaacaacgtggagcagcaagaagggccaaagctggaggattttcttggtggcgcttctctgggaggacactataacgacgcgagaaccgattcaatctacagaaacgcggacgccttcgatgacaagatgatggtgtcagggttgcgggatgttgtgccaaattgcttgaacgctttcgatgtcaccgactctgaattatcgtcgggctccaagaaaactgatcagaaccaggatcctgcagcgaggaatatgaacccaatccagaacaccctcgtacaggattcatatgatgaaaactcgaacgatcaatatatgttccaggattgcagcctccagcttcctcagaattccggggcaaacaacatgattggtttgtcgatgatcaagacatggctgaggagccaaccatgcccagaaaacaagatgaatgcggctcccaattcaactaccccgacctcagctaaagatcagtcccttggcaacctaacaaatttacaatctttatctctctccatgagcccgggctctcagtccagctcaccgttggctcttcctgcgcaataccagaatacaaacgctgacagccattcctccgaaagtaagaaacgctctttagatcagaagcaaggcattgttgtagaagctaccccaagaaaatccattgatacgtttggccagcgcacttcaatctatcgcggtgtcaccagacatagatggactggaaggta

SEQ ID NO: 12596 - DNA, 986 bp, Pinus taeda
  Predicted polypeptide sequence is orthologous to G1794
tcagatcaaggcggaggaggacgagcgatgcgaggggatcgggatcgtgaaattaaggaagaaaaagaaggcggtgatcagcagaattcgtatttcaatccccacggtgcgcctgcacaagctgagatgtccgccatggtttctgcactttcgcaagttgtggctgggcgcggtggagctgcgccacaggaatggccactaccgcagtccaccacgacaggggtgaaggaatggccactaccccaatcgaccgcgacaggggtgaagagggagagagaaaaagaaaatgagagtggtgagatgttaggagaaatggggcgggggcaatattatagtgatcccagatttcatgcttctgaattcatgcaaggatccattatttcccgtccgcggcttttccaccagcaggaatccattaagccgccgcagctaggaatgtggcaaacaattcaaccttctgctcaagccgccgccactttgcgccctccgccgccgccagcgggttcatcatcagaagaaacgcaaacggagctgagcacaggcgaagccgtagtgtcggtggagcgtcggcggcggtacagaggcgtaaggcagaggccatggggtaaatgggcggcagaaattcgagacccgcacaaagcagctcgcgtttggctggggactttcgatacggccgaggacgccgccagagcttacgacgaggcggccttgagattcaggggaagtcgagccaagttgaattttccagaggaagcccaactaattcttcgtccgcctccggctcataacaatccaccgccgccattacatgctactcaaaatctgccgccgacgacgacgacgccgccgtcacgatttggcggcggcggaggagccggaccaatgttgccattgcagcagatacccccattcaggatattttccagtggagtactacgaatatgctcgattggtgcagactccggagccctgaacgatgcctgaac

SEQ ID NO: 12597 - DNA, 843 bp, Pinus taeda
  Predicted polypeptide sequence is orthologous to G1796
gatccgtaacttcgggaaaaggattggctctgagggctgggcatagagactcctacgtgaagtttcaagctgtcttactggctgcgggcaactgtggacggtaggactggcgagattcggatcgtgggagatcctctatgcaatcaacagctaactcagaactgaagcggacaaggggaatccgactgtttaataaaaacaaagcattgtgatggcctgaaaaggtgttgacacaatgtgatttctgcccagtgctttgaatgtcaaagtgaagaaattcaaccaagcgcaggtaaacggcgggagtaactatgactctcttaaggtagccaaatgcctcgtcatctaattagtgacgcgcatgaatggatcaatgagattcccactgtccctatctactatctagcgaacccacagccaagggaacgggcttggaataatcagcggggaaagaagaccctgttgagcttgactctagtccgactttgtgaaatgacttatgaggtatagcctaagtgggagcgtgagcgaccctgtaaaaccactactcgttttgccattttacttattccgtgaggtagagtccagggtttacctggttctagacttaaggttgggttttatatccgactgatctaagcggaagacatagtcaggtggggagtttggctggggcggcatacctgttaaacgataacgcaggtgtcctatggtgagctcaaagagaacagaaatctcttgtagaccaaaaggggaaaagctcacttgattttgatttccagtacgaatacaaaccgtgaaagcgtggcctatcgatcctttaactttaaaagttttaagcta

SEQ ID NO: 12598 - DNA, 819 bp, Pinus taeda
  Predicted polypeptide sequence is orthologous to G1804
cttcctaaggcagaggcaattgtacccaagcaggcccagtttctcctatctgctgcaccaccggtggctcaggaatttgctaaaatcgcagttaatatcatacttaaaggtgatgtggctgctagaggatatgcaaaagcagccagtgcattgcaaataacagtagatgcagtggatcagggagtgaaaatgctccgtgacatcttcataagatcagctcaatccaatttgtcagctgtccagatgactgaatttcttaaagatcttgggttccatagtgagacaagagaatgcttggtagattactgcagtcaacgattcggggaaataaggggtctggttgcagttccaagacttaatgtgtcatcatatagaaagctggaatggcggcttgatgtgcagcttggtagcagaagtctgtttcaccagacagaaccatccttccttctgaagctttcattaaatcgagaacatgtgggaggagtgccatcatttggaggtaaacaaagccagtccaaagcactaaacaacgaaagaactgaaaaaaaagttatctatttggaagcaaactatgcaactctgaagacaatctcctcccagttagaacaggctctggctgagcgcaggagcaggcgtagccgcggaatactacagcaattgcagtaaagatctggacaattttctcctttcttgtctccagctgtagttgtatttggtcctttgtgttggcctacatgccatgcaaaaggaaaattgtttttttcattaatgcaaattatccatggggatatcatgcttttccacccgaagaggccagat

SEQ ID NO: 12599 - DNA, 861 bp, Pinus taeda
  Predicted polypeptide sequence is orthologous to G1841
tcatatcctgtgatggtaattgatggttgctgttgttgctgctgctgcatataattactgcacattggtaatcccgcacctgcatagttcgatgaagctaaattgggcctccctgtaatttgcagttgtgaaatataatctaatcccggctggttttggattgatgtgatagaaggcagctgttggttataaacttctgattcctgctgatatttcatagatgctaaatactgctggagtaaggtagggtgagaattagcctgttggacatcaaatatttgatcttgcagtagttgggcatagtgatatacatctgaaacttgtgataagcatgtcgaatcagctgtgatgaaatgctgagaagggtgcccatggtggactgcgtcgcagtgggccggtcgtgccggcgccgacaaattgacatatgtcggcgcagatggccagtaggttgcgggtgcaacttgaacactgaagtcgctgattgccgcgttttcctcgttcacgatgttcacaccaggattatcctcatcacggatgttgactctttctggaaaattcaatttggcccttacccctcgaaactttaaagcagcgtcgtcgtatgctctcgctgcaccttccgcagtgtcaaaggtgcccagccatactcgagctgctttctttggatctcgaatctcagcggcccatttgccccacggtctttgccttacccctctataacgtttattttttgttggattctgtggctgttggatttcatccttcaacttcgacctcaagtcatcttcccgaatactttgctggtgttcgagatgcgtgactgagctcgattcttctggagataatgtaatttattgacca

SEQ ID NO: 12600 - DNA, 824 bp, Pinus taeda
  Predicted polypeptide sequence is orthologous to G1841
gggcctggaatatctgttccatgaagtagaaatgcctagcctcgaatgtttgttccatgaagttgaagagcaagaggtgcaaccgatgatagatgaaatgtccgcccttgaatgtctgttccgggaagttgaagagcaggacgggcaacaacatttgggttatagcaatttgtccactatggctgtttctgaatcatggttgcaccaccccaccagatatccagtccaggagaagatatagacgggtggctttaggacggcggctcttagcactgacgcctgcaatggttcagtgagtgctcatgctgtagagagaaactcaaacgaagacacaacgttgggctttggcggcggaattggggcggcgcaaggatcgcttatctcggactctggcctgcccacatacgaaaaccaacaggttcctgcattattaccagaagacatagttagttatggatatcaatccaaaggagataagcagaagatgagcatagacagagctactgccaagtcgagcaaacattatagaggagtcagaatgagggcttggggtaagtgggtagcagagattagtgatccaatcacgagggcaaaggtgtggctgggcacctttgatacagcagagaacgcggcacgagcttacgatgagactgcttacaggttcagagggttgaaagcaaacctatatttcccaaacgaactgcgtcacagcaatggaaatgctcaccaccctcaccgccatggatatcaatccaaaggagctaagcagaaggttagcatagacagagctactgccaagtcgagcaaacgcaatcgaggagtca

SEQ ID NO: 12601 - DNA, 757 bp, Pinus taeda
  Predicted polypeptide sequence is orthologous to G1852
caagtgtacgcaatgttatggatatgaatgcaggttttggtggctttgcagcagcacttattgcagatcctgtctggatcatgaacgttgttcctacttatacaacaaatactcttgctgtgatttatgacagaggccttattggagtttatcatgactggtgtgaggcctttttttcttaccctcgaacatatgattttattcatgcaattagcattgattctttaataagagatctgagtagaggtggaaacagatgtagtcttgttgatttgatgattgaaatggatagaattttccggcctgaaggaactgttgttgtccgggatactcctaaggtcattgatagggttgcaaagattgcaagtgcaatacgttggagtacagaagtttatgacactgagccagagtccaatcgcaaagagaaattgctagtggccaccaagcagttttggactctttcctctatttcagggtgactggccctttcatcatgtttttttttttaacaacttccaaagaggacttcagcagtttgctcgcatgcagattgattgaaatgaacaattttttagggacatgcctgtaatatgcaacccagatcactttggaaggatggccttggggccaagccttggagttggatccctgtttttgtaatttggtcctccttagtatgtggtattttatgtaacatttcaaactggtgcccatgcctctttgggcagcaatgtcatcaatcaatattgcttttgtc

SEQ ID NO: 12602 - DNA, 865 bp, Pinus taeda
  Predicted polypeptide sequence is orthologous to G1852
cggccgggggatttggacagtgagaggtgggtttgtgatgtgaccgcaccctaattccagtgatgtaaatgcacgatgatactgtaacgcgtctagtctagtctacatagtggagaagtgaatgtgaaggaagatacaaatcaggaagaagagggaaatgatgggtcatataagcgtgccatcgaagcggctggttcggccatggaagctgctggatttggtttcaggcttgctgttcttggcagtcttcgtatttttcctttgcgtatttactccactgggagattcgttagctgcatcggggagacaagcattggtgctgagcgggggaagggacagagatggagatccccagcacagagaacgctttctcagagtggttgaatcaggggaggcagcagtggaggcctaccccctggaatccgtcgattactgtccttgcgaagatccacgacggagtagccatttcaccagagaaagaaatgtttacagagagaggcactgccctcctcaagatcaaaatctcctctgcctcattccaccacctctcgactacaaaattcctctgccatggcctgaaagtctccacaagatatggcatagcaatatgccccataacaagattgcagatcggaaagggcatcaaggctggatgaaggcagaaggaccttacttcatatttccaggtggtggcaccatgtttcccgatggagcaatacaatacattcagaagctgaaacaatatttacctataagtggtggaaccatcaggacagctttggatgttggctgtggggttgccagctttggaggatacctgcttaaggaagatatattaaccatgtcctttgctccccgggattca

SEQ ID NO: 12603 - DNA, 888 bp, Pinus taeda
  Predicted polypeptide sequence is orthologous to G1855
taaaaatgataaccctgatgatgcttggtatagaaaaatggaaacctgcataacaccacttccagaggtcagtgatatcgatgcagttgcaggaggagccttagaaaagtggccgaagcgtgtaacagctgttcctccccgaataagcagtggcagtattcctggaattactgctaaaaaattcaatgaagattctaaactatggaatgacagggtagcaaactacaagaggcttataggacaactgggtcaaggaagataccgcaatatcatggacatgaacgctggtctaggaggctttgctgctgccttagtcaatgatcctgtgtgggttatgaacgttgtgccatcagatgctaaacataacactcttggtgtcatctatgagcgaggattaattggaacttatcagaactggtgtgaggccttttcaacataccctcggacctatgacttaattcatgctgccggtctcgtgagcatgtaccaggacaggtgtgatttaagcgacattcttctggaaatggaccgcatcctccgccccgaagggactgtgatcttcagggatactgttgatgttttggtgaaagtggagcacttgattggtggcatgagatggcgaagtcagatgatggatcatgagagtggtccctttaaccaagagaaaatccttattgcagttaagcaatattggactggaaaagcagaagatagaagctcctaaagcagggccatgttttctttttgtgttttatgttgtattcattggttttgggttttgagaggattataaggggttgctctctattctcaacttgtacaacaattcaaatttgcctggcaagggtgaattggttttgtttttaagacggtgtttcttatcaagaa

SEQ ID NO: 12604 - DNA, 759 bp, Pinus taeda
  Predicted polypeptide sequence is orthologous to G1855
cggccgggagaaaagcaggagttattgaaatgccttatacctgctccgccaggctataagaatccattttcatggcccaaaagtcgagatttcgcctggttttccaatgtaccacacagagaactcagtgtagagaaggctgtgcagaattggattcaagttgatggagataaatttcacttccccggtggtggaaccatgtttcctcatggtgcagatgcttatattgaaaatatcaataaactgcttcctttgactaatggatcaatcaggactgccattgacactggctgtggggtcgccagctggggtgcttacttgttgaataggaatatcttatccatgtcctttgcaccacgggattcacatgaggcacaggtgcagtttgctttagagcgtggtgttccagctatgattgggatcatggcatctcgccggcttccatacccagcaagggcttttgatatggctcattgttcgaggtgtctgattccatggaataaatatgatggtatcttcttgatggaagttgatcggatcttgaggcctggtggttactggattttatctgggcctcctataaattggaaaaaacaccataatggctggcagcgaacaactgaggacttgaagcaagaacaagatgaaattgaggatattgccaagcgtttgtgctggaaaaaggttgttgaaagggatgaccttgcaatatggcaaaagcccacaaatcatcttaactgtaataaaataaaagcgaga

SEQ ID NO: 12605 - DNA, 843 bp, Pinus taeda
  Predicted polypeptide sequence is orthologous to G1855
cggccggggatactcatgaccattttctgattcacggagatttatgagactcgtcgcatgagattactggaagctgtgctcgcaattcattggaggaatgattgtcaaggtgcccaagttgctatcaggctcagctgctaattcttcaagattcttgagattcagagcataagctcattgtaaacagtgattgcaattcgttggaggaaagattgccaaggcccgcttgctaattcctcgggatatatgagattcagagcatgagatcataaccagtgactgcgattcattcaaggaaagaatgccaaggcctaccttctaattcttggagatttataagattcaaggaaatattgcgaaggtgtccaattttttagcagattcaaagcacaagatcactataatcgttaattgcaattcactcaaagaaagatttctaaggtgccgaagttgggattaggcaagatggtgaaggactacagcgcaacaaacagattttatcagttttattctcagaaacgaagtgttatgcagatcattgcgttacttgtgctgtgctcttttttctacattctaggaatatggcagaacacttattcgacacccataatccccgccggactggattgttctaaatacaagatagcgatatcctcatcttcatctgtttccttagattttgaggcccatcatatgctgggagtggatgatatttcaaattcaaatataagtttcgcaccatgtgatatgaagtacagtgagtatactccatgtgaagatcctgtgagtctcccaaatatgacagagaaatgctcaaatacgagagcgtcattgcccagaaaa

SEQ ID NO: 12606 - DNA, 777 bp, Pinus taeda
  Predicted polypeptide sequence is orthologous to G1855
cggccgggggaaaaaggttgttgaaagggatgaccttgcaatatggcaaaagcccacaaatcatcttaactgtaataaaataaaagcgagagtcttcaaggttccaccaatttgtgaagatggaaaccctgattctgcttggtacaagaattcggagacttgcataacccctcttccacaggtcaaggatattagagatattgcaggaggggctctggaaaaatggccacaaaggctaacatctgttcctcccagaataagcagtggaggtatcccggggattacagctgaaaattttactcaggatacagagctttggaaagctagagtgtcatactatggaagtatgataggtgatcttaagaaaggaagataccgcaacatcatggacatgaatgcttatctgggtggtttcgctgctgcctttgtcaatgaccctgtttgggttatgaatgtggtgccatcagatggtaaacacaacacactcggtgtcatatatgagcggggattgataggaacatatcagaattggtgtgaagcattttcaacatatccccggacatatgacttaattcatgccaatgaagttataagcatgtaccaaaacagatgtgatattactgacattctgcttgagatggaccgcatcctccgcccagaaggaatagtgatcttcagagatgatgtggatgctctggtgaaagtgaaacatatagttgatgggatgagatggaaaagtcagcttgcaaatcatgaggctggtccccttaataggca

SEQ ID NO: 12607 - DNA, 556 bp, Pinus taeda
  misc_feature (11)..(11): n is a, c, g, or t
  misc_feature (498)..(498): n is a, c, g, or t
  Predicted polypeptide sequence is orthologous to G1868
aggcaagcagnctcttatttatggattccctgatcagcagctttgctctgatttctcccttcttatacttgtttctaatagcagcagaggcatttgatggaggttcttgaatcttccctgtcacatgatctaggagatcatgatcttccaatttgagatctaatatcatcttccaggcatggaagtcatcacttccagtcagcttgtcattctccctgaattcaagactagtggaacccatttccttcgatgatgattgctatagatagagtttgtcttcacctcagctctgataccatgtaaagttttgtagatgttctatgctaagagcaatttcacttttctcacagcaatcatacaagtagttaagcaaaatgcagatagaacatataagcagatcttacagaagacaaatcagaaacaggaaaaagtgtgtgttcgtttcggcggtcaacaggatgcttcaaccagcaaagtctcctttggtcagccagcccngcatgtgtcacaacaaccctccaaccagtagatgagtcaacccaagtcaattctacaa

SEQ ID NO: 12608 - DNA, 983 bp, Pinus taeda
  Predicted polypeptide sequence is orthologous to G1868
caccaacccgaacacaaactcgttgctccaatataattcttcacaacttcgcaccattgggcaagaatttgggttaatgcctgaaatgaacctgcaacaggggcagcagcaacaacagcagcaatcttttctgagcaacggtttcggagtggttgaatcggtgcgtgatcagtcagccggtgggcaacctctgaggcatttcttcgatgactggccacgatccagagacccgtggtctgaaatggaggccgagcaacgatcccacccaacaaccacgcagctttctatttcgattccaatgacaagctccgattttgctggcacaaactccagttcccctagaggaaagttgtccctttcatccctgaaactctccatgtcaatgtcggcccgaggtgcagaggacgaccccacacagatggccctcggcgtgggcatggggcttggcctgatgaacgaagagaggcaacgccagagtaccaataattggattcctgtgtcctggcaaagccccatgggggggcctctggcagaagttctgcagtcgaccaccaatgcggccaacgctgctgttacctcacgtgggtgcaaaactcccgggggactgaatctgatgacagaggcctgggatttgagtcctcatggcagtccaagaatggcatccccaactggcgttttacagaaaacgctcgcttctttatcagacagcagtagtggaagcagtcccagagcagttgctgcagcagcagcagccgccaaacatgaccaaacaacactgcaacataatctgggaggactgtagtgtgttgggaatccattggggataatctgtcatagcagaatttcagttagtttgcatagaatctgctttgggttcctgtcgttgttgtcacgatgaatagtgtgtttatttttttctttctttctttctccatttttaacatttagcctttttaaatgcctgcagacaatccaaactcttc

SEQ ID NO: 12609 - DNA, 995 bp, Pinus taeda
  Predicted polypeptide sequence is orthologous to G1868
gcagaaacaatgaacagcgcaggcatgcacgcaattttagccggaactcggtctccgttcactccgtctcagtggcaggagctggaacaacaggcgttgatcttcaaatacatgatggctggggtaccagtgccaccggacctactgattcccctccggaggaacatcaatattttctccagtttaccggtcgctggatcgacccttcgttccaacttgggctggagctctttccatcttggttacgcggccaacaatgccgatccagagcccggcagatgccgccgaaccgatggtaagaaatggcgttgttccagggacgccgttccggaccaaaagtattgtgaacggcacatgaacagaggccgtcaccgttcaagaaagcctgtggaaggccagactcctcatcatcatcattccgccactgctcagtcctcctctaccagtggcgccgccaataattcttcatctgcatcgagtctggcagcagcagccgctcgcagcgctgttactgctactactgttactactactgctacaagtgctactgcgtcgtctacgtcctcgcagaccaatttactccgttcatcgatcagtacccatcagcagcagcagcaacagatcgggacgaagctctccgtgtttcctgcttcattgtccgccggtggtggtggtgtagcatctcctgccgcctccgtcagcccttttcaaatccctcttaacgtcgacaggtatctgaacgggatgaaaggagatatagaggggccaatgtttgaatcctcgtcccaatcaattaacggcctgtcaatgctttcgactatgaacaatgcatggggatccaggaacatggtaccggcgaagactacgagcaacaacggcatgatgagctacgagactcgaaccctgattgacgacggagggcaagatttcgggctcttgaaccagaaccagatgagtagtctcctgtccatgactcaaaaccagagcaacgactc

SEQ ID NO: 12610 - DNA, 915 bp, Pinus taeda
  Predicted polypeptide sequence is orthologous to G1868
caataccttcggacttcgattccccggggtctcctcgctgtgacaaactcatgctatcgccgctgaagctctcaatgtcccgcgacgcggatccgctgggaatcgatcccacgacccagatgggtttgggaatgggcatggggatgggaatgggtttggctaaccaaacaagtgaagtacaatgccgccaaaaacagaccaactggattccaattacgtgggaaagccctgtgggaggacccttagctgaggttctcaactcaaccaaggactgcaatgtgaaaaactcggctcttaatctcatgaccgatggttgggactgcagccctcgtgggggagacagctcgcgaatggcctcccccacgggtgttttgcagaaaaccttcgggtccctgtctgatagcagtactggaagtagcccccgtgcagttcatgtagccaaggctgctcatgactccgctggtctctgtgaaaatctccgaaccgtcacttttgttactggggcttcagctccgatttcaacgacttaatctttgctttcaggtattccaacaaaaaaagcaaaaaaaaaaagatcatatggttgtctgtgcgtgtctctcttctttcacaacaaatttgtgtgttttgcaactatcccatgggatcgaacgcgtgacattgtggtgtgggaattatattacagaagcgaaaatcaagtagaagccgaagcagcagtagcagaagaagaagtatctcatggagtaaactgtatgatcctgaattgactggatcaaaaggggtcatgtattatcatcaatcacttgctgataattaacacacaacgtcactgactcgcggacattattgtttaatgctttgattgagatgccggtctaaacttgcaatattatgccatggcttggaccatatatc

SEQ ID NO: 12611 - DNA, 825 bp, Pinus taeda
  Predicted polypeptide sequence is orthologous to G1868
ttcgaagcggccgcccgggcaggtacagttccagcccgcagctaaggactcttcttggccaaaacctcggcattgtgagcgagggaaaccaagttgccagtattcacatgaatccccatgagcagcagcatcaacgacagcaacattcatttctgagcaccgattacgggggagtgcagggagcgatgcgagagccggaagagcagcctctgcgtcatttcttcgatgagtggcccagatcaagaaatccatgggcgaccgacgtagaagaggaagcgtcgaaccgtagctcctcaacaacccagctctccatatcgattcctgtgccgtcctctaatttctcagcagcgaacaccagttcatctcctcgtcgcaaattatcgctcacctctctgaaattatctatgtctggggatggcagcgatccagtgggcgtggatcctatcgaaatgggtcttgcagtaggcatgaatatgaatgtagaagaacgtcgtcgacaaacccatggccaacaccaccaccaccatcatcatcaggccaactgggttcccacagcttggggaaaccccatgggtatagggggtcctttagcagaggttcttcagtcgttcactaccccaagtggatgcaacaacaacaacaagaagcagcctgggctaaatttaatgaatgatattggatggaaggacaacagcagcagcagcagcaacaagaacagtatggccagtagccattcaagagacagcccaccaagctgcatgcaaacatcatccccaacaggtgttttaccaaaaaacatttggttttgtttcaagcattaatagt

SEQ ID NO: 12612 - DNA, 784 bp, Pinus taeda
  Predicted polypeptide sequence is orthologous to G1893
gatttgattggtttgcattggattgcattatattggattgccttgccattaaactaagctgagcagagttgagagtgctaggtataaccagtccaggccatttcaatgcaaaagaacaggcccctagagatggagatgatgatgaactccagaggttaccaatattctcagagttccatggccgttccgccttcgatttcgttccatcgcctccctttaggtgaatggattaaccctcagtttgtaatggagccatctgttgctcagctgccctctgcaattcctttcctctatgaccatggcatagtttctctcaataaccaggccgagtctgtaaagtcatccctcctccattttccctgccaccctgctgctgctgcgtccatgattccaagaacctaccctgcggctgcagatccagaacttagagataatgaagatgaagaagaagatgatgaagaaccctttctgagcttgcggccacctggtcagacggaagcggccatcaagaataattgcgccagcagcagcagtcacccgtgctcctatgtcacagatcaggacgattccgatgacaatgtgaccgtggctctgcaaattgggctgccgaattcggagcttcgagagtgcagaagcgaaggtgccggagaatataacgacgcggtttccatgagtcccgacgatgggtgttttcaaacgggagaaaaattggcagagggccagtactggatccccacgcctgcgcagatcctcgtcggtcctacgcagttttcttgcgccgtct

SEQ ID NO: 12613 - DNA, 851 bp, Pinus taeda
  Predicted polypeptide sequence is orthologous to G1932
gatccccgctcccttttcactccttcgccgagctcagcatacgcttttcagttcgttctgctttgacgaaaggattccatggctcccagagatctggaaggcgatggcagtaagaaaagtgtaactgatggcaatggcaatgccaatgccccgaaggaaaaccattacattggcgtcagaaaacgtaaggggggccgttacggggctgagatacgagataccttcaggaaatgtcgcgtttggctgggcacctgggacaccccggaagaagcagcaaaggaatacgacagagctgccaaagttctgaaaagaccccatgccaagatcaatttcccctctcctgacaacctcacatgcggcgcgcagggccgaagcgccgcgctcgacaggtggacagccattcatcaagtatcgccctcagcaacaaccacaaacgttcctgtccctccgcgtattcccgcggatcgaaaccttaattttcaggagaaaatcaataataagttggtagccagaagcgtcaatcctgaaaaggagaagccctggtcacaccattacctgaatggtacagtgggaatgcagaaagtggggaatgaaagggtgagaactaataattgcaaccaaaaccctcaacgtaaccctacttcttccctcaatcttgtcgaataccgtgcggatattttgcagcggccacctgaggcggtgattttgttggggaggattgtggggactcagatcgacacacaccaaggccatgagcgggtaggggcagcctgggggccgaagaatctacttcatgcaacctcttattgtgattctttttccacctccagagcggtagacacccaacttct

SEQ ID NO: 12614 - DNA, 772 bp, Pinus taeda
  Predicted polypeptide sequence is orthologous to G1932
gcccgctaccttctcactccttcgttgagctcagcatccgcttttcagttcgtcctgctttgacgaaaggattccatggctcccagagatatggaaggcgatggcagtatgaaaagtgtaactaatggcaatgctaatgccaatgccaatgccccaaacgaaaaccattacattggcgtcagaaaacgcaagtcgggccgttactcggctgagatacgagatcccctcaggaaatgtcgcgtttggctgggcacctgggacaccgccgaagaagcagcacgggaatatgaccgagccgccaaagttctgaaaataccccatgccaagatcaatttcccctctcccgacaacctcagatgcggcacgcagggccgaagcgccgcgctcgacaggtggacagccattcatcaattatcgccctcagccacaaccacaaacgttgccgtcccgccgcttattcccgcgtttcgaaagcaaaattttcacgcgaaaatcaataataagttggtagccagaagcgtcaatcctgaaaaggagaagcccttgacacacccttacctgaatgatagagttggaatgcagaaagtggggaatgaaagggtgagagctaataattgtggccaaaaccctcaacgtaaccctacttcttccctcaatgtggatattttgcggcagccacctgtggcggtgattttgttcgggaggattgtggggactcagatcgacacagatcaaggccatgagcgggtaggagcagcctcggggccgaaga

SEQ ID NO: 12615 - DNA, 837 bp, Pinus taeda
  Predicted polypeptide sequence is orthologous to G1932
ggctgccttctcactccttcgttgagctcagcctacgcttttcactgttttcagttcgtcctgttttgacgaaagaattccatggctcccagagatctggaaggcgatggcagtaagaaaagtgtaaaagatggcaatgccaatgccccaaaggaaatccattacattggcgtcaggaaacgtaagtggggccgttacgcggctgagatacgagatcccctcaggaaatgtagcgtttggctgggcacctgggacaccgccgatgaggcagcaagagaatatgacagagccgccaaagttctgaaagcaccaaatgccaagatcaacttcccctctcctaacaatctcagatgcagaacgcagagccgaagcgctgcgcacgacaactggacagccattcatcccgtatcgacctcagcgacaaccacaagcgttccggtccctccgtttattcctgaggtttggcatcttaatatttacaacaaaatcaataataaggttctaaccagaagcgtgaagcctgaaaagaagaagccctggacacacccttacctgaatgttggggcgggaatgcagaaagtgggcaatgaaaatgtgagaactaataattctaacgaaaatcctcactatagccctagtttttccatcaattttgtcgacagcggtgcggatcttctgcagcagccacctgtggcagtgactttgttcgggaggattgtggggactcagatcaacacacatcaaggccatgagttcgtaggagcagcctcagggccgaagaatctacttcatgcaacatcttattgtgatttttcttccacttccagagctgtagaa

SEQ ID NO: 12616 - DNA, 842 bp, Pinus taeda
  Predicted polypeptide sequence is orthologous to G1932
cggccgggggtctgtttgctttcttttattatgaagtgaagtgagtttttccatcccgtttccgccactcagacgtttgttctttcattgaactcacgtttgttcattcattattaatccatatgcggggaagatctccatggctcccagaaatagacaaggcgatgttaatcaagagagaggtaatgtcatttccgccaaggaagtccattacagaggcgtgagagaaaggccgtggggaaaatacgccgcagaaatcaaagaccccttcagtaaaaatcgcttgtggctgggcacatttgctacggccgaggaagcagccaaagaatatgacaaagccgcgagatatttgagaggaccaagaacgaaaactaactttcctgctcgccccgtcgaccttgtccacgaaataggccagagctgcaccacccaaaacagcagcgcaacactcgactcccggattccctcctccactgccaccaccgccggccttcctgcacctccactttccccacctgctcgattgtctattcatcgcaacaagaggttgtttcccagatgcgctgtcgctaaacaagagaaaccctggactcaccttttcattaatcgcgaagcggaaatggaggatcagagtatgagaaggattgctcctccttctcctcgcgagattcaacttcccaatccgatccgttgcgctcacctttgctctaaccctagtctttccctcgattttgttgagtacgctaccgatcttcttcagcatggcccaatgaagacacatttgttcggagagattctggagcctcagatgagcagacacaaaggtcatgagtcggtggaag

SEQ ID NO: 12617 - DNA, 876 bp, Pinus taeda
  Predicted polypeptide sequence is orthologous to G1932
cggccgggggctcccagcgatagagaaaacaatggcaatcgccaaagcgttccaactgaaaatgtgactgagaaagtgcattatataggggtaaggaaaaagttttggggacgttatggtgcagaaatcagaaaccatttgaagaaaagtcgtacctggttgggttcttacgataccgccgaagaagctgctaaagcgtacgaagctgcagctagatatcttaggggtcctttcgcaaaaacgcattttccggcaccaaccctaccaacccttgactcggcctttgaaatcagttgtcaggaccctagcagcatccaagacaacagcgcggctctagaatgccggactactgttgaggccctatccactcgtcttccagctcttcttgataagctgaccccccttgccgtctccactgatcttcacgctggtagtaggtccgctaatagagataaagtgaaggtggatatgggtaaacaagcgttgccctggacgcttgcttacatgaatgttgcagtgggaatggagggagtggtggatcccagcaagggctgtacgactagtgcatgcgcgcttcgcctccccaataccagtccctacccttgtcatacttcttatcagaccagtctgttggattgcgctgctattgtgaagcaaccgcgaatggagatgccgctactggcagagaatgtggtgtctaataatgggctgcgccaggggatggtgaataatttacctcctatagcttctgattgttgttacccctcctcctcgggggtaatagatgcgcaactttctcatcttcctggtgtgaaaaacacagggccaaatttcatagatttgaaccggcctcctcctgaggaagatgttccttat

SEQ ID NO: 12618 - DNA, 848 bp, Pinus taeda
  Predicted polypeptide sequence is orthologous to G1932
cggccgggggtttccgtcactcagacgtttgttcattcattattaatccatttgcgggggaagaccttcatggctcccagaaatagacaaggcgatgttaatcaatagagaggtaatgccatttccgccaaggaagtccattacagaggcgtgaggagaaaagggccttggggaaaatacgccgcagaaaacaaagatcccttcagtgaaaagggcacgttcaataccgcccaggaagcagtaagaagccgcgagatatttgagacgacccagaaccaaaactaactttcctgcctccgccgctgccggccttcctgcacctccactttccccatatgctcgattgtctattcacggcaacaacgacaagaggttgtttcccagatgcgctgtcgcttaacaagagaaaccctgactcaccttttcattagtcgctaagcggaaatggaaatggaggatcagagtatgagaaggattgctcctccttcgattcaacttccgaatccatttgcttgcgctcacttttgctgtaaccctagtccttacctcgattttgtggagtgcgctatcgatcctcttcagcagcggccgatggcgacaaagttgtttggggagattctggagcctcagatgaggagacacaaaggccatgagtcggtggaacagggcgtactgaaaaatgtaattcctgcaaaatgtatgtccgattcgtcttcctcctcgggtgtagtagacacgaagatatctcctcctgaaattgataacgggatgccactgatattcgatttggattttccgccacaacacagaagatgatgaagatgagaatcgcctctctcactctctat

SEQ ID NO: 12619 - DNA, 831 bp, Pinus taeda
  Predicted polypeptide sequence is orthologous to G1946
acgcgggggcggaaccaccaagtcattgcagaaaaaaaacacgactgagccggcgccccacagaaagggaaaaggaaacgaagggatcctcccggtcacgagatcgattcccccttctttttgtcgccttgtttgctctctggcgtcttcagatctgtttcggcctttggaagagcttctgaatgatgtaaattggaggtcctgttgccggcttagtccatgtattgatttgggttttttcacttttgggttttttcgatttctctggggttttagggtatggatggatctcagaacagcggcggcaatgcggtgcccccgtttctcaccaagacgtatgacatggtggacgacagctccacggacacgatagtttcatggagccccgggaataacagtttcattgtgtggaatcccccggaattcgcacgagacttgttacccaagtactttaagcacaacaatttctccagcttcgtcaggcagctcaatacatatggcttcaggaaagttgatccagatcaatgggaattcgcaaatgaagattttctccggggacaaaggaatttgttgaaaaatattcacagacgcaagcctatgcacagtcattctcagaatccccaacaaggcgtatgtaatgatgctataaaatatgaactggaggaggaaattcagaggctcaagagggataagggtctgctcatgatgggagcttgttagaattaggcagcaacatcaaggtaccgagatgcatatgcagaccttggaggagcgtttgcaagccatggaacaccgccacagcaaatgatgggcatttctggccaaagctgt

SEQ ID NO: 12620 - DNA, 827 bp, Pinus taeda
  Predicted polypeptide sequence is orthologous to G1950
ccagaattttcagtgtagtgcaaacaagggaaacctattgcgccatttttgttacgaggggagtgaagggtgccgacaacagtcaaaacgccgttctgagttgaacttgacaaacaggtcttcttttccagtgttttgaagaaagcaaagccatggcggaagacatggacgtggacacaaaagaagtaactggcatcgaggacgcggatctgttcagggctgcagagggtggagattcagggctattcgagaagctctcaaggaacgaggtggagcttaacagagtgagatcaatcaggaatgaggacgcgcgttctcttctccatgttgcagcggctgcaggccatcatcaggtcgttcgcatattagcaggtcttgatccatccgtaagcggtgtgaacaatggtgacgaggaagggtggactccactccattctgctgtgagcagtggacatgctaatgttgttgaagcattattgcaagcaggtgcagatgtttctgtggcaaacaatggtggtcgcacagctttgcattatgctgctagcaaagggcggcttaagattgctcaagttttaatctccaatggggccagcgtcaggcgaaaggacaagtttggttgcactccattgcatcgggcagcaagtgcagggcacccagaaatatgtgaactgttgatagaggaaggtgcagacattgatgccactgacaaaacaggtcaaacacctcttatgtatgcagtaatcagcaacgacaagcaggttgctttacttctagtaaggcatggtgcagatgtcgattgtgagacaatgaaggttatacagtccttg

SEQ ID NO: 12621 - DNA, 858 bp, Pinus taeda
  Predicted polypeptide sequence is orthologous to G1954
gaatctgtcatcaccagcagcttttggaaccagaaagctgcattacacatgtttctgaatcgtgttctccaattaagactgaagcctgcaaggaccattccagctccgagatattagaagagggtgttagctctgcggccctggatcccaattcctgcataactacaaattcctcgtcagaaaatggcacaggtgggggatttgtaacctcgtccatgatgccgagcagtactgctccttctcaattgagtaccaggatggaagttcgcgacagaaggaagaggaagcgctccaaggcctgcaagaacagtgaagaagtcgaaagccaacgcatgactcatattgcagtggaacgcaatcgccgaaagcaaatgaatgagcacctctctgttcttcgttctctcatgccaggatcctatattcaaagaggagatcaagcttctatcattggaggggccatcgatttcgttaaggagctagaacagctcttgcagtcgcttcaagcacagaaacgcaaacgagaatgcgaagaatttgggtgtagtcccaattctcctactcctttcaatggcttcttcctctctccacagtatacatcatactccgcacagtggaacgcgagatatggtatggaaaatacttcatttaatgatacgggcaacgaattgattgcagagaacaagtctgcagtggcagacatagaagtgactatgattgaaacacatgctagtattaaaatcctatcacaaaagaggacaggacagctaatgaaaaccattgaggcgcttcaaagtcttcacatgacgattctacacctaaatatcaccactatcgatcagactgttctctactctttca

SEQ ID NO: 12622 - DNA, 484 bp, Pinus taeda
  misc_feature (429)..(435): n is a, c, g, or t
  misc_feature (453)..(453): n is a, c, g, or t
  misc_feature (472)..(476): n is a, c, g, or t
  Predicted polypeptide sequence is orthologous to G1958
tgcgagtgaaatttctcgtccatgcaaagattataggaatgaggagctgaaagaccattaggtgttttggggcagaactcctgattatttgtggatagaacaaggtacaatcctactaaggattcacatcatccatggcggtgatatttggaggcccaacattccatacagttgcctcgttgacacaatatactaatagatgtctgcagtctagatgccatacgttgtcacttctgtcccggagtatcatgaagcacagatttcaaagtcacaaatatcttaaatatgggacaagtctggagcattatgcagtaaggccatgggcctcttctgatgaaaacggtgtcactgaaacacctcttaattcagactctgttagcaacaaaacaagtgacaagaaagccaaagctgaagcagagattaaaaaannnnnnngaacagccattttgactngggcaataacaattctatnnnnngttggata

SEQ ID NO: 12623 - DNA, 867 bp, Pinus taeda
  Predicted polypeptide sequence is orthologous to G1958
cattttgagtttagtctgtagagagatgtgcagtagcattaagttggttttcttcttcagaaaagataatggtcatagtatccaagatgagaggctgattcatgttgctttgaaaccagaaatagttcgagtggaaagcagagtgtgggaggtgacggctaggtagactgggagggagcgagctagtctgaggaggcagaggcagagcctcatggtgctcagcctgagagagagtgctgcccccacggtctcctcctctgcgactccgtatgcgatgttgaaccatcacgctatgccgaaggtgaagctcaagagaattgagggcttgtgtagaaatctgagagttagcagagggagcctgggtaaggttcaaagggtagaattgggaatggtaataatggaaaccattgccaaaggcaagacaacaaagcaggcagcaacgttttcctaccatagttttgtggagggattctgcctggagcgggcaaacactgataaatggagggcaagcgaaggtgttaatgggccccataaaggattgatctgtctggaatccgcggcaagagcgagcattaatgtagttttgcaagctggtctacgttcgcttgagatgataattcatgtaccaaggtctagcctgggaggaagcgttggccaccagctggctgggccgagcgccgacattccaacatccctacatgaatgcacagttaattcacctgcatcttggtatatattccatgtctattagaaaaccttctcataacacaatggaaagggattaccattccttttctcgagtagtaccattattttctagtattgtttctagttcactgaatttattatagtggttatctaattctt

SEQ ID NO: 12624 - DNA, 738 bp, Pinus taeda
  Predicted polypeptide sequence is orthologous to G1968
ctcaattttgctttcaattttgcttcctctttcattccttccccttcaagttactcattcgaatccggccaatccaatccattccattcaggggagacgtttcttatgaaattaagccggcgatttcgttaatttagctctagtccgtgaccatactgtgaattgcttcaactatcactacattggtttattgtttatactctctgtgtagaacgaaactcgctactgaaggttgtttgaagagtttaaagcatgacgaaagtggatatattgtaccccagctctcaagccatggacgtgttcaagaaacagggagcagagcacccgttgaactacatgtgcaagatttgcagtaagggattcgtctcaggaagagctcttggcggtcacatgagagtccacgcccccgcctccatcgctgcagacacacacaccgaaactgaatttcagaagagcaagggttccggggcttgggatcacaaattaatgcaggaaaaggagaaggatgaagagggattggatagtaatggaagtaatctaatgtatgatctgcgaagaaatcccaagcacagttggcggtttgaagatcaggactactcgggtctcttgggtcagaggttcgatcccaaacccattgattcttctataaattgtgatgtgtgtgggaagggattcagttcctgggaaggactgtttggtcacatgagttgtcactctgaacccatcaagatagtagtg

SEQ ID NO: 12625 - DNA, 742 bp, Pinus taeda
  Predicted polypeptide sequence is orthologous to G1983
tgggattcccatcttaacctgggaaaacaccaggaacatacagtactagccaaaacgaaacaaaacattacatggggttagttttatatgaattccatttgaaatgcatactcatgttacctgactacttgcagcgcgggagggtacaaggaggaaaggatggcctccattgccctcagcaccttctacacctgcaacaatcaccagttctgcagcgagaaggtacctatgagttgagaaagcggccaaatatttcagccagaaatgcaaatataatggcaagcagagcattggttacttttacccacaagagattggaatgtaacttctcggtgcagagaggcaaagaaagcaaacatcataaaaagcttttgaaggcagcaagaggcttctcactaaaccaagcacttacatctggcaataaacctgagaaactatccgagtctttactcaagttgaataccttattgcagttatgtgcgtttactttggctactacttatgtatctgcatacagagctgtatctgaaatttctagtagtattccagtggtatcatcaggggtgcataatttggttggattttgggttggaccagatttcgatgatggggtgggggttatatcgaagctgtggttgttcggcttcactactagtaaattagtaatgtattttgaggccatagagatgaatcttcaactaatgtatgtagatatcatcatgtattgctgatgtccaatcat

SEQ ID NO: 12626 - DNA, 707 bp, Pinus taeda
  Predicted polypeptide sequence is orthologous to G2010, G2347
tcttcctcttcttcttcgtcaccgagagcgcagcctcccgcttgccaggtggagaaatgcgcggcggatcttgctgatgccaaagagtactataggaggcacagggttttgcgagcaacattcaaaggctcgaattgtgctcgttcttggcctccagcaacgcttctgccagcaatgtagcagattccatgtgttagaagagtttgatgaagcaaaaaggagttgtaggagacggctggcaggccacaacgaacgccgtagaaagactccgtctgattcgtcagttgacagactagattcaaatcatcatcttaatgacaactggttgagacatatgaaggaaactgacaagatgtcaattgtactagagcggaacactacggctaaagtttgcaaggagataaaaaatcattagactctgggcgtgctctctctcttctgtcatcctcagttcagctctcttcgtgcagaacaaacatggccagagttatatttacaattcatcaaattgaattcttgctgttgatcatgaactgtaaatctaaatatttgaaatttggattgtgttggtcctaactcttacaacttatgaagtccagaatttgaaagtctcatgaaagttttgagcttgtatggtacgcttaaaatgttgtattttaatggtacttaaatggttggatttttattatgcacctttcaaaaagaag

SEQ ID NO: 12627 - DNA, 839 bp, Pinus taeda
  Predicted polypeptide sequence is orthologous to G2052
cattatcggccaccagcacagaaagacagcagataaattatcaaccgggaaagagaagggaaaaggaaagacaggtggaagggggcttcgataccccttccttccccatgggaagattagctttacctccaggtttcaggttccatcccacggacgaagaacttatctcctgctatctcaagggcaaactcaatcatgcccttagaggagcagagctcgaagttattcccgaggtcgacctttacagaaacgagccctgggatttgcctgcttatcaagtttcctggaacagttatgttcagtttttcagtaacaatagttaatgggatgatctggattttctcagttgggtttgcagaagtgtaaaaattctgaaaaatccttcctgcccagccgtgatatggagtggtatttctttagtcctcgtgataggaagtatccaaatggttcacgcactaatagggctactgaagctgggtactggaaagccacaggaagggatcgtgaagtttactctcgagaaaatacagtaggaaaaaaaaagactctagttttctatagaggccgggctccagaaggtgaacgaactgattgggtaatgcatgaatatcgtcttgagaaaaatgaatgtgagccaggaccttgtttgcaggtattatttatgaattattcattctttgggatgctgtttttaagtgaaatgcatttgtttggataccatcatatcgaaaacatcatcaatattcatatgcatagatagagacatatgcacattcatacacctcttttgttttgaagatatttacttcaaggctaaaatataatgaatgagctagaaa

SEQ ID NO: 12628 - DNA, 524 bp, Pinus taeda
  misc_feature (423)..(424): n is a, c, g, or t
  misc_feature (449)..(451): n is a, c, g, or t
  misc_feature (456)..(458): n is a, c, g, or t
  misc_feature (471)..(471): n is a, c, g, or t
  misc_feature (497)..(500): n is a, c, g, or t
  misc_feature (518)..(521): n is a, c, g, or t
  Predicted polypeptide sequence is orthologous to G2053
gtcgctttggcatcgatttaattataaatgtggtggtttatctgtggaggagcatctgaaagactgtcgaagttctgtgacaacaaacatggaaaaggaaagcacagagaaccaaagactctgattgggattctgttagatacatccaaaccagccttggtttaaattcagaaatatcttaaacaagtgagatccaggaaactgaccgggagcctgaccagtcccaaatgaagacaaatacaatgttatttgcagaaatttcgaattgtggaataaaacacacaagcagcgtggaatagtgatttgaactcattgcaaggagcaacttatggttggtgaggcaaatagtataaatttgcccataatgtaattgtttgcttgtgttgtgactttcatggtggctctgactatgagttttaaagnnatatatgccattgtgcttggcgacnnnatgtnnnaaaactagtgtantatggcaaactattgtttcttttgtnnnntggatggtattttttctnnnngat

SEQ ID NO: 12629 - DNA, 905 bp, Pinus taeda
  Predicted polypeptide sequence is orthologous to G2071
gaaccaacgaacgctggcttcaaggttttcgttttatctttcttatttcacttccttggatttagtttcctttccgatcctgaaaccgattcattgtgtgagttttccgcgaattaactgatcagggtttcggcctctgtatcaaatgttttggggagcttttctggtttgaaatgacgaggcccttggcgaaatcactgttttccctaagctgaatgactacaacccatcttcaaggcatctataactgtaaatttcgatacctgggtcgatccgtgtgcgaccctcgtccgagaaaagagagcacagcagcattggtaggtctcgggttcaatacacagctggggaagaatttcaaaataaaacgcaagcctcgggtttgggctccagaggcacacacgacaataatacatcataggagtagcggcgtaggtcgtgtgttcaaaccccatccagggaaaataccgtgaagctcgcttgtcgcaagttcgactgacatcgactgaattgcatttcttagtcggcaaaaatattaaagagtcaagacaaagagggggttacgggagcaggctgcgggttcgatcccaagataaggaaaaaagaaagaaaatttcatgaattgggcctgtagattccagtcacgaaattaaaacctatcggtctcgtcttcgagctaaagttggggaaaaagctaagctctcagggaatgggttcccgcacaatgctgtcctctaatggtggccggacacctcagttccaaccgctcgttcgtcagaattctttatacaatttaacgctggaggaggtccagaaccagctcggggacgccagcaagccgcttagcagcatgaacatggacgagctcctgaagaacatttggacacaagaagaaagccaggctatat

SEQ ID NO: 12630 - DNA, 809 bp, Pinus taeda
  Predicted polypeptide sequence is orthologous to G2124
cggccgggggctctgcattaggctctctattgctacggcaattcaattgtatgacctgcaagaaaggctaggccttcagcaccccaatatggcggtagactggttaattaatgctgcaaaattagctatagatgagctccccgttagggaagcagaaaaggcttctgcttatgtaggtcaagtgcctgaacgaacttcctcaaactgttccattgtagagcattttattggatcatcaagagagagtgaaactgcagctactggatcggccattacaacatttacagttggcctcgtctctgagacagcccaaggggcgaattcttttatggatattaatacaaaggctataactattacgaatatgaagggaacggagttgggaggcagcggcagcagtatttcagatgtaagcataaagagatcagccgaacgtacatctagttcttcaatgtcagacctgagttccgagatggaggcaatgttaaaaggatctgaaaggaatctaactcttgacatacacaggtatggcacttgtggactctgtgggttttgatttatcttcactggttctttgacaataactgacatatttctcgcctttcgaggttggtgtcctgtgcaacgtcttagaggtgtttttctttggttcagaatatgagtggttaatttggggtgagggtaggtttcgaatgatggctatccaatgtcctgaatagtttctatgttatgttaatgatttcttgatatgtattgatataatatctagatgttagggactgttgtaagcttattgcctcgattcaaat

SEQ ID NO: 12631 - DNA, 819 bp, Pinus taeda
  Predicted polypeptide sequence is orthologous to G2140, G2765
cctcgtgccgaattcggcgcaaggattctggcggccatggcttcggaagccggctcttcgtcatctaattcgttctcggggttccaagacctcattaattgcggggcaccgctgcaattttcctacgattatcgtggcggccacatgatgcaggtcccctcaggcttggcgaacttcagttctgtggaccagaagtccgtcggcgatcggctttttcaaccagtcttgatgagcagatcggcattggaaatgagcaaaatgacggcgcaggagatcgtggaagccaaggcccttgcggcgtccaagagccacagcgaagccgagcggaggcggcgtgaacggattaacaaccatcttgccacccttcgcagcttgcttcctaacacaaccaaaacggacaaagcttctttgctggcagaggtcatcgatcatgttagagagctgaaacgcatggtggacgacatagggcaggcaagcccggtgcccagcgaagctgacgaagtaagcctagaatatcctgatccgaacgaagaaggcaggtcggtcatacgcgcttccctgtgctgcgaagaccgccccgaactcctgtcggatctcattaaaaccctaagatcactccggcttcgagcagtcaaggcggagatcgcaaccctcggcggtagggtgaagaacgtgttagttgtgactagtggtgactcacaggaccccaacgacgtgagcgaaaccccctccgcttccagcattaaggaggcgctcaaggcggtcatggaaaagcagaattctggtgatctttcgcctgcaagttcttccggtgggaat

SEQ ID NO: 12632 - DNA, 757 bp, Pinus taeda
  misc_feature (543)..(547): n is a, c, g, or t
  misc_feature (576)..(578): n is a, c, g, or t
  misc_feature (643)..(644): n is a, c, g, or t
  misc_feature (646)..(649): n is a, c, g, or t
  misc_feature (663)..(664): n is a, c, g, or t
  misc_feature (670)..(674): n is a, c, g, or t
  misc_feature (700)..(700): n is a, c, g, or t
  misc_feature (715)..(717): n is a, c, g, or t
  misc_feature (727)..(728): n is a, c, g, or t
  misc_feature (740)..(742): n is a, c, g, or t
  Predicted polypeptide sequence is orthologous to G2142
tgaaaatggaataggatttggatggtttcctacattgtatagcttccatggataaacttgccatggtggcaatttgtgtctctttttcttgcagctactctctttgactctcttaattttaggtcattcaattcttttcccatatcattgattttatcctccatgagaccacatcctatacacttttggatttcaatctacatccatctatgtgtcctacctctttccttctctaactcaaaaaagagtgtgatggcaaatttctcaagtataatcctccctccctcaacaaattatagtacgattctaggctaggttatggatcaaactcttgaagctctttgaggcctttttcttcttctttcaaggtggcttctccttcctatagaagaccatatttctcctacaaataatgtgtttcctcctatagctcttctttttcttcttctaacatggtagcttatgtcttgagcctcttaaaggtgacttccctggtggtgggccttcctaaagagagcacaagtttcttgtttttttatcttnnnnnaagtactttctccaatcttcccctcactnnntcccacttcttccttcttacttgttgactcctctatggtgatagggacttttgtaagaggctganncnnnncttgccttatcctnntgctcnnnnntgttttgaatataggggactttacantcgtttcctcctttnnngcttggcagnngtgctcaatgtnnncaatgttacaaccac

SEQ ID NO: 12633 - DNA, 784 bp, Pinus taeda
  Predicted polypeptide sequence is orthologous to G2142
gatagaagattaatcatataagtacgttgggagccacatatttcgggctggatggaggcctcgtacagcttcgatatgcataatccaaagaataggcttagctaaacatctctctcaatcttaggccttttcggcggctgctcacactcggaggatgtctctgcagcccttgactgcccatgtaattgatggttctgggacgactcctcatgattgtgactgtgctccttgatattagttgtagttccagatgttccaccccggcggccaaggtcaatctgcactgatatgtttgcttgtgagagatctaaccctgagttctgcaatgcttgcgttaatgtatgcaacaacccttgagagtaaacactcgaaacatttatgacaccaccttggatcacaagttcttcctgttcactagtagccggtcgagcctcacttgccctctgttggtcagaagaagagcaaggtggttgtggttgcctacttgctagttcagcttctgattgaggcacatactgagataaccttggagagctatttaaatatgcacttgaatgctgattttctgacttagatgctgattttgtatctgcagcttcatctttgagcaatatccctccattctggcctgaatattgttgaattggtgacacctgagatgaccttagctcagaccactgactttcatgcccactagtagtttttgccacagtaacagtatttccttgaaaatgggacagctggacaggtgtggcagtgtcgacatcttctcttatcaaaagaa

SEQ ID NO: 12634 - DNA, 875 bp, Pinus taeda
  Predicted polypeptide sequence is orthologous to G2142
gatcatatctgcgcacacatgctgacattatgtcatgtcgtgggaaagaattagctgtcggtggtactgtgctctgccggctgtcatccggagttagcacagtcgcatggggaagcaaactgccccttagtccggcagactgataactttacagtttcagaaaagctgagactataatcggaaaacggaaaaaagtaattcactagacgattagcttattatctgcttgtgccttgatcattttttacagagttcaagattcgactattcatttttagagaatttaagattctttgtcgatctcttgaaaaaacgctttccaacttcagctattatttatttatttatttaaaattagtctcgttcgttcatgtttatctgcagcagggcaatctcagctttaatatctttgacttgtttctgagcccctgaacataggcgattactgccttgactttagactcttcatccttacactctgttgcattgggaacagttgaagataaaaggtcgagcctgagccttttatgtgatgatcgctttgccaccttctggtgtcggtgtgccgacctgctggtcgaccctgctgatatcttcccattcttatcagatatatgaagatcatgggatgaacttggaacgacataagcggattcagtggaggttactgcgcccaattcctcctcctcctctgtgtacaattcatgaagccggctgcttgatgtgcttaatctggagttcaactccgataattgcaggctcccaccatcatcctcatctttggaaactggtggggggacacacatgtttaacccagataaattttagatcagtatttttttccaatttatgaaattaaacttggagtagctttt

SEQ ID NO: 12635 - DNA, 840 bp, Pinus taeda
  Predicted polypeptide sequence is orthologous to G2157
cttccgcgattatgtggacgactttaagaacgattccaactctaaagaacgagggtcgaaccattagcgtccagagcagaagcaaatggacaaccagagacaactcttaaaatgaaagccagaagctacgctcggaggggaaggagaaaaaggtgatgaagtagggctctacaggccgagagaaaagccgagagaagcccaagccctggagttctccaatgggtgcaacgtgggagagacagcagggaatctctgtgttaggtggcagtggaattgtgattaatgtcaccgtccgccgacctgctgcgaaatcgtatcctttcacggccgctgtcgggaagaagtactttgttttcctctgcagagttctttaggtcgaggcaaacacactgggagaatcagggaactcgcaattggacatcacaagggttttaaacattgtcatttggagggaattcctgcgcgttttaaccactggcatttgaattgatagagatattccaggtgaaggcaaagaagagtgttcacaatcgtggaagaaggtgaaacgaggacgttttgtgcaggtctgagggatcagcctcattcttcgtctgcaatcaggttaaaaggaaggatcaaatattaaattatggagggaatggaacatttttataagtaaatttaagacttgttttttgatccatgagacaaacctataatatgattccatgtgtatttggattatgattaaaaatggctcggattaaagatgaattaaagatgaattagtaggcggtgatcaatgtacatttcttaatcagacatggtctttggaatgagcttgtttaatattgatac

SEQ ID NO: 12636 - DNA, 871 bp, Pinus taeda
  Predicted polypeptide sequence is orthologous to G2157
ggaacttggtgaaaaaaacagatatctacattgagtagatagagacgctgtgaactactctccctgctgagaatagaagtgaaaagcgcaggccgtcttccatggcaaacaggtgctgggcgaataatgtaacgatggcgggagtccatccagaggaattttcatactctggttcccacgtttgtcctcaatctgaaaaccctaggatcacttcccaaacaagcagccgatcaaagaaacagagtgtaggtgatggcaatgacagcaatgcagaccgtaatgtcactcgccaaacaagcaaccgatcaaagaaaaggagtatacgcgatggcaatgacggcaatgccaacaaggccgatgagaaacgtccggaaatgggtgttccagtgggaacctgtaagcctcgcggcaggcccaagggctccaagaacaaatccaaggctcctctttctgaaaatcctgaggcaccagaaacactggagaaccgtatttttgagatcgctagtggggtagatatcaagaagacattggagaagtttgcgctgaaaagccagctaggaatcctcattttcagtggcaatggcgccgtcacgaatgttacactcatgcagcaggcagttccagggggaatggtgacatattcaggacccttaggaattatttcactttcaggagtgatccatccagctagtggcgctgccagaattacagcgattttagcagatgggcatggtatgatagttgctggtgaagtaacacggagcctggtagcatcagatcttgttactgtggtaactggagtggcccctaagatacttacgagaggtaaatgtgaaatctttggaggtctagcctcttcgagttttcaaat

SEQ ID NO: 12637 - DNA, 649 bp, Pinus taeda
  Predicted polypeptide sequence is orthologous to G2207
cggccggggatgaggttgttgaatggttttattccctaatgttaagaccgatgaccttgataaaagtgatgaggtatgcatgttattataatttttctgtgtagttgggcacgtgttgtgacttttaaccttggtgtttttaactgggtattgagagagtatattcatattgacaaaagtaccccctctcaattaacatttagaatttattgcaatttacctatcttgctactgtaacgttcatatgttggactttgattcttgcgtcgaatggtcttgtgccacctagagcaggcccatgtgattttcacatagcctgttgtagtctcctcccttctatggttggatttgatgcatgttcatccgacagatactatggtttctccttatcttatcggctcctgtaacactaccatgatgggggaaagagacactcacagttgggtttctgtccaagtgttgtggcatgcactagggatcctgcgcctccaccgctcactgaagcaggaactcaaatggattctctctctcatctcgcgaattcaactaggattggcttaactctatctcttagggttatcttgaaatttggttaatccttctagagacgcttgctagtgttggctcaacgtggaaccagtattctatt

SEQ ID NO: 12638 - DNA, 889 bp, Pinus taeda
  Predicted polypeptide sequence is orthologous to G2226
aggggtggccagacgcttgcagaagaggagaaattagaacttagaacttatgggtttcccgagcttccccggtgtatcagcatggcttctactgatcatctctacggtcctctcagtccaatgcatcaaggacattgctaattcaatttttcatattttccacatgatcttctccattagaacttctgctaataacaatgatacccaattcatgagagactcggctcggctcccttttgaagaagagaccccagtattgggctcagggctggcgcaattgcccccgatagctgaagaaatcaggggaagcctgcctgttactcattatcaatcatcacccacaaatgcccatgtggtggaatgtgctgtttgtctgtcaagttttgaggaaggggatgatataaggcagcttccatgctgccatttctttcacagagtttgtgttgataagtggctggatcaccaacagacaacttgccctctctgcagagcatctcttgtgccagaggagacagccaataagctgaggagaagggaacaagaactcacagaggagctcatgttttggttctcttctttccatggccatggattcaacagcatgtggtggttaaggtagctttttgttgttgtatgctgttcaagttttttaaatttattctcagtgcagatagattatctaagatacccatccaagggtttcctctgttttttctttatatataatttagctttgtccttactttcagaaagtaaggacacccaatctgtcaattgttgtgggatggcccatcagtcaaacagttaggcatttcgcctggatcttgtatatgaagtactgtacatatatataaattttttcgttctctatatgcaaacatgcttgtct

SEQ ID NO: 12639 - DNA, 809 bp, Pinus taeda
  Predicted polypeptide sequence is orthologous to G2226
cggccgggggggtggggtgggtttatttattaggaatctgaatggatggatctatattacgcgtgtcaagaatttgtatgaaaaccagagggtgcaggaattagaccaaatacggtgagacaggttgcctagaaggtgagcacagccgagggtgcaggaattttgagcaaatacagtgaagaaacaggagcggtgggaaggtatttgctgctgagcagagaaagatggggctttcaagattcccagacgcgtttgaaggaggagtgataccacttttgatcatccgcacagctttgtctatagccatggtgagggacgttctcatctcgtttcttcaaaaaatgggtctcaaagtgattacagagcaaccagaattagcccaatcatctaggtcatttgtatatgctgaagaagaagctgctgaattgggctctgggcttgcagagctggccatgaccactgaagaaattggagataagcttcctgtatcactgtttcaagtgtcgtcgtcgtcgtcatcttgttcttgttctggttctgatggtgatggtgtcactgagtgtgtggtgtgcttgaggaaatttcttggaggagaggagattcgaagcctgccctgccgtcatgtgttccacaagatttgtgtcgacaaatggattctggattatcagaatatgacatgccctctttgcagagtatgccttgttttttctgtagaggacgagttgagaagataagggaactggtaatgcagttttagtcctagttttcctgtagaggatgagtagagataaggaactggtaatgcggtc

SEQ ID NO: 12640 - DNA, 871 bp, Pinus taeda
  Predicted polypeptide sequence is orthologous to G2290
ggccagtgtcgtgatctggaaaagtaaaactgacctgctgagtgctcaacacccaagggaccatctccagcccaccctgtcacagtgagcatgtccataatggctaaaaagctcagtgtggacaacaatgcatcggcagtatcagagtccgcttgtagttgtatttctgaagatcttaaaatgcctcagggcgaggtctgcagttcgaatctccaggccgccttagggccttgcctgaaggaggcagataagcagcacctcgtaggggatggagatgagaaatctctgcgcggagaatgcattaagctctccatcatgctggttttcatggcctctgcctcagttgcagtcttagcccctgaagctttgcctgctcttctttcatctattcacagccattttctcctcttgtccaccaagctctctgtttacaggcttagggcatttgcagacttccagggaatttggaaaaagtctcaaatctctggaagtgaaattcacttggcattagttggaactttaattggccttatcttcttggccctaaggttcttcagtcttttcactgggagggacccaatgatcccaaataagccgagtgtttctgctgctgtagaaatttctccggatttcaaagcccaaaccccaagtgagtcgggaagcagtgaacatgtttcagcagagaatactccctgttctgagaaacaggaccctatttcgagcccattagaggatagccccgtgccttggaaggctatctccaagcctgaagttagtctccttttcgagtattctccagcagagatgagtacttcagagaaaaaagttaaccatggggccgggcagtcttttttaaccagagatgatactg

SEQ ID NO: 12641 - DNA, 310 bp, Pinus taeda
  Predicted polypeptide sequence is orthologous to G2296
cggccggggatgttgatttctgccagaatcacaatgccttcatagatcgcagcgatgaaatgaatattagagggtcttattttcatgtttgtcgattcgggttttaatggatttctgtttttgggtttggcctttgggcaactcatcctccatctgacgtgaggatctgtgggcgcccatgaaaaggcctaaaatttagcaggctttgttgagtcgctgtatccgaaataatcagttgctatagcgaatattgccctgcaaaatctgttatacagcacatttctaaagagtcctaatgactattcgtttt

SEQ ID NO: 12642 - DNA, 801 bp, Pinus taeda
  Predicted polypeptide sequence is orthologous to G2298
gcagaagaagcagccggttcggagttcgaatccttgccctaacgcagtcccgtgttttaagactcaatctttagtgactcccccgcaacatggttaagcccatgccaaaacagagcagcccgagcggatcggaaaactgccaaataaagtcgcgacagttcaaaggaatccgactgagaaaatgggggaaatgggtgtcggaaattagaatgccgaattccagggccaaaatctggctgggctcctacgactccccggaaaaagctgcccgcgcctacgactttgcgttgtactgtctaagagggtcgaaggccacattcaattttcccgactccccgccggaaattccatgcgcctctgacctgtcgccgccgcaaattcaagccgccgcggccaggttcgccacagaagatttccggctgccgtcggaagaggacgcggcgtcctcctcttcgtcgccttcggaagcagaatccggcattgacagccaacagatttctgcggaacagtggcccgcattctgggattcgttactgcttgaagatctggatagtggcgagtctctaaatttagaggattttcctcccttagaattctctatggatgattttgggattctgttcgagcagacgaaagactgggggcttttctagagaaaaatattcatctaactctgccggcgattttgccattaaagattgattaatgtgtatgctctgcctgaaatttatgagattagtgaagtttctgggggttttcatcaatggaaattgatgcctccttggggaaattgtaagctgc

SEQ ID NO: 12643 - DNA, 648 bp, Pinus taeda
  Predicted polypeptide sequence is orthologous to G2311
atcttgggctggtctggtgacaacgcactgccagaagagccgtcttgaccctggctgttgtatggctcgagctggtcatcgggttcggtcaagatgtcctctaaagacagactggtctttgatttcagtcgacttgcagctgtagatggtcctggtcccggtgtcgatgatgatggtgtggatacgtctggtggtgatgcagcacccgagtcgtttcggctcaacttgccacgtagctcttcaggacaacaagtgcggaaacggtccttcaagtcgcctgctgttcggctactaaactcaaactctgggtcttcgagaatggccgtccacttgccaagtccgtgtctactgacgcctataagcagctggtttgtctcctcttctgtccagcgacggcgtggctttgttgcacgccgtttcggctttgatgagtttgttgacgacgctgcttctggtgaatcgcctgcttcgcctgtcgtagatcgagttgaccgtggtgctcgtgctggacgaccgggtactggtgatttcttggtcgcttttcccattcttggtgacaattcggatgctgaagaagtcgaaaagtgccgtcctcccactaaggggagcatagacgaagacatgcccattccgtcacccattctgtcg

SEQ ID NO: 12644 - DNA, 727 bp, Pinus taeda
  Predicted polypeptide sequence is orthologous to G2311
agatacccattatcagccatgggcgctccgaagcaaaaatggacatcagaagaagaaggtgctctgcgagcgggcgtggagaagtatggcgccggcaagtggcagaccattctcaaggacccagagttcgcgctctgcctcgcatctcgttccaatgtggacttgaaggacaaatggcgcaaccttatgagcgtcaatgccggtggccagggttcgaagacccccagactaaaatccattgcggctgtgcctctttcctcagtttcccctctctctgccgcagctcctggtgctgcaatgctcataaaatccgaagcaataataccctcctcaacagatattgtcacctattctcctaagagcactcccgcaagtgctagaaatcattccccgaggtgcgattatgatgacatgatcttagaagccctcaccgctctgcgagatcccaatggaatagaagctaacacaattgctagtttcatggaggaaaggcaccaattgcccccaagtttcaggcgaacgctcggctcgaagctcaagcgcttagtttcccaggaaaagataatcaagattcgtaatagctacaagctcaaggatatggcagaactgagagctgcagtttcaggacctcggaatccaactgatgcggcaatgcgattatgctacacagccatggatgctgcttcagtggagaccataaatcaagcttccatggctgctgccatga

SEQ ID NO: 12645 - DNA, 874 bp, Pinus taeda
  Predicted polypeptide sequence is orthologous to G2311
cggccggggtcggcgattttgttgaattttagatctgcctgaatgatcatgatcgaacctggttgaagtcgaggattggtgggtttttggcggtgcagggtattggtagggttttagatttgtgggtttttgacagcagagggcattggtggacttttagagtggagggtgttttatcagtgaagggtattggtgggtttttgccagtagtctcagagcagaccagacagaggagaaagaggccatttgaagaagaaactgtagatagatacctagatacctatccatgggtgctcctaagttgaaatggacctctgaagaggagagtgctctgcgagcaggcgtggtaaagtatggcacgggcaagtggaggaccattctcaaggacccagagtttgcagcctgtcttgcagctcgttccaatgtcgatttgaaagacaaatggcgcaaccttatgagtagtttgagtcccggtgggcagggttccaaaacccctaggctaaagctccttgcacctgttcctatttcttcagctgcccctcagtctcctgtaacgacatcctctgcagcagcagcaattttggatcatgtgatttcttcccctaagagtatttcaacatcaactgctgcgaggaatcattcaccgaggtgtgattacgatgacatgattttagaagcccttacagctctgcgagatccgaacggtacagatgttgccacgattgcaagtttcatggaggagagacaccaattgcccccaagtttcacgcgggctctctcttccaagctcaagcggttagtctcgcaagacaagattttgagggttcgtaacagttacaagctcaaagatttgggagagatgaatcaagcagtg

SEQ ID NO: 12646 - DNA, 846 bp, Pinus taeda
  Predicted polypeptide sequence is orthologous to G2343
agagaataaaatctctctagtgcggacgaatttctgacccgaaatcttcagataacatcatcaaagcagcttggatttggtcgaagagagtgctttcgccagggttcctctggttcagcaatgaacatggcgaaggggacaaggaaacataaccactatcaacgggctgccagttctggtttgcaacatttacggagcagcaggtgtttctgtcgcccacaaggggaaagtccagagaagcttccccatatctatcaagatcctcattcatggttgctttgtaaaagtttgcactaaattggtcacaattctgctcaaaatttccccagtctgcaacttctggggttatggtaggagtcagaatttgagagcatcctgcgcctgagtcaccatacaaatcaatttcaggtgctggatccatgtcgacgtcatcaatggcgatctgatcgagaatcatggcaattggaggttgttgagaggctccctgattggcggcggcgacggcctttttcttcaggcagctgcgccagtaattcttgatttcagtatccgtccttcctggcaagtgttttgcaatctgtgcccacctgttatttagtctggcctgaagactgatgatgacattctcttcttcagtggaaaaattcccacgcttaatccctggcctcaagtagttcatccacctcaacctgcaactcttgccacaccgctgcagtccagctctctctgaaagtgatgaccagcaaccatggccgtgtgtagtgatataagtgatgagcttcatatcttcctcgggcaaccagaagcctctctttacagctttcttgctacagcaattgtgcacta

SEQ ID NO: 12647 - DNA, 864 bp, Pinus taeda
  misc_feature (837)..(837): n is a, c, g, or t
  Predicted polypeptide sequence is orthologous to G2346
gactggataaatccaatccagttaccctgcaatagaagtagtctgaagcaaatctgatgtgctttcttttcaagagtggatacccaaagtaaaactgatgtgctttcttttcaataatggatacccaaagtaggttatactgctaaagaattaccaccatgaagttcaaacattggaacactgtccaacctacaaccatggtacaatgctgttgttgacatttccttcaaaaatgaaaagaacattcaacaaatatagtgcgtctgagtcctccaatggcagaaattgcctcgggctagcacccactacatgcagggatgatcctaattaaacatgaaataggtgaactagattttaaaagaacaatggacattgaccttctcgaatgaagatcaggattgctatttctacagaatcaaatctatcaaatatattcggcatgtctctcatgatctccgtggggagatcctgacattctttgggatttttctctgttaatggctaagaaaggcaagcatctttttggctgccctttgtaatacctgtctacatgggactgatcactgcagttattacgacacttttgcccctctgccgtatcttcagtatgcaccttgttacaatttttacagtaggctttcccacatccctggcaagtagtcttggagaagaaagtgtacccgcaacaaaatgagcatcgactcatgctcaatttccaaaggccaaagttataaccagtatgtttggcagaagctgggagaacctgataagactgaccatcctgggcagaaaatggtttaggagacaccttggagaagccaattgaagaaccagtangagaataagacgcctttatcttataca

SEQ ID NO: 12648 - DNA, 683 bp, Pinus taeda
  misc_feature (522)..(523): n is a, c, g, or t
  misc_feature (581)..(581): n is a, c, g, or t
  misc_feature (607)..(610): n is a, c, g, or t
  misc_feature (619)..(621): n is a, c, g, or t
  misc_feature (645)..(648): n is a, c, g, or t
  misc_feature (654)..(655): n is a, c, g, or t
  misc_feature (658)..(661): n is a, c, g, or t
  misc_feature (664)..(665): n is a, c, g, or t
  misc_feature (667)..(667): n is a, c, g, or t
  misc_feature (676)..(677): n is a, c, g, or t
  Predicted polypeptide sequence is orthologous to G2348
gaattatattcattatggcacatgtgaagccattcctcttggaaatccaagctcatgttttagaagcaaggaaaatattttccaatcctcaaatcatgaatcattcaaaatatttattccatcaactgatcccaggttatttggcccagcatttatagaggttgagaatgagtatgggatatctaatttcatccctattctcataggggacaaacaaatttgttcagagtttcaaatgctcgagcaggaacttgtgaaatccggattctgctccagaagtaatcatggacttgctatcggaagttcgagttctgatatttgcgagcaaaatttggtgaagaggcagagtatcttggagttacttgtagacataggttgggttctcaaggatcccgaatctgatgaggataaagtaccagtgaattttttacacatacaaaggctgaattgcttgttcagttacttaataaatggccacttccttgctatcacggagaaagttttgcattcacctaaagttannaaaatgttaaggcaagtatatggaaagtcaaatgaggttaatggtgctgacatgaagntgcttcagaattatgttgagcatgcnnnncaatcgctnnngaaacagcgggattataagggtannnncgattnncannnnttnntngataacgtnntactgc

SEQ ID NO: 12649 - DNA, 732 bp, Pinus taeda
  Predicted polypeptide sequence is orthologous to G2348
tgcaaccagcagcgctgtacagtatctcatgaaaaccaggaaacggaacgtttattgaagatccaacctgaaatcagacctttctctgaaatagaatcaagtgatacacgtgttttgtcagttgaagaaaataacatgctcacgcccttgcttgagaaggaatgctctagcaatattgcaggtgacttgaagtataactcaacatggagaggtccaaaaatagaggttgctgagtacactcgaaagatgaaagtttgcctaaaaggtgatatcagggtcgatcgtcgaatctttatcttggcaattactgtcatttctgtttgtgctggaatctgtgtggtacttcagcatccacaccaagtaatggagatctccatgtcactaagacgatgtttatctggcttgcgcaaagctcgcgaagacatttcacacccttaaataagcatggcactgcttagtggccatctcaaattaatgagtttgtatctttataactacagagattttcagctcaaaggttctgcagtcttcttgatgtaacctattaattcgtaagcggccagtacgcacctcccaaaccatggagacagtgtgcgtgcgtaataagcccaagcttcatcagctgaaattaaaaactatttactgttcaatgtaaaataacaatgaatcagctggcatttttatcggtaactgctttccggtccccttgtataagtaactatcgattttcag

SEQ ID NO: 12650 - DNA, 703 bp, Pinus taeda
  Predicted polypeptide sequence is orthologous to G2375
catccatttcaggagagtttttgaagatgtgaaattgtctactcatcaatggggaatccaggaacttcgacggaggctgtcatcttctcgtacacccctctcgtgatcattgctgcagttctcgtggtgttcttgctcctcctccttctggggttgtgtgtccgtgctgtacagctagcgctggcgctgtgtgttcgtgccggacaatgctgtagagagtgctgcagcagacggagggtggttgtctggccagttattgagcccacctaaagaaggcgggaatcggagaataactgaaatcatgatacagagtattagggttcttttggttggctaatccacgctgtgtgttcgtgccggacaatgctgtagagagtgctgcagcagacggagggtagttgtctggccagtccttgagcccacctaaagaaggcgggaatcggagaataactgaaatcatgatagagagtattagggttctttcggttggctaatccactggaatttgaattgataaccttttagcaaggagttatgagtgttttaacagcacaaccactaccgtaaatccaaagctgccatcaagagtattagggttacttgtatcaaaatttaacatttttgcagggttgcattaatgagcacaacaactctgacagtggatatgtagttagaaaccctgaggagtgtctctctattgaat

SEQ ID NO: 12651 - DNA, 597 bp, Pinus taeda
  Predicted polypeptide sequence is orthologous to G2379
gttaaatatatggcataattgccatgtttgtcacgtacacgttgaacccaaagcgtatggaaaaaatgtacagctctatctataatggatctctctgaacagtaaatagcattagcattagtgactaagtacacagctagaaataatttacagattactcacccggttatcaattttccaacgatctcccttggaaacatatagcgtatctaaagcttatctacttgccacatttcttacttttgataacacatatcataagctgaccttttaacagcagcaacaaggccataaccgcagaattgaacttgaaagccatgaagcaacgaagcagaggcctcggtccatcaaagttcgacaatgcaaaaagtttaaagaagtcgcatgagtaaaaataccccgagaatgttattctgaaggtctgcatctatcagaatcagcgcaatcaatgctggaacacgacggatttttctttttcttcctgtgaagctttgcaagttctgaattcatcttcgcaaacagctccattttagcattctctattctagagtaaatttccgagaaactcacaagagcatccgccagggcccggacggg

SEQ ID NO: 12652 - DNA, 959 bp, Pinus taeda
  Predicted polypeptide sequence is orthologous to G2379
cacgctgggactgccggcgcccaatctcccggcggcgtcgctggcggccaacgccggcgcaggaggcagccgggaggactgctggagcgagggcgccaccaatacactgatcgattcctggggcgagcgctacctcaacctgaacaggggaaacctcaagcagaagcactggcgcgaggtttctgagaccgtcaatgcgcgcgccgccggcctcaagcttcgtaagaccgatgtccagtgcaagaaccgactcgacaccctgaaaaagaagtacaagctcgagaagacgaagatctctaacggaaccatcattggaccctccagatggcccttctacgtcaagcttgacaacctcataggaccctcgcggagcaagcaccaggcccttaagcatctacatcaccatctgcaaccccatccgcagctccagcccctgcctccgcccctgccgcctcccctgccatctaagcgtccggacgggggtttaaattcgttgtcctccggctccctcgatgctactgagagcttacccagtgacggggctgacgagaagggcaagagggggaggaagtcgtcgtcgtcctctgagagccccgtgagagaattggcgcaggcgattttgaagttcggagagatctacgagcggattgagaacgccaagcagcagcagataatagaattggagaagcagcgcatggagtttacaagggacttggaggtgcagaggatgcagctcttcatgcagacgcagatcgaggttgccaaaatggagcacgctaaaaatggcggtacagagcactatttgtaggcatgctgttttggtagaaaagtttgtgccatcagaaatctagtgtaaacttgagactgaattgtcccaccaaagagaaagttgaaaatcccttctaagtagcagaacactttgacaacagatgtgtttttttatggcaggaaattgttga

SEQ ID NO: 12653 - DNA, 955 bp, Pinus taeda
  Predicted polypeptide sequence is orthologous to G2379
cgtcgtcggcggcaatactggtggtggcggtggtgcatcaaacggcctgagtctttctttgccgctgcctcccggttcctcctctgtcaagcttaacgcgtcaccacctcctccccctctccctccgcctcagaccgccggagagcccgcggggggggatcgtgtggcagcaggcgggggtagggacgatatctggagccagacagccactctgactctgatcgatgcttggggagagcgttatctggagctgaaccgcgggaatctgaagcagaagcactggaaggaagtagcggaggcagtcaacggccggccgggcaataacaagcaagctaagacagacgtccagtgcaagaatcgcctggatacactgaaaaagaagtataaggtggagaggagcaagatcttctccggcagtgtcaccaaatggccgctctacaccaagatggacgaacttattggacccgctcgcaaacaccaccaccacccgcaaccgcttcccctcccgccagcgccggcgttgaggccacggcgccacctgatcgaatcttccccaaaccccctcaacacggccacttcccctgatatgaccgagagctgtctcaatggcttcaatgggaacccttcttcggccaaacgacgaaagacagcggcggcggcggtggagaatcctgatggcagcccgttgaaggagctggcgggcgccatcctgaagttcggggaggtgtacgaaaggacagaggtggtgaagcatcaacagatgatggatctggagaaacatcgcatggagttcgccaaggacttggaattgcagcgaatgcagttgttcgtgcaaacccaactggaacttgccaagatcaagcacgccaagcatggaaacacagagcattatctctaagcattccatgtcaaagagtccatttcatcgacaaccattcttgggatagctccacgg

SEQ ID NO: 12654 - DNA, 313 bp, Pinus taeda
  misc_feature (208)..(208): n is a, c, g, or t
  misc_feature (222)..(223): n is a, c, g, or t
  misc_feature (229)..(230): n is a, c, g, or t
  misc_feature (232)..(233): n is a, c, g, or t
  misc_feature (263)..(263): n is a, c, g, or t
  misc_feature (301)..(301): n is a, c, g, or t
  misc_feature (305)..(305): n is a, c, g, or t
  misc_feature (311)..(311): n is a, c, g, or t
  Predicted polypeptide sequence is orthologous to G2382
ggggggactcacgatggatgaaggtcactaggaagtcaaataatgtagggaaaacatgctttgccttctccccatgtgccctggggagtagttaagctcccctgtgttacatcctcatcatttctcttggattgggcatgtggttaatatatttcacatcattattatgcattataatacaagtgtttctttggagcctatgattganctacatgggtttcnntttganncnnttgatgacaacatatatacagggatttctntaactttttggtcttttttgttgatggtcattttaatntaancttcanca

SEQ ID NO: 12655 - DNA, 565 bp, Pinus taeda
  misc_feature (502)..(502): n is a, c, g, or t
  misc_feature (539)..(539): n is a, c, g, or t
  misc_feature (549)..(549): n is a, c, g, or t
  misc_feature (553)..(553): n is a, c, g, or t
  Predicted polypeptide sequence is orthologous to G2404
gcctggggtgaaaactagtttttctgcagacagacaacctgaagctctccctgataaggaaactaatttaacaggctgcaaggcagggatttctggcctgctgttttcctctgtttgttcatcatttgccaaaatcaataatgctggacaaaagagatacagctttgggaattttggttgcacatctgctccagatgtatacttacccacatctgcgactaaggttgtccgtgcctctgctgattgggatgcaaagcgaccgggacacaaatcctctaaaatcagaagagctacaagctggtagttttggagccacatttgcaaattactctgggaaaagttttgaaagtagagctcagttgacttcacgttcaatctgtaatcagtcctccactcccccatcaagaaagcagaagactcctattgtggatcctgacatgtggtgctctagaagtctatctttgatgacagatgcaacttcgtttgattgtgttgtaccaanggcaaagtgcatgcttgtgggcgtaactatacaacancaagatcaangtgnaaattgccaaag

SEQ ID NO: 12656 - DNA, 758 bp, Pinus taeda
  Predicted polypeptide sequence is orthologous to G2404
tcgagtttttttttttttttttttgtattgaaggtttttattgaaattatgtttacaaggggagacataatagaataaatagttcatatatataataagagacactgggtatgagcattcataacattaataatagaagctgcccatactcaatcaatagttcttcttaaagaaatctgaaataggttaatacaaaaatatcatgtgacttccacacaataaaaactaaggttactttcagataaaagaacaaatgtccctgagtttctctctgtctctgtcagtccatcctcgagttcgacctccccgattagtcaggctctgactctgcaaaggatcctactttccaatagacatctgccagttttacagctatcttcatacccacacgtcttcattcagtcattgatgcaccggtgcttatgttcttcatcattctcattctaaaagcatctatattgaaatacccacaagttacatcttgtgtccaaaaaggttcaaaaacaatgcaaaaagtttcaaatatttattgcttacaaccccaaagtcttgattagatttgcttgtgtcaaagtgctatacgagcgaatctgcaaccctaggtttaccattagagtttcatctaaaagttatccatgtactttacttatataagagtgagactagtcattgaaaactcaatcgactcattccaatcagaagactctatattgatcatcaagcggaacttgaggctcctaaataggccagtctatctt

SEQ ID NO: 12657 - DNA, 1005 bp, Pinus taeda
  Predicted polypeptide sequence is orthologous to G2522
gttgtaaatggcgagcatgcgtgaagaatgaaaaatggcttccttgagtatacataagaatatcgtgctgcacattaaggtttcaaaatacatgtccgagcctttcagtggtctgcatttgcggctgataccttctcgacttctctgatttttataattaaatgcaccgcttcatggcggaggaagtcacattttgagtgcgtgaagagtctttgaagttttactctgtaagtcggtgctgaaattgaatcagaaggacgtaagcataagcattcggagttctttatttatattatcctttttccattcgaaaaattgatgttcaaaaccctaacatttttttcacgggttctttagtgacaaagatacttggaagaagcactgttaccagttttgcaatcgagaaatgactgttgttgcctgaaattttcagttggatttgagtttaaagaaaattttaagcaaacccagcttgaggttagctagactttaattttttgagattagagttgaacacacctaggatttctgctgtagtgagtgttgatggtggagtgatgctggagttctgaaagacgcaagtagagaaaacgaatctgtattgtagtctatgtttggagttgaatttgaaaatttggtaaagcatttattattgctcggtttttgcggcagaaaaactgttggctggtttgaatttaaaatctatgcatggagggcagagaatcaatgggattgagcggacctgggtcatttggttcgattttacacagaggagtgggttctcctccagcaggtatgcccacgccttcgtcggcaccagcggctatacataccccggccgcattgcgacctgtggtgagttcggtcataggtatagcgtccaaccccaacaatcctagttctgcttcctatgcaaacgagtcaccagctaccgttgttcctcatggtgtgaacatgggagtggggatggctgttagcgtgcacggacagagccgctcaagcgga

SEQ ID NO: 12658 - DNA, 789 bp, Pinus taeda
  Predicted polypeptide sequence is orthologous to G2543
agagataaacgaaacaggccccagtgggatgcagtttctggtgggaattcaacggaggaggctgtagattttccaaatgggtcccatcctggaaactgcattactcttttgagagcttacacttctatgcagaataacttgtttattctccaggaaagttgcacagattcttcggggtccctcatagtgtatgcaccagttgacataaatgctatgaaggccgcaatgaatagtggggctgacccatctatcatacccgttcttccatcaggcatctctattctgcccgatggttcagacaacaggagactgcaggcatcttctagcaacagcagcagtattggtagccctggcaacacaggaggaggctcattattgacggtggtattcgaaataaatgttggaaattcaccctcctcaaacatggaaccccacgccacaactgtcaatcacatcgtctgcaatgcggtgcaacaaatcaaagcagcattgcattgtctagatgtctgatgcagccatatgctgcatccccccattaattactttgctgtacacactgataacttcattttgagtttttaaccataggcctaacatcatcatctgtgcgtcttagagttttacttctacaagataaatatctaggggattggataattacaacgcacagctcacattgagcggagcgttggatccgacctgtatgaggcccgaaggagagaaatatattggatggcagcagccagcgtccattgctaaaccgggctaatctatatttggctagtagta

SEQ ID NO: 12659 - DNA, 805 bp, Pinus taeda
  Predicted polypeptide sequence is orthologous to G2543
cggccgggggtgggtggagagagagcctctggggcagaaagagggaggcaagccctcgccctcctgccatagctgggctaaaataaaatacttgaatgactcgtctcctggataatcccgagtaacagaagttagttcaatggtgttagtattcgtcactcggttgcttgggggtctatagaggaatctggggcttttgatgacagaaagtgtgaggacgaagtggggattattggtaagagttattattgagtgtcgaatggaagaacagacgagagaattgagagagcaagagttgtaggggtaaacatggaaggatcaggatcagatcaagatgctgctgatcagcaaaatccagccaggaagcgctaccacagacacactgcacaccaaattcaggaattggaagcgttgttcaagaagcacccacatcctgatgagaaacaaaggcttcagctcagcagagatctgggtctggaaccccggcaggttaagttttggtttcagaatcgccgaacccaaatgaaggctcagggcgagcgtgcagacaataatacacttcgtgcagagaatgaaagaataagaggtgagaatctggccattcgagaggccctcaaatatgtgctttgctcaaattgtggaggacctcctgctggagaaacctcatttgaagaacaacatcgcctacgtttggaaaatgctcgcttgaaagaagagctggatcgtttgtctggtattgctgcaaagtacattgggaggcctatccaaacaacagcttctttacatccaatttcaatgccctcct

SEQ ID NO: 12660 - DNA, 923 bp, Pinus taeda
  Predicted polypeptide sequence is orthologous to G2559
atataccggtgcctgttttctagaaacccacttgaggattcagaataaaacagggtctgcagggcatcagccaggtcaaatctggttagatcttctttgttcagagttgtgttgttatataagaaataagatatcacaaggaggatattagacatggctgaagaacaaactctatcggagcatccttcggctcctgttgtcactaaggatgtcctggaagaaaattctgtatctgagcagcctgcgatggttgctgaggaaaaacatgccaccggtgatgaatcgaaggctttgatgattgttgaaacggagaaaaaggaagcagagaaaaaggaagcagatgttgggcccgtgccatcgaaaatatcaggaggatctgtagacagagatgctgttttagcgaaggttaatacagagaagagattggctctcgtcaaagcatgggaagaaaatgagaaagcaaaagctgagaacaaattctacaaggcagtgtcaaccattacagcatgggaaaatacgaagaagtcagctgcagaaacaaagatgaaaagagctgaggagaagttggagaagcagaaagcagcatatgttgagaaaatgaaaaatgagattgctattatccacaagcaggcagaggaaaaaagggccatggttgaggctaaacgaggagaggactttcttaaggcagaggagttgagtgccaaatataacgcaacaggccagatgccaaaaaagttcttgctgtgctttggaggctagcaagtttttcactacaattgctgtgaatatcttgtttgtttggatatgtagaatattgatcagaaagattgtgttcatttaactgtatttcttgaacacatttgatgggaccaagtttgtacagtcttgattaaagaataatatgtgtattgtatagtccactt

SEQ ID NO: 12661 - DNA, 735 bp, Pinus taeda
  Predicted polypeptide sequence is orthologous to G2559
actcccaaaaactcaaatgaaaatgaaaatggcctcaacaatgttgcttccccagaaattaaccccactcaaggtgataaaaacaacactggtacaaattatgagtcgtaccctcagctttcacctgctaagaaggagtctattcttgccaaattgaataatgagaagaacaatacagatatcaatgcatgggaagaaaacaaaaaagccaactcaatgaacaaatacaataaaaagctctccaggattgctgtgtgggaaaataataaaaaaactacagctgaggctcgtttgaaattggcagaggagaaactggagaagaaaagagctgcttatgttgagagaatgagaaacgagctggcatatgctcataagaaagctgaggaaaagaaagcaaaggcagaagtaaagaaagggcaggatctcctaaaagtagaggaagcagcagccagctaccagatacatggaggactgccaaaatggaacaagttggtccagtgttgtaacgcatagatcttgactgattgttttcttcatcagatttgccacatagatttcttcattccttttctgacatagatttcatggtgtgggtagtgagaccatggagctatgcccttagctttttactgtaattgtaaatagtttgtaactatttgcgaaggtagagtaacatacatttatgaaatacagaagagaggttgttgtagaggaaaatgaatccactctactttg

SEQ ID NO: 12662 - DNA, 733 bp, Pinus taeda
  Predicted polypeptide sequence is orthologous to G2565
tgacctaaaaacgggcatgcaatttacagaggcgttacgcttacagatggacgttcagaagaagttacacgagcagcttgagacccaaagaactttacaattacagatagaagagtatggcaaacgcctacagaagatgcttgaagagcagcaaaaaacaggcagaaaaatagaatgcgaccctaaggcggcggatgaccaaagtaagtcagatgctgtgggaggctcaactccagaatgagaagttggatgagaataacataagatgacattacatgctggttcgaaaactttgatcaaccttatcagcaatacactgattcacaactgaaacctttctacatgctttgtaatttgttagcaacttattttctcaatcattacctccgtggtactggtatgtcatgtagagtatcaatctgactggcagaagtccactgactagggattggtgagactctgaaagtaatcatattgaccatgaaagtgagcattacttgaatgcgtttggggaaaatctcaaatctgtaaaagtattgttattcatctcaaaatgctctgggaatatttggagaatgagaacagggttcgcatctaaaccgtagcgaggccaggatttatgttattccaggtttttcgtaaacaaattccttttgaagctttagacaaagatgaaaggcggccatgatttacaatattgtagggtcttttctcactttttgacacgagtctc

SEQ ID NO: 12663 - DNA, 324 bp, Pinus taeda
  Predicted polypeptide sequence is orthologous to G2574
gctgaagtccaatccaaattccatggtctccttgagcagtaatagcaataataatagtaatagtttctattctgtatttggggcttcgggcctcaaattggagctcccttcaagccaatcagcggggtctgctggaagcgcagacacgccaaagtccaatctatcttttacaaatttttcctcctcttcttcttcttttcagcaaaccaactgcctgatttcagaggcggacagttttaatgacaacaactcgggactcctggaagcactactcatacaggaaacacagtgtcgtaataataataataataaagatttggattc

SEQ ID NO: 12664 - DNA, 847 bp, Pinus taeda
  Predicted polypeptide sequence is orthologous to G2575
tgtgctgcagatatgacataaaattcttacaacgatggaggaaattgggaacacaagtataaagttgcatctataagcccaattgcagcctcagttcacctgtgagaatttctaacagtaatatgtagagaatgaatatcaatcaaacctcaaatggatttgattcgatccccttttacagtttaccatatctacaaaaaaaaaagccatgaagtcccataagcaataaaaagctcataacgcattctttccttgctctcgcccatatatatatatattatatatatatttttccttgttcttgttgctatatagtaatgaataaccatgatctccagactgttctttgatttgaagggcacctctagtagtataagttgagtcaaaatttgcgcataccaggtgggacgatatcctccagtaaaccttgatcaataagtggctgctgggaaagattggtgggcattagatgagttgagtgaggctgggaattaccatggtgggactgaggcagaagatgagggttcatgcaggacttgatggacccaaggtggtgaaaattattagtagaggaaggggaagcagctgggacctggttagtactactcatcatcattgggtggggagggaatctgatcaatggcgtttgagtgaagggagaattcaatctttgatctgaaaagtgggattgggattctgctgacccacgcaatatggccaggcttggatgagaatgctgtccttcatatgtcgtaatcacaattcctggatcttctgacgaacgctccactctcttcttcactgagcattttccatttgtgcaacgatagtaactccggggaaaggg

SEQ ID NO: 12665 - DNA, 803 bp, Pinus taeda
  Predicted polypeptide sequence is orthologous to G2575
cagagttccttgtttcggatgaggaggaattggaccattcctgcgggagtgagcatgcggttgagcagaaaaactactttaacaatgtcaagcccggatcaagtatccaaagcagcgagactcaggagactataagtcctaagaagaacaggaagagaaaagcagagcgaggtgtcaaatatgcatttctgaccagatcagacactgatattttggaagatgggtataagtggcgcaagtacgggaagaaatttgtgaagaacagccccaatccgaggaactattttagatgctctgacaacaactgtggtgtgaagaaaaccgtggagcgtgatgcccgtgataaggcaattgtcgtaactacttatctgggcaaacacaatcacgaaagcccatctgtaatctattatactctcaggcctgaaatactagtccaggtaccacgccagacgaccggttcgccaatcgagcatttctcgcctgtgtgtacttatcttccagagtgtttccaacaataccaataaatgggtgatgacactgcaagataatatctagagtttttcatagaggttgtgagatttgggatccaactagtggaaattcgcaatatattagttcatgaaccggtacactgcaggtagtccactgcaaggtagttgtttgatactcacgtaaatatactttacatttgaaaataagtgtgcggtcacttcgacagattgtgtctaattggacagactgtgttcggcttatttatatgattaagaatccagtgcatctcataagaaaattaaatattttat

SEQ ID NO: 12666 - DNA, 792 bp, Pinus taeda
  Predicted polypeptide sequence is orthologous to G2592, G2713
gaatgaagtaggcattgcatccgtctaggaccccttgagcccaaaagattaaacttgtaagctacctgtccaacattataacttccagctggaactcgaggagagacttgttttgatgctacccgccgaccagctcgattgcttgagagtcgtgcgccattatgtggtggttgactatcatagatagtaaatttagtgcccaggaaatcagagctcagttttcctacataagcattgcttccttgggacagatcatcagcatcaagagagattatgtattcagtactagttggatgcctgaacctccttgcagccaatagaaatttcccattttccataaacgttggtgtaagcccgagatacaagtaatatgtggatgtttctttgcgccttttaatgaaacactgcatcggagggtcacgtgcaccaggctgcttcagagaagagggaaaagtcagcttcccactcagatcaggtgctttaacaatctccttggtaatatccctccaacttttacaaacagaggcgcaggatacgacatttttgcgacctggccacgctccctcgctctcttccactctctgaatcatttcagtcagtaactcgggaagcatgttggaccaattaacgtgctgttgctcttcgtccttctctgtctctgcctccctttgtaccatctcatccctaacactactctgagatcggcctctgtaaagcttaatttcaaagctcctcctggaaatactctccatcccatccttcatttcctgaattatgtacttcaaagccatc

SEQ ID NO: 12667 - DNA, 918 bp, Pinus taeda
  Predicted polypeptide sequence is orthologous to G2592, G2713
gtcgcagaggatgggaaactcccatacagaattacactccattgtctcgtcttttccattcaagcgttcgattgataattagttgtgaaaccgtctcaaagctgcagatgtgctttcacaactgattatcactaaagccaattaaaacaataacttagcctaaacagttcttcgtacattagtgttctctgaatctctaacttgtgaatgcaattccaatgatcatccaaacatcagtatgacaaatgaaacttgcctctgctgcattagaatctcacgtgcctccctgaaaactttatgtacatccaagtaatatacaacaaatagcttgagatcaattggactaacagcacccttacacatcatttctaataattgcctgcaactaattgttggcgcaccctctactgaaaacatcatttaacagtaacaaaccttgcaaccactggggcattgtgaacacaaggaaatgagaaaagctaagtggatgtgtataaaaaatacagtccacaagcaattaccaagcggagtggcagcagcaagtgatttacgatttatcacttgctggagttggaatgaatgcccatggctttggaccctcactattcacaggccagctttgtatcaaaactactaagacatatggcaaacgcctgaaaagctgagagtggataacgataatccatggtaaacgtgtcctttccaacttttccaaattggagtataaccttgtcatggtcactttgagctgcaggttgagtgggctcagtggctgcaacaagttgaaaatttttaacagaaggaactgtcacacgccctttgaaattcaaacaccagcattgtagctgttcatgccaccttggagctttatttttcaagagcaatggaccctccttccagttgctattgatgatgggt

SEQ ID NO: 12668 - DNA, 771 bp, Pinus taeda
  Predicted polypeptide sequence is orthologous to G2592, G2713
ggtcgctagtctagaccagtctcttgcatcttgtcctacttttggctccaagtcgtgcattttagaaagttcatctatctctgagccacttaccggtagcaacttgaaagatgaaccattggttttaaaaaataaagcgccaaggtggcatgagcagcttcaatgttggtgtttgaatttcaaggggcgtgtgactgtggcttctgttaagaattttcagcttgttgcagcacctgagcctaatccatcggtttctcagaatgattgtgataaggtcatactccaatttggaaaggttggaaaggacatgttcacaatggattatcgctacccgctctcagcttttcaagcttttgccatatgccttagtagttttgacacaaaacttgcttgtgaataggggaagatcagtcagtttgttgacaaataggctcaggttgatgcaatatagttacttaaaagtctgaaggttgggtcgtattttgtataatcatcagtgtttcatggtatttagctactagttaccacaatttataacgctcatgagcttggtgatttagaaataaggtaggcaggcttctgctacccctagttgatgcctttatgctaccagtagcaactgaaggtagcatatactgttgatgtatgaggagtcaccactcagtttcatgtggaggtgtttggcatattctgcattattgtacatagttggttttgtacatttccaggagtgcaaggcctatttatttattgaaagatacatcattggtc

SEQ ID NO: 12669 - DNA, 803 bp, Pinus taeda
  Predicted polypeptide sequence is orthologous to G2592, G2713
aggatgcagtgcacaatgcattctattccagcttcttctattcaggttggaggaaatgctccaacaccgacagaatttcctcgttcattggatgaatcattttccttacccttttccaaagaaccccttatagatttcagcagctctagcttatcagaaattccaatcaatgttgagagcaaagatgtaccgcttgtattgaaaaataaggcaccgagatggcatgagcagttgcagtgttggtgcctgaatttcaagggacgtgtgacagtggcatctgtaaaaaactttcagctagttgcttccgtggaaccttcgcagttggtgacacaagctgaccaggacaaagttatccttcagtttgggaagattggaaaagacatatttaccatggactatcgctacccgctgtctgcttttcaggcctttgctatatgcttaagcagttttgacacaaaactggcctgcgaatgagagcaatgaccttggtcctttgaagttgctcattccgtacaaaattaggatatccaggtgcagtattataagaccaattaatccgcagaatacaccaccagatacttatgtaacatgttcacaacgatgacgaggattttagggggtgataaaatcctcagtttttgcacatgggtatgtgtagcattttggaatcagtttcataggaaaacaacatgttaatgcaatattgcagattattgtcagggatcttccatgttttataacacactaggtggcctatttgtgtctctcttttgagaaatagagacacgaaactagtggctatc

SEQ ID NO: 12670 - DNA, 868 bp, Pinus taeda
  Predicted polypeptide sequence is orthologous to G2592, G2713
gcgatagatgaactttctaaaatgcacgacttggagccaaaagtaggacaagatgcaagagactggtctagactagtgaccgaaggttcaacaggagttggggcactgcctcctggctgcacagcagaagctggaatagaatgcatgatgcattgcatccgtcttggacccctagttcccaagacattcaactcatagccaatgtgagcaatattatagctaccagctggaactcttggagaaacttgctttgctcctacccgtcgacctgcacggcttgttgatgcaattgccccactgtgaggaggttggctatcatatattgtaaacttagtaccaagaaagtttgacctcaattttccaacatatgtattgctaccccttgacatatcgtctgcattaagagaaataatatactctgtacttgtagcccgcctgaatttccgagccgcaagaagaaattttccattttcagaaagtgttgtattcagacagaggaacaattgataggtagatgtagccctatctcgcttgatgaaacactgtacagagggctcccttgatccaggctgcttcaaagaaatggggaatgtaagcttcccagatagctcaggtatcggaacaagctcctttgtaatttgcctccatgtcatacaaaccccagcacatgccaccacactcttcctgaaaggccaactgctctcgctctcctcaattctctgaataacatctcttatcaactcagggggcatattcgcccacaaactgcactgcaagcctccattattgctattattcttattattcgcattgcttttataatgtaaatcgtccacagcactctgtgaacgagatctaaggaacttta

SEQ ID NO: 12671 - DNA, 1008 bp, Pinus taeda
  Predicted polypeptide sequence is orthologous to G2592, G2713
cattcggcggatttcggcaaaaccacctgttacgcggtttcgccagaggtgtttctacctgttctgctgcgcaagggttggagagcaggcatgcattctttcattcacaatggattacggtcttgatgacgaaacacagagcacttggaagcctttaaatgcttgagatccaggcgaaaatggcctccggcaaccccaaaccagcggaattaccgaccttttgagcctgcctaccctcgaatcggtcgattccgtgctgtatcggtacattaacaccctgccagcgcggagattccatctcgcatattgaagctttaatctcgtggccctttttgcaaattatgctgtttctgaaattacggggaacggaagcttaattttgaaggctttgaagcgtccagattgttcttgatgcctccgatcaagaatatcatccaggacatgaagggcggcatcggaagtatttccaagaggagcttcgatgtgaagctctcctacaaccgcagatcgcggtcacactcgcacggcgtcgcggtgacctctggtgatgagaatcactgcaaaacagccgccgatgttttgcatgagagctgctgggcgaatttgccctatgagctgctcagagatattattgagagaattgagagcagcgagatcacctggcctgcacggaggaacgttgtggtttgtgctggcgtgtgcagaacgtggagggaaattatcaaggagattgtgaaaccgccgctgctgtccggagtgctcacatttcctgtgtccttgaagcagcctggaccgaaagattctgctgtgcaatgttttatcaagcaagataggactgcatctgcttattatttgtacttgggtttggcttcaacgatttgtgaaaatgggaaatttcttctcgctgctcgaaaattcagaaaggctacaagcactgattatatcatctcgtttgatggagaggatatgtcaggggagcatacctacgtacgaaagctgagatcaaat

SEQ ID NO: 12672 - DNA, 809 bp, Pinus taeda
  Predicted polypeptide sequence is orthologous to G2603
attttaattcatcattctttcttttgccctgcttgtttgcatcaattgctctggtgattttattttgttgtttattttgttgttgtaatgtagagcaggagaattggaaaagaatgttgcccattggagtggaaggcagtgaatatgggaaaacaagattgcaacgcaggacaggatacgaacgtgccaaaggatgctcgtacaccttttggtttcatcatttggtggagtcaggttgataggccggacaggcaaagtgctggaggatgatcgtacgccctttgcttcatcattacgtaaggtcgagaggcacctgatttgtcttttatccggcgaacagatgttcgtacacctttcgcgcattaggagtaaggaaggctgcacaaatttgtatggagcgctaaaattactcttatcgttcgagctcttggaaggagccatggatacaagcctgctgaagaatatcacgagcctctgtcatgatcattaagtgccactttgtgagggacgttcaagcaattctaggatttataatgagtccagcatagaagcttccagtcataaaaatggtgtctcacacagacttctgagtacattttcggagcaagcaatcaaatacaaaattttaccaggagaaattatgcatgccagagatccccttaatttgaaatttagggcatcatcacttttgagcaacagatcagcacgatgagaagcatttcctcagctgaaacaagagttgataactatgctgcaatcgatgaacagatctattttactgatgcagaagctggccagctgatgtaaga

SEQ ID NO: 12673 - DNA, 845 bp, Pinus taeda
  Predicted polypeptide sequence is orthologous to G2694
cggcgcgcttgctgttgggcctgcagttgtgaacgtatttcaggtgtgctgcacctggcgggcagtttctcattctgaaatgctgtggaaggccctaatgcattcagtgtgggatcaaaatgacaggcagacgagtgaatcgtggcgaaaccgatatattcgccttcacagaacggcttcaaatttccgtcataatcgagcgaagcataccgcaattgaatacgacgtttccagcgattccaacagtaatggtaacggcacagcgtgcaggtgcctcgcgctgtcgccgaaccatttggcgggagggttttttgacggtgctgtacggatattctgtctcactagcaaagaatgtattagaacaatgaaagccggcgaccccaaccgtttgggtccgctttctcaagccatagccggcattgttttgcaccaggacaaggtcgtctttgcgtcattttatggaagtatttttgtaggcagcatttctcgcggggatgtgcggtgtgcacatccaggcaacgtaagggacgatggcacattggtggatttcaccgggtgcgataggtggtggataggtttatatgctgggatctccggtcacgcctgtcatatttgggatgccggcacggaggagttggtgtttaatggcggagatataacggaccccgatgcccttcggggctggcggatgttgacggagcaggcagagcgcattggtcgcgtcaagattggcagcaacggtttgttgctgttggcgacgcggttaaaggtggcagcatttgacctggaaacacatgggatttttttcagagtggaagaagaagcagatgatgagattatcgttg

SEQ ID NO: 12674 - DNA, 700 bp, Pinus taeda
  Predicted polypeptide sequence is orthologous to G2717
tagtttgttcgaacgatgaaaaccagctaaaacaaaccgcagggattggcaggattcgagcagtggtctcttggggcggagttgatagaagaagaagaaacctaccatatacacatacatatattatatacatagacacatgggggctccgaagcagaaatggacttccgaagaggagggagctctcaaagcaggtgttgagaagtatggcactggcaagtggcggaccattcagaaggaccctgagtttggacactgcctcgccgctcgttccaatgtggatttgaaggataagtggcgcaatatgagtgtgagtgctagtggccatgttcaagggataaggtaaagactccaagagtaaaagctattgcctctctgccttattcatcagttactgctgaatctacttctgtattctcaatagaagcaacaacctcaacaactccagataatcttatttcccctaaaagttcatcaaatgggaaaattcactcaccaaggtacgatggtatgattttagaagcccttacaagtatgcaagatccaaatgggatagacattgccacaatcgcaagtttcatggaggagcgacatgaattgccccccaatttcaagagggcgcttggcacaaagctaaggcggttggttgcacaggaaaaggttataaagattcgcaatagttacaagctcaaagatatga

SEQ ID NO: 12675 - DNA, 915 bp, Pinus taeda
  Predicted polypeptide sequence is orthologous to G2717
catcacgggatggtatgcaagtagaagtgggcgtttaggttttggcagcaggaattctgtcgtggcagtgaaaataatttcacggcttcagtagatgggggcgccaaagcagaaatggacacatgaagaggaggctgctcttaggactggggtggagaaatacggacctggtaaatggcgtgctattctgagagatcctatattaagctcgtgcttgtcatcacggtctaatgttgatctgaaggataaatggcggaatatgagtgttactgcaaatggttggggttcaagggaaaaggcaagactggcactcaaaagaagcaaatacattgcaaagcaatctggcaggcaacttgcgcttagtgcattgagcaatggaaatatggatgttgtggttactaagcccttgtccactgtcaatccatattttccaagctcaaataccaaaagatctatttcaaggttagataagctgattttggatgcagtcttcacattgaaggaaccaaatggatcaaacaaatctgcaattgcaacatatattgaggagaatcaatatccgcctccaaacttcaggagaatgttgtcatcaaagttgaaatcactagtaatatgtgggaaactggtcaagataagacaaaactacatgataaatggtagttttcgtccagatgatgagaaagtccccaaaaatgagaaagtggaaaagcatgtcacaacccttagtaagaactcttcaaaaaaggtggtaggggaagttgggtattgcagttaaatctgagttgatgcagaagtttctaagatgagaagatgaatgccgaagagctgctaaagcagcggctgttgctgttgctgaagcagaggcagctatagcagcagcagacaagcagcatgtgaagcagcggctgcggaggc

SEQ ID NO: 12676 - DNA, 882 bp, Pinus taeda
  Predicted polypeptide sequence is orthologous to G2717
agctttcttgatattagcaatcagttttactgtatagttagctcgcatgtcaatgagtggtacatcacaagacatgaaattaaacccttctcaatagccttcctatagaccagaagcaaatagaatatgcagaaacataaactgcaccattccatattaacctgataaattcactgagattccctaatctttgtatttacattctgctttagggaatattcatgaggatgataaccattaaatcttctaactcttgaatcttacagtctcctcaaaaaatcaagacagtgatgcatgacctcatttagaataatttcaacatctcatacatgcaaggttttatcccttcgtttgagatctatttcctgatgttgagtacttggcagatccctctcgtttgcgcttcgtgactgtgtcttgcacttgtcaacaaaatcaaatttctctaccaaatacttcttatccagaattctgttgatggctgcttctgctgccagtttggcagccttggcctcagctcgtgcctcctcggctatttgaagggctgcaacagcttgagcagcagccaatcctgcagacatttctgcagctcttgctcgatgatcagatgttattcttttctcatcgaccatgcaaacgttttgccattgactccatccatcaccgaagacaagttctcttccataaatttcagagctatccctaattgttctaccaatcgctctacaatgaggcaccttccaatcatttttttgccatgctgcttcctttgaaccagaaattctctccctaccaccagaatcttgagaatagtttatgtctccaaagcactttatgctattccaataaagttcctttttctgcgctatcaaacagagctca

SEQ ID NO: 12677 - DNA, 601 bp, Pinus taeda
  misc_feature (2)..(2): n is a, c, g, or t
  misc_feature (4)..(4): n is a, c, g, or t
  misc_feature (32)..(32): n is a, c, g, or t
  misc_feature (305)..(305): n is a, c, g, or t
  misc_feature (453)..(453): n is a, c, g, or t
  misc_feature (459)..(459): n is a, c, g, or t
  misc_feature (556)..(556): n is a, c, g, or t
  misc_feature (572)..(572): n is a, c, g, or t
  misc_feature (580)..(580): n is a, c, g, or t
  misc_feature (588)..(588): n is a, c, g, or t
  Predicted polypeptide sequence is orthologous to G2724
cnancattatggccggggggggcggttttaantaagtagacgccttctcatcatcaatttgtccccaagcctgggcgattagtggggttttccttgtggttgttgtgtgtcgtgcttatccatgagccaatatgcatataatcggcgccaccgctctccttagagcgactcgaacttcgttccacccctccatagctcgagctgtttcgacatccaatttttcttcggcatcttccccgttttctcctcgatctcagtcagttgcagccctcagagggtttccaaccggttcccaggccgtaaantctttaaatacctcgtctttcgcaggcgatcagtcgcggtttcggagcttgctagggtttcaccactggaatttaaatcacgggctcagagcgcacgcgagatcatcaagctgccgttctcaagccctgtcgaacgggaaaatgtccnaccatnggcgactgagaatgctttcaagcatattttgactggccttcctaaaactggtggaaggagagtttggaaagtattacaagccttacagctctcaatngatccaaagggacaanttatactncctttatnctgtcaaaaattc

SEQ ID NO: 12678 - DNA, 760 bp, Pinus taeda
  misc_feature (613)..(613): n is a, c, g, or t
  Predicted polypeptide sequence is orthologous to G2724
gttaaagttttaagccccttgtcagtaagcaatcagagagtcaaagcttcaactttggtgggctaattctatggcgttgagaacctggtggaaattttctgctgtgggagatgaggaggaaccaaagacgaggaaggggccctggactgttcaagaggacatgcagcatattaggtatataagttcgcatggagaagggcgccggccttttcttgccaaagcagcgggcctaaacagaactggcaagagccgcaaccttatggggatcaactacctccgacatgatctcaagcgcagcaagatcgctcctcaagaagaacgtttgatcattaaactccatcgccgttgggggaacaggcaattcctcagccaattgcctcagccttagaatacgactccgtttcaagtggtcaggtggtcccgcattgcgcagaatttaccggggaaaacggacaacgaaatcaagaattactggagaactcgaattaagaaaagactgaatctacaaactgagagcggcagcaagacattggtacagacgatagcgtgcaaactgccggctcaataggctctgattcctgcaaagcttcatctcagagactgcctggcctangatagtgtggagttttcctctagaatcacaaggcaaattccccgaggaaatagcggttcatgcttatccaagtagcggagaacattgcagggagaaaattggagagggttctcaaatcaatgaagatgcgcaacaaggcgcatcttt

SEQ ID NO: 12679 - DNA, 704 bp, Pinus taeda
  misc_feature (24)..(25): n is a, c, g, or t
  misc_feature (484)..(485): n is a, c, g, or t
  misc_feature (514)..(515): n is a, c, g, or t
  misc_feature (539)..(541): n is a, c, g, or t
  misc_feature (616)..(621): n is a, c, g, or t
  misc_feature (631)..(632): n is a, c, g, or t
  misc_feature (634)..(636): n is a, c, g, or t
  misc_feature (693)..(699): n is a, c, g, or t
  Predicted polypeptide sequence is orthologous to G2747
gaaggccaccaataatatggcagnnctcatggccatggagcatttcctagaaatcttgagggactcaaatttacacaacaccataattgacgctaattccgaattgataattaattcggtcaagataattggcaatggctcagtaccagagaaagtgtcgagacactggaggctactgcaattttatcaacatattcaatcccacttgcagaccatgaaaacccttagttttatccatgtgcgcaaaacaaccaatagattatcggatattttggcaaatgaaggtgtgctctgttccaaaagcaatataagatatgactggataaggactccccaaggacgtctatgggaagaatgctccaaacaggcggccttgaatagagagttctatcaaagcaaggaaaataggcaggatgaagactaatggagacagaggatttttggtccacagggggaaacaatatatggcaaagtgcgagcaggnngtcagatacccctctaaattctacgtaannttttcaggggggaaaatgctcctnnnactatgcacactcatggttctcgggtgagaaactataaacaggcctagtcttcacatggaccctaataacattannnnnngccttttaanntnnntggggtcgttgactcatttaaaatggtggcaagttgatgccatcgcaacaatcccannnnnnntgcga

SEQ ID NO: 12680 - DNA, 867 bp, Pinus taeda
  Predicted polypeptide sequence is orthologous to G2763
gcctgtggacgatctttctccctatctctgtgcaggaacttcacaatcgacagcagctgttttcctagtattttaggcttgttatttttctcggccattatggaagagcgttacggagatgggaaagtggtggtatggcgggccattttgcaacgaaattatttgagtcgcctggtgctcgcgctgcgccataggagaattggaagatcaattagagcctcggctcgaattcgatccgttaaattggctgcagatctgtcactggccatgaagtcagaagatcgaactgcgtggaaccgagcaatccatggaaaacacctttcaaggctccagagatctcactacaaactgcgagtagtaaaagccagaaggaatctatatgtaataaagagatcggcctctgccaaaagcgggacgaataaaaggacctctgtttggaagaagtttgccaggccgttcttccgaagggcgttgaggaggggatacaattgcagggaagcaggaggaggtgccgtggcttctcgtctgcaaaccctaaggttgctcgtcccgggaagccgtgcactagacacgcccgaccttttaaagcagaccactgactacatcgcggtccttaagaagagggttcaggtcatgcaggcactcgtagaatgctgctcaaattaaagcgccgattcgaattgccagatctaggtctaatgtatgcctgccaggtataacaagaaggtcgcaaggtccaatcttgcgctgcatgaacacgcaggtggttgtatatcgcgggaataacagaaaatattatatcgtgttgaggtggggcgtttctaaagatatgcggcaggtgatctgaataatgctggaggctggtct

SEQ ID NO: 12681 - DNA, 338 bp, Pinus taeda
  misc_feature (156)..(156): n is a, c, g, or t
  misc_feature (231)..(231): n is a, c, g, or t
  misc_feature (236)..(236): n is a, c, g, or t
  misc_feature (279)..(280): n is a, c, g, or t
  misc_feature (306)..(308): n is a, c, g, or t
  misc_feature (335)..(335): n is a, c, g, or t
  Predicted polypeptide sequence is orthologous to G2783
agagaaatcgacattctcacttcctgcgaagaagacttcggctccaggaactcctttacttctttgctcaactcggcggtcccgcctgggggaccgtccgatccgccggccgccgctccgccttccttgcaacaaacattattcgactcaattgcnagctatctcgacaatatcaatcccagggccgtagccgccgcctcgtctcatgtcgaatctcagcagcagctcagnaaagncgcctgcttcagacgtggtcccggggtcgaatcgcacgagctnnagctggagatggagagtcacagcaannntagcagcagcgataataatatctcgcnccc

SEQ ID NO: 12682 - DNA, 706 bp, Pinus taeda
  Predicted polypeptide sequence is orthologous to G2789
ccctaacgcgctcagagcccacgttatggaaattgccaatgggtgtgatgttttcgacagcgtggcgaattttgcacgccggagacagcgaggtatatgtattctaagtggcagcggcacggtcacgaacgtgaccctccgccagcccgctgcaccgaatgcaattatgaccttgcatgggcgctttgagattctgtccttgtccggagcctttttgccccctccagcgccccccggggcaaccggccttacaatttacgttgccgcagggcaagggcaggtgatgggaggaagcgtggtgggttccctactggcatctggttccgtgatagtaatggccgcctctttcatgaatgccacttatgagcgtcttccgttagatgatgacgaacccatcccaatacagcccccgggttcggtttctcagcaacagcagcagcagttagcagatcaatccaacatgcccctatataacttgcctccaaatttggtcaactgtcaaatgccatccgatgtttatgcctgggcgcccgcgcggcctcctttttgaggctctacagttcgataaattatcaccagtgaacgaatttttgtagttgttacttctttgcattgctggtgcctgtgtcaatggactggtcaaggcgggagaaatatcgaagtcagagctgccccactttctcttgctactgctgcgatggaggat

SEQ ID NO: 12683 - DNA, 953 bp, Pinus taeda
  Predicted polypeptide sequence is orthologous to G2789
acaacatatatttgacctggcccagcgccccagcgcagcccagcccagatcaaatctatgcagatgcttgattagccttctcacgtcctccccacaatccaaaactttcttgctgcttcagatgaagccaggcacatagattcaacaccttatctgtgatttgttttggttcttgatctgacagtgacagataacaatatattttttggttggtttctactgtgtgtgttgattcagaagcaatagggatagagaaggggaggggatttttagaattgtgaaaggtacagaaaaggcggcatattggagtccagaagaagaaagggaagggatgatggcagagatggagatggaatgtgcaggcagctgaatgtgaagaaaaaggaagagttgagctgagttgagtggtggtggacggggaatgtgtcaatggtggggatggatccaggagcaccatcaggtcatgctcattccctgccacctccgttccagacaagagacgtcttgcacggttcagaggatcatgatcacaacaacgggcccgggagggggcagaagcgcgaacgggatcacaacgggaagtcagggttgtcaccggaggcaggcgatgaaggcgacccgggcggcatgagaaaaccgagagggaggccaccgggatccaagaacaagccgaagcctccgataatcataaccagggacagcggcaacgctctgagagcacacgtgatggaaatcgccaacgggtgcgatgttggcgagagcgttgccactttcgcgcggcggaggcaacggggagtctgcattctcagcggtaccggtatggtgaccaacgtcacgctccggcaaccggctgcaccgggtgcaattgtgaccctccatgggcgtttcgaaattctgtccctctccggttcatttctgccgcctcctgcaccgccggggagcaccggggttga

SEQ ID NO: 12684 - DNA, 901 bp, Pinus taeda
  Predicted polypeptide sequence is orthologous to G2789
gccctggcaaaaggtggttggctgggaatgtggcgttgcccggagtcgatccgggcacgagtccaggcctggggcttggacatgatcccgggcgagggcatggccgtggtctgcaatacagggacttgcacagttccgaagacgaaagtagcgaggatagcggatcgaagaaacgagggcgggacgacaacaataatgacaacaacaatgccgccggcaagtctcaggaagatcaagacggtgggggcgagctgggccgaaggtcgcgcggccggccaccggggtcgaaaaacaagccgaagcccccaataattatacaccaggacagccccgatggccttgcagctcacgttctagagattgccaacgggtgcgatattggggagagcttggccactttcgctcgaaggcggcagcggggagtctgcgttctcagcgggagcgggacggtgtccaatgtcacgctgaggcaaccagccgcgccgggcgcgatcgtgactttgcacggaaggttcgagatcttatctctttccggctcgtttcttcccacgccaacgcccccaggggttacaggcctcacaatctatctcgcaggcggacaaggacaagtcctgggcgggagcgtcgtgggcgctctcgtggcctccggttcagtcgttgtcatggccgccacattccgtaacgcccctttcgaacgcctgcctctcgatgaggacgacggaccgttgccgatacagctccagcccccgggtggactctcgcagtcatctggtctggcggcgtcgcagcagcagcagcagttgccggatccatccaccatgcccctctacaacgttccccccaatctgctccccaacggccaactgccccatgacgtctacgcctgggcacagcatcagcg

SEQ ID NO: 12685 - DNA, 932 bp, Pinus taeda
  Predicted polypeptide sequence is orthologous to G2789
cctggcaaaccggtggtgggcagggaatgtgccgatggggggagtcgatccgggcgccgggtcaggccccgggtctggacatggacatgggcatgggcatgtttctggtcccgggcatggccacggtctgcaagccagggacttgcaaacttctgaagatgaaaatagtggtaacagcggatcgaagaaacgagggcgggatgataacgacagcaacgccgcgggggccaagtctcaggaaggtcaggacgggggggcggagatgagccggaggcctcgcgggaggccgcccgggtcgaagaacaagccgaagccccccataattatacaccaggacagccccaacgccctgaaagctcatgtaatggaaattgccaacgggtgcgacgttgccgaaagcgtagcgacgtttgcacgcaggcggcaacggggaatctgcattctgagcgggagcggaactgtcacgaatgttaccttgcggcaaccgggcgcgcctaatgccatcgtgaccttgcacggacgcttcgagatcttatccctgtccggggcattcctgccaccgcctgtgccgcccggggcaacaggcctcacaatctatcttgcaggcggacaaggacaggtcgtgggagggagcgtcgtgggcgcgctgctggcctccggtcctgtcgttgtcatggctgccacattccgtcatgccccctatgaaagactacccctagaagaagacgaggggccgccgatgcctatgcagcttcacccccctggaggactttgccaatcacccaatctgactgcggtgcaacagcagcaacagcagcaacaacaccagcagcagcagcagcagcagatctctgatccatccagcacaatctacgttcccccaaatctgctctccaacggccaactaccccatgacgtctacgcctgggcac

SEQ ID NO: 12686 - DNA, 909 bp, Pinus taeda
  Predicted polypeptide sequence is orthologous to G2791
ttttgggcaaaggtctcactctgaagacaaaatgctagccagagaaaatagatctggagatactgagcatgatgatcttcaagggacccttttgacatcttatacaggaccacaaggaggtcagacagtgctacctagaactccaggggcacaatcccatcaacagaatcttagcacacaaactatacaatcaggtgaaggaacttctctacagcagtatggaaaccattcagctgtttctcagctgcagtctggggctggtggtggcaatgctgcaaatggagctgcaaggccacgtgtcagggcacgtcgaggtcaagctaccgatccacacagtattgctgagcggcttcgcagggagaggattgcagaaaggatgaaatctttacaagaacttgttccaaactctaacaagacagacaaagcatccatgcttgatgagatcatagagtatgtcaagtttttgcagctgcaagtgaaggttttgagcatgagtaggcttgggggtgctggtgcagttgcacctctgattgctgatgttccatctcagggatcaggtggtgtcatgtcaacagccttgggccaagcaagtgggcccttgactctgtcacaggatggtcttgcttttgaacaggaagttgcaagactcatggaatcgaacatgacctcagctatgcaatatttacaaaataaaggactttgtttgatgtccattgcacttgcaacagctatatcaagttcaagtggaaagcctgtactggctactgtgccaggaacaggtgttgatagtagtgagaagcaaaattctgacatgcaatccattgtcttaccttttagtagcagttcaacaaccatgggactcagagctactgcatctggcagtgacgcccctataaatgagaattcaat

SEQ ID NO: 12687 - DNA, 539 bp, Pinus taeda
  Predicted polypeptide sequence is orthologous to G2791
acctttacctcgaagagaatttcagagagccgacaggcctaatccttaagaaaggagctctgagctctgctgcttacaattttcgagattaaaacgaatggcggtgaccgtgcaatattgtattccaggaccaagtacttaggacagaatcaggtcacgagtggctccactccacaatacgatgttcatcgttttaatcacaatacaagtttgttagtccaagtaagtgcgctgctgcagacagtggggcacccctcgtgggctttgactgcctgtcatactgttccctccttgctcctgctcttgctctcgctgggctgtggtgagttactaacctggttcgacccacaagggcttctcactagggcgttaggccgcatggatctgccagatattgtggttgcaagggacagaggcatgagacacaggcctttgctttgcagaaactgcattgctgaccccgtgttttcatccatcagttttgctacctctccttctgttatggacgatccctcctcatctctgcaaatattatcagt

SEQ ID NO: 12688 - DNA, 876 bp, Pinus taeda
  Predicted polypeptide sequence is orthologous to G2791
aaggtacaagaaccaacagtagccagaactcttctccagacggtctagcattaacagaacgccaagtagcaaagctaatggaggaagacatgggatcagccatgcagtatcttcaaggcaaaggtctctgtctgatgcccatatctctggcctcagccattaataactccggtgcgagaccccaggcaccatccaccccttctcttcaagggctattgccacctaatgccaacgacaggcagatactggaaccctcgaactcggcactctccgccctcacgtccacctccatgaccatacagtcatccatcagctcgcctgggagtggaataacggagcaaggtgataatgcacacaaggcagggaacggaacaaggaatccaaaggattccagagaagccaattccgttacgaagtccaacgggataggaggcccagctctttccaagaacgccgttaaaggagaggacgaacctcaaaggaggacgggccagtaaacagcaccaccttgctaacggaaactgtaccatacttctattaacgccagattgcatgaaattgttcaagcatacgaaatttacttttcacatgcttcaacaatttctaaatagtcgtagtcgcagtcgcagtcgcagtcgctctatgggagagcattcattcaaaaatcccaaaaacacacttcaaattttcctttctcctgaagtttggtgtttatttttattgaatgggtaaaagaatcgagcaagtctatcaaaataaggcacgcgccccactttgatgatgccttatttacatagacttgcataaatatgacattatgtatggttgacccaagcgctttgttaatcactacgtaagttatatcttaagttggat

SEQ ID NO: 12689 - DNA, 875 bp, Pinus taeda
  Predicted polypeptide sequence is orthologous to G2791
cggccggggaactatatcgggagcttctgattctcgggtagcttgtgatacagaagctctgtctgtctcgggtagccgtatcacaagctttgtaagtctctcggtagctttgtaagaagagaattgtttcgggtagctgtagtctctcgggtaacggaaatcatttgcaaactggtggagaagctttgaatggtgctccaaggatccgtgcaagggctcgtcaaggtcaatctacggatcctcacagtgtagctgaacggcaacgttgtcagagaattgcacaaaaattgaaagctttgcatgaccttgttccgaatgctaagaagactgacagagcatcaatgctggatgaaataattgagtatgtcgaacttctgcagatgcaaataaaggttgttccccaatctcttgcaagattgaatttctgcagcctattataagctcagtgcttgttctcaaagctcagctgttctgcaggttgtgagcgccagtaagcttggcagtgttggttcgtttgggcctctaactccgaatgttgcagctgaggcatcagctagtctgcttcaacctggtggctcgctatttgacgaaggccgagagtttgagaacaatattgtgaagttcatggagagggatatgaatggagctacggagtactggcaaagtaaagggctcgatttgattccacttgcacaggcaagggctctctttgattcgatatctaatgaagtcgtaacctaggggggctcggatcatctcggtctcaggtttctattgacaaactaaacacggaactaacgctagttgttcacgtgttcttggaatgggatctgttggatctggcagcgatttaagttcaaagggaaacgaagcga

SEQ ID NO: 12690 - DNA, 869 bp, Pinus taeda
  Predicted polypeptide sequence is orthologous to G2834
gcgatgtagggtttgaaggcgggatcgatttacaggaggagaaatttgtcgtcgacatcaaaacaggggttgaagaagaaacaaattcgccggacgataggcgttacgagatcatagagataaatgaggatgatattctggcagagcacacgcatttctgtgagatctgtggcaagggtttcaggcgcgatgcaaatgttcgaatgcacatgcgagcccatggggacgaatacaagacgaaccaggcactaatgtcaaggccgccagaacagggcatcaagttgcccgcggatgcttcttctgccccgaaggcgaggaggtattcgtgccccttcgagagatgcaggcggaaccagaaccacctcaatttcatgcctctgaaatcgataacttctctgaggaaccattacaagcgtagccactgcccgaagatgtatacctgccacaaatgcaacaagcagttctcggtcgtgggagacctcaaaacacatggcaagcactgcgggcacaacccgtggcggtgctcctgcggcaccacgttcaccaggaaggataagctcttcggccacgttgccctgttccaaggccacaagccgctccttcctgaccaggaattggctcgctctcctgcacccaaaagactcaaggccaccagcaacggcggggcaactacggcacagtctgccggagacgacgatgatggaagtatcgctgaatttctcactggagatttatcaggtctggctgacaacaaatttcagggcatcggcactggggacgatgatctgttctttgcaccgaaagtgagtcagatgggccatcggcaaaacgaagtgccaattgagagtcggttctcggaatctgacttt

SEQ ID NO: 12691 - DNA, 827 bp, Pinus taeda
  Predicted polypeptide sequence is orthologous to G2834
gcggcaagggtttcaagcgcgacgccaatgtccggatgcacatgcgagcccatgggaacgaatataagactcaccgggcgctcatgtcaaaaccctcggctccctgtccagactccccgaggaggtattcgtgccccttcgaaagatgcaggcggaacaggaacagccgcaagttcaagcccctgaaatccatcgcctctttgagaaaccactacaagcggagccactgcccgaagatgtatacctgcaacaagtgcaacaagcagttttccgtcgtcggagacctgaaaacccacgggaaaatctgcgggcacaattggtggcagtgctcctgcggcaccacgttcactcggaaggacaagcttttcggtcatgtcagcctcttcgaaggtcaccatcccgcgcttccttctgatgatgccactgccaaatcggaagaggaaaacagcacccggtgcaacgaaaattggccagattattttgtgggaaatgcagcaggtgtcggtaataataccgagggctatgccaattcctgcagcgatgagatgctgcttctcgcgggatcgaaccagcagaacgacaatgacggtaggttctgtaaatccgacgtcttttggggaggtttctcaggctagtttgtttggttagacaagaataatttcctttgttttttttttttttctttgtggatttttgaaaagtacatttctctgtgggtggccgacagcatcccaaggcttgaatctatatatatccctaaaaaaaaattatgtatatggctcataatgttttgataataatataatatatatttaaggttaaaagaa

SEQ ID NO: 12692 - DNA, 844 bp, Pinus taeda
  Predicted polypeptide sequence is orthologous to G2846
ttcatatatggcatgctcagcttctgcacttgttcgtgtagagatttaatatacacaatggcttcccacaagacagatgcagtgtcagtcttgccaaagggcgaaaccagttgttgtaacgctgtaattctgtcccctagtttttctttccttaccttgaaagtgggaagggtagaattagtattatctagacgaggccttttgaagatcgaatccgacgaactgctatcagggctgcttctctttgcatcatttgttgcatctcgagcttcatcgcagcggggcatattaagcgattgggtcgtgttattcagttgcttcccttcctgcaggaattgtggcgagcagtattgtagcgatgaggcgcgatctgtagaatttgtggactgctgcatcttttctggtgtggaggccatggagttccacagtggaatgtttctgctgttagtcaagagcctcgaggcaggttgcttcaagggagaagagggcagaagtcgagagagtgcagcaggaaacgtcctagaactgtaggtattgctagatggccacagcccatgaggctgttgatgatgatcctctcctctcatagaagttgcattgtgaaagccatgagcagtggcgccttttagaaatggttgattcagtgggaagtccagaatacgtaaaagctcttcgttactgcaaggatccgatctgaatccttgggatactagtgtacgaggagcatctaatcctgggttgtcatacgacatgttaaattcctgctttactctgccgatgtcaaagtggggtatgggcaggtctagtctggaattgaaactattgatggggacatgaccaggag

SEQ ID NO: 12693 - DNA, 215 bp, Pinus taeda
  Predicted polypeptide sequence is orthologous to G2847
cggccggggcacataagtgcatggcttgttcggtggggactgtcggctgctttgcgccccactcgagttcgattctcgttgatgtggtgttgcgcgctctgcagctatttccgaattaatatataattgatgtgacatgaatgatgaaatgatatgtaacatttgtactacgggccttataataaagattctttcagggaacttagccccccttt

SEQ ID NO: 12694 - DNA, 848 bp, Pinus taeda
  Predicted polypeptide sequence is orthologous to G2850
cggccgggtgatcgtcttcaaagcagcaactctcatgcattgcctgatataggcagatggtccgtggcccaacccaaacagccgggccatgccttaccccgaaacattagtctcaacacagcgtacagcaataccccgcagttcgatctgagcagaatcaagcaagaatatcccgtgccttacaccactcccgacctaggggtttcactatcttccaacgcaccgcttcttcaaggctttggaattcatgcagaccccaatttcaaaaacgagggcttttgtcacattctggaatctcccaccaccaaggcatttcttaaaccgggcatgggcgctgcccgtggctgcccgatttccggggatgattatccaggccggtggctgccaaatagcagcctgtctcagatgctaccctcttcaccctccaagcaaagtgtgctgaattttggtagcatgagcaaacaagtcttggatttctctgcctgcaaatctgatcatttaaagactgtacagcaggtttcgaaaacagactgtaatctgcaatattttcctgatgggaagcaaattcacagccctcatgcccaacatcgaacaatgccccatggcgaggaagctcgagattcaagcagtgacacaaagaggatcaacaactgcactgatcagagcacagcagatcaagcaatatttaaaaggccccgtctagagactggctcaacgattccaacgttcaaggtgaggaaggagaaacttggggatcgaattacagccttacaacagctggtttctccttttggcaagactgacactgcatctgttttgctggaagccattggatatattaagttcct

SEQ ID NO: 12695 - DNA, 973 bp, Pinus taeda
  Predicted polypeptide sequence is orthologous to G2854
tctcgatcgaaatctgcacggcctgtatacagtcttagcacattcactgagctgccataggtttcttggaactcttttttccgcggctcttgcgagtttcacaggtttttgtttgattgtattttgagggtttttctttcttcgagggttttgttttcccgtttttgtccccttattctttcaagacatctcagaatgatgcagccagccgtcggtgttgctcctccccctcctgttgctgcacccgcaatggatccccagcagcagcaacagcaatggatgatgatgcagcagcagatgcagcctcagcagcctcagcctcagccgcctcctcaggctgggttttggccccagcaacaccaaccccaaccccagcatccccaatcgcagcttatggctcagcaatacccgcagcagccgacctcagctgacgagattagaaccctgtgggtcggagatttgcagtactggatggatgagagttatctgcatggctgttttggtaatagccaagaggttgtttctgttaaaattattcgcaataaacagactggacaatcagagggttatggctttgtagagtttgcaagccatgcaggagcggagagagctttgcaaacttacaatggtgcacagatgcccaacactgaacaattttacaggataaattgggcaacctttggcattggagaaaagcggcctgagattggacctgattatcctatatttgttggagatttagcatctgatgtgacagactatttgttgcaagagacattccgaactagataccaaactgtaaaaggagccaaggttgtcactgatagggttacaggccgttcaaaaggatatgggtttgtaaggtttggggatgagaatgagcaagttcgggctatgacagagatgaatgggggtgttttgttcctcaagacctatgcgaataggtcctgccacaacaaagaagaccacagtt

SEQ ID NO: 12696 - DNA, 753 bp, Pinus taeda
  Predicted polypeptide sequence is orthologous to G2869
gaattcgattctgtgagctataggttttgctttgctgcattgtgcttgtaatcgatttacctgcggcagatcggttgcgttcagtgcaattcttggacaacagaggcttctgccagctttttatgaccttgaagaaaatattgggttgctaagggttcaaaatggttttattagagtgatgattattcttcctgtcagttccctgctggatcagtttggtttggacagaaccctcgcccaactgattttcgcttttcttgatcccttctggatttcttccagtatagcaaatgaaccagttatggattatcattacccgtttctgggatatttagttatggattagcattgtcctttggtcagtttgatgatgtctgcatttatccctgatgttctgctcacttcctgtttcaatcccaagaatctcagatcatcataacttcatccaattttgtcatcatcatatgtctgatatcagtccatcgttttctgcatgcaataaaaccatggacattattgagtttgtgcctaaatgaaaaatggctcgtcttacagcagaaacccgtgtctttaaatgtgagatgcctcgaatttgtggcatgtctaggctgctcaatataaaaatgggttttgcatttttggcagatcagggggagctgtagagtcctgtcaagctcttatacgggaaatttgaggatgcttattagcatggcattgagtctcaaaacggttttgagatattaagatctttag

SEQ ID NO: 12697 - DNA, 807 bp, Pinus taeda
  Predicted polypeptide sequence is orthologous to G2888
caagcacatctcaagacctgtggaacaagaggtcattcatgtgactgtggtagagtcttctcaagggtggagagcttcattgaacaccaagacacttgcattacagcaaaagagagagcagcttttggattctgcatcgatcagccaagcttgccatctctaacggccggaaccaggagttccaacgatactctcagcgccaccaggtctgggcattcgtcgttaggcatacaattcgattctggtaggcttcatgagcaagcagctaattggctgaatgtggaactgcgagagcttcagtttcttcctgtcaggcaccagtctgatactctcgaaacatcaagacggcagggtcacaacgcagctgccactgtaacgagagatcatatcagaagccttgcatatgagccgaggtcaaatctgtctacctcacctcccaaagaacataggtttatggatgacacgtctggaagtcctttaagattgcagctctctattggactctgctctgatacttctgcaaacagtgaaaagaagtcatatgtaaaatccgatcaattcagtgctgttaacgaaaggcagcgaagtcatagggccggaattcaaatagccctaggactcactctttcatctaatgattcattccctggagataataacatggagagtaactatgagtgattttttgcatagtttattgaaaccactagaccattacgaaggcaagcattcacctggtcagtggaaaaataagttgagcttactggaaacactctggcctagtcacatggtaatatatgacatcag

SEQ ID NO: 12698 - DNA, 863 bp, Pinus taeda
  Predicted polypeptide sequence is orthologous to G2964
gaggcacgagcgagggagggctttttctacgtccctggcgccggctgctgctactgatatctatctacatttgggggcgtccctggcaacagaagaagtcgcgagcaaagcgatagaaaaggaggttctgtgaaaaagtggtggcaggcggtcgtcaatggatcctcgcaagaagcccaaaacccaactccatcccaacgacaatggagatgcgaaccccaactccacagaaaaggagtcaatatcaactgctttagggagtaaatcaaaggcatgcaccaagtttttcagtccatctggatgcccatttggtgagggttgccattacctgcattatgttcctggtggagtaaatgctattcctcagatgccaacactgggaaacacttttgcagcaggttcgaggaaaacagtagggcttacacctggtgttccatctttagacaagccagatcctggactaggctacaagacacgcctttgtaatcgttttggcactgacgaaaaatgcatgtttggagataagtgccattttgcccatggagagaaggaactgagaaagggaaatttacttgcaaaagatcttgaaagggagcgaatagcaggtcctttcagcagcatagctgcctctgctgatctagagggaaagccaggaggacattcactataccgtgatcctcctcctggaatagctgctgctgcaaattttggtgcttcatcaacagcaaaaattagtattgatgcttctcttgctagttgtataattggtaaaggtggtgcaaacacaaagcaaattttccgcttaactggcacaaaaatgtttataaaagaacatgagtctaatcctaatttgaagaatgtcg

SEQ ID NO: 12699 - DNA, 262 bp, Pinus taeda
  misc_feature (36)..(40): n is a, c, g, or t
  Predicted polypeptide sequence is orthologous to G2967
cggccattatggccggggtaaatggaaacattggannnnncttggatctttggatccttaaagtagttgtgggaaattgaagccatttgttgtacccaactcatgggaacttaaaaaaatagggagaattatctgttaggacaacgtggaatgatcaacacacttcctcatgtgaaatattgttacaacaattctctgtttttaaatggcaacctgacttttattaaaaaaaaaaataataaaaaaaaaaaaaaaaaaaaaa

SEQ ID NO: 12700 - DNA, 753 bp, Pinus taeda
  Predicted polypeptide sequence is orthologous to G2981, G2982
ccatttgggctccatgatgatgcatatgtactgaaagaaatgaacttttgtaaaaggccatttagcactggtgtagatagtggccatgaagattgctgcaatggaaccgcactcgctgaatgcaagtcacctgaatctaatgtgtgccagaatctcataccatctcattctccattgccgagtgttggagcttcctatcctatgtcttctactcctgggagaacgtactctactccacctgttccaggcatattaaaagctcgtgtcaagcatgaaaatatgacataaatgaaaccaggtgttgcttttgtgtaaatgcgtggctattgtattcaccacatgaagtacatacaattgatgatttcctgccattcattgaagtggagtcttcagtgattggcagttaacgttatggattgagcaatttccacaatatggttttctaccagaagctaccgagtgcatgtgtcaaatggattggtaatcttttgttacatcaaaattgtagagctactttttctgttgagaaagttcacgagtatgccatgaataggggaacatagctatgaaatggggaacatagctatgaatagttatattgcaaactgaaaaacaccatctgaacattgcagaatgcataatgataagctatctgacatttgagttatttatggtcctatgaattgctgaaactaccgcatagactattgcaaagcaatgtctcagtaattaacataatgccagactgcacag

SEQ ID NO: 12701 - DNA, 729 bp, Pinus taeda
  Predicted polypeptide sequence is orthologous to G2989
cacactaattacataaaataagcttatcacagagtccattccaataaatactcggtaaaacatccagagaagaagtcgtttaaaaacaatacaatagcaaaggggtcatctccctttcaaaccctattatgttgaattctagataaacccaaaagaaaacagaaacacgaattcaccaatccatcatacttcaaggcaagctcatactgttcctcttctttttaaattttcttgatgttgttcacagcataatcgtagcagcttgaagctaaaccccaaagccacaagtcttgacaacctgtggaagggtggagagggttttccttctgttgacattggagggaaacctaaaggtgttaccgtcaatttactctggtgcaagctcatactgttcctcttctctttaaaggttcttgatgttattcgtggtagaatcgtagcagctcgaagctaaaccccaaagccatggatcttaacaacctgtggaagggcgaagagggttttccttctatttacatcagagggaaacctaaagttgttaccatcaatttacagtagaaggtagggatgtgagtgttttaagggagagtccacctgctctgagggactccatggaggctttatgtacacatgcagctatgtcgaatggtaggggcaaaatctagtcgcaagaatgctccctctacagcttcctcgtgccgaattcggcacgaggcctcgtgccgaatt

SEQ ID NO: 12702 - DNA, 854 bp, Pinus taeda
  misc_feature (62)..(63): n is a, c, g, or t
  misc_feature (70)..(71): n is a, c, g, or t
  misc_feature (78)..(78): n is a, c, g, or t
  misc_feature (825)..(825): n is a, c, g, or t
  Predicted polypeptide sequence is orthologous to G2992
ggcctgtgctcattccctttccgcctcttctctgcaacagctcgtaacgagagcaacaaggnncgacagnnggagcancgataactgtacacctgaatggccaatgctggactgaagcgaatttgcagaagacacctttctggaaaatgaaatcaaggcggagagtggtcgcgggttcgattcaagccggatgctgaaggcagcgtaagagacgaagcagcagttatgttttgcggcggcgacggtgagggtttgatgctcgaacagagggcactggggcacatgatggatctgggaaacacccagcatatgcctgtttcgatgtcggcaccttacggtgtgtatcccagtggcaacggcaatggaaatgccgccatcattatggtgctcccgcacgacgagagctcctccaatcccttaaatcctcaaaaccctataaaccctcgaaaccctatggaggcggcgtctgcaccgcttgctaccaaggttctgcgctacagagagtgccagcggaaccacgcggccaacatcggtggccacgccctcgatggttgcggggagttcatgcctgccgaagacgacacgttgaagtgtgcagcctgcgggtgccaccgcaacttccaccgccgagaggtagagggcgacgagcaaccgccctccaactgcgagtgctgcctccgcaagaagcgtggcggcggatcctcgtcagggccgggatcccctgctgccccttattaccccctccctttgccccacggttcctcggctccccatgtgctcatggcgctaagctctggtcttaccgagtccgatgaccccgatggncatacccacaacaacagtaataataacct

SEQ ID NO: 12703 - DNA, 888 bp, Pinus taeda
  misc_feature (14)..(14): n is a, c, g, or t
  Predicted polypeptide sequence is orthologous to G2993, G2994
gccgcaagcacgcnggatggaaaaccgcctgaaaaaggatcagaaggcagaaaaacggtgagatacagagaatgccagaagaaccacgctgcgaatctgggcggacacgtcatggacgggtgcggcgaattcatgcccagcggggaggaggggacgccggagtctctccgatgcgctgcctgcgaatgccaccgcaacttccacagacgggaagtggagggcgaggaggcccaaaccgcctgcgacgtttgctatcacaagggactcgtctcgggttcgaatctcatcccgctgtcgttcccaccgccggccataggcgttcttgggcgggctctccctcagatcattgcggccgcacccgtcaataataataacatgaggagcagccccgcgtttgcgccctcgccggagtccgaggaacaggcggacggaaacttgccgtcggggaagaagcgattcagaacaaagttcacgcacgagcagaaggagcggatgctggcgtttgcgcagagagtggggtggagactgcagaaacacgaggaggctgccgtgcagagcttctgtcaagaagttggcgtgaagcgacacgttctcaaagtgtggatgcacaacaataaacacgccatggccaccaagccccacgctgacaacaacaaccacaataacgacaatacggccgcggctaatagcagcagcaataactcaaccccataaaaattttcagtaagctctgttatttcgctcccatcttctcaccagagttttgcttcttcaggcttccaaatattcgtcctgcaggcaataaatctatatattttttaaagtatatattgacactgatgatgtcaatactaagatacttgctatttttttttcttgctccaaaga

SEQ ID NO: 12704 - DNA, 864 bp, Pinus taeda
  Predicted polypeptide sequence is orthologous to G2993, G2994
cggccgggcagactgcagcagatttacggcaagagcctgggcatcgtggagggaatgagcccacctgaagatctcaggtctcaggttcaaggcatgaggcccccccatcatgttcacgaaacaacagcagcagcaacaaggcccggccctcctcctcctcctgtacatgaagacatgaggactcaacagcatcagcagccgcagcattacccacaagagaataataggaatgctgataatatattgattaaggctgttaggtacagagaatgcaggaagaatcatgctgcaagcattggggggtatgcagtggatgggtgtggggaattcatgccgagtggtgaagaggggactgcgggggctctgaagtgtgcagcctgtaattgccacaggaattttcacaggagggaagcggaaggggagaacaggtgtgattgccatcacactcgtaggtgatgggtttttagggttagggttttaggattggagaagcattatctttgtttattttgtattgggtttattgttattgatgttgttgattgaagaacttggtatattttatatacggggaaaatagggaatttcttcaattgggtttttgtttctgttgtgatgtcacaaggtggataagtgctgaataggttttttttaattgtgaatggatatttataagacttctgttatatttcacggtgaaatttttgcattgaagaaacaaagttaatacgtgatgatattattttattgatgtaactgtcaaagccatcaatagatattgtatagcatgctaggtacaaacactttggtgcatcttgattgctgatcatcttcggagcctttgggcacgttaaatcatttttc

SEQ ID NO: 12705 - DNA, 841 bp, Pinus taeda
  Predicted polypeptide sequence is orthologous to G2993, G2994
cggccggggccaatctcggttagctatggccccatacatgagtcttccaagctgaaaatattgacaccaggtggcaatggggctgccgcttcagatgagcagcagcaacaagtacagcaggcagcagcgaagaaatcggtgagatatagggaatgcatgaagaatcacgcagccagcattggaacgcatgccattgatgggtgcggggaattcatgcccagtggggaggagggtactctagaggcactcaaatgtgcagcttgcaactgtcacaggaatttccacagacgagaagttgagggagaaccaccgtgctactattgctataatccaaggaaggatggcagaaagaggccttctggtggtagtcccttgccactggcccttccctctactagtccttctggggtgatcaccaggccttctccgcagatgataatggccttcggctccggacccactcatgaaaacgatcagcaggagcatgacttgggcagcctccatgggcttcatggagctcaaatggcgatgcccattatgaagaagaggttcagaaccaagttcacgcaggagcagaaggacaaaatgtgcagttttgcagagaagctcggctggaggatccagaaacatgacgaggcagcagtccagcagttttgcatggaattgggtgtcaaaaggcacgtactcaaggtgtggatgcataacaataagcatacactaggaaaaaagatttgaaattttttatgttctttctcttccttcttccgtgctgatcaaacttgtaggacaacttcctttcaatgaatgtcacatgacagacttcttgtttcaatgttcatga

SEQ ID NO: 12706 - DNA, 796 bp, Pinus taeda
  Predicted polypeptide sequence is orthologous to G2997
cccagtggcgaagaaggcaccttggaagccctcaagtgttctgcctgcgattgccatcgtaatttccaccgcagggaattggagggggagccttcttgtgattgcaatttccgaattagggatcagctcagtcgcaagaggtctggagttctagtctcgtcgcgtgcagtacctggcactgctgctgctgctggccctccggatccctttgtttttcctccgaacaatctgctcccgcggctgccttctcaggcgatcatgtcctacagcaccgggccctctgaatcggatgagctggagggcaccttcctgtcacgtcccgccattctcaagaagcgtttcagaaccaagttcacgcaagagcagaaggatagaatgctggactttgcagagaaagtggggtggagaatccaaaagcatgatgagcaggcggtacagcagttctgtcaagacattggcgtgaaaagacgcgtgctcaaggtctggatgcacaacaataagaacacgttagggaaaaaagaatgattaattgcaggcttatctatgattttagagcataacaaacacttaggcaatttgctcttattgctcctctaattcctttctaggtatgcatattatgtagtagaacagactgaactgacctctgtaagactcatagctagcaatgggctgcattcaaagtagtatttttcagcgaacaatatcaaatctagatcagtacgttacacatgagatcttattttactgttgtctggactttggtgtatgaattgatttatgttacacattcctg

SEQ ID NO: 12707 - DNA, 937 bp, Pinus taeda
  Predicted polypeptide sequence is orthologous to G2997
acggcaatggctcctcgaagaggcccggcggcgcgcttcacctcccgttgcccggtccccatgtacccctggcgttgccctccagtccgtccgggatcccgcgcacccatccgcagatgatcatggcgatccgcgacgtcggtggcgacgaccacgatcacatgatgggcggcgccggtgctcacgccatgtacatggctggccacgctatgaaaaaaaggttcaggaccaagttcacgcaggagcagaaagataagatgtgcgccttcgcagaaaagttgggctggaggattcagaaacacgatgacctggcagtccagcagttctgtatggatgtcggcgtcaagcgccacgttctcaaggtttggatgcacaacaacaagcataccttagccaagaaaccctaattattcatcaccaccatctctttacaaatgcccagccacaggtccaaggatcgaacctcgtcgtcactcaccctttttcaggcatgcgaacagaccctctatttttctctatgtttctgaacgcctgctatagcagacgcccttgtaagtcccaacccagaaaagacaacgctgtgtttttttttcttttagccttgatgtcttagctggtagattttaagctgacttaaaaacacacagaactttctttacattctcgcccatgatctacactactggatcatcctacatttttcatttaacccaaaaaaacctctcctagtttttcagatttctgtgctgatcatggactcttttagctcactgctcataaatataaattcacctcttctaccaaggtcttacaccagtgctttcactgcttttcaaatggtattttaccaaaaattacagcgtcccatgagtggtgaatctctaaacagtattttctgctaataattcatgaatttttccagttctcgtgcaaatta

SEQ ID NO: 12708 - DNA, 877 bp, Pinus taeda
  Predicted polypeptide sequence is orthologous to G2997
tggtgagaagattgtgagatacagagaatgccagaaaaatcatgcggcgaatattgggagccacgcgcttgatggatgcggggaattcatggccagtgggttggatggcacggcggaggctctcaaatgccaggcctgcggttgccatcggaattttcacaggcaagaagttgagggcgagggcgggttggacgggtggtattccggtcctgcgggacggagccgagtcgataaaaaacggctgcttcctggtgttggaaatgtcggcgtcccgctgttttcttccccatctccgcctcccacggccacggcggtgaacgcgtcgggtcctcagatgttaatggccttgagctccgcctgcacgctcggagaccaagagttccacgaggggctcgtcggccggggcgtcgggtcgtcctcatcggctatgaagaaacgtttccggacgaaattttcgcaggagcaaaaggagaaaatgcacgcgtttgccgaacagttggggtggagaattcagaaacacgacgaggccgcggttcaccagttttgcaacgaggttggtgtcaggcgccatgttctcaaggtctggatgcacaacaacaagaacactgtgggaaaaaaattatagtaattatagtaatttcgcctccaatcaaatcagttttttgtttttaatgtctggtacaaacctgtaaagtaaattgatttcttctccctaggttgctgctgctgctgccatttgagacctctgaaacacctaggttttctgttcatcaaactgatgttcagcggctcttaattggttgttgctgctgaacggagggtagtttgataaactaacacaaatgaattaatctgagctccatctttctttactgat

SEQ ID NO: 12709 - DNA, 745 bp, Pinus taeda
  Predicted polypeptide sequence is orthologous to G2998, G2999
ccagactgagcccgctgtttgtgacacaattaggagaggagatggggtgcagagcctagacatgaagttattgtcctagactgcatttacaattttacaagccacagggtcgagtcctggtgaggccgagtaaatgatagatgtcagcgcgtatattcagcaactgaatatctttgataggacttgcagtgcattgtttcgcattatgtgtgtgtaacaggcaatggaatttaggattgggggtgcggacagctgaggaggcgagaaactagtttttgggttttggaattcattaatggagatgggagctgggggcaacgaagccgagatcgggatgcccatgtcagtgagctacggtcatatggcggcaatccacgaagcgaattcgaagccgaaccatagtaatatgggcgccgacaactgcagcacggcttcggatcaggagatccgcccgctgtcacacgaggcggcggcggcggcggctggggcgtccctggcaaagccacgcagtgtgaaatatcgagaatgcctgaagaatcatgcggccagcatcgggggccacgcaaacgatggctgtggcgagttcatgcctagcggtgacgaaggcactctggaggccctcaagtgcgctgcctgtggctgccaccgtaatttccacaggcgagacaccagcggcaacggaggcgccgacccctcggcagccgcttcctgctattattgctgctacggtagcaacggcaatggc

SEQ ID NO: 12710 - DNA, 802 bp, Pinus taeda
  Predicted polypeptide sequence is orthologous to G3032
atctggacgagaaattattattagctgtacgctaaataaagaggctgaagatgaaatcgatcaactgacggcaaagttcaggagttgcctcatgaaaaccatatatggtgaagctggtgcttcagatgatagaaaccctcatgtggagaagggtccgaacttgatgataacaacgatcgtagttcaccgcagctccatctcttctgacaattactgccaccactcatcctgtgacaggaaaaactctcttattttgaagcgcgagagttccctttctgaatggggaaaagctgatgctacaaagaagattgaaactccccgagatgatgttggacgggcaaagctaccgcttcctcctcgccccagggaagcttcttacagaaatccactccagatgagctcgtcccgcggggattcgattgagttgcaaccaccaagtcctttcgtacaatttttcagtccccaagaatcgttggcccgaaataacgtgcagtcaacgctctccaaaatcgcgaaaaaacagaaggagatttcggtaccatttactctttctgcaataaagttcattgtttatgcatctgatcggggacattttactgctagatttttttatttgatattttagaattccaaaactcgttcttgctgccactggattttaggttaagttatggaggaacactctaactctggtacgccaatgcggaaaacctgaggtctgtgctatattcggctgttacctatataattgtttcctccctttctttaattgtgaaaactactttacatacattttcttcat

SEQ ID NO: 12711 - DNA, 859 bp, Pinus taeda
  Predicted polypeptide sequence is orthologous to G3055
cggccgggggagaaccctcgaatccccgcctcttcagcctgctttcccattcggctctcctaatccgcaggcgggaggtattcccaggccccgcccctctgccacgggttccctacagaagaccaagctctgcgcgaggttcgaggccgggacgtgcaccttcaacgacaattgtagctttgcacacggtgcggaggagctccgaaggccgactgcgtttgggggtggggggtcaaacatcgccggatcggtgaatttgcagagatttcacaagaccaggccgtgtaagttctttttggggggcaattgtccttacagagagaggtgcaattttctgcatgatacggaacagggtcagtttaataacgcggctgtggtgagagcggcttcttctaccaggcctcctaactggaagactaagctttgcgtgaactgggggaattctcagaactgtaattttggcgataagtgccattttgcacatggctttggaggtatgtagggggatttttgatttctctttggattcaacagacagcaattttttaaaattgtttttgtttcgaagagttttcattatttcggattcatggattgttattgcatgtaattatgccagatgaagattcggatcccttcgagtctcaatcagaaatgaatgtgatgacaaactcaattttatccccttttagtagtataacgattattttggaattaacggatgccgaagtgcacttcctggggcgtcgactctatttcctgattagaaataccgtggactggtggctgattgcgggcgttttttgtgtgattgcggaaaatatcgactctttacattggccctgaatctgggacaatg

SEQ ID NO: 12712 - DNA, 2021 bp, Pinus taeda
  misc_feature (518)..(518): n is a, c, g, or t
  misc_feature (919)..(919): n is a, c, g, or t
  misc_feature (1700)..(1700): n is a, c, g, or t
  misc_feature (1723)..(1723): n is a, c, g, or t
  misc_feature (1732)..(1732): n is a, c, g, or t
  misc_feature (1739)..(1739): n is a, c, g, or t
  misc_feature (1754)..(1754): n is a, c, g, or t
  misc_feature (1757)..(1757): n is a, c, g, or t
  misc_feature (1759)..(1759): n is a, c, g, or t
  misc_feature (1762)..(1762): n is a, c, g, or t
  misc_feature (1764)..(1764): n is a, c, g, or t
  misc_feature (1771)..(1771): n is a, c, g, or t
  misc_feature (1774)..(1774): n is a, c, g, or t
  misc_feature (1780)..(1780): n is a, c, g, or t
  misc_feature (1782)..(1782): n is a, c, g, or t
  misc_feature (1793)..(1793): n is a, c, g, or t
  misc_feature (1801)..(1801): n is a, c, g, or t
  misc_feature (1809)..(1809): n is a, c, g, or t
  misc_feature (1817)..(1817): n is a, c, g, or t
  Predicted polypeptide sequence is orthologous to G3059
cgccagatgaagacataaagaaaactatcatcgaatgtcgttccctcggccatcaattgaactttgcagggcaatggcggtgcgttgttcgcaggttttcttctgatcatcgcgtcagcagcttgattttgagtttatcgaaatttgaatgaactctctgttagaaacgaagaaaatcatgaagacggaaaatccttttgatggacaaagcgaggctgagcttcggatgtttgagactgttttaagtcagaacagtgatcttcccgaccagctgtgggccagtaatgaagattatactgataatcacaagtttactaatatgagcatcaattcttcatccggaaacatgtccgatgacagcacagcttcgaaagaggccttccctgcaaccatgccaagttcttgggaagatgaagccttatccgacacggctctatacggaattaacttacctgaatatatgaaaagctataattcatcaattgtgcatacagcccgcggttttactgctcaggatnaatatctgtctcaagaatccgataaatctgtacaagcaatcactcaattggaatatcagctggctcggctgactctccaataccacgcactcgccgagagtttcaacgattccattctccgtttgcggcaagcggaagcagacaacgagagaatgaggaaagagaaccttcaactgaaagcatctaacatggagcttactatgagggagtcgaaatactttttcgacgacaaaacttataacgacattcccttcgatgccggctattccgttattcagacaccatcgacatcactgtcagcgttcagctataacgacaatctggtcaattctactgtcgaatcctccacgttcctggacgcttcagcgtcttgtttcaacaatcagtttccgacgccgttnaacaatagtgcctcccactcaaacggcttaatgtcgatcttatcgtgccgggcagatccggaaggcatggaaatgcagcaaccgagaagcagatacatgaaaataatgaagagcattacagcagatgtttctgcaaatagccccacaagcgttctcagcagcttcgacgatcttcatgccgatttcaacaataaattgatgcatctaacctccaaatcagcggcgaatgcaagcaatttggataaaacagttgccgtaaacaagccgacacctcggggcctaccgaaaagcatttcgattcgctcatcgggcttcttgaacatgaagatgaacggtgttaatacgccttcgcgagagggagtgaagagatcgccgcagctgtccaagacagcaccatctgtcctttctccacaccgaccccatcgccttcggctcactgcaacggctgacattgtacccgttgctgttgcttcgccaactggccaggatgtcgacagagcacaagacgtggaatacgacgtttacaaccaggggatgttcaagactgagctgtgtaacaaatggcaggataccggagcatgcccttacggagatcgatgccagttcgcacacgggatcgaggaactccgccctgtaattcggcatccgcgttacaagacggagctatgtcgcatggttgctgctggagacaggtgtccgtatggccaccgttgtcactttcgtcacgctctcacggaagaagaaaaagcaacggcagcagcaaccaaacaacgcgaacganaaaaagctacatctgccgcaacngtatcttgnagtcccnactccaatatttcanttncnaanantcgatanacncccaantntttttgaatcncatacaangcttaatntgggaaanattattcatttttagtgaattaatgataaattgtagtaggactttaatgcgtgctgtgttaaacgacgcagcagcagcttacaggaaagtataaaataacctataatgaaggaccttaataatttggggtagttgtcatacctcaagctatatctagtaatttgctatgggacactatacaactcaaaaatttccttcaatacg

SEQ ID NO: 12713 - DNA, 862 bp, Pinus taeda
  Predicted polypeptide sequence is orthologous to G3060
tcgatgtgggtactcgacggttcacccttctgacatcgtatatggagatcccgccagattcaagcagccaacctttgtttctcctgaaatggagtcgttaccaacaggtttaggaagcaaatcaaaggcatgcaccaaatttttcagtacatctggttgcccatttggagagaactgtcatttcatgcactatagccccggtggtgtgaatttgatttctcaggtgtcaaatttgggaagtggtctgcgcacagcttcaaggaattcaacaggtcccccaactagcattttgcctcctgatcaggcagctgctgtacagccatacaagacacggatgtgtaatcgccatgggactgcagaaggatgccggtttggagataagtgtcattttgcccacagtgaaaatgaactgaagaaaggaaatacacttgctcctgtagagagggaatggacaagctcttatggcaggccagttcctggtggaggtagacttgtgcagcatgaggctacaacacctggaatggcagctgcagcttcatttggttcttcagcgacagcaaaaatcagtgtcgatgcttctctctctggtgccattattggaaaaggtggtgtaaactccaagcaaatttgtcgtgtaactggagtaaaactagccatcaaagatcatgaatctgattccaatctaaagaacattgagctggaaggtagctttgatcagataaaacaagcaagtaccatggttcacgagctgataatgcaaactagggctgtagctgcaaaaccatctgggtttgtttccaacaatttcaaaacaaagctgtgtgagaatttttcaaagggtacctgcacatttggggatcgt

SEQ ID NO: 12714 - DNA, 970 bp, Pinus taeda
  Predicted polypeptide sequence is orthologous to G3060
gtatctgctttcctctgatgctcgttttcactcaaacgcagttagtgtctgtttgtggaacggcggcattcgcgactcaggtttgaatctcgcctcgcttcggcagcttgtaagcatggagtccttcgagcccacgttgaagaaatcccgcggttacgacacagatggtgcaaatggtatgccctggacctcatcctcgtccgctggaaacatgaatatgaatcctggcatgaatctcagttctggcgttaattatcactctggacctaaccccaaccagggtcatgggttcaatcccaatgcagcaggggctaatcctaaccctaaccccaccctcaaccctaactccggggttaacgaggttatgcaagggccgccccagggaggatacccacctgcgatgggcggagggcaatacgcaggaggctcaggagcgtcatacggaggaggttcatatggagggggttcgtatgaaaatgggaaccattccacccattttgaagtgttagggtttcaacagcaacatcagcagggaagtaatgttaatgtgggggatctcgagtgcaggcgttataaaactgacgagggctgtccttatggccttacctgccgctacaagcacggcccaacagatgaaagggattttaatattcacgtcccttcttctggaggcaagtcaaaaccttgtatgaagttcttcagtacatctggatgtccctatggtgaaggctgccacttctcgcattatgttgtgggaggcattgctgcccttggtttggcgcctgttcaaactatgcctgctgccactatggcaccaccaaggaaacagcccggaccaattggtgatcccagtgctactgtcagtggttacaaaactagactttgcaatcggttcaacactgacccgggttgccgttttggagataaatgtcactttgctcatggggagagtgatttgcgttcatctaat

SEQ ID NO: 12715 - DNA, 868 bp, Pinus taeda
  Predicted polypeptide sequence is orthologous to G3067
cagcaagacgctgccagctctatacactctttatcagcttcctaatatatggtcactattaaaaaagtcataatgcagcacactaaaggtattaacctgtccaaagaattcaaatactctaccaacatccatctcttacaatggaagatttagagtaatgaatgagggcaaacaagaagatcaggctgtggggttgcttacaaaaccacaaacaaatatgacaggtaactaaaataagtccaaacacaagaaatgggccaatcagtatacgtaaggttaaaacagtcagctgtttttttagaccttatacatcacaacaaagcaaggaagcactgccttaggattaaacacaaataactcatccagattagagtagattcctgcctgacctgctaatgaatcatatccaccattgaaacactcatctgggtcttgggacttgttaacccgccctgcaataactctgcaaactagcattgctctcttatcctttgattcatcctcctctgatacctcaatggaatcatgggcttttccactgcttgcggtggtgtaaattccttttccattctcaacttttgaggagaatccatgtcggatgatattgcagacattgcaggatggaatgttgcataggttagttaatccattcatacccagtgaacaagagaatgtgatgcagtggaaacgaagtagttcgttgccatctgctatgcaccttgggtgcttcttggctgacttgttggctttagcctttaccatgtctctgtaatcttcgaatttgttgatggtcttctggctattgtggattttcagaaccctctctatcttgcaaggtgtctcctttttaaccagctggttggaagaa

SEQ ID NO: 12716 - DNA, 893 bp, Pinus taeda
  Predicted polypeptide sequence is orthologous to G3075
cttgcgctgcatttgccatgatttcaaaaattacccttgaaatacagtattcttctccatcctcaaagagatgcattgtcaaaataagtcatagatgcttcaaaaaattatgaaatctcacaaacattgctcaaatttccgctgaagcccttcgggctaaagcatctgctgctttaactttctccggcacaaagtctgcatataaagaatgtgagttccagattatttgagaaagttaattcaactttaataaatcaaaacacaggtcatggagaaacaccaaggtaaaggactgcttaattatactgacgtacaaaattaacagtattaacacagccatatatctattacgaactgcatcaaaggaatttagttgaatccattataaaattaaagcatggaaacaaacacatcactaacctgcaagaaactcgtacctcttctggttagccacagttgaagaaaaaggcttgtagcttaaaatatttttggtctcctccaaaatatgttcgaatgagtccacaacaaactgttccaagaacttctccgctgctttgttaatgagaaaggctgcttctacattaatccgaatatcaccctcgctcctgattacacgcctcactctggctgtggggaacgccagagttgtaggagtttccggccttgggaccttgatgtgcgaactttttacaggacggcttggggtttccgcctcccccatatttggagaagaataagcgccattatcggtggggattttcgttggtgaggttttctcatctgcattttcctgctcctcgctgaaatctgaagaagactgtgcagaagaatcggattttggagtgttagctgccttcattttcggaagaaacatgaagtgagcgagcggaagt

SEQ ID NO: 12717 - DNA, 1143 bp, Pinus taeda
  Predicted polypeptide sequence is orthologous to G3091
ttccacatccataacctgtcagtctgtcatttgcagtaaagtgacggcataacaggccggtcatcatgaattctgacaggcttatccagtacatgaaatacataaagcaagaatatacattttgtggtcaaacttggtggtatatatattttatatataattatgtatatacacccaaatacctctccaaataaagttactacaaaaatttatgctccctgctccgtattgagctcgcaattctaacttccgagtggagcccggtgtggaattcccttccgtcgcctggccgtcctgtaatttgttgcaataggcggtgtggggggtgacatgtcgacatttccactgctgcttggactgtaacggccgccgaccctggtgccctcgtcgtttgtggaatccccggatgtatacatctccatttcgtttttaatgtcggctgggtttgtttcgtgtgagaaacggtgagagtcggtcttcttgatcagtcggaatcttttatgggtcgacgagtcttccgattcccatcctctcggatgatgaagaatatgatgcttcggttgttgcaggaggaacgttgcatccccgctgttctcgattcctcccaactgtaaaattacagacagcaaacgccattaatattaaccctaaggtcagggcaatgctacaggattcaggattctactgttcttagttcacaaaccatattcattattagaattctgaaattcacaacctccattcaattcgacttaagactttgaaaaaaactttaaaagtttttttcagaagttttttcctattaaattgatacgatataccttgataccagattacatactatcaaaatccttttgctgcgatcaaagaacataaaataacagaagtaaaaagaattccagtcatgaatggcataccttgcaaccgagagagcagaagcggaatgtgtctaggaggctcctgtcacatatttcgcaggtatttgtaacgcccttacctggcctcggctgaggcctttcattcagaaaaacaatcctggcgctattgataatgtaagtctgcacaccgctaatgtcgagcactttctgaatctcagaaacacgaacaacgttatggtatgaagaccgtcttatctgcagaccc

SEQ ID NO: 12718 - DNA, 848 bp, Pinus taeda
  Predicted polypeptide sequence is orthologous to G3091
cggccgggggctgctttcaggcttttgttttcattgggaagcattagttttgtgtttgtgtttgtatattgggcaagttgaatgtcggtggatgattccggtcaggttattttggagaaatcaagactctgcataatgcacagctcagagcagaggctcaattgattcggcgctgtgcaggggttttgttgtaagggacggtgcagaatcaagggttagagttttcattgttgtgatcgacagattctagcgttttgttaggcttgcttatagaaacctcaattagcagggactttaagtaaattcgtccacgaatttggccgttgaatgcattcaagaagccaatcataaagtggtttgaggaaggcggtcgttaccttttgtcggtgcaagagagaaagagcaagctggcgatagagaatcggccgaaggctcatattttcaagacgagagacaaaagaatcatggttggaacaatgttacctctgcgtgacgaagaattcggccctccgtggctggaacctctgctgagaacacattttttcaagccgtgccagttccatggcgattcaagcaaaagcgagtgcaatatgttctgtctaaagtgcaggggagaggcgttgtgcacttattgccgagcacgccacaaggaccatcacattgtgcagataagacggtcctcctaccatgacgtgatacgggtttcagagatacagaaagtcttggacatcacaggcgtgcagacctacattatcaacagtgcaagagtcgttttcctcaacgaaagacctcagccaagctgggcaagggcgttaccaatacttgcgagatttgcgagcgaagccttg

SEQ ID NO: 12719 - DNA, 773 bp, Pinus taeda
  Predicted polypeptide sequence is orthologous to G3094
gatgtcccagttcttgcatgaatgcaaatctctgccactctctgactttgcattcactcactgcatcgaaggcttaaagtcagatgcagcgggcgtggtggaggacgggcagaggacccccagctcggttctggaatgtggagactccttcggcacctcgtttggatcccccaccgctggtcacggctcatttgcgggatgcagaaacacagtatacaccgcgacaactggctttcaaaacagcaggtcaccgactggatatatttcctataacgccaatcgccgcccttgtgcagtagaaactactgccgcttcgacccagactacagtcatgtccatgagcagacgcaaaggcactccccatagatctcctctcttttaaaattttcaattttcaagccaattgttattaagaatattcagcatttctgcgctgttatgtttaagttaggttgacatctggttattctgattagggtttaaaattaatcttccttaccaatagtaccagcaccgccctcggattcgtctgtgacatattttgcattgtttcggcaagccctctgatcaaggaaagctcttcagacaggcttgcaattttgggtgtatgcagggtacatttctaaggtcgatcggcgttagcgggcggtgacctttggatgcacccaaattttgtatataggccagtaacataacccaagctccactctggacttggaaatgccatgcgaatatctatttactactataaaatctcattttattaatatact

SEQ ID NO: 12720 - DNA, 883 bp, Pinus taeda
  Predicted polypeptide sequence is orthologous to G3094
cggccgggggagagatagttcgttcgccgcctcccgtcgaaatccttttcccgtccgtccattcatttctcatttcttcagtttccgctgcattttggtgggatgctctgtgtaggtgcggtctagcagcactcagctccgcataacatggttggatatgctctctccgttgttccacaaaaaccggcatggctggaggctctgttaacggaccaattctttacaccttgttccattcatttggagcacaagaagaatgaagtcaacatcttttgcgtggattgcagtgccagcatttgtcaacattgcctcttttcccatcgttcccatcgccttctgcaggttcgaaggtacgtctaccatgatgttattcggctgcaggacatgcagaagctaatagactgttctctggtgcagacctatatcaccaacagtgctagagtggtgttcttgaaccagaggccacagtctcgactatcgaagggcctggggaattcttgtgagacctgtgacagggtgctgcaggaaccctaccgttattgctctgtcagatgcaaggtagacgcggtgaaaaatctgtcaagtgtgctgcaatcttgcaattcactgcaactgagggagtttttgtcaccatcgtcatctcctacaagccaaagccccaaggatgaaaaactggagatggaaggaggagaagaaatgtacccagaagagtcattgtcttcaacgtcctctgccagtgacagagacgaatgctggctttccggcagcggcacagcagctcacgccattttcccgctgcctaaaaattgcgcagcagcacagcagtagtgtggtggagggatgatggtgtcttgctcacgaaatctgtgatccaccctcatca

SEQ ID NO: 12721 - DNA, 920 bp, Pinus taeda
  Predicted polypeptide sequence is orthologous to G3095
tcatcaatctgtgcttgcagagctgagttgcagaggagcaatcctagagaagagcaaagtatttttctcagagcattaacacaagcaagctggctatcgaagcccaatccaaaggttcccttctaaaatctaagagaccgagattcatggttcgaaggactctgccattggaggataacgaaattggtcctccatggttgaagccccttctgcagacaagcttcttcgttgcctgtaaaattcatggggattcaaacaagagcgaatgcaacatgtattgcctcgattgcatgtcaggtgggttgtgcgcctactgcctggaacaccacagagatcatccaattgttcagatacggaggtcttcgtatcacaatgtaatccgggtttcggaaattcagaagatactggatataacaggcatacagacatatatcatcaacagtgctcgtgtggtttttcttaatgagagacctcagcccaggccggggaagggtgtcaccaatacctgtgatatatgtgaaagaagccttttggatacgttccagttttgctccttgggctgcaaggcagcaggtataagacggaacctctgcaatatgacatttctgctacagcctaaacagcaagctgagtttgactccgaccaggactcctcatcttacaagagacagaagacacacaagggtctccatgaattcagaaacaaggattacaagaagagattacaccttgaagctgagaatgagcatgaccatgatcaccatgaagatggtgcaagctacgacacagcagtgtttggttacagccctgccagcaattcacatgacaatatctcgccctcaactcctcccatgataatcaattacagaactgcaagaaagaggaaggggatccctttcagagctcctctgggaagtctt

SEQ ID NO: 12722 - DNA, 757 bp, Pinus taeda
  misc_feature (614)..(614): n is a, c, g, or t
  Predicted polypeptide sequence is orthologous to G3967
gttcattagaaagttgtacaagcttgcctttcagccttgtcactgcaacgtaacagttctgtgggagtactacatttcttacagtataaaaacaatatttctttcatcctcaaaactctagaaatacattagctatttcctgagaaacccaggaatgccaagttccatgtgccggggtgatatacactatgacgagaaaaatatgccgtgtgaaacatttgctgaaaaacctaatgcattggctgctaatgcaagaagggaaacagacatcccccttgcttgccgattgtgggcttcccatgccaggcattgttctacagctttatgccaatcttgaacaaccatgtcctttccataatacaaatgttcagaatggtgctttttttctgaaatgttcttgcaatacctgaaattgagagattccgcatgcaaaatatctcgcagaactgatgtactaagtgcacggacatgcgcactggaatgtgatagacattgaacagttgcaggtagccgatacttcaataggttccatagtccatctgccattgccttgcctggtaccccccaacctagtgaaagttgtgctgccactgccattgcttctaacaactctnattgtggtgttgtacatgcttctccatcaacaagcatgccatctgttgctctcatgagaagatctgatgcattagccaaaacccatcaggattctggagcattatgatacctcagaagttcagcaagaaggcttacgatccgc

SEQ ID NO: 12723 - DNA, 675 bp, Helianthus annuus
  Predicted polypeptide sequence is orthologous to G867, G9, G993, G1930
ttttttttttttagaaaaacaaaaagtttctatttttcttgggattttactagaattaaacttgatccctacattgagctttctttagctcaattatctttaaatttctaaaaatcaatatacaaacttttgcaacttgcaacttgcttcctcctctattccattcccaccactttccagcttcattccccatcatcatcatctctagaggaaaaaagtagaccaaaatgttaccacacaaaccctccaaacatgagagattgttacaaagggtcaataatcttttgcttcttacaattctccattcccaacaacaccatttctatgttatttctctttccattgcaagtgctgctatcaagagcaagagtattattattagcactaaatatgttgactccaaacaacctaaacatttggactggttgtactggttggaccggttggaccggttggattggtcttgaactcgtgttaccagatccggttttcgtcttccagtcgatgtaaagttgcttgtctggaccggtagatctttgaaaactaacaatgtcaccggcttttaagttcttttcctttacaaaccggctccaacctttggtcaacacgtagctttgactactgttccagtaagagtaacgaaatctccatactttcataccaatatcttcgaaa

SEQ ID NO: 12724 - DNA, 702 bp, Helianthus annuus
  misc_feature (15)..(15): n is a, c, g, or t
  Predicted polypeptide sequence is orthologous to G4
ttttttttttttggntgaatttaccactttaaagtttttaacagttggttcaaacaatctgaagtccataaagagaaacaaaagcaacatttagttttcaaaatattatcatccatacaaacataactaacacaaaataaaaataaagatcttacaatcataacatagttgattgttaagctatatactctgcatataaccgaacgaaatcgacacaccatgcttatttgtccgcccatcgttaccaaacaatagcttagaacgatccatccaagatggcgggaagatcgctgaagctccaaagatccacctcatttccaccatcttgagtagcatccgcattcagaaacgcatcaaccgaagaagcatcccagctctcttcgaaactcggcatctgaaacagcggttcatcagcagaaaccatgtttacagggtcttgtttcagtttctttgcaggattcatgttagccatgaagctgacatcatcactctcggagaaaacagacgtgatttcaggagttgttgcgcagtgatcccaaccgaattcagcggaacaaccaaacgagttgctccccttgatcagacttaaaataaaaaaccccagaaccggtttaagggcctaaactggtttacacccatatcctcaacagttgcaggaaacgttaactttgaggcttcggtttcaaagaaccctcggccggg

SEQ ID NO: 12725 - DNA, 793 bp, Helianthus annuus
  misc_feature (677)..(677): n is a, c, g, or t
  Predicted polypeptide sequence is orthologous to G12, G24, G1277
ttttttttttttaatgctaaaacagagagatttattaattaaaacaaaatacaccacaattatttacattactgcccttgtaccttaaaacaactactccaaatcatcatcaagttaggtataaaaactaccggaccatccaccacccatcatcaacaatctccatccgggtcttcggattcgggtttcttattcaaatcaggcttttcttgaaaccaacaagccttcttcaactcagaactagaaggacaattatgatgatgctcaaacgtaccactcttatgcaccaacgtacaacacgtctctgcatctactctagccccaacttcaatagcttttttcctaatagaagccgtgctcagctcatccaagccgccatcagaagccatcaactccgggaagttaagccgagccgacggcccccgtaggtagtacacggccgtgtcatacgcccgtgcggcggctaagggagtcgaatacgagccgagccatatcctcgaccgcttattcggctcccgaatttcggctacccactttccccactttctcatccggatccctttgtacggtcgttgatcggactttctttttccagccgccggagaatagtttaagtcaccggagacgctgccggagaagggttttctggcttccatcgatttagtgacggatccagnaaattttttctatataaaaaagatatataaattctcgtaaggttttttggaacccgaaactatgggtagatccacccctgattggattgggatatttgtgttagagggtttttggg

SEQ ID NO: 12726 - DNA, 566 bp, Helianthus annuus
  Predicted polypeptide sequence is orthologous to G15
ggaattcggccattatggccgcttgaccggaacaaggatctttacttggggacattcagcacccaagaagaagccgctgaggcttatgatgtagcggccataaaatttcgtggagttaacgcggttacaaatttcgacatatcgcgttacaatgtcaaaaagatcattgcaagtagtacccttttagctggtgagctagctaggcgaaccaaagacgtagacactacaacggagctcttgtcagaccaaccaccggctcaaaatggcgagcccaagaccatatcaaccgagcacactaccaacaggaacatgttggactggaaaatgacactctatgatcaaaaccagactggaccagggctcgatgtggacgagacaactaaacttggagcacatttatcaaacgcttcttcattggtgactagtttgagcagctcgcgagaagatagccccgagagaaattcttctcgcgatgcatggttcccgacagcagcagcagcagcacaaatgagagctcatatcccagtctttgctgcatgggcagatgcatgatcatgaaactgaaa

SEQ ID NO: 12727 - DNA, 309 bp, Helianthus annuus
  Predicted polypeptide sequence is orthologous to G25
acagaaggaagagaatgaggtgcagaagctgtcggaggagctgatggcgtatgagtcgtatatgaagttttatgatattccgtatcttgaagggcagccgtcggcggtggctccggcgaatgcagacggtggtggttcgattgagctttggagctttgatgatgtagcgtgatttggaagtttacccttctgcgtgttttttttagtttaagtttaaataattttgtgtttaataatgcaaattgttgtgtttgaacttctatatgtgtgttgggcataaaagtaagaagtttggtgtaaaaaaaaaaa

SEQ ID NO: 12728 - DNA, 1301 bp, Helianthus annuus
  Predicted polypeptide sequence is orthologous to G38
gaattcggcacgaggcccaaattcacacaaaattccacaacatcaagtaatcaacgacaactgatttcaactttcaaaaggcgtcaagaggaaataaatctgtaattatttgtgaactgaagcttgatttgaagaagattgttcgagaagatattgatttgctgttcatggcgttagggttttccgatagaaatactgagatgagtccttatagtcaacaatcgaatacgtctgctgtaccgatggatagctcgaaaaagaggaaaacaaggagtaggaaagaggcaccagagaaagtggctgcaactcttgccaagtggatagaatataacaaggctaatgaagacggtaaagcaaaaactcgaaaagcacccgccaaggggtcgaagaagggttgtatgaaagggaagggcgggccagagaattccagaactaatttcagaggtgtgaggcaaagaacatggggtaaatgggtcgctgagattcgtgaaccgaacaggggtaggaggttatggctcgggacttttgggtctgctgttgaagctgcgttggcgtatgatgaagctgctagagctatgtatggcacgtctgctcggttaaatcttccaaattgtcggtcaaagaacgatatacttcctttgctggtgactaaccctgcttctagttgtgactcgaccaccacatgtagttactctgaggtcgatgcaacccatgattccaaaccgggtccggctgtgtttccaagcgttaaacatgaggagagtgtacaagtgaaacacgaacctgagattgtagctaaagaagaacattgtgtagacaataacgatttgggctttgatattggtgatgagatgtttgatctggaggagcttcttggggctgtcgaagactctaatcccgaggcgggatctggtgatggctatgatggtcgatttgtgaacggagcggatgctaatgaaaacatgcaaatgtacatgcagccagatccgtgcgtgagcggtcaggattatagtttcgatttcttgcagccgggacggcctgaagattgtagttttacactggaggagttgggtcttggtttggatgctgagttggatctgtatagtaactagaagtagaatcttgaactaactgtgatggtattttggttttactgaacttggattgaaccggttctctacaggttttttatgtgggaaattggtatctatgtatggtttaactgaatgtaaataacatacttaacattagatattaaaaaaaaaaaaaaaaaaaaaaaaaaaaaaaaaaaaaaaaaaaaa

SEQ ID NO: 12729 - DNA, 1200 bp, Helianthus annuus
  Predicted polypeptide sequence is orthologous to G129, G136, G140, G146
gttttttttttttttttttgctataagtcttgaacaatatatatagcaaaaaaatgattgaatatttggtattaagatataatgattaaggttaagagggtttattaatttaaaggacaaaaaagtcgttgtctactttataaatactcatcaaccatcccacctccccattccattttctgcaatctttcctgttcagatttgtgggaaaccctcaaaaagcagagagagatcaaaaaggtgtatccatgtcttttcccaatgagtcaggtgagatgtctccacagagaaaattgggtaggggaaagatcgaaatcaaacggatcgaaaacacgacaaatcgacaagtgacattttgcaaacgccgcaacggtttgctgaagaaggcttatgagttgtctgtactttgtgatgctgaggttgcgcttatcgtcttctcgagccgcggtcgcctctatgagtatgccaacaatagtgtgaaaggaaccatagataggtacaaaaaggcatgcctggatccaccaagcagtggctctgttgcagaagcaaatgctcagttttaccaacaagaagctgcaaaactccgtcagcaaatcgccaaccttcagaaccaaaacaggcaattttataggaacatcatgggtgaatcactaggaaacatgccagcaaaagatctcaagaatcttgaaggcaagttagagaaaggcattagcaggatcagatcaaaaaagaatgaacttctgtttgctgaaatcgagtatatgccaaagcgagaaaatgagttgcataacaataatcagttcctccgagcaaagattgctgaaaatgaaagatcccagcagcaacacatgagcttgatgcctggaagttctgattatgatcttgtaccacctcatcaaccatttgatggtcgaaactaccttcaagtcaacgatcttcaaccgaataacagttactcttgccaagatcaaacccctctccagttggtgtaattcatgatgggcataaaggatttggggtttctacttgctataacatcttcatggtgattaatatggttttatggtttgttacaaccttattctaagtatctagtttgacttttgtgttcttgttttatttgccatgggtgccacaatgtgtattttatgaaacaacttgtttttccacgggttatcttctttgtattaaaaaaaaaaa

SEQ ID NO: 12730 - DNA, 1098 bp, Helianthus annuus
  Predicted polypeptide sequence is orthologous to G129, G136, G140, G146
ccaatctgaaaatcaagtttagtttcttcccaaatttcttgaggtgaagtacatgtaatttacttcaggattcatggaaaattctgaggctattgagcatgagcatgatttcagctgcatcgatcgatccatgtcgtttcaaaacgaggactcgggggacatatctccacagagaaggattgggaagggaaagatcgagatcaagcggatcgagaacactacgaaccgacaagtgactttctgcaagcgtcgtaatgggttgctcaagaaggcctatgagttgtctgttctttgtgacgccgaggttgctcttatcgtcttttcgagccgtggccgtctttatgagtatgctaacaacagtgttagagggacaatcgataggtacaaaaaatcatgcttagatccacctagcacgggttccgttgctgaagccaatgctcagttttaccaacaagaagctaccaaactgcgtcagcaaattgcaaaccttcagaatcaaaacaggcaattttacaggaacatcatgggtgaatctttggcagatatgccggggaaggagcttaagaaccttgaaagtaagttagagaaagcaattaacagaattcgtgcgaaaaagaatgaactattatttgctgaaattgagtacatgcagaaaagggaacttgagctgcataacagcaatcaattccttagagcaaggatatctgaaaatgaaagagctcagcagcagcacatgagcttgatgcctggaagttctggttataatgaccttggaccacaccagtccttcgatggtctaaacgatcttcaaacgaatgagttgcaactcaataacaactactcttgccaggaccaaacccctctccagttggtgtgataacgacatggggttctccattactcgttcggccggagctataataacttgattatgattaattgacaaagactagacttatattcttatattaacttgcttgatttagtacggatttagttcatggctatctaagccagagagctctaaatatatatgtgtacttttatgattatgtatgtgttttaatattatgaagcagcttatatgttaaaaaaaaa

SEQ ID NO: 12731 - DNA, 1040 bp, Helianthus annuus
  Predicted polypeptide sequence is orthologous to G131, G135, G155
gaaagaagcaacacccaacccacccatacatatcataaatcattcacttctagaaagaaacaacaacagattcacaactttccttttcttgccaagagtatgggtagagggaaggtacaactaaggaggatagagaacaagataaacaggcaggtaactttctcaaagaggagaggtggcttattgaagaaagcccatgagatttcagttctttgtgatgctgaagttgccttaattgtcttctccaacaaaggaaaactatttgagttttctactgactcttgcatggagagcatcttggagcgatatgagagatattgttactccgaaagacaactagtcgcaacagatgctactccgagaagctggaccctagaatacaacaaacttaaatctagggctgagctattacaaagaaatcacaggcactatatgggtgaagatatcgagtcactgagcttgaaagaaatccaaaatttggagcaacagcttgatactggacttaagaatattcgtgcaagaaaaaaccaactcctgcatgaatcaatcaatgagctccagaaaaagggaaaggccatacaggagcagaacactactttgacaaagcaactcaaggagaaggagaaagacaagaccataccgcaaaacactcaatgggaacaacataactatgtggaccatgatacaaccttcttcttgccacagccacatcccgctctcaacatcggaggagattacaaccaagctactacttctgctgctagtggtggtgaaggagctgatggaaggaccagccagctggacctcagtctgcagccaatatattcgcaccacctaaggtgctttccgtcgtaaaatgatctcatgagtcgtgacctgccaatgcattaatgattatgaataatggttttgttaatgacatattaacgaagaaagaacaatattgaccatcagcaatcaagtgatctatgtacgataaaatgggatcaacataaacacgttggatgttgatttattatgtgctgtgtgactcaaaaaaa

SEQ ID NO: 12732 - DNA, 1055 bp, Helianthus annuus
  Predicted polypeptide sequence is orthologous to G131, G135, G155
ctctggatttggtttgtaaggttttctgaagatagcttgagagggatggggagaggaaaggtacaactaaggaggatagagaacaagatcaacaggcaggtaactttctcaaagaggagaggtggcttattgaagaaagcccatgaaatttcagttctttgtgatgctgaagttgctttaattgtcttctccaacaaaggaaagctctttgagttttctactgactcttgcatggacagcatcttggagcgatatgagcgatattcttacactgagagacagctagttgcagcggatgctactccgagaagttggaccctagagtacaataaactgaaatctagggctgagcttttgcaaagaaatcacaggcactatatgggtgaggatattgagtcactgagcttgaaagaaatccaaaatctggagcaacagcttgacactggtctcaagaacattcgaacaagaaagaaccaactcctgcatgaatcaatctccgagcttcagaaaaagggaaaggccatacaggagcaaaacactactttgacaaagaagatcaaggagaaggagaaagacaagacaataccacaaaacactcaatgggagatgcacaactatgtcgaccacgacacaaccttcctcatgccgcccccacctcccgctctcaatatggggggtgattacaaccatggtggtggtggtagtagtgaaggagctgatgggaggaccaatgagcttgacctaagtctgcagccaatatattcttgccacatgaggtgctttccttcctaaagtgatcaccagctggtagccaatcaacgctttagtgattatgctaatgataaattaatcatgaaattaagaaaataataaaaagaaaaaccaacaatcatttaagtgtggtgtgtttgctcatgactatttggcttatgtaaactaatcttaaacaatgtgatgtgtttgctgaaaaattactatgtgatgcatgtataaaacaggatttattaattgtatgttggtgtgtgacgttttaattatggattttaacaaaaaaa

SEQ ID NO: 12733 - DNA, 201 bp, Helianthus annuus
  Predicted polypeptide sequence is orthologous to G133
aagtgacttattccaagagaagaaacggactgttcaagaaggcgaatgagctcacggtgttgtgcgatgctaaagtttccattatcatggtgtcttgcactgataagcttcatgaatatataagcccttctgttacgacgaagcagttttttgatcattatcagaaggcatctggaattgatctttggaactctcattatg

SEQ ID NO: 12734 - DNA, 844 bp, Helianthus annuus
  Predicted polypeptide sequence is orthologous to G133
gagaaagagagagaaagctagagagagagagagatggggagggggaggatagagatacagaaaatagaaaacaatacaaacaggcaggtgacatactcaaagagaagaaatgggatattcaagaaggctcatgagctcactgttctttgtgatgccaaggtttctcttattatgttctccaacacaggaaagttccatgagtacatcagcccttctacaacgactaagaagatttatgatatgtatcagactactctagggtttgatctctggagctcccattatgagaggatgcaagaaacattgaagaagcttaaagatagcaacaataaacttaggagagagatcaggcaaagagtgcttggtgaagatttagatggtttggacatgaatgatctaaccatactcgagcaacacatgcaagattcactcacggttgtgcgagaacgcaaggtgaagaatttggagcaaagaaattgtaatcttcgactagactatgacacaatacaccagttggagaagaaatatggcatggtagagaatgaagtaggctacgagtccacgattgcatattcaaatctctacggcttttgtgagaacccgaacaacaacattatccatggttcaggttcaggttacgagcctcatggtcttcgcctcgattgagtttttaattggcgcgatgtaatatacactggctattggtggttaaagtggtcattagaagtatgttaactaagtagctagctagttagctgatcagtgctgaccataatgtgacaaagtttatctataactctttatttatggatattgagaaaacttttttgtccaaaaaaaaaaa

SEQ ID NO: 12735 - DNA, 697 bp, Helianthus annuus
  Predicted polypeptide sequence is orthologous to G134
gattgttaactgaaagcaaattgagagaggggatggggagaggaaagatagagatcaagaggatagagaacacaagtaacaggcaggtcacttactctaaaagaaagaatggaatcatcaagaaagctaaagaaattactgttctgtgtgatgctaatgtctctcttgttatctatggctcgtctggcaagatgtatgagtactgcagccccaaaaccaacttgattgacatgctggatcggtatcaaaggctttctggaaataagttgtgggatgctaaacatgagaatctgcagaatgaaattgacagaatcaagaaagagaacgagagcatgcaaattgagctccggcacctgaaaggggaagacatgacttctttgaactatgaagaactaattggatatgaagatgcacttgaaaatggtctgaccaacattcgtgagaaaaaggatgaaatccccaaaatcatgcgaaaacgcgaacaagttcttgaggatgtagtaatatatgcatttatgcaaatcatgttgcgataaggtttgtaatacattaactatggatgtgttttggtaggtgtgtcgtcaataatggtgcgctcttgggcgtgtgttgtttcttgtaactttgtgttgtgaactcatgatgatggtcatgtatccaaattggtatctatctatctaaaaaaaaaaaaaaaaaa

SEQ ID NO: 12736 - DNA, 848 bp, Helianthus annuus
  Predicted polypeptide sequence is orthologous to G134
attgttatctgaaagcaacttaagagagagaatgggaagaggaaagatagagatccagaggatagataacactatccacaggctagtaacatactccaaaagaaagaatggaatcatcagaaaagctaaggagattactgttctctgtgatgctaatgtctctcttgttgtatatggatcttctggcaagatgtatgagtactgcagccccaataccaacttgactgacatgctggatagatatccaaggctttctggaaataagttgtgggatgctaaacatgagaatttgcagattgaaattgacagaatcaagaaagagaatgagagcatgcaaattgagctcaggcacttgaaaggggaagatataacatctttgaactatgaagaactaattgcatttgaagatgcacttgaaaatggacttacccacattcgtgagaaaaaggatgaaatcccccaaattatgaggaagcatgaacaagttctagaggaggagaataagcacctaatgtatatggtgcaacaaagtgaaatggcagcaatgggagattaccaagcagatggacccttttctttccgtgtccaaccgatgcagccgaacttgcatgagaggatgtagtcacattttctgtatgcaagcacgtcttgaccaattgaagcttataattgcattaattacctgaggtttgtaatccgttaagtatggagatatggtgatttgctaggactgctatgtttcttgtagctttatgttttaagatcatcatgatggtccacctattaaaattgcgggtgtgccttgttggaattattaaactaagttatgtttatgtaaaaaaaaaaaa

SEQ ID NO: 12737 - DNA, 872 bp, Helianthus annuus
  Predicted polypeptide sequence is orthologous to G137, G145
gatatgggaaaaggaaggttagagttgaagagaattgagaacaagataaacaggcaggttacctttgccaagagaagaaatggtcttctcaagaaagcttatgaactttctgtcctttgtgatgctgaagttgctctcatcatcttctccactcgtggcaaactctatgagttctctagcacctctagcatgctgaaaacacttgagaggtatgagaagtgtagttttgggccaccagaacaaagaaagccagccaaggaggatcttcaggaacaaagcagttaccaggaatacatgaggcttaaagaacgctacgatgctttgaaacaactcgaaaggaattactatggtgaggagattgactcgttgactaccaacgagctcgagtcgcttgaaaggcagcttcattgttcattgaaacagattaggacaataaggactcagtcgctgatcgataagctttacgaacaacaaaagatggaacaccaactttacgagtacaacaagacgcttcgactcagattagatgaagaaagccaagcagaggcactccaatgggatgtacacgctcacgcacacgcgaatggaatggtttatgggcatcatcatcagcaccaagtgtctcatcctgcacatggtgcgttttatcatccgactggctgcgaaaccacattgcaaatcgggtaccagactgaacaaatctcgggagcgacctcgtcgagcatgagccatcatcatcatcaaatgcagggttggcctgcatgaaacaagattctatgtttgcttgttaaatcaccagacttaattaatattgtgttgttgtgggacatttggtcttagctaatttttygttaatgtgtttatgttaaaaa

SEQ ID NO: 12738 - DNA, 508 bp, Helianthus annuus
  Predicted polypeptide sequence is orthologous to G189
ttttttttttttcttccataatcggaaataatggataatcttaccatatagaacacttaaaaaaaagatcgatccagatacacataaaataaaagaaaattaaaaaaaaagtctagtaacaaatcaaatcatccttttgttgacactacagccatacaaagccctttccctttacaaaggtagcaatggagatttacattttgttttccatgtaagctacatatataaggatccgatagaatatgattttcgggagtttaagaagattcaagaactatagccgccggcgtgtcgttcatattatgagaatggttatgttctccttcgtaagtaacaataagcattgcaggatcatccaaagctctttcaacatgttttcttgctggacaaccttttatactactacacttataataaccttttggatggggagatcctttaatcggttagtgaccgagctggctgcacggggaattatccgggggttttttccgcttattattgcaaa

SEQ ID NO: 12739 - DNA, 741 bp, Helianthus annuus
  misc_feature (584)..(584): n is a, c, g, or t
  Predicted polypeptide sequence is orthologous to G280
tttacaacacaacacacacttgcattcttcattaaaacctaaaaattacaataaccacctactaacataaaactaacaagacaacctcacggagccttttttttttgttaaaagtaactctatttccagatacgaaattcccaaatccagagcaacaacactctacccacttgtacatcacacatcaacacttgtactcaactctaaacttaagaatcccacatccagtaacacatctaacaccgtttcttttttccatcttctcagttatctcatgaactcccaaaactcaattagcttcaacaccggcaggctccggctgcaccttacgcggccgtcccctcggccggccggttttcgacggcggcgttggcaccgtcgcagccttaactttcttcgccgacggtggagcattcggatccttcttcgggcgtcctctgcctctcttaacttcagaacctgccgttgccggtgacgtcaccgccgccggagtctcggtctccgccgcggatggatccttagccttcggaggacggccgcgaccgcgtttcgctggtgtggcggagtccggaccatgtagttgntatttgaaaccactagctcaccgttttcaacgagtttgttcaactgatccgccaggatatttgtgtgttcttccggtaagcttccgcaagttgattcgatgtagtttgagatcgacgatgtgcttgaaccgtccttctctttcagagcatcaatcgc

SEQ ID NO: 12740 - DNA, 709 bp, Helianthus annuus
  Predicted polypeptide sequence is orthologous to G307, G308, G309
ttttttttttttaacagcaaacttttttttttattattaagggtgagactgaatgaagataatctccacccaatccactcatagaaagtacaaattccaatccaccccctctaacttcaactaattaccaatttaaaccctcaattttcagaaagtaaaaaaccactttaatcaaaaactaaaaagaaaaatcataatgtgggccatcagctatctccaatttttccttatttccttaaaaactcttttgatgtaccgagttaatccaccaccaccactgagtcaactcggtggtttgactccgaacccaccgagtcgatactcgagttggtttcttccgagttcaccgaattttccaagccgaggtggttatgagcggacgagtatgccacccgagcatcaaacacccatcctcttccaccactcggtaaccatcaccacccgcgaacaaagccaacaacatactcgcttgcttaaacgcgttcgagccaagatgaaccgcttcaaacccggccgagtcaagccgagtcttccactgagtcaacgtttcatgcctttcaactcggtccacaccttcacatgcaaccacgttacagatctgtttcccccaatacacctctgacataaacctatcctcactgctcaccggcgatacaccaccgtcgttaactccaccgtcaacttcgccgtttaactgtggcaccacccg

SEQ ID NO: 12741 - DNA, 804 bp, Helianthus annuus
  Predicted polypeptide sequence is orthologous to G363
tttttttttacaagataaatagttttcttcaactttattacaatcacctgtacatgattcatctttcctttcgaattagaaaaagatgtagatataaacaatataaaggacatcttcaaacttaaaaccttaagactcttcggatactacgctgcataaaagagtttgttacctgaaacctaagaactgaaatgagagacagcaaactattaactagactctgcagacgataggcccgcttcatgagagtaataaggtttgtaatagtgaatctgttctctttaaaaacacttgtacagttgtacccgattcgaatcacagcttgagattcaagtcaagtgttattggatctggatccggatcagatggctgcgaatccgccatttgcggatctaaataataacctccatgccacattctttcctgaccatgcacacggacccaagcgtctgcggctgctgcggttgcaactgcatacttattattattaccactggcttctgccactgctgtcccggtaatcggtctgtgtacaaccgagtgagcttgcagttgcacagcgagtgtccgactgtacgcaggcgtgataagcgaatgatatcttctagcagcatctctctccctcttgtgtgcattttggtgaccccctagtgcttgtgcactgtagaatttcctcttgcagaagtggcataccttcaccgcgaccggtctcgatggcgagtttgtttgtagcttgcctgaggctaagatccagcccctgttgtgatgctctccatcttacctttggtattcataagactgaag

SEQ ID NO: 12742 - DNA, 399 bp, Helianthus annuus
  Predicted polypeptide sequence is orthologous to G380
gcgcgtgattgtgctggctcgagggtatatggcgactgatgggatgtgtgcgggaggatatagcactggcggagcatatcgttgatgggtttttatagggttcttgatttgtgtggttttttctaataagtgttttgtgatttgaagttgaaagttcacattgtgtctaatgcaaatcatgttttctatctgatggagttgttaccatcacaaaaatcaaaaaccctctaaaaaccaatcaaaaataatgctccgccagggaatatcttcgccggccgcctaggccctaatgactcaatactcgggcaagcttatgattgcgggcttaattacagaacactgggggggccgtcgttttaccaggtctagtcgaacctacactcaggggggccgagctcc

SEQ ID NO: 12743 - DNA, 2559 bp, Helianthus annuus
  Predicted polypeptide sequence is orthologous to G388
agtcccgcacgcagaccaaaagcgaacacaatttagtagaaccagcaccagcatacacagccatggctaatccgtaacaaactctgctactacggtcatgtcgtcttccaacgataacaataataatttcattaacaatccactgacttctaccaaagacctttttccgtccacttctctctcgctcactctcggattgtttcgtgacggagaggatgcggtggatgatcgaaaagaggaggctgctaatacgacggtgacggagatcagcagcgagacttccggaccggtgagatcacgatcggatgatgacgatttcgatgctgatcctgacgtcgatgacggagatgacgctagcaataagaataacaaaagtaagaagcgaaaaaagtaccaccgccacaccgctgatcaaattcgtgagatggaagcgctctttaaggagtcacctcacccagacgaaaagcaacgacaacagttaagcaagcggttaggtcttcatcctagacaagtgaagttctggtttcaaaatcgccgtactcaaatcaagactatacaggaacgccatgaaaattcgttactaaaatcggaactggataaactaggtgaagaaaataagttattaagggagacaatcaagaagggtacctgtaccaactgtggtttcggtagttctagcaaggatgtacacacttacgttgatgaacaacagcttcgcgttgaaaatgccaaacttagagctgagattgagaagctaaggaacatcagttggggaaatatccacagggagcatcaccaacgaaactcgtgttcggtaggaaatgaccatgaaaacaaaagctcattagatttgtgtagtgggttattcgggcttgaaaaatctagagtaaatggaggttgtcgctctggcctgtggaagagcttcgtacaaatggctagtgctggtgcaccactatgggtcaagagcttggagacgggtcgagaaatacttaattacgatgaatacttgaccaagttctccactgtggattcaagcaatgttcaacggttgagattcattgaggcatctagagatagtggtgttgtttttgtggatctcccccagctagttcgaagtttcatggatgtgaaagaatttaaggaaatgtttccatgcatgatctcaaaagcagctacccttgatgttatttgtaacggcgaaggtcctaacagaaagggtgcggttcaactgatgtttgctgagctgcaaatgctaactccgttggtggccacaagagaagtttatttcgtgagatattccaagcaattgactgctgaaaagtgggcaattgttgacgtttctattgacaatgtagaaaagaacattgatgcctccttagcgagatgcagaaaacgtccatctggttgcatcatcgaggacaaatcaaatggtcactgtaaggtgacatggatagagcattgggaatgccaaaaaagcgtatctcattctatgtttcgtgcaatcatcaatagcggcctcgcttttggagcaaggaattggatggccacattgcagcaacaatgcgaacgtcttgtgttcttccttgcaacaaatgttcccactaaggattcttgtggtatcggtacactggcggggaggaaaagtattctaaaactggcacagagaatgaacgttcgagttttagttagagcactaggagcctcaagctatcacacatggaaaaagataccaagtaagacgggatatgacatacgtgcttccagaaagaacctaaatgatgccggtgaacctttaggtgtgatactatgtgcagtttcgtctatatggttgccagtttctcacactcttctttttgacttcctaagagatgaaactcgaagaaatgagtgggatattatgtcaaatggtggtccggttcaatctattgccaacctggcaaaaggacaagatcaaggaaataccgtctccatccatacaatgaagtggaaggagaacatgtggatgatccaagatagctgcacaaacgcatacgagtccatggtggtgtgtgcaccggtggctgtgaccgccatgcagtccataatggctggctgtgactctagcaacatcgccatattaacccttgggtttttcaattctacctgatgggattgaaacaagggcctttggtgatcaatcaaaggcagatgatcaaagttgggaatacgggtcgttgttaaccgttggatttcagatccttacaagcgactcacccatatctaaactcagtatggaatccgtggattccgttaatacgcttatttcgagcaccctgcacaatatcaagacgggtttcaatgatgaagatcaatgattttactgctacaatatagagatatacttgtgcatcatgaataatcttttagttttaaggaccacccataaaaatctgactttttccaggtattaggtgaaaatgcttggtacaagtaaatatttggtgggttttgaaagattagatttgaatacgtgaagacaattaagatactaattattggagactagatgattataatata

SEQ ID NO: 12744 - DNA, 417 bp, Helianthus annuus
  Predicted polypeptide sequence is orthologous to G394
ttccacacttttgccaacactgaacttgcactggaactaggtcttaatccaacactatccatggccgaaaacacgacaaaccctaccaagaaacctaacccgagttctgatcaccctcttgagccgaatctaaccttggctctttccggtgattcatgtggcggttcgtcgttctctaatgcatgtgtgaagagggagagagaggttgcaagtgatgaatctggagagagaggagtggagaacactagtggtgaagaagatgaagatggtggtgtgaattgtaagaagaaactaaggttaactaaagctcaatctggactactagaggaagcctttaaacttcacacaactttaaaccctaaacaaaagcaagagcttgcaagggacctaaagctaaggcctagacaagttgaagtt

SEQ ID NO: 12745 - DNA, 989 bp, Helianthus annuus
  Predicted polypeptide sequence is orthologous to G394
taaacatcgatcaatctacacatcttttattcagatggattttcatggatttgccgaacatgcactggaactacgccttagtacaacatcatcggtggccgaaaacacaacgaatcccatcaagaagcctagcccgagttctgatcattgtcttgaaccatctctaactttggctctttctggtgattcatgcggtggttcgtcgttctctatcgctagtgcgaagagggaaagagaggttccgagtgaagaatcggagagaggaggagagaacactagtggtgaagaagatgaagatggtggtgtgaatggtaagaagaaactcaggttaactaaagctcaatctggactattagaggaagccttcaaacttcacacaactttaaaccctaaacaaaagcaagagcttgcaagggacttaaagctaaggcctagacaagttgaagtatggttccaaaacaggagagcaagaacaaaactgaagcaaactgaggtggactgtgagtatttaaagagatgctgcaacacattaaccgatgagaaccaaagactccggcaagaggttcaagaacttaaagcacaaaaagtgtcaccagcgttgtacatgcagctgcccacgaccaccctcaccgtgtgtccgtcgtgtgaacagatcggagacacaaagtctgccacaagcaaaaacccttgtactaaaaaaccatctttttttaaccccttcactagttcatcggcagcttgttgataattgattttatatgtggattatgttgcataaaatttaaatcactcatgcacagccccacccttttttcagagtcatgggcttatctagtggtggaagaaataatgaaactggaatattgtagaaagatatcagaatacccactcatatttttttgtttttctaaagaatgtattgttatttattttgttgtgtaaattaatttcctgtttatagtataacaagagaatatcttatttggatt

SEQ ID NO: 12746 - DNA, 153 bp, Helianthus annuus
  Predicted polypeptide sequence is orthologous to G394
gattgtgctaatggtaggaagaaactcaggcttaccaaaccacagtctgctcttcttgaacaagcctttaaacatcacagttctttaaaccctaaacaaaagcaagaactagcaagggaactaaagcttaggcccaggcaagttgaagtttgg

SEQ ID NO: 12747 - DNA, 622 bp, Helianthus annuus
  Predicted polypeptide sequence is orthologous to G409
agaggtaggtttggaaggtgaagtggcaggaggagtaatgacggttgttggtggagctagtgtcggtgaagcagcaggtggagtagtgacaggtggcggtttggttccagaaccgtcgtgcacggtgtaagactaagacacttgaaagggattacaatcgcctcaagtcttgttatgatagcttgacggctgattatgagtccatcgtcaaggaaaacgaaaagctcaaagctgaggttgtttccttgactgagaagatgcagtcaaaggaggtgtcggaaacctcagccgtcggtcaaggctccggctcagccgttgaggaaggcggagatgtggcagttccatcagacaatgtaaaagtggaggaccactttagtacgggtagtggtggaagtgcagtggttgatgatcatgaaggcccacaacttgtggacagtggtgattcgtatttccctgatgatgattaccctcatgaatatgtagtacctgtggatcagtctgaagaagatgacggcagtgatgatgggcagaaccgttttcgatacacgtttgaagctgcggatcatgtggaagacatgggctaggctggtgggtttggtcctagacataaatataaatatat

SEQ ID NO: 12748 - DNA, 410 bp, Helianthus annuus
  Predicted polypeptide sequence is orthologous to G409
aattcactagtgatttcgagcggccgcccgggcaggtactcgatgaatccgaggttcccttctcttgcagcatcattttgtcacttaattcttcaacctcagattttagtttctccttctctttaacaagatcctcatagttggctttgagtttattgtaactttcttgcagatcatcatagtccttctctagctgtttattcttccaacgggctcgtcggttctgaaaccagatcgcgacctgtcttggctgcagaccgagttctttcgcaagctgaattttccgttctggctcgagcttgttatccgactcaaaacttttctccaggaaccgaacttgatcacccgtgagccgccgtttcttctcgggctggtgaaagtacctcggccgcgaccacgccaatcgaatt

SEQ ID NO: 12749 - DNA, 782 bp, Helianthus annuus
  Predicted polypeptide sequence is orthologous to G431
ctgtgagatgctgattaaatatgaacaagaactctcaaaaccctttaaggaagctatgcttttcctctcaaggatggagtctcagttcaaggcaatcactttctcaaactcagattctggttgtggtgagggaggcatggataggaatggctcatctgaagaagaacttgatgttgacatgaacaacggtgtggttgatcctcaagctgaagatcgggagctgaaaggtcagttgctacgcaagtacagtgggtatttaggaagtctgaagcaggaatttatgaagaaaagaaagaaagggaaactgcccaaagaagctcgtcaacagttgcttgactggtggactagacattacaaatggccatatccttcggaggctcagaagttggcactagctgaatcaacagggctagatcagaagcagataaacaattggttcataaaccaaaggaagcgacactggaagccatccgaggatatgcagtttgtggtaatggatgctgctcatcctcactatttcatcgataatatctttgggaacccttacccgatggacgtatcgcttctctaataattatatattatgataaaaagtaagctactggagttatgatataatcatcatctaaaactgatgtaaggatgcaatgccttgcaagctagtgtgtgccttttgctgttacctatattttgcttgttttaattgttctctgttgaagtgatgcaaccgaaaatcagacaatcagtagtagtaatgttaatgaaaatgtatttaattccgg

SEQ ID NO: 12750 - DNA, 1353 bp, Helianthus annuus
  Predicted polypeptide sequence is orthologous to G431
ggagagagcgagagagagagagagagagagatggagagtgatggagatggaggtggtacttcatcatgtttgatgagttttggagacaccaccaacaacataaataataacagtagtaataataataacagtaataacaacattggatcactgtgtcttcctccaaacccacctggtgcatataacaccaccaccaacaacaataacctaattttctctgatcatcatccttctgctatgatgcttgaagacaacaacattaatatcaatgatggtgtagggttagccttcatgaacccctcttcttctgttaaagcaaagatcatgtctcatcctcattaccctcgtcttttatcagcttatctcaactgtcaaaagataggagcaccacctgaagtagttgaaagactagaggaagcttgcagggcctcggtggtggctgcaatgtccagttgctccggtggagctggtactagcgatggtagtggtggtggaatgaatatgatcattggacaagatccagcacttgatcagttcatggaagcttactgtgagatgctgataaaatatgaacaagaactctcaaaaccctttaaagaagccatgctttttctctcaagaattgagtcccagttcaaagctatctctatttccacttcagattctgctggtggtgaaggaggcatggacaaaaatggatcatccgaagaagaggtggatgtaaataacaatctcattgatcctcaagctgaagaccgagagttgaagggtcagctgttgcgcaagtatagcggttatttaggtagtctcaagcaagagttcatgaaaaagagaaagaaagggaagttaccaaaagaagctcgtcaacaattgctcgactggtggaccaggcattacaaatggccatacccttcggaggctcagaagctggcacttgccgagtcgacaggacttgaccagaaacagataaacaactggttcataaaccaaaggaagcggcactggaagccgtccgaagacatgcaatttgtggtaatggatgctgctcatcctcactatttcatggagaacatgaacatccttggtaatccttatcccatggatgtttcacttctctagtgctaaattatataaaacctccagtgtgtgtcaacaaatgattggtctgggtttgaacttgattgaaactattgagggtttttacaagtttgtcagctgttaaggatttaatgtttccaatttgtccgtagaacttaaattattctagactttgttttgtaagccatgtacgtactgccattggtaatatatttcatgtttagcttccgtattttaaaaaaaaaaaaaaaaaaa

SEQ ID NO: 12751 - DNA, 774 bp, Helianthus annuus
  Predicted polypeptide sequence is orthologous to G450, G456
aattcggccttatggcctcgcaacggggaggctgcgggtggtggcggtgcggcgtttgtgaaggtgagcatggatggagctccatacctccggaaagttgacctgaaaatgtacaaaagttatcaagatctctctgatgctttgggcaatatgttcagttccttcactattggtacctgtggatcacacgggttgaaagatttcatgaacgagagcaagttaatggatcttttgaacaattccgactacgttccaacctacgaagataaagacggggattggatgctcgtcggagacgttccctgggagatgttcgttgattcatgcaagcgtttacgtataatgaaagggaaggaagccatcggacttgcaccgagggctatggagaaatgcaagaacagacgctaaactcgacgaacaaactcaaccgcgacatcttgcttgttcggtctttgtgtggcatgcaacatcaagtatagtgcgcgatggaatgagcagacgatacggttcgtgtttgtacttattgttttataataaactctttatctggattgggaacttgattgttggttatattgtgagggtaatgtgtatttataaacttgggtgattgaaattcatggacataaataggcaagagaccaataaatatcattagtatgttctatgtactaccaaatctaaggtttttaccctttgttttggtgatttgttgtagtattatgtttaataatctatgtaactcatgttgtgaagcaaaaaaaaaaaaaaaaa

SEQ ID NO: 12752 - DNA, 490 bp, Helianthus annuus
  Predicted polypeptide sequence is orthologous to G461, G462
gccggtttgttcatatagaaagagggctataatcaagatgtatgtgaaagtaagcatggatggcgcgccatttcctcgcaagattgatattaatggtttcaaagggtattcggatttcattagggctcttgagaacctctttggtcttggtgatgaatgtgagtacacaccaatatatgaagacaaggatggagattggatgcttgtgggggacgtcccatgggagatgtttacagaaacatgcaagagattaagaatgaagaaacgggtataggatggtggacctcaaaccaaaacttgatgatcgatcgcatgctgattgctgagtaaagactgaaatctaagtatatgaagaatgaattatctttagtttgttttaattaataataataatgtcataagcatatgcttatttattaattaggttactataaagttggtgatgaggctattatatatgtacgtacgtagtcaagaatgttaatctcat

SEQ ID NO: 12753 - DNA, 469 bp, Helianthus annuus
  Predicted polypeptide sequence is orthologous to G536
gtgatgtatgcagctgaggcattctaacagaccggtgctgaacggaaagaggctgctgagagtactctcaatgcttataaggccgatcaagatattgcaaatgctgaacttgccccaacacacccaatccgtgtaggattggctcttaacttatgggagtatctactatgagattttgaacttaccagatcgcgcatgtggtcttgccaaacaggcgttcgatgaagccatcgctgagttagatactttgggtgaagactcgtacaaggatagcactttgatcatgcaactacttcgtgacaatcttactttgtggacatctgatatgcaggatgagggggctgatgagatcaaggaagccaagccaaatgacgaacaaaaggaatgataaccgacatcagtttcatccatttatgtttattagaaaagactgttggagcttcattgttttatgttgctacaacttaag

SEQ ID NO: 12754 - DNA, 883 bp, Helianthus annuus
  misc_feature (788)..(788): n is a, c, g, or t
  Predicted polypeptide sequence is orthologous to G536
gggagagagagagaaagagacacggtgagttcagactcagagatcggcgacaatggcttcttcaaccgaacgtgacaacttcatctatgtcgccaagcttgctgagcaagccgaacgttacgacgaaatggtggatgctatgaagaaggtagcaaagttggatgtggaactgactgttgaagagagaaacttgctttcagttgggtacaagaatgtggttggttctcgtagggcgtcatggagagtattgtcctcaatcgagcagaaggaggaatctagaggcaatgaagtgaacgtaaatcggatcaaggaatacaggcagaaggttgaaaaagaattgaccgacatttgtaatgatatcatggttgtgattgatgaacatctgattccatcttcatcggctggagaatctactgttttctactacaaaatgaaaggagatcattataggtatcttgcagagttcaagactggcgatgataagaaagaggcagctgatcagtctctgaaggcttatcaattggcttccacctcagcagaggctgaattatcttctactcacccgatcaggttgggtttggctttgaacttctctgtgttctattatgagatcatgaactctcctgaaagggcttgtcaccttgcaaaacaagcttttgatgaagctatctcagggcttgattccttgagcgaggaatcgtacaaagatagcactttaattatgcagctcttgagggacaacctcactttgtggacttccgacattcctagagatggagaagacgaanagatggagatcaccaaatctggtgctggaagagtaaggttgtatgacgacagcgggcctaccttttgggtaggaaaggatgatgtatgttaattg

SEQ ID NO: 12755 - DNA, 870 bp, Helianthus annuus
  Predicted polypeptide sequence is orthologous to G536
gatccgagctctgagatcggcatccatggctgcttctgctgaacgcgaaaacttcatctacgtcgccaagctcgccgagcaagctgaacgctatgacgagatggtcgatgccatgaagaaagtagcaatgttggatattgaattgacggttgaggagagaaatttgctctcagttggatacaagaatgtggtgggttcacgtagggcatcatggaggatattgtcctccattgagcaaaaagaggagtcaaggggcaatgaagttaacgtcaagcggattaaggaatataggcagaaggtggaaacagagctgtcgaacatttgcaaagatatcatggctgtgattgacgagcatctgattccatcttcctctgcgggagaatccactgttttctactacaaaatgaaaggagactattataggtatcttgcggagttcaagtctggcaatgacaaaaaagaagcagctgatcagtcacttaaggcttatcaattggcttctactgctgcagaggaattatctcctacgcatcccattagattgggtttggctttgaacttctccgttttctattacgagatcatgaactctcccgaaagagcctgtcacctggcaaaacaagctttcgatgaagctatctcagaacttgattcgttgagtgaggaatcatacaaagatagcactttaattatgcagctcctgagggacaatctcactttgtggacctccgatatttcagaggatggagaggaccaaaagatggagatcaccatatctggtgaagatgcagagtaaaatttggagggtaagtgtacatccttggagggagtggatgtggccctttgttattgtatttgtaaagcctatat

SEQ ID NO: 12756 - DNA, 780 bp, Helianthus annuus
  Predicted polypeptide sequence is orthologous to G536
atggcagccgcatcatctcctcgcgaagagaacgtatacctagcaaaactcgcagaacaagccgaacgctacgaagaaatggtcgaattcatggaaaaagtcgtcgccgccgcagacggcggagaagaactaaccatcgaagaacgaaacctcttatccgtcgcctacaagaacgtcatcggagcacgaagagcctcgtggcggatcatctcttcaatcgagcagaaagaggagagccgtggcaacgaaggacacgtgtccaccatccgtgactacagatctaagatcgagtcggagttatcgtcgatttgcgacggtattttgaaggttctggattccaaacttattggatctgcatctggtggtgattcaaaggtgttctatttgaagatgaaaggtgattattataggtatttggctgagtttaagaccggagatgagaggaagctggctgctgagaatactctttcggcttataaggctgctcaggatattgcgaatgcggaactagctcccacccatccgatcagattaggactggcactcaacttctctgtgttttactatgagatccttaactcacctgatcgcgcttgtaatcttgcaaaacaggcttttgatgaagcaattgctgaattggatactttaggagaggactcatacaaggacagcactctcatcatgcagctacttcgcgataaccttactttgtggacttctgatatgcaggatgacactgctgaagaagttaaagaagcacctaagcctgatgatcagtaa

SEQ ID NO: 12757 - DNA, 404 bp, Helianthus annuus
  Predicted polypeptide sequence is orthologous to G557
ggggttggaagtacgagttaaagagttggagaagaagaactcggagcttgatgagcgtttgtctactttgcaaaatgagaaccaaatgcttagacatatattgaagaacacgacggctggtattcaagaaaggaaatagaagtagattttgattttggtttagaaggatttagcacatatgttgtagcagctagagttaagattagaagtgatgatcatgtgtcattgtcgtttcttgtgtgttaaggaacataagtgaagattgtgatggttgaagctttatctgaaaatcttatattatattataattattttaaggttgtgtttgtaattatatttatatttaattatatttaataaataaattagttatcgaaaaaaaaaaaaaaaaaaaaaaaaaaaaa

SEQ ID NO: 12758 - DNA, 386 bp, Helianthus annuus
  Predicted polypeptide sequence is orthologous to G591, G793
ttttttttttttgatttaaagccaccccccactataaaaactttataatccccttagtcatcccccactagtctcaccaattgacacaaaaaggcacaacatatcaagcaaatgtttgacatctttccttgaatcttgtgggctttccattattcttataaaacattatgagtggtggaaaaagataaaggcaaatatgatgctactttcaactaaaaacatattggtgaatggtgattgcattcaagctagggctaaaactagaagtttatgggaatgttattttttttggcttataaagggggttcggattcggctttggcaatcgaggttgaatcgattggttgtgtgagaacgatagagtatgcaaatgatataggcttgat

SEQ ID NO: 12759 - DNA, 648 bp, Helianthus annuus
  misc_feature (634)..(634): n is a, c, g, or t
  Predicted polypeptide sequence is orthologous to G611
acaacgtttccttgattgggccaaatctgagtcaaacctaattctttaaattcaccaaaacccccctcaacgtttcctctaatgggtttcaatttggataaaaattcaagattatatgatgattgtggccttccaaaggaggccaaatgaagtaagaggtagacatattgtttgtcgccaaatcgagaagagctaaagaatcgatggtcatccatcaattcgcggaagaaaagttggcactgctttaaaagggtaagcttgcagccattggagttcagatgtaaagaatcaaatactgtatgttcgtccacagtctacaactacaagaaaaaaaataagcttgaggaggaaccgaagggccttctttcggatcagcttgttgtggcttctttgatctggcatgaggagcactggacgggcctctgtttgcatcatcgggtttacgagcccaagaaggtgactgctcaggttcgtaacagtaatcataaaagatttcttgacccgcttcaattcgctctttggcaaatatgctgacatgatgatctcctcccacttttattatctgcacataatgaattggtttcaggacgagtgtttggcattgattgcttatttaaagtttgtttaacacatnaaaaaaaaaaaaaa

SEQ ID NO: 12760 - DNA, 516 bp, Helianthus annuus
  Predicted polypeptide sequence is orthologous to G616
ttttttttttttacattttatataatatcatcaatatttattcgcacctgataataaacgtaacacagattaaagcatgcatacaacatcacccaagacaataatactaatacacaataaccaacacttgctcatctttagcaagatctggcgtaagtgctgcatgtccggccatcaccaccggtgactctacctgcacaatcattcctgcaaacccctttacccggcctttgcagaacggggtcataaacgagatgaggacgacttgtccccagaatccgcctatgttcttcagtatccatcataaattcttgctcttcaacctccacaacccgacactcagctgcagtgctgccgttggaagccgccaaccattcgtcacagtctttgatcatcatcatcatcatcatcatgacgagcatgatgattgatagcgataagatggcagtggtgcttggtttgtctattgaacattttgggttttccggacctttgtgtcgacccgggtaatctcgc

SEQ ID NO: 12761 - DNA, 861 bp, Helianthus annuus
  misc_feature (746)..(746): n is a, c, g, or t
  misc_feature (748)..(748): n is a, c, g, or t
  misc_feature (805)..(805): n is a, c, g, or t
  Predicted polypeptide sequence is orthologous to G620, G1821
ggttctagagagagacaattccctcccttagagagagaaacatatggaacgtggaggaggtttccatggctaccacaggctccccatccaccctacatctgggatgcaacagccggatatgaagcagaagcaaccagacacaaccaacaccacatctacagaagacaatgagtgcattgttagagagcaagaccgctttatgccgatagcaaacgtgatcaggatcatgcgaaagatcttgccacctcacgcgaagatctctgacgacgcaaaagaaacgatccaagaatgtgtttccgagtacattagttttgtgacaggtgaagcgaatgaccgttgccaacgcgagcagagaaagactatcacagctgaagatgtgttgtgggctatgagcaaactcgggtttgatgactatatcgaaccgttgactgtgtatcttcatcgctacagggagtttgatgggggtgagcgtgggtcgataaggggtgagccgcttgtcaagagggctgcggctactgctgaccctggtccgtttggtatgggtccgtttgtgcctggttttcacatgggtcatcataatgggttctttggtcctgctagcattgctggtttctttaaggacccgtcgagtgcggctggccagtctgggcctgctggtttcgagccgtatgctcagtgtaaagactaactggtttcgattttcgagccgtgtgttggttgggttgtttttttttttctgtttggtngnttccttggccctgggagcaacaaaatatattgggccaaactttggccggggagtgcncaaaaaaaacaaaactaacatattttcctgccggcgggctttgcccggttggctct

SEQ ID NO: 12762 - DNA, 598 bp, Helianthus annuus
  misc_feature (553)..(553): n is a, c, g, or t
  Predicted polypeptide sequence is orthologous to G652, G1335
agtggtggtggtgataagactaggtggtggacggcgactagagtggtggtggtgaggagattcagatagtggccgacggctggagtggtggtggccggcggcagatgcggtggtggtgagggggagattaggttacggcggcggaggcggcggtggaggtggtgcgtgttttaagtgtggtgagactggtcatatggctagggagtgttctcagggcggtggaggcggtggtggttacggcggaggtggtggtggttacggaggtggtggtcgtggtggtagtcgtggcggcggcggcggttgctataactgtggtgaagaagggcatttctctcgtgaatgccctaatggcagcaaccgttgatctggaggagggtgaagggtaaatatgtctttcgacatttacttactatcctgtttttactttttttttgttgttctatgttgggtgatctgaatgcttgttatggttttgagattgttagttggtttgtgatggtttatgattgacatttgctagatctagggtttggatttggagtatatgttctanattgctatcagcaatggaaaaaagtttagtttttggattctgtgt

SEQ ID NO: 12763 - DNA, 366 bp, Helianthus annuus
  Predicted polypeptide sequence is orthologous to G652, G1335
aattcggccttatggcctctgtgcgggggtggtggtggtaggtacggcggcggcggcggcggccgtggaggtggttacggtgggagtcgtggtggcggcggcggcggttgctataactgtggtgaagaagggcatttctctagagagtgccctaacagtagcaaccgttagatctggtttaagttgatggtggatgattaagggtaaatgtgtcttttcacatttgcttttagctttttttattttggtttctttgttgatgaaagaagactatggttggttttattatgaggtttttgttgttgggtttttgatgctttagttatgaattatgaatgatatgatgttaatttacgttttatggag

SEQ ID NO: 12764 - DNA, 539 bp, Helianthus annuus
  Predicted polypeptide sequence is orthologous to G791
tggcctgtagccggggaagcaaactgccacatgggcacaccttggtaacccgtgaagggcatgaacttgttgccgccaacgggtggcgggggcccaggacacgggactggcattacaggagggtaaaaggcaggcggaggagggtggcaacaagccgctttcagttgttgttcaagtttctctttctctgacttcaacttctgcttctcgtctctcagctcgttcttctcaacctttaactcgttgattttcactagcaaatcttcggaagaatccttaagcttcgcagcttcgtttctcaactgagtgaccattcgaatagcgtccgccagtataacagtcttgtccgtcttggtggatcttccggggtccaatatttcattcaattcttgaaaccttttcaaacaatagtcaatatacgaaacgttacttcttcccatataagtcaagtacaaattcacatgcatgtcagtacggctgcaaacgaaccaaacgttcaacgaacagttcgtgaaccgttcagtgggaagttcgtttgt

SEQ ID NO: 12765 - DNA, 508 bp, Helianthus annuus
  Predicted polypeptide sequence is orthologous to G791
ttttttttttttaaccgaaaaacaacatatataagcattaaattttacttgctaaagatgccacaggtataacgacttaagagtgtatgatatatcatataaattacacactgatacctaacagggataaaacaatgacaagcaggccatgaacatttaaatgaaaacgaaagccaaattaggcgaccggaggggggagctcgtgatcttgcgaggtgtcaacagcagcaggcggcatgaacggccacatggccattccagggtaactcatgacaggaatcaacttatttcccattgcttgggattgtgcgagtgccatcgcggaaggataggcggcagggattccaggcgggggggccaagaaactaggttgggtgttcattgcgttagcttgttgttcaagtttctctttctctgtctttagcctctgcttttcatcccggagttcgtttttttaagacttgagctttttaattttttcctgcagatctgaattcgagtttttgag

SEQ ID NO: 12766 - DNA, 375 bp, Helianthus annuus
  misc_feature (347)..(348): n is a, c, g, or t
  Predicted polypeptide sequence is orthologous to G807
gggggaaatggagaagtatctgaccgcatacgacccgtcgtgggagcagtttcttgagcagagtccggaggctaacacaaacgatgaaatggactctgggccggtggatgatgacgtcataatgggaagtgaaatgaagtcgtcagaaaccgagtgttcgaggtctcaaatgcagcagctcactaaacaaatggggcttctttcttcagatactagaaacacttgatatacaattgttccatgcgtataagtaattttagacatgcatcttgtctttttgaagagaaataacatatgtgagttatgttgactttgaccctttgaatatgtcagctgtttgatgctcnnaaaaaaaaaaaaaaaaaaaaaaaaaaa

SEQ ID NO: 12767 - DNA, 1776 bp, Helianthus annuus
  Predicted polypeptide sequence is orthologous to G839, G1196
atggcgaattcatccgaaccgtcatcatccataagcttcacctcatcttcacacatatctaacggcgcaactagctacaacatacccccaccatcaatccccgagccacggtcgaatattgaaatcattggcttaaatagactcagcacaaacctagagaagctcgtattcgattcaggttctgaatctgattgcaattacagcgatgctgaagttgttgttgagggtatttctgtaggcattcatcggtgtattttagccactagaagtacgttttttagcgatttgtttaagaagaacaaaggttgtgtagagaaggacagtaagccgaaatataacatgagtgatttgttgccgtatgggagcgttgggtatgatgcgtttctcgtgtttttaagctatgtttatactgggaaactgaaagcgtctcctccggaggtttcaacctgcgttgatgatgggtgtcttcatgatgcttgttggcctgctattaactttgctgttgagttgacttatgcgtcttcggtttttcaagttccggaattagtttcgctttttcagcgtcgtcttctcaactttgtggacaaggctcttgttgaagacgtgatcccgatccttgttgtggcctttcactgtcagttgcaaaacgtcttatctcgttgcattgaccgagtagttaggtcaaagctcgatactatttccattgaaaaagagcttccatttgaagtcacccaaatgatcaaatccattgataacatcatccaagaagatgacgaacatacagtcgaatcagaagtcgtgttacgtgaaaagagaattaaaagcatacacaaagcattagactgtgacgatgttgagcttgtgaaaatgattttagacgaatccaaaatcacgttagatgaagcctgcgctcttcattatgcggtcatgtattgtaatcaagaagttgctaaggagattcttaacttaaaccgtgcggatgttaatcttagaaactcacgagattacaccgtgcttcatgttgctgccatgcgtaaagaaccatcacttattgtttcgattctaagcaaaggcgcgtgtgcatcggatactacttttgatggacaaagtgcggttagtatttgcaggagacgaacaaggcccaaggattattatgtgaaaaccgaacacgggcaagaaacaaataaagatcgtatatgcatcgatgttttggagcgggaaataaagaggaatccgatgataggcgatgtttccgtgtgttcttcagcagtggctgatgatttgcatatgaatttactctacttagaaaaccgagtggcatttgctcgactgttatttccgtcagaagcgaaactagcaatggaaattgcgcatgcccaaacgactgcacagtatccgggtctattggcatcgaaagggtcaaatggtaacttaagggagatggatttgaacgagacaccgttggtgcagaacaaaagattgctttcaagaatggaagccctttcccggacagtggaaatgggtaggcgatatttccctcattgttcagaggttctggataagttcatggaggacgatctacaggatctttttatcctcgagaagggtaccgaagaagaacaagaaatcaaaaggacgcgatttatggagcttaaagaagatgtccaaagagcctttaccaaggacaaggccgagcttcatcgcggtttgtcctcatcaatgtacacccccacagtgagaaacgggtcaaagagtaaagcccgcaaatactcatga

SEQ ID NO: 12768 - DNA, 509 bp, Helianthus annuus
  Predicted polypeptide sequence is orthologous to G987
agcttgtttcgcaagtgaaaagtaaggtgaaggctgggtatcacaaagattacgtgtttgatgaagatgggaaatggatgctacagggatggaaaggcaggattctgtatgccattacttgttgggtacccgtgtaggacccctcgtactttcttgttaatatccatagccagggctctcgtacggtgcttttggcatggatggatgtccttacaatttgatctaagataatggttttatgaagatggagaaggtttggtttgcaagcaggtggaagactggaagcaatgttgacatgttttagaagagagtgtgtaaccattaattaattttattaaaagtagatggatggatgcatcacagtagtagtttggtaaatttgttgggcttacttgttgctgcattatggttacttagttgcttgtcaaatcttcccttgatattggttttataaaaattatcttgaaaatgatctaggacataatgatgcctttctttttaactttgat

SEQ ID NO: 12769 - DNA, 668 bp, Helianthus annuus
  misc_feature (649)..(649): n is a, c, g, or t
  Predicted polypeptide sequence is orthologous to G1033
acataaaagtaaagacactatgtaaacctaagctaccgcacgatgaactgaatgaggaaatgcaaagcatcaagcataacaaagtataaactatgaacatcaagttcaagtctctcgcaaacatttggcgtagatctcaatcatcatcctcgtcatcatcatcctcatcgtcttcttcatcatcgcccccttcctggccgctttcctcatctacctcagacttggatttttcagattcttcatcctcgtcagcagcgctctcctgttccttgttgtaagcagtcattaatttctcataatcggtcttcctttttgcagctttcgcttcatatggtgctttctcagctgcactcaaagatttccacttctctccaccagctttcccaacagcggaaacagctttcacatttggattctctttcttgaatgtcttcctaaactcctcaaggaagacgaagaaagcacttggaggtctctttggcttgttaggatcttttgctgctttacccgccttagccttgcttttgccgacggccttagcaggtgcctttctcttccctacctttttgtcatcaacaggcttcaagctgtccttctttgcagctcctttacccttggcacccttcatatctgaaactagaggattggnaggaagtgtgatccggtga

SEQ ID NO: 12770 - DNA, 1062 bp, Helianthus annuus
  Predicted polypeptide sequence is orthologous to G1145
atttggatgagcttttgaagagtgtttatagtgctgagactaatcaaggaacgagtagtaacgcggttaattatacggagctcaattcgggtgtgacgaagaagacggttgatgaagtgtggcaggatatacaacaaggtcagaggaagaaaaagaacgatagcgatgacgatgggagtaatgtaagtaagggcggtagttttaagagcggggacgggaagcgacagcgtactctcggtgagatgacacttgaggatttcttggtcaaagcgggggtcgtggccgaatcttctcccgggaaggtgaacgaagaagggaatcttgaaccgcaagaaacgcagtggataggctatcaaagtcatgcagttcagcagcagaatatgattatggcgggtcattatcaagttcaaccatcggttacggttcctggtaactctttgatggatgtgggttatatgtccccaacctctttaatgggtagtttatcggacagacatatgtctggaaggaaaaggtttgcttctggagatgtgatggagaagacggttgaaagaaggcaaaagcgaatgataaagaatagggagtctgctgcgcgctcacgagcaagaaaacaggcatatacccatgagctggagaacaaagtttcacgtttggaagaggagaatgaaagactcaggagggagaaggaggtggagaaggtaataccgtgggtcccaccacccaagccaaagtatcagctccgaagaacttcctctgctcctttctgacggctagctaatctggtcagcggtcctgaatttgtgatcttggtcatgggctctgagtcatgaaaaatgttctgcagcaatgaaagtgaaaggcttgtagaccttcctttttatagcagggaagctttggtgtaccttggtcaactctttttcatttccatctaaatctttatcagatgcattatggatgatgtacgccttgtgttttttgctacttttcggttttagtttgttttatacctagtttcacgcagtttcttgtttaatgtattgtccaagggtgatcttattatgt

SEQ ID NO: 12771 - DNA, 913 bp, Helianthus annuus
  Predicted polypeptide sequence is orthologous to G1145
caacatgttcccggtccctctttggctcgccagtcgagcatcaatcttgctcaagatctgcgcaaaaagacggtggatgaggtgtggcaaggtatccaacaaggtaaaaacaaaggtagtaataatagtagtggtagtggtaataatgatggtgataaaaggggtaatcgagagcgacaaccgacgctaggtgagatgactttggaggatttcttgctcaaagccggggttgttaccggatccggaaagaaaaatgtggatgtgaatcaagagaacgcgaatcatcaacaagcgcagtggatgcagtatcaggttgcaccgataccgcagcaacatgtatatatgtcagggcatcatccggttcaacagtctttgtcgattggggcgaacccgatgatggatatggtttatccggagacccaaatggcaatgtctccgtcgcatttgatgcataatttatctgatacgcagacgcctgggaggaaacgcgttgcgtctggtgacgtgatagagaagactgtcgaaaggaggcaaaagagaatgataaagaatagagaatcggctgcgcgttcgcgtgcaagaaaacaggcttacacacatgaactggagaacaaaatctcacgtttggaagaggaaaacgaactacttaagagacagaaggaggtagggatggtattgccgagcgcaccaccacccaaacccaagtaccagctcagaagaacaagctcggcttctttctaacagtttgttttcatcttaataagaatattagtatgttatgtagagccaattttttcccttttctcagtttttgttaggagacatggtttttatgcattaagtttgctgattttcttaggtttctacaaacagtgtatcgggtcaatattatggtcgacgaatgtgctgtccc

SEQ ID NO: 12772 - DNA, 294 bp, Helianthus annuus
  Predicted polypeptide sequence is orthologous to G1150
gttgaaggggtcgtggatgatggaggtggtagaggcaggagccaaggagtaggaggttatcctggtggcaacagaggtggaggccgtggtggtcgtggatgatgtgacgggtgcaaaggacgtctctcgttttcatatccctattttttttttttttcagtagggtttgtattcaatgactggtttggttatggggattaaaaatgttgttcctgaaagtgttgtggaggatgaagtccttggtatattgtaaaattcaagttcaactgtttaagagattaaaatttaagcgtg

SEQ ID NO: 12773 - DNA, 585 bp, Helianthus annuus
  misc_feature (68)..(68): n is a, c, g, or t
  Predicted polypeptide sequence is orthologous to G1247
ttttttttttttactttttcaccttcccttaaacgaatatttaaagttcgttttttatttttaaaggnttcacttttcacaatgaccgtagttttttcgcgatttaccaatatgtcgtcatcacgtaaatattcaacaccacaccgcatcaatgcatggtagctcccgctagttttaatcaatcaacccgtgaagacatgataaaagaaaaaagaaacccaatgtactttctgagttctcacatattaacccctgaacttttttacataggtaaatccttaaattttgttgagagttaccaaaaatatgtgtatttgttaaaatttttggtaagtgggcaaatcaaagaaaacctaaccaactttcctatttttaacaggtaaaaaccttaatgccttttaacttgattaactcccttaacttgttgaaaacatacatataaccattttaccactattaaaagttgaacattgacctggataccatgtatttgttattttatgacatgatatatgggtaaatttggtattttaaagtttaattccattcttttccttatggggaaaaactcaaaaaataaaaaaa

SEQ ID NO: 12774 - DNA, 372 bp, Helianthus annuus
  Predicted polypeptide sequence is orthologous to G1340
taataagagacactagatctagaccgccacttatttatattattctagatatggccgatgcatcggaacaacattaaactaaagaagggcaggtgaagatgtaggaggtgtggtttttgaaggcgatcggaatatcaatgtttgtggcggaggaatcatgtttgttaggataagggtttgtggtttttgaaggcgatcggaatatcaatgtttgtggcggaggaatcatgtttgttgggataagggtttgatgtgaaggaactcgatcttatccggaaaagtcggcaatcagttacgtcaccagcaccgcttttgttttttcttttcttaaattttgatttaagttttacttttttcctaaactactgctag

SEQ ID NO: 12775 - DNA, 758 bp, Helianthus annuus
  Predicted polypeptide sequence is orthologous to G1380
tgttggtcccgggattcggactgatggcctcgcgacggggggttcgaaagagaccatggggccggttcgcggcagagatccgtgacccgtggaagaaagcgcgggtctggttaggtacgtttgactccgcggaggacgcggcgcgtgcgtacgacgccgccgcacgcgctctccgtggatccaaagcgaaaacaaattttccgattttaccctcggaaaaagttgaaaactttgatgacgtcatgaaaccacggcctacggtgagtagtttgagtagtacggtggagtctaaaagtggaaaccggtcgaacttgattaacccggttcagagattgaacacatgaacccggatcggactgatgttatgaatgatgatgatgattgtcatagcgggtgtgactcatctgcatctgttgtggatgattattattgtgatgtggatctgacgtcatcgagatttggttatgaaaccgatgccgattgatctgaatttgcctcctcctcctccagcgacggatgagtttgggttttgttctaacgataacggcaacgacaatgatgagttatatgtaacgggcctttgcttgcaagctggtatgatggttgatgatgatgatgatgcgagatctacggccgagatgtggtctgaaatggttcaagatgagaggtttgtggagaagttgttgcgatttatgaatcttgatttgtcttagaatgctattgttggctatgatgatgatgatgacatgatgatgata

SEQ ID NO: 12776 - DNA, 462 bp, Helianthus annuus
  Predicted polypeptide sequence is orthologous to G1380
gctttaaaatttcaagaccatcatataaaaaccacaaattacactaatctacaaattcatcaccacaatcaactcaaaacaaaacataacaaattaatattatctttgaataaaaattcaccagaaactcataagcaaagtgtggtcaacggatcatcatcaaattcaaattcatcaataaccggaggaagattaagatcaaacgacatcgttttattctccgccgacttaacttcaccggacacgtcatcaacaaccgtcgacgacgaatcacaattactccggcaatcaccgtcatcgtaaccaaccaccaccgccgccggagttgaccgtcgtgaccagctcgccgtctccaccgtgctgctcaggctactggtcgtcgcaacctgctgagtcgcacgatcggtaatttcgtgttccggcaggggccaaagtggaaaattggttcttgctttaacacca

SEQ ID NO: 12777 - DNA, 121 bp, Helianthus annuus
  Predicted polypeptide sequence is orthologous to G1399
aaggtggctgctgaggatgagaagacatggacaccgccatttcatgtttagaggatgaattgaatttgttttctatgttattctgaactttgatttgatttattttttaaaaaaaaaaaca

SEQ ID NO: 12778 - DNA, 498 bp, Helianthus annuus
  Predicted polypeptide sequence is orthologous to G1446
aaatggcgtacaatggaactcgacgagtcaatcccacggatagatggtacggggaaaatgttttagccctggtgaggtcaataattgtgacattgcagtaatgagtctacctaataacatgggagataaatgtgttctaggtaatgcatatataaatgtttgtggcttttacatgacaataattgtaagtggatgagagtaatttagttgtgtttttaccttccatgaagaaagcttgtgtttgattttcaaaaaaaaaaaaaaaaagccaaaaaaaaaaaaactttaaaaaaaatagaaaaaaacaaaatgaaaaaaaaaaacccccagaaaaaaataaaaaataaaaaaaaaaaaacctttgggcccccttggcccagtgcatttttaattcgaacaacttttatgctggggcccaatttcccacccaattggcgggcccgctttttaaaaggtttaacccccccttaattttaggggcccccgcttccaattttg

SEQ ID NO: 12779 - DNA, 611 bp, Helianthus annuus
  Predicted polypeptide sequence is orthologous to G1451
ttgcggttgacccgcttctcctgagtggttcgtcacaatctcttcttcaccaagtcgaacaactgggccctacgccgcacacaaacctttctcagaacactaatctttcacaaaacacggtttcgttaccacctttcccaggaccgaacaatgatcctcaaagtaatcttttatttggagttaacatagataactcgaatctttttatgcaaggtggtgacggtggttcattgactatgccgatgacttcttccacttataacggtaatacaggaaacgggttctcagtcaatccgacaattacatcttcaagttgtcttactgagtcaggtttcctgcagtctcctgaaagtgcaggtcaaacaaacccaccgacccgcgcgcttgttaaggtttataagtcaggatgttctgggttgtcactcgatataggtaaactcagtagctatcatgagctgagaagtgaagttggtcaaatgtttggtcttgaaggccaactggaggacccgttgagatcaggctggcagcttatatatgtagaccgggagaacgttcttcgtctccttggtgacgacccttggccggagtttgtaagcaggatatggtgcatt
